United States Patent 7,319,142 (NUCLEOTIDE AND AMINO ACID SEQUENCES FROM XENORHABDUS AND USES THEREOF) - sequence listing, part 4

SEQ ID NO: 16035 - DNA, 31 bp, Xenorhabdus bovienii
  Terminator location: Contig name=SeqID_16897; Position on contig =228726..228756bp; Strand=-; Gene name=ArsR
cgcctccaatcaggaggcgttatcagattcg

SEQ ID NO: 16036 - DNA, 43 bp, Xenorhabdus bovienii
  Terminator location: Contig name=SeqID_16897; Position on contig =235173..235215bp; Strand=+; Gene name=TdcF
cagctctgatagtttcagtatcagagctgtgatttcttcgatc

SEQ ID NO: 16037 - DNA, 38 bp, Xenorhabdus bovienii
  Terminator location: Contig name=SeqID_16897; Position on contig =235744..235781bp; Strand=-
cgtggctggctgaatatccagttgtgttctgatatgaa

SEQ ID NO: 16038 - DNA, 33 bp, Xenorhabdus bovienii
  Terminator location: Contig name=SeqID_16897; Position on contig =236582..236614bp; Strand=-
ggttggagagtgaccagcctctctttttgcttt

SEQ ID NO: 16039 - DNA, 42 bp, Xenorhabdus bovienii
  Terminator location: Contig name=SeqID_16897; Position on contig =239691..239732bp; Strand=-
tttcgtatcaggaattttttctaatgaaatttataaaataaa

SEQ ID NO: 16040 - DNA, 52 bp, Xenorhabdus bovienii
  Terminator location: Contig name=SeqID_16897; Position on contig =242073..242124bp; Strand=-; Gene name=LysR
gaacaagtcgggatgattatcagtttaccggcttgttcagttatttatccca

SEQ ID NO: 16041 - DNA, 42 bp, Xenorhabdus bovienii
  Terminator location: Contig name=SeqID_16897; Position on contig =248133..248174bp; Strand=-; Gene name=WecB
gaccggaagatcaccatgatctgtccggttttgtagctattt

SEQ ID NO: 16042 - DNA, 32 bp, Xenorhabdus bovienii
  Terminator location: Contig name=SeqID_16897; Position on contig =248944..248975bp; Strand=-; Gene name=XerC
cattctgcttgagcagaatgtattaaattaaa

SEQ ID NO: 16043 - DNA, 38 bp, Xenorhabdus bovienii
  Terminator location: Contig name=SeqID_16897; Position on contig =255654..255691bp; Strand=+; Gene name=LytT
gccccttctctattaggaaaaggggctttatcttcaag

SEQ ID NO: 16044 - DNA, 40 bp, Xenorhabdus bovienii
  Terminator location: Contig name=SeqID_16897; Position on contig =255640..255679bp; Strand=-; Gene name=LytT
gccccttttcctaatagagaaggggctttttaatattgaa

SEQ ID NO: 16045 - DNA, 42 bp, Xenorhabdus bovienii
  Terminator location: Contig name=SeqID_16897; Position on contig =257813..257854bp; Strand=-; Gene name=SrmB
taagtccacatcttgataggtgggggcttgtttgttcgttta

SEQ ID NO: 16046 - DNA, 58 bp, Xenorhabdus bovienii
  Terminator location: Contig name=SeqID_16897; Position on contig =258836..258893bp; Strand=-; Gene name=NrfG
ttgacgtaaagaacggcgtcctgtaaaaagggcgccgtttagtcaattttgggcagga

SEQ ID NO: 16047 - DNA, 31 bp, Xenorhabdus bovienii
  Terminator location: Contig name=SeqID_16897; Position on contig =261252..261282bp; Strand=+
ggggccctattaggccccttttcactgaaac

SEQ ID NO: 16048 - DNA, 32 bp, Xenorhabdus bovienii
  Terminator location: Contig name=SeqID_16897; Position on contig =261238..261269bp; Strand=-
ggggcctaatagggccccttttcttctaggaa

SEQ ID NO: 16049 - DNA, 58 bp, Xenorhabdus bovienii
  Terminator location: Contig name=SeqID_16897; Position on contig =261613..261670bp; Strand=-; Gene name=RpsO
tgggctgtcttgcgcttcacctatttgcagcgtagaatagcgcgtctatatatgagtt

SEQ ID NO: 16050 - DNA, 29 bp, Xenorhabdus bovienii
  Terminator location: Contig name=SeqID_16897; Position on contig =268531..268559bp; Strand=+
tactggcgatgctggtacttctgcttgtt

SEQ ID NO: 16051 - DNA, 47 bp, Xenorhabdus bovienii
  Terminator location: Contig name=SeqID_16897; Position on contig =271290..271336bp; Strand=-; Gene name=FolP
tacaggctgttgcccttggatttgacagactgtacttattaaacccc

SEQ ID NO: 16052 - DNA, 40 bp, Xenorhabdus bovienii
  Terminator location: Contig name=SeqID_16897; Position on contig =274433..274472bp; Strand=+
taaaaaaggccatctcaggccttttttatttccatatcag

SEQ ID NO: 16053 - DNA, 45 bp, Xenorhabdus bovienii
  Terminator location: Contig name=SeqID_16897; Position on contig =276750..276794bp; Strand=+; Gene name=DacB
gaaaaagggcgcttaaaaagcgcccttttgtcattctagtacatc

SEQ ID NO: 16054 - DNA, 52 bp, Xenorhabdus bovienii
  Terminator location: Contig name=SeqID_16897; Position on contig =276731..276782bp; Strand=-; Gene name=DacB
tgacaaaagggcgctttttaagcgccctttttcgatcaatgattttggtata

SEQ ID NO: 16055 - DNA, 45 bp, Xenorhabdus bovienii
  Terminator location: Contig name=SeqID_16897; Position on contig =279937..279981bp; Strand=+; Gene name=IspA
cagtatcccagattgctcaatctgggatactgtctttattttcaa

SEQ ID NO: 16056 - DNA, 33 bp, Xenorhabdus bovienii
  Terminator location: Contig name=SeqID_16897; Position on contig =280361..280393bp; Strand=-
gccaaatgttcaaaatttggcttcctcttcact

SEQ ID NO: 16057 - DNA, 37 bp, Xenorhabdus bovienii
  Terminator location: Contig name=SeqID_16897; Position on contig =281238..281274bp; Strand=+; Gene name=Nlp
ccgctagttatttctgagctagcggtttcagttatct

SEQ ID NO: 16058 - DNA, 45 bp, Xenorhabdus bovienii
  Terminator location: Contig name=SeqID_16897; Position on contig =281222..281266bp; Strand=-; Gene name=Nlp
gaaaccgctagctcagaaataactagcggtttttctttcaataat

SEQ ID NO: 16059 - DNA, 53 bp, Xenorhabdus bovienii
  Terminator location: Contig name=SeqID_16897; Position on contig =283346..283398bp; Strand=+; Gene name=ArgR
taaagaggatcgcacgactcatgcgatcctctcactctgatgattttgacaat

SEQ ID NO: 16060 - DNA, 53 bp, Xenorhabdus bovienii
  Terminator location: Contig name=SeqID_16897; Position on contig =283330..283382bp; Strand=-; Gene name=ArgR
gagtgagaggatcgcatgagtcgtgcgatcctctttatctctattctcagggt

SEQ ID NO: 16061 - DNA, 30 bp, Xenorhabdus bovienii
  Terminator location: Contig name=SeqID_16897; Position on contig =285979..286008bp; Strand=+; Gene name=Fbp
ggggcgaagtgtcgcctctttaataaacga

SEQ ID NO: 16062 - DNA, 53 bp, Xenorhabdus bovienii
  Terminator location: Contig name=SeqID_16897; Position on contig =286921..286973bp; Strand=+; Gene name=Ppa
taaaaaacctctgccaccacatagaggcagaggtttttatttattcttcttcg

SEQ ID NO: 16063 - DNA, 40 bp, Xenorhabdus bovienii
  Terminator location: Contig name=SeqID_16897; Position on contig =286914..286953bp; Strand=-; Gene name=Ppa
cctctgcctctatgtggtggcagaggttttttatgatcaa

SEQ ID NO: 16064 - DNA, 43 bp, Xenorhabdus bovienii
  Terminator location: Contig name=SeqID_16897; Position on contig =293623..293665bp; Strand=+; Gene name=MsrA
ttagctcagtgttataatcattgggctaaatttatatatctta

SEQ ID NO: 16065 - DNA, 26 bp, Xenorhabdus bovienii
  Terminator location: Contig name=SeqID_16897; Position on contig =295117..295142bp; Strand=+
cggccgcgaggccgttaattatactc

SEQ ID NO: 16066 - DNA, 28 bp, Xenorhabdus bovienii
  Terminator location: Contig name=SeqID_16897; Position on contig =295103..295130bp; Strand=-
cggcctcgcggccgtttttgatcggatt

SEQ ID NO: 16067 - DNA, 47 bp, Xenorhabdus bovienii
  Terminator location: Contig name=SeqID_16897; Position on contig =296335..296381bp; Strand=+
gtcataatggttccaaaacaggaaccattatcaccttaataattaag

SEQ ID NO: 16068 - DNA, 32 bp, Xenorhabdus bovienii
  Terminator location: Contig name=SeqID_16897; Position on contig =296330..296361bp; Strand=-
tggttcctgttttggaaccattatgactaact

SEQ ID NO: 16069 - DNA, 38 bp, Xenorhabdus bovienii
  Terminator location: Contig name=SeqID_16898; Position on contig =9546..9583bp; Strand=+; Gene name=CspC
gaagcctcgcagaaatgcgaggctttttcgtatctatc

SEQ ID NO: 16070 - DNA, 33 bp, Xenorhabdus bovienii
  Terminator location: Contig name=SeqID_16898; Position on contig =12327..12359bp; Strand=+
tattcccatttagtgggaatgttactcactagg

SEQ ID NO: 16071 - DNA, 55 bp, Xenorhabdus bovienii
  Terminator location: Contig name=SeqID_16898; Position on contig =14236..14290bp; Strand=+
tatctttttgcccacacgctcagcgtgtgggctactgggtatttttacggtgtgg

SEQ ID NO: 16072 - DNA, 43 bp, Xenorhabdus bovienii
  Terminator location: Contig name=SeqID_16898; Position on contig =15287..15329bp; Strand=+; Gene name=LysR
tctctgctgataactaatattcagcagagattatgtcattttt

SEQ ID NO: 16073 - DNA, 47 bp, Xenorhabdus bovienii
  Terminator location: Contig name=SeqID_16898; Position on contig =20447..20493bp; Strand=+
ctaaagccatctcagcataatggagatggcttgggtatatctatttc

SEQ ID NO: 16074 - DNA, 37 bp, Xenorhabdus bovienii
  Terminator location: Contig name=SeqID_16898; Position on contig =20440..20476bp; Strand=-
gccatctccattatgctgagatggctttagtttttat

SEQ ID NO: 16075 - DNA, 40 bp, Xenorhabdus bovienii
  Terminator location: Contig name=SeqID_16898; Position on contig =22789..22828bp; Strand=-; Gene name=PTR2
ggctgccatttcatcgaatggcagccatgatttttctctc

SEQ ID NO: 16076 - DNA, 50 bp, Xenorhabdus bovienii
  Terminator location: Contig name=SeqID_16898; Position on contig =25277..25326bp; Strand=+
tgttggcgtaaatagcatctcattatttacgccaacattgttactttaga

SEQ ID NO: 16077 - DNA, 49 bp, Xenorhabdus bovienii
  Terminator location: Contig name=SeqID_16898; Position on contig =25265..25313bp; Strand=-
tgttggcgtaaataatgagatgctatttacgccaacattctgattgccg

SEQ ID NO: 16078 - DNA, 41 bp, Xenorhabdus bovienii
  Terminator location: Contig name=SeqID_16898; Position on contig =26574..26614bp; Strand=-
cgtgcggaaagtgttcttattttcgcacgtttacacttacc

SEQ ID NO: 16079 - DNA, 55 bp, Xenorhabdus bovienii
  Terminator location: Contig name=SeqID_16900; Position on contig =347..401bp; Strand=+; Gene name=MscS
tagcttggtgtgagtagtgaaaattctcacaccaagcttaagcagttttacctgc

SEQ ID NO: 16080 - DNA, 44 bp, Xenorhabdus bovienii
  Terminator location: Contig name=SeqID_16900; Position on contig =1181..1224bp; Strand=+
gttacatactactttatagatagtgtgctaatgtttctggaaag

SEQ ID NO: 16081 - DNA, 43 bp, Xenorhabdus bovienii
  Terminator location: Contig name=SeqID_16900; Position on contig =2052..2094bp; Strand=+
ctggcgccctagtttcagtagggtgtcagtgacttttctcatc

SEQ ID NO: 16082 - DNA, 42 bp, Xenorhabdus bovienii
  Terminator location: Contig name=SeqID_16900; Position on contig =3755..3796bp; Strand=+; Gene name=RpiA
tttattggggcagaataatctgcccttaaaatatttccatgt

SEQ ID NO: 16083 - DNA, 38 bp, Xenorhabdus bovienii
  Terminator location: Contig name=SeqID_16900; Position on contig =5283..5320bp; Strand=-; Gene name=SerA
ggggctactgtttctacgatagccccatttttcatagt

SEQ ID NO: 16084 - DNA, 53 bp, Xenorhabdus bovienii
  Terminator location: Contig name=SeqID_16900; Position on contig =11319..11371bp; Strand=+; Gene name=UbiH
gactaaagtgtgtccagttgatttacttcacactttagtctttttctaataaa

SEQ ID NO: 16085 - DNA, 41 bp, Xenorhabdus bovienii
  Terminator location: Contig name=SeqID_16900; Position on contig =16180..16220bp; Strand=+; Gene name=GcvP
gcagtgttgaggaggattcctcacactgctttttcagaaaa

SEQ ID NO: 16086 - DNA, 52 bp, Xenorhabdus bovienii
  Terminator location: Contig name=SeqID_16900; Position on contig =23051..23102bp; Strand=-; Gene name=DsbG
gcgctttattaggtgtcgcactgcaccagatggattgcatatctttggctga

SEQ ID NO: 16087 - DNA, 55 bp, Xenorhabdus bovienii
  Terminator location: Contig name=SeqID_16900; Position on contig =25250..25304bp; Strand=+; Gene name=RecJ
ccacattcaggacttgtctgagcggacagaagttctgagggggtatctttgacta

SEQ ID NO: 16088 - DNA, 38 bp, Xenorhabdus bovienii
  Terminator location: Contig name=SeqID_16900; Position on contig =27872..27909bp; Strand=+; Gene name=LysU
gccctgtaaggttagccggacagggcgtttttttatac

SEQ ID NO: 16089 - DNA, 40 bp, Xenorhabdus bovienii
  Terminator location: Contig name=SeqID_16900; Position on contig =27858..27897bp; Strand=-; Gene name=LysU
gccctgtccggctaaccttacagggcatttgtcgatttta

SEQ ID NO: 16090 - DNA, 43 bp, Xenorhabdus bovienii
  Terminator location: Contig name=SeqID_16900; Position on contig =29241..29283bp; Strand=-
cataaacatagggcatgagtcgatgtttgtgatttataattcg

SEQ ID NO: 16091 - DNA, 49 bp, Xenorhabdus bovienii
  Terminator location: Contig name=SeqID_16900; Position on contig =29562..29610bp; Strand=+
gtgtcgtttaataaaataatggttttgttagatatatttttatcctatt

SEQ ID NO: 16092 - DNA, 60 bp, Xenorhabdus bovienii
  Terminator location: Contig name=SeqID_16900; Position on contig =29965..30024bp; Strand=+
tattcatatatgttattccttagaatgatattaacatacctatggatagtttattttttt

SEQ ID NO: 16093 - DNA, 43 bp, Xenorhabdus bovienii
  Terminator location: Contig name=SeqID_16900; Position on contig =30970..31012bp; Strand=+; Gene name=InsB
gtcaaggttgaaataaatttttaatcttgactgttaatgcaat

SEQ ID NO: 16094 - DNA, 46 bp, Xenorhabdus bovienii
  Terminator location: Contig name=SeqID_16900; Position on contig =37437..37482bp; Strand=+; Gene name=FhaB
gtacagtgacacaataaatttgtgccactgtacttatttaatcgta

SEQ ID NO: 16095 - DNA, 34 bp, Xenorhabdus bovienii
  Terminator location: Contig name=SeqID_16900; Position on contig =40566..40599bp; Strand=+
ttgggttgttcgcgtaatccaatttctgccatag

SEQ ID NO: 16096 - DNA, 61 bp, Xenorhabdus bovienii
  Terminator location: Contig name=SeqID_16900; Position on contig =123608..123668bp; Strand=-
tcatttaataagtcgattattaaaataatcgacttattaacctggtggtgatttagatcgg

SEQ ID NO: 16097 - DNA, 40 bp, Xenorhabdus bovienii
  Terminator location: Contig name=SeqID_16900; Position on contig =126111..126150bp; Strand=+
cattttttattaattagtaagggattgatttacggttaat

SEQ ID NO: 16098 - DNA, 33 bp, Xenorhabdus bovienii
  Terminator location: Contig name=SeqID_16900; Position on contig =135033..135065bp; Strand=+; Gene name=HsdR
gctgggtaatatgaacccagctatgtctctgaa

SEQ ID NO: 16099 - DNA, 29 bp, Xenorhabdus bovienii
  Terminator location: Contig name=SeqID_16900; Position on contig =142681..142709bp; Strand=+
cagggtgcagccctgacgttattttcaca

SEQ ID NO: 16100 - DNA, 32 bp, Xenorhabdus bovienii
  Terminator location: Contig name=SeqID_16900; Position on contig =144296..144327bp; Strand=+
cgatcccgaaaagggatcgttttttccttttt

SEQ ID NO: 16101 - DNA, 36 bp, Xenorhabdus bovienii
  Terminator location: Contig name=SeqID_16900; Position on contig =144130..144165bp; Strand=-
tgcctgcctcaaacaaggcagcacaatttttagtcg

SEQ ID NO: 16102 - DNA, 39 bp, Xenorhabdus bovienii
  Terminator location: Contig name=SeqID_16900; Position on contig =147895..147933bp; Strand=+
gacctgccctgagctttcagggcagtccctttattatca

SEQ ID NO: 16103 - DNA, 30 bp, Xenorhabdus bovienii
  Terminator location: Contig name=SeqID_16900; Position on contig =148715..148744bp; Strand=+; Gene name=Ssb
gccctgtctcaacagggcttatttgtatat

SEQ ID NO: 16104 - DNA, 37 bp, Xenorhabdus bovienii
  Terminator location: Contig name=SeqID_16900; Position on contig =156148..156184bp; Strand=+
gcgtcagtctttcaggctaatgctggtattttgacgg

SEQ ID NO: 16105 - DNA, 26 bp, Xenorhabdus bovienii
  Terminator location: Contig name=SeqID_16900; Position on contig =156122..156147bp; Strand=-
gccgcggggcggcttgtctgctgacg

SEQ ID NO: 16106 - DNA, 48 bp, Xenorhabdus bovienii
  Terminator location: Contig name=SeqID_16900; Position on contig =157792..157839bp; Strand=+
tgtgattggcgggctgatcctttcggcagtcgcgttctttaaggtcgc

SEQ ID NO: 16107 - DNA, 53 bp, Xenorhabdus bovienii
  Terminator location: Contig name=SeqID_16900; Position on contig =164810..164862bp; Strand=+
tgatgcgctatcccagcacgatggccgggatagcgttcaggttagtcttcgta

SEQ ID NO: 16108 - DNA, 38 bp, Xenorhabdus bovienii
  Terminator location: Contig name=SeqID_16900; Position on contig =169176..169213bp; Strand=+
tattaaatagttagttgttatgataatcttccggtatt

SEQ ID NO: 16109 - DNA, 33 bp, Xenorhabdus bovienii
  Terminator location: Contig name=SeqID_16900; Position on contig =170091..170123bp; Strand=+
gtggctttttatacagccaccttagtcaataga

SEQ ID NO: 16110 - DNA, 32 bp, Xenorhabdus bovienii
  Terminator location: Contig name=SeqID_16900; Position on contig =170079..170110bp; Strand=-
gtggctgtataaaaagccacttattttcttat

SEQ ID NO: 16111 - DNA, 62 bp, Xenorhabdus bovienii
  Terminator location: Contig name=SeqID_16900; Position on contig =183188..183249bp; Strand=+
ttaagcagagtgtgaatggtgtgtgagttttattttttcgcctgtttaacctgtttatcatt

SEQ ID NO: 16112 - DNA, 38 bp, Xenorhabdus bovienii
  Terminator location: Contig name=SeqID_16900; Position on contig =184133..184170bp; Strand=-
cctcttttccctcagtgagaaagaggtttctgcgcctc

SEQ ID NO: 16113 - DNA, 46 bp, Xenorhabdus bovienii
  Terminator location: Contig name=SeqID_16900; Position on contig =186185..186230bp; Strand=+
taaaacccgaataaatccaattattcgggttctagtcttaatgaat

SEQ ID NO: 16114 - DNA, 62 bp, Xenorhabdus bovienii
  Terminator location: Contig name=SeqID_16900; Position on contig =186164..186225bp; Strand=-
ttaagactagaacccgaataattggatttattcgggttttactctaaatgatttatgtccag

SEQ ID NO: 16115 - DNA, 41 bp, Xenorhabdus bovienii
  Terminator location: Contig name=SeqID_16900; Position on contig =189480..189520bp; Strand=-; Gene name=HsdR
gttgggttggggcgcactctgatgtcaattttttgtgttac

SEQ ID NO: 16116 - DNA, 56 bp, Xenorhabdus bovienii
  Terminator location: Contig name=SeqID_16900; Position on contig =197539..197594bp; Strand=+
cttaattttttcttggtagtttaagattaagaataggataaggctttacatatcca

SEQ ID NO: 16117 - DNA, 36 bp, Xenorhabdus bovienii
  Terminator location: Contig name=SeqID_16900; Position on contig =199937..199972bp; Strand=-; Gene name=XerC
tgctatcacgtccttggtagcattttttcaaccatt

SEQ ID NO: 16118 - DNA, 59 bp, Xenorhabdus bovienii
  Terminator location: Contig name=SeqID_16900; Position on contig =203247..203305bp; Strand=-
tatttcaagtgttttagattacatctagtaatctaaatctaaataagttttcataatag

SEQ ID NO: 16119 - DNA, 39 bp, Xenorhabdus bovienii; identical to SEQ ID NO: 15526
  Terminator location: Contig name=SeqID_16900; Position on contig =209325..209363bp; Strand=+

SEQ ID NO: 16120 - DNA, 42 bp, Xenorhabdus bovienii
  Terminator location: Contig name=SeqID_16900; Position on contig =210325..210366bp; Strand=+
ggaactgtgccccgaatgggtcggttccgcctgtttattttt

SEQ ID NO: 16121 - DNA, 48 bp, Xenorhabdus bovienii
  Terminator location: Contig name=SeqID_16900; Position on contig =211350..211397bp; Strand=+
tcaaccgaaaggggaaactattcccttttcggggcgtgttttcctttt

SEQ ID NO: 16122 - DNA, 28 bp, Xenorhabdus bovienii
  Terminator location: Contig name=SeqID_16900; Position on contig =212141..212168bp; Strand=+
gcgcctttcggggcgcttttttttgttt

SEQ ID NO: 16123 - DNA, 60 bp, Xenorhabdus bovienii
  Terminator location: Contig name=SeqID_16902; Position on contig =710..769bp; Strand=-
gcggcgtcacttggtaatcgctgtgctttaacacaagtgacgccgcgcagttttcgggac

SEQ ID NO: 16124 - DNA, 47 bp, Xenorhabdus bovienii
  Terminator location: Contig name=SeqID_16902; Position on contig =2560..2606bp; Strand=-
caatgaatggagaggcactatcctctccattattgtttaaatttata

SEQ ID NO: 16125 - DNA, 39 bp, Xenorhabdus bovienii
  Terminator location: Contig name=SeqID_16904; Position on contig =3339..3377bp; Strand=+; Gene name=FecB
ctgcacctgatatttgcaggtgcagattatatttttaaa

SEQ ID NO: 16126 - DNA, 37 bp, Xenorhabdus bovienii
  Terminator location: Contig name=SeqID_16904; Position on contig =3327..3363bp; Strand=-
ctgcacctgcaaatatcaggtgcagcctttattgacg

SEQ ID NO: 16127 - DNA, 48 bp, Xenorhabdus bovienii
  Terminator location: Contig name=SeqID_16904; Position on contig =8563..8610bp; Strand=+
gtggtaatccgacaatgaccagatcgggttgccactctttgagtagtt

SEQ ID NO: 16128 - DNA, 37 bp, Xenorhabdus bovienii
  Terminator location: Contig name=SeqID_16904; Position on contig =8255..8291bp; Strand=-
cccaacaactcacgttgttgccggctttgctcatgag

SEQ ID NO: 16129 - DNA, 39 bp, Xenorhabdus bovienii
  Terminator location: Contig name=SeqID_16904; Position on contig =11288..11326bp; Strand=+
tttattgctaaccaattgagtgataaattaatattcctc

SEQ ID NO: 16130 - DNA, 43 bp, Xenorhabdus bovienii
  Terminator location: Contig name=SeqID_16904; Position on contig =12822..12864bp; Strand=+
tgatgctgctatattaaaataacagcatcgtatttaaagtttg

SEQ ID NO: 16131 - DNA, 42 bp, Xenorhabdus bovienii
  Terminator location: Contig name=SeqID_16904; Position on contig =12809..12850bp; Strand=-
gatgctgttattttaatatagcagcatcattttttatctaaa

SEQ ID NO: 16132 - DNA, 41 bp, Xenorhabdus bovienii
  Terminator location: Contig name=SeqID_16904; Position on contig =15088..15128bp; Strand=+; Gene name=LysR
tcatggcacagattgaagctgcgctgtgagtttccatgatc

SEQ ID NO: 16133 - DNA, 36 bp, Xenorhabdus bovienii
  Terminator location: Contig name=SeqID_16904; Position on contig =17263..17298bp; Strand=+; Gene name=LysA
tacggggcattttttgtccccgtattctcgattact

SEQ ID NO: 16134 - DNA, 42 bp, Xenorhabdus bovienii
  Terminator location: Contig name=SeqID_16904; Position on contig =17248..17289bp; Strand=-; Gene name=LysA
gaatacggggacaaaaaatgccccgtattttatttataccgc

SEQ ID NO: 16135 - DNA, 46 bp, Xenorhabdus bovienii
  Terminator location: Contig name=SeqID_16904; Position on contig =21454..21499bp; Strand=+
tgctgatagtggtaagtttgccatttttggcaaagtattcataggc

SEQ ID NO: 16136 - DNA, 44 bp, Xenorhabdus bovienii
  Terminator location: Contig name=SeqID_16904; Position on contig =29749..29792bp; Strand=-
caaaaacccgctgtgtatctgacagcgggttgcattttttagct

SEQ ID NO: 16137 - DNA, 41 bp, Xenorhabdus bovienii
  Terminator location: Contig name=SeqID_16904; Position on contig =34377..34417bp; Strand=+; Gene name=WecD
ggttgtgcaaacagtattgcatatatccaattttcccgtac

SEQ ID NO: 16138 - DNA, 51 bp, Xenorhabdus bovienii
  Terminator location: Contig name=SeqID_16904; Position on contig =40526..40576bp; Strand=+; Gene name=BetT
ggaagctgcctgcaatatattgagttgttggcagtttttttgttttttacc

SEQ ID NO: 16139 - DNA, 47 bp, Xenorhabdus bovienii
  Terminator location: Contig name=SeqID_16904; Position on contig =40702..40748bp; Strand=+
ttattgattaatggtgttgtactttaatcggtaatttatagtcatct

SEQ ID NO: 16140 - DNA, 37 bp, Xenorhabdus bovienii
  Terminator location: Contig name=SeqID_16904; Position on contig =42057..42093bp; Strand=+
gtagcgctcaatgacatgaggctgtatatttatacag

SEQ ID NO: 16141 - DNA, 40 bp, Xenorhabdus bovienii
  Terminator location: Contig name=SeqID_16904; Position on contig =43200..43239bp; Strand=-; Gene name=DinP
ctcccctgctcatcagccgtaggggagcttccttttcagt

SEQ ID NO: 16142 - DNA, 38 bp, Xenorhabdus bovienii
  Terminator location: Contig name=SeqID_16904; Position on contig =49728..49765bp; Strand=+; Gene name=ProA
gtcacactttatcgtaagtgtggctgtttgcttgatga

SEQ ID NO: 16143 - DNA, 39 bp, Xenorhabdus bovienii
  Terminator location: Contig name=SeqID_16904; Position on contig =54389..54427bp; Strand=+; Gene name=CinA (BS)
ttgatgctgtatgattatacagtataattaattccagca

SEQ ID NO: 16144 - DNA, 46 bp, Xenorhabdus bovienii
  Terminator location: Contig name=SeqID_16904; Position on contig =55605..55650bp; Strand=+; Gene name=RecA
gaagaaccacatcctgtcgggatgtggtttttgtttttataggagt

SEQ ID NO: 16145 - DNA, 43 bp, Xenorhabdus bovienii
  Terminator location: Contig name=SeqID_16904; Position on contig =58847..58889bp; Strand=+
ttcgcattggtgtgaatgcgcccaaggaagtttctgttcaccg

SEQ ID NO: 16146 - DNA, 49 bp, Xenorhabdus bovienii
  Terminator location: Contig name=SeqID_16904; Position on contig =59132..59180bp; Strand=+
cattttcataaattttagcgagatttaagggattgtgctgttgataaaa

SEQ ID NO: 16147 - DNA, 43 bp, Xenorhabdus bovienii
  Terminator location: Contig name=SeqID_16905; Position on contig =5470..5512bp; Strand=+
gaggggaagtagggtgtcaatctttcccctcttaatgataata

SEQ ID NO: 16148 - DNA, 40 bp, Xenorhabdus bovienii
  Terminator location: Contig name=SeqID_16906; Position on contig =3351..3390bp; Strand=+; Gene name=Tra8
ttaatatattgttatgccgatatattgggtttttgtacgt

SEQ ID NO: 16149 - DNA, 43 bp, Xenorhabdus bovienii
  Terminator location: Contig name=SeqID_16906; Position on contig =3074..3116bp; Strand=-; Gene name=Tra8
gagtgggtattcctttaaataactcattcggtgttttgtaatc

SEQ ID NO: 16150 - DNA, 50 bp, Xenorhabdus bovienii
  Terminator location: Contig name=SeqID_16906; Position on contig =4304..4353bp; Strand=-
gaaaaagtgtcggtacgttagagctgccggcgcttttttttctccagcat

SEQ ID NO: 16151 - DNA, 42 bp, Xenorhabdus bovienii
  Terminator location: Contig name=SeqID_16906; Position on contig =6593..6634bp; Strand=+; Gene name=NrdG
cactcagcaccagaatctggtgctgagtgttctattcgtcac

SEQ ID NO: 16152 - DNA, 38 bp, Xenorhabdus bovienii
  Terminator location: Contig name=SeqID_16906; Position on contig =16242..16279bp; Strand=+; Gene name=CysC
cacattattgcgagtagaataatgtgtttctacactca

SEQ ID NO: 16153 - DNA, 36 bp, Xenorhabdus bovienii; identical to SEQ ID NO: 15245
  Terminator location: Contig name=SeqID_16906; Position on contig =20785..20820bp; Strand=-

SEQ ID NO: 16154 - DNA, 35 bp, Xenorhabdus bovienii
  Terminator location: Contig name=SeqID_16906; Position on contig =26890..26924bp; Strand=-
ctatcgctatctcatagtgaggatttctcacaatt

SEQ ID NO: 16155 - DNA, 47 bp, Xenorhabdus bovienii
  Terminator location: Contig name=SeqID_16906; Position on contig =28278..28324bp; Strand=-
tattcatggattcgacaatgggattcatgagggagtatgtatggagg

SEQ ID NO: 16156 - DNA, 42 bp, Xenorhabdus bovienii
  Terminator location: Contig name=SeqID_16906; Position on contig =28631..28672bp; Strand=-
tccagctcattttataagtgggctgtggtgagtttaattact

SEQ ID NO: 16157 - DNA, 44 bp, Xenorhabdus bovienii
  Terminator location: Contig name=SeqID_16906; Position on contig =29829..29872bp; Strand=+
catcatgtggatttataagtcaacatgatgtggatttattttat

SEQ ID NO: 16158 - DNA, 42 bp, Xenorhabdus bovienii
  Terminator location: Contig name=SeqID_16906; Position on contig =29817..29858bp; Strand=-
catcatgttgacttataaatccacatgatgtttaattcaatc

SEQ ID NO: 16159 - DNA, 38 bp, Xenorhabdus bovienii
  Terminator location: Contig name=SeqID_16906; Position on contig =31113..31150bp; Strand=+
ttaacctgattatagtcaggctaacggttattaattaa

SEQ ID NO: 16160 - DNA, 37 bp, Xenorhabdus bovienii
  Terminator location: Contig name=SeqID_16906; Position on contig =31437..31473bp; Strand=-
tttgggtatcggatatactcaagtgcttctattaatg

SEQ ID NO: 16161 - DNA, 37 bp, Xenorhabdus bovienii
  Terminator location: Contig name=SeqID_16906; Position on contig =37808..37844bp; Strand=+
gcccatcattgctctaatgatgggttattgcctctcg

SEQ ID NO: 16162 - DNA, 27 bp, Xenorhabdus bovienii
  Terminator location: Contig name=SeqID_16906; Position on contig =41765..41791bp; Strand=+
ccctcttcggagggttttttgtttatg

SEQ ID NO: 16163 - DNA, 32 bp, Xenorhabdus bovienii
  Terminator location: Contig name=SeqID_16906; Position on contig =50793..50824bp; Strand=-
gcgctgccgatatacagcgccttgtacatggc

SEQ ID NO: 16164 - DNA, 30 bp, Xenorhabdus bovienii
  Terminator location: Contig name=SeqID_16906; Position on contig =52262..52291bp; Strand=+
gggtgcttgcgagtgcccttgataatgttc

SEQ ID NO: 16165 - DNA, 37 bp, Xenorhabdus bovienii
  Terminator location: Contig name=SeqID_16906; Position on contig =55150..55186bp; Strand=+
gaaccctgccaaattggcggggttttcttttttcagg

SEQ ID NO: 16166 - DNA, 47 bp, Xenorhabdus bovienii
  Terminator location: Contig name=SeqID_16906; Position on contig =65632..65678bp; Strand=-
gcgcctgttctgcaatcgggcgggcatatgcgcgctctgtcggtgag

SEQ ID NO: 16167 - DNA, 38 bp, Xenorhabdus bovienii
  Terminator location: Contig name=SeqID_16906; Position on contig =67577..67614bp; Strand=+; Gene name=Pcm
gttaagcaaaatattttgccttaaatcttttgtaattc

SEQ ID NO: 16168 - DNA, 38 bp, Xenorhabdus bovienii
  Terminator location: Contig name=SeqID_16906; Position on contig =68739..68776bp; Strand=+; Gene name=NlpD
gggcaggattctgaattcctgcccgcattatcatgggt

SEQ ID NO: 16169 - DNA, 51 bp, Xenorhabdus bovienii
  Terminator location: Contig name=SeqID_16906; Position on contig =69858..69908bp; Strand=+; Gene name=RpoD
taaccaaaaggtgggctaaataagcccaccttttatttatcttttattttt

SEQ ID NO: 16170 - DNA, 33 bp, Xenorhabdus bovienii
  Terminator location: Contig name=SeqID_16906; Position on contig =69855..69887bp; Strand=-; Gene name=RpoD
ggtgggcttatttagcccaccttttggttaaac

SEQ ID NO: 16171 - DNA, 41 bp, Xenorhabdus bovienii
  Terminator location: Contig name=SeqID_16906; Position on contig =72859..72899bp; Strand=+
tatttaatcagatagttttgagtaaatggtgtttacagcat

SEQ ID NO: 16172 - DNA, 36 bp, Xenorhabdus bovienii
  Terminator location: Contig name=SeqID_16906; Position on contig =74485..74520bp; Strand=+
caccgggtttgcaggcttggtaggtgtattctaact

SEQ ID NO: 16173 - DNA, 45 bp, Xenorhabdus bovienii; identical to SEQ ID NO: 15016
  Terminator location: Contig name=SeqID_16906; Position on contig =75961..76005bp; Strand=-

SEQ ID NO: 16174 - DNA, 27 bp, Xenorhabdus bovienii
  Terminator location: Contig name=SeqID_16906; Position on contig =76646..76672bp; Strand=+
cggactttcagtccgttaatcattaac

SEQ ID NO: 16175 - DNA, 47 bp, Xenorhabdus bovienii
  Terminator location: Contig name=SeqID_16906; Position on contig =79914..79960bp; Strand=-
cttttgctcgtttctctaaaagaacgtagcaaaagtcttgcattcat

SEQ ID NO: 16176 - DNA, 51 bp, Xenorhabdus bovienii
  Terminator location: Contig name=SeqID_16906; Position on contig =85112..85162bp; Strand=+; Gene name=CstA
gataccccgcataatcgcctttgtattatgtggggtatttttctttggaga

SEQ ID NO: 16177 - DNA, 42 bp, Xenorhabdus bovienii
  Terminator location: Contig name=SeqID_16906; Position on contig =86394..86435bp; Strand=+
tattttattctttattgagcagtgaaatagtttgtataaaaa

SEQ ID NO: 16178 - DNA, 48 bp, Xenorhabdus bovienii
  Terminator location: Contig name=SeqID_16906; Position on contig =91512..91559bp; Strand=+; Gene name=FabH
tcctcgatcacataattaactatgtgaccggggattcgtttccttgcc

SEQ ID NO: 16179 - DNA, 27 bp, Xenorhabdus bovienii
  Terminator location: Contig name=SeqID_16906; Position on contig =93109..93135bp; Strand=+
gtgcagatgctgcgctttatctggata

SEQ ID NO: 16180 - DNA, 51 bp, Xenorhabdus bovienii
  Terminator location: Contig name=SeqID_16906; Position on contig =93475..93525bp; Strand=+
tgaaaaatgccgcagatattctttgcggcattgtttattttttacctctat

SEQ ID NO: 16181 - DNA, 35 bp, Xenorhabdus bovienii
  Terminator location: Contig name=SeqID_16906; Position on contig =93470..93504bp; Strand=-
tgccgcaaagaatatctgcggcatttttcacgcta

SEQ ID NO: 16182 - DNA, 43 bp, Xenorhabdus bovienii
  Terminator location: Contig name=SeqID_16906; Position on contig =99519..99561bp; Strand=+; Gene name=PncA
taactggcagattaattatctgccagtgaaattattttacata

SEQ ID NO: 16183 - DNA, 35 bp, Xenorhabdus bovienii
  Terminator location: Contig name=SeqID_16906; Position on contig =99510..99544bp; Strand=-; Gene name=PncA
ctggcagataattaatctgccagttatatattcca

SEQ ID NO: 16184 - DNA, 49 bp, Xenorhabdus bovienii
  Terminator location: Contig name=SeqID_16906; Position on contig =102564..102612bp; Strand=-
tggatatggattattattgatgctaatttagtattcaatttatctccaa

SEQ ID NO: 16185 - DNA, 34 bp, Xenorhabdus bovienii
  Terminator location: Contig name=SeqID_16906; Position on contig =104060..104093bp; Strand=+
ggtatatcaatcggtgtatcacttttcgtaaaaa

SEQ ID NO: 16186 - DNA, 45 bp, Xenorhabdus bovienii
  Terminator location: Contig name=SeqID_16906; Position on contig =104713..104757bp; Strand=+; Gene name=Hpt
gagtaaatggcagccttatgctgccatttgtttttatgtggatct

SEQ ID NO: 16187 - DNA, 32 bp, Xenorhabdus bovienii
  Terminator location: Contig name=SeqID_16906; Position on contig =104707..104738bp; Strand=-; Gene name=Hpt
tggcagcataaggctgccatttactcatagtt

SEQ ID NO: 16188 - DNA, 36 bp, Xenorhabdus bovienii
  Terminator location: Contig name=SeqID_16906; Position on contig =107299..107334bp; Strand=-
ctccgccgtaaacaacggcggagcgttatatttaca

SEQ ID NO: 16189 - DNA, 43 bp, Xenorhabdus bovienii
  Terminator location: Contig name=SeqID_16906; Position on contig =113210..113252bp; Strand=-; Gene name=GlnS
gagtacggcgctgaatggcgccgtatgctcccttatatttatc

SEQ ID NO: 16190 - DNA, 37 bp, Xenorhabdus bovienii
  Terminator location: Contig name=SeqID_16906; Position on contig =113965..114001bp; Strand=+
tctgttatgctggccccgtaacagattacttcgaccc

SEQ ID NO: 16191 - DNA, 32 bp, Xenorhabdus bovienii
  Terminator location: Contig name=SeqID_16906; Position on contig =113740..113771bp; Strand=-
ccccccattgttgggggggtcgtttgatagtg

SEQ ID NO: 16192 - DNA, 34 bp, Xenorhabdus bovienii
  Terminator location: Contig name=SeqID_16906; Position on contig =119723..119756bp; Strand=+; Gene name=MrcA
tccccatcgattccgatggggacattttcccggc

SEQ ID NO: 16193 - DNA, 41 bp, Xenorhabdus bovienii
  Terminator location: Contig name=SeqID_16906; Position on contig =119706..119746bp; Strand=-; Gene name=MrcA
tgtccccatcggaatcgatggggagcgatattctattactg

SEQ ID NO: 16194 - DNA, 40 bp, Xenorhabdus bovienii
  Terminator location: Contig name=SeqID_16906; Position on contig =130376..130415bp; Strand=+; Gene name=IscA
taagggcagcttaagagccgcctttatttttttctacgtt

SEQ ID NO: 16195 - DNA, 40 bp, Xenorhabdus bovienii
  Terminator location: Contig name=SeqID_16906; Position on contig =130362..130401bp; Strand=-; Gene name=IscA
taaaggcggctcttaagctgcccttatttttaataacggt

SEQ ID NO: 16196 - DNA, 36 bp, Xenorhabdus bovienii
  Terminator location: Contig name=SeqID_16906; Position on contig =145519..145554bp; Strand=-
tcgccacccttccgggtggcgatttttatgatcaat

SEQ ID NO: 16197 - DNA, 51 bp, Xenorhabdus bovienii
  Terminator location: Contig name=SeqID_16906; Position on contig =147567..147617bp; Strand=-
tgttaaaagtccccgacatatgtcgggggcttttaatgatattcataaaat

SEQ ID NO: 16198 - DNA, 33 bp, Xenorhabdus bovienii
  Terminator location: Contig name=SeqID_16906; Position on contig =149346..149378bp; Strand=+
tggtggtaaatcgccatcacgcgtttttcacgg

SEQ ID NO: 16199 - DNA, 39 bp, Xenorhabdus bovienii
  Terminator location: Contig name=SeqID_16906; Position on contig =149130..149168bp; Strand=-
gaacctacaggtttttcctgtgggtttttctatagatcc

SEQ ID NO: 16200 - DNA, 39 bp, Xenorhabdus bovienii
  Terminator location: Contig name=SeqID_16906; Position on contig =152299..152337bp; Strand=-; Gene name=SprT
gaagcccgcaggatattagcgggctttttcataactcac

SEQ ID NO: 16201 - DNA, 47 bp, Xenorhabdus bovienii
  Terminator location: Contig name=SeqID_16906; Position on contig =156100..156146bp; Strand=+; Gene name=SpeA
gttccgtgttgctgaaattcagtgaacgcggggcttttgaggatata

SEQ ID NO: 16202 - DNA, 46 bp, Xenorhabdus bovienii
  Terminator location: Contig name=SeqID_16906; Position on contig =157099..157144bp; Strand=+; Gene name=SpeB
caaagaaccccccgctggccagggtggttctttgtttcaagtagtc

SEQ ID NO: 16203 - DNA, 48 bp, Xenorhabdus bovienii
  Terminator location: Contig name=SeqID_16906; Position on contig =161715..161762bp; Strand=+; Gene name=LeuD
tgcaaaaaccactgtggctagcggtggtttttggcattatagcgttcc

SEQ ID NO: 16204 - DNA, 40 bp, Xenorhabdus bovienii
  Terminator location: Contig name=SeqID_16906; Position on contig =161605..161644bp; Strand=-; Gene name=LeuD
tcgccagttcgccaaccggatcggtgggatatttttcact

SEQ ID NO: 16205 - DNA, 36 bp, Xenorhabdus bovienii
  Terminator location: Contig name=SeqID_16906; Position on contig =163013..163048bp; Strand=-
tgccagttagtgtttggctggcatcttatcgctgga

SEQ ID NO: 16206 - DNA, 41 bp, Xenorhabdus bovienii
  Terminator location: Contig name=SeqID_16906; Position on contig =165940..165980bp; Strand=+; Gene name=SmtA
ggatggcttatttaaatcataaaccatcctttaaaataata

SEQ ID NO: 16207 - DNA, 41 bp, Xenorhabdus bovienii
  Terminator location: Contig name=SeqID_16906; Position on contig =165928..165968bp; Strand=-; Gene name=SmtA
ggatggtttatgatttaaataagccatcctttttgtaaacc

SEQ ID NO: 16208 - DNA, 38 bp, Xenorhabdus bovienii
  Terminator location: Contig name=SeqID_16906; Position on contig =170412..170449bp; Strand=+; Gene name=MetC
tgccagctgttcttcctcggttggcatttttgtgctgc

SEQ ID NO: 16209 - DNA, 63 bp, Xenorhabdus bovienii
  Terminator location: Contig name=SeqID_16906; Position on contig =173195..173257bp; Strand=-
tatctatatcgagtaggatgaggtgccatcatttcatcctactataaaatacctttgttaaaa

SEQ ID NO: 16210 - DNA, 35 bp, Xenorhabdus bovienii
  Terminator location: Contig name=SeqID_16906; Position on contig =180180..180214bp; Strand=+; Gene name=FAA1
taacgttggtgtctaacgttatgttaattaatcta

SEQ ID NO: 16211 - DNA, 36 bp, Xenorhabdus bovienii
  Terminator location: Contig name=SeqID_16906; Position on contig =182605..182640bp; Strand=+; Gene name=IlvH
gagccctactgtaaagtagggctttttcatcatctt

SEQ ID NO: 16212 - DNA, 38 bp, Xenorhabdus bovienii
  Terminator location: Contig name=SeqID_16906; Position on contig =183667..183704bp; Strand=+; Gene name=PurR
gtaccctcattgaacatgagggtgccttattaatacga

SEQ ID NO: 16213 - DNA, 44 bp, Xenorhabdus bovienii
  Terminator location: Contig name=SeqID_16908; Position on contig =6606..6649bp; Strand=+; Gene name=ZnuB
gagagccatatctaattttggatatggttctctattgagtgcta

SEQ ID NO: 16214 - DNA, 50 bp, Xenorhabdus bovienii
  Terminator location: Contig name=SeqID_16908; Position on contig =6590..6639bp; Strand=-; Gene name=ZnuB
tagagaaccatatccaaaattagatatggctctctactttattaatttga

SEQ ID NO: 16215 - DNA, 48 bp, Xenorhabdus bovienii
  Terminator location: Contig name=SeqID_16908; Position on contig =8089..8136bp; Strand=+
tcaaggatcatttgatcttcgatatgttccttgatgaatttaaattgg

SEQ ID NO: 16216 - DNA, 44 bp, Xenorhabdus bovienii
  Terminator location: Contig name=SeqID_16908; Position on contig =7871..7914bp; Strand=-
gctgcggaagcatttatcttctcttcgcagcttattaagatatt

SEQ ID NO: 16217 - DNA, 43 bp, Xenorhabdus bovienii
  Terminator location: Contig name=SeqID_16908; Position on contig =9372..9414bp; Strand=+
tcacttaaatgggcattcccacttaaatgggctttcaaatccc

SEQ ID NO: 16218 - DNA, 37 bp, Xenorhabdus bovienii
  Terminator location: Contig name=SeqID_16908; Position on contig =9070..9106bp; Strand=-
gggtatggtgatttccaccataccttttgcttttgta

SEQ ID NO: 16219 - DNA, 61 bp, Xenorhabdus bovienii
  Terminator location: Contig name=SeqID_16908; Position on contig =10812..10872bp; Strand=+
gaataatccttaacccgcaactttccgcgggttaagactggcttcattcttctaccatccc

SEQ ID NO: 16220 - DNA, 27 bp, Xenorhabdus bovienii
  Terminator location: Contig name=SeqID_16908; Position on contig =10959..10985bp; Strand=-
ggggcttgatgccccttacttcattca

SEQ ID NO: 16221 - DNA, 28 bp, Xenorhabdus bovienii
  Terminator location: Contig name=SeqID_16908; Position on contig =13630..13657bp; Strand=-
ggtcgctacggcggcctttttttatggg

SEQ ID NO: 16222 - DNA, 37 bp, Xenorhabdus bovienii; identical to SEQ ID NO: 15550
  Terminator location: Contig name=SeqID_16908; Position on contig =15447..15483bp; Strand=-

SEQ ID NO: 16223 - DNA, 67 bp, Xenorhabdus bovienii
  Terminator location: Contig name=SeqID_16908; Position on contig =17397..17463bp; Strand=+; Gene name=MhpC
gcctgagcgggaatttctttgttttatttaaagaagttcccgctattacaggcatgttttttgtgta

SEQ ID NO: 16224 - DNA, 61 bp, Xenorhabdus bovienii
  Terminator location: Contig name=SeqID_16908; Position on contig =17385..17445bp; Strand=-; Gene name=MhpC
gtaatagcgggaacttctttaaataaaacaaagaaattcccgctcaggctctcttaagact

SEQ ID NO: 16225 - DNA, 47 bp, Xenorhabdus bovienii
  Terminator location: Contig name=SeqID_16908; Position on contig =19390..19436bp; Strand=-
gggtattaggggaggaacgcccttaagtacgtcgattgtaacatagc

SEQ ID NO: 16226 - DNA, 41 bp, Xenorhabdus bovienii
  Terminator location: Contig name=SeqID_16908; Position on contig =22275..22315bp; Strand=-
ggttagtcacactggaatatgactagccgttagtttttaaa

SEQ ID NO: 16227 - DNA, 47 bp, Xenorhabdus bovienii
  Terminator location: Contig name=SeqID_16908; Position on contig =26027..26073bp; Strand=-
gagcttcgtgttattacatgatacatgaagctctttttttattacca

SEQ ID NO: 16228 - DNA, 51 bp, Xenorhabdus bovienii
  Terminator location: Contig name=SeqID_16908; Position on contig =69471..69521bp; Strand=-
cttaatgatatgttcacttgaatgataatatatcgtaagttaataattttt

SEQ ID NO: 16229 - DNA, 46 bp, Xenorhabdus bovienii
  Terminator location: Contig name=SeqID_16908; Position on contig =71863..71908bp; Strand=-; Gene name=XerC
ggttaattaattgatttatatcaagtaattaattttcattaattac

SEQ ID NO: 16230 - DNA, 59 bp, Xenorhabdus bovienii
  Terminator location: Contig name=SeqID_16908; Position on contig =79241..79299bp; Strand=+; Gene name=FliK
ttttccgcgtttgttctcgctattggcggaacaaagacgcgggataattgatatcgatt

SEQ ID NO: 16231 - DNA, 45 bp, Xenorhabdus bovienii
  Terminator location: Contig name=SeqID_16908; Position on contig =83847..83891bp; Strand=+; Gene name=FliR
gttcccgctcttttcatcgggatgcgggaatcgaatttttgcaga

SEQ ID NO: 16232 - DNA, 46 bp, Xenorhabdus bovienii
  Terminator location: Contig name=SeqID_16908; Position on contig =93286..93331bp; Strand=+
tggatatgctgcgctcactgcccagcgagtccagttgttccagttc

SEQ ID NO: 16233 - DNA, 61 bp, Xenorhabdus bovienii
  Terminator location: Contig name=SeqID_16908; Position on contig =93055..93115bp; Strand=-
caggctcttatctgtttctctgcaatagggagaaatgggtaagagcctgtctgtttctccc

SEQ ID NO: 16234 - DNA, 43 bp, Xenorhabdus bovienii
  Terminator location: Contig name=SeqID_16908; Position on contig =96048..96090bp; Strand=+
cgttgattgcgcgaccttagcgtaacgcggattttctgtcagc

SEQ ID NO: 16235 - DNA, 34 bp, Xenorhabdus bovienii
  Terminator location: Contig name=SeqID_16908; Position on contig =98766..98799bp; Strand=-; Gene name=FlgH
gctggggaggaaactctccggctatttccgcgat

SEQ ID NO: 16236 - DNA, 32 bp, Xenorhabdus bovienii
  Terminator location: Contig name=SeqID_16908; Position on contig =102878..102909bp; Strand=+
cggcctgatatttcaggctgttatctgcgaaa

SEQ ID NO: 16237 - DNA, 47 bp, Xenorhabdus bovienii
  Terminator location: Contig name=SeqID_16908; Position on contig =109514..109560bp; Strand=-; Gene name=FimC
gtgatatctccaccgcattcggtgggggtgtctctcatttttagttt

SEQ ID NO: 16238 - DNA, 56 bp, Xenorhabdus bovienii
  Terminator location: Contig name=SeqID_16908; Position on contig =112454..112509bp; Strand=+
tccacataaagcaagatgaaatcgtcttgctttacatgatgcgattcgtcgtgggc

SEQ ID NO: 16239 - DNA, 47 bp, Xenorhabdus bovienii
  Terminator location: Contig name=SeqID_16908; Position on contig =122552..122598bp; Strand=-
tggagtgtcattctattcttaaggagatcttcatgattattttaagg

SEQ ID NO: 16240 - DNA, 46 bp, Xenorhabdus bovienii
  Terminator location: Contig name=SeqID_16908; Position on contig =128880..128925bp; Strand=+; Gene name=PinR
ggtgtgggaaacgagtgctcattgttcctgtgcctttaataaagct

SEQ ID NO: 16241 - DNA, 52 bp, Xenorhabdus bovienii
  Terminator location: Contig name=SeqID_16908; Position on contig =128795..128846bp; Strand=-; Gene name=PinR
tctggcagtgactaatccatattctgggtcgctgtcagatttaattctcaca

SEQ ID NO: 16242 - DNA, 38 bp, Xenorhabdus bovienii
  Terminator location: Contig name=SeqID_16908; Position on contig =130371..130408bp; Strand=+
ggcaggtaagctctaatcgcctgccctttgccgtcgta

SEQ ID NO: 16243 - DNA, 55 bp, Xenorhabdus bovienii
  Terminator location: Contig name=SeqID_16908; Position on contig =130102..130156bp; Strand=-
gttcaaccttccctgttatgcaggcggggaaggttaagaccgcattttaacgtca

SEQ ID NO: 16244 - DNA, 44 bp, Xenorhabdus bovienii
  Terminator location: Contig name=SeqID_16908; Position on contig =143816..143859bp; Strand=-
ggtttgggcgggtctgctggctggcccaaacttctgtcttcaac

SEQ ID NO: 16245 - DNA, 50 bp, Xenorhabdus bovienii
  Terminator location: Contig name=SeqID_16908; Position on contig =155175..155224bp; Strand=-; Gene name=MotA
gcaggttacaggtttttatgtgcagacctgtaatctgctctgtcataccg

SEQ ID NO: 16246 - DNA, 56 bp, Xenorhabdus bovienii
  Terminator location: Contig name=SeqID_16908; Position on contig =156473..156528bp; Strand=-
gtgtcagttttgtgatatatgtcacatagtatttaaaatggcatatattctccgtt

SEQ ID NO: 16247 - DNA, 39 bp, Xenorhabdus bovienii
  Terminator location: Contig name=SeqID_16908; Position on contig =157759..157797bp; Strand=-
tgcgtcatcacccaaatgatgaagcaattttacattcat

SEQ ID NO: 16248 - DNA, 41 bp, Xenorhabdus bovienii
  Terminator location: Contig name=SeqID_16908; Position on contig =162878..162918bp; Strand=-
gctcgccacacttaaattccgtggcgggctttttgtttttt

SEQ ID NO: 16249 - DNA, 50 bp, Xenorhabdus bovienii
  Terminator location: Contig name=SeqID_16908; Position on contig =163235..163284bp; Strand=-
gttatgtgtaagtgctatctctggtagcctttgttgaccgtttccttctt

SEQ ID NO: 16250 - DNA, 48 bp, Xenorhabdus bovienii
  Terminator location: Contig name=SeqID_16908; Position on contig =164355..164402bp; Strand=+
gaaatcccgatttagttctgctaatcgggatttctgcttttgatttta

SEQ ID NO: 16251 - DNA, 39 bp, Xenorhabdus bovienii
  Terminator location: Contig name=SeqID_16908; Position on contig =164346..164384bp; Strand=-
tcccgattagcagaactaaatcgggatttcttaaatttg

SEQ ID NO: 16252 - DNA, 48 bp, Xenorhabdus bovienii
  Terminator location: Contig name=SeqID_16909; Position on contig =1366..1413bp; Strand=-
gtagcgttacctatccgctacaagagtaacgtttgccattttgattgc

SEQ ID NO: 16253 - DNA, 40 bp, Xenorhabdus bovienii
  Terminator location: Contig name=SeqID_16909; Position on contig =1773..1812bp; Strand=-
cacagtgccttgccgtcagggtactgtgttttgttgtgcg

SEQ ID NO: 16254 - DNA, 27 bp, Xenorhabdus bovienii
  Terminator location: Contig name=SeqID_16909; Position on contig =8854..8880bp; Strand=+
cggactcatgtccggttatcctctttg

SEQ ID NO: 16255 - DNA, 54 bp, Xenorhabdus bovienii
  Terminator location: Contig name=SeqID_16909; Position on contig =13344..13397bp; Strand=+; Gene name=Tpx
tggcgacgataaaatcacaatgaataattttatcgtcgccaacttattttatat

SEQ ID NO: 16256 - DNA, 41 bp, Xenorhabdus bovienii
  Terminator location: Contig name=SeqID_16909; Position on contig =20478..20518bp; Strand=+
tcccctgcatcttgtaaagatgggggaaattcatggtcaat

SEQ ID NO: 16257 - DNA, 34 bp, Xenorhabdus bovienii
  Terminator location: Contig name=SeqID_16909; Position on contig =27323..27356bp; Strand=+; Gene name=IcmF
cgcttacaaactcatgtgagtgtttatacctctg

SEQ ID NO: 16258 - DNA, 34 bp, Xenorhabdus bovienii
  Terminator location: Contig name=SeqID_16909; Position on contig =28564..28597bp; Strand=+
cgcttgcaaacccatgtaagtgtttatacctccc

SEQ ID NO: 16259 - DNA, 28 bp, Xenorhabdus bovienii
  Terminator location: Contig name=SeqID_16909; Position on contig =31460..31487bp; Strand=+
cctctcttcggggaggttatttcccacc

SEQ ID NO: 16260 - DNA, 34 bp, Xenorhabdus bovienii
  Terminator location: Contig name=SeqID_16910; Position on contig =986..1019bp; Strand=+
gtgatagcgttgcgtttatcgcctttgttgcact

SEQ ID NO: 16261 - DNA, 43 bp, Xenorhabdus bovienii
  Terminator location: Contig name=SeqID_16910; Position on contig =6915..6957bp; Strand=-
tgtccccgtgcggagcaagcgcggggcggcgattgtggtaaac

SEQ ID NO: 16262 - DNA, 31 bp, Xenorhabdus bovienii
  Terminator location: Contig name=SeqID_16910; Position on contig =7551..7581bp; Strand=-
gaggcggtgttattgtctcattgtcctgtct

SEQ ID NO: 16263 - DNA, 47 bp, Xenorhabdus bovienii
  Terminator location: Contig name=SeqID_16910; Position on contig =15298..15344bp; Strand=-
gaaaaggtctatcaaaaaaattaatgggccatttcttgctcaatcga

SEQ ID NO: 16264 - DNA, 46 bp, Xenorhabdus bovienii
  Terminator location: Contig name=SeqID_16910; Position on contig =26237..26282bp; Strand=-
tattcggctttttgttagaaagatgccgaataaattaattaacctc

SEQ ID NO: 16265 - DNA, 54 bp, Xenorhabdus bovienii
  Terminator location: Contig name=SeqID_16910; Position on contig =26998..27051bp; Strand=-
taatatatttggatttttgttagagaaaagtcaggtgaattatttacaccttcc

SEQ ID NO: 16266 - DNA, 51 bp, Xenorhabdus bovienii
  Terminator location: Contig name=SeqID_16910; Position on contig =28894..28944bp; Strand=+
tttattctggcttcgtacatcgatgaagcagagatagaattatattgcgga

SEQ ID NO: 16267 - DNA, 30 bp, Xenorhabdus bovienii
  Terminator location: Contig name=SeqID_16914; Position on contig =268..297bp; Strand=+
ccccattttaacatggggtttttaattaaa

SEQ ID NO: 16268 - DNA, 50 bp, Xenorhabdus bovienii
  Terminator location: Contig name=SeqID_16914; Position on contig =246..295bp; Strand=-
taattaaaaaccccatgttaaaatggggttttattgtttctgtctatggc

SEQ ID NO: 16269 - DNA, 48 bp, Xenorhabdus bovienii
  Terminator location: Contig name=SeqID_16914; Position on contig =3272..3319bp; Strand=+; Gene name=TfoX
ttaatcaataggggcatggcccctattcagattggcgcttttctctgc

SEQ ID NO: 16270 - DNA, 35 bp, Xenorhabdus bovienii
  Terminator location: Contig name=SeqID_16914; Position on contig =6737..6771bp; Strand=+
tgtcattatgaataatgatggtaattattatttat

SEQ ID NO: 16271 - DNA, 41 bp, Xenorhabdus bovienii
  Terminator location: Contig name=SeqID_16914; Position on contig =33278..33318bp; Strand=+; Gene name=EntF
ttagtgggcctgattttaggcccattgattgtatgatcaga

SEQ ID NO: 16272 - DNA, 37 bp, Xenorhabdus bovienii
  Terminator location: Contig name=SeqID_16914; Position on contig =33088..33124bp; Strand=-; Gene name=EntF
tgccgaaatattattatccggcatttttgctattaac

SEQ ID NO: 16273 - DNA, 47 bp, Xenorhabdus bovienii
  Terminator location: Contig name=SeqID_16914; Position on contig =38027..38073bp; Strand=-
taaggcgatgagtagtaaacaaccatcgccttattcatttttccatg

SEQ ID NO: 16274 - DNA, 37 bp, Xenorhabdus bovienii
  Terminator location: Contig name=SeqID_16914; Position on contig =43993..44029bp; Strand=-
gttttttttgtgcgcaaggaggtgcttttctctttgt

SEQ ID NO: 16275 - DNA, 45 bp, Xenorhabdus bovienii; identical to SEQ ID NO: 15016
  Terminator location: Contig name=SeqID_16914; Position on contig =48691..48735bp; Strand=-

SEQ ID NO: 16276 - DNA, 37 bp, Xenorhabdus bovienii; identical to SEQ ID NO: 15550
  Terminator location: Contig name=SeqID_16914; Position on contig =49667..49703bp; Strand=+

SEQ ID NO: 16277 - DNA, 37 bp, Xenorhabdus bovienii
  Terminator location: Contig name=SeqID_16914; Position on contig =49506..49542bp; Strand=-
gataagctgtgtgacatggctttcactcttatcacaa

SEQ ID NO: 16278 - DNA, 31 bp, Xenorhabdus bovienii
  Terminator location: Contig name=SeqID_16914; Position on contig =51616..51646bp; Strand=+
gcctcgcactcgcggggctttttgctttcta

SEQ ID NO: 16279 - DNA, 56 bp, Xenorhabdus bovienii
  Terminator location: Contig name=SeqID_16914; Position on contig =52094..52149bp; Strand=+
catattaaatccttataatatttactgatggttatttgatatgagtttcacatatt

SEQ ID NO: 16280 - DNA, 35 bp, Xenorhabdus bovienii
  Terminator location: Contig name=SeqID_16914; Position on contig =54024..54058bp; Strand=+
gcaggagccatcctgtctcctgcttgattgttatt

SEQ ID NO: 16281 - DNA, 46 bp, Xenorhabdus bovienii
  Terminator location: Contig name=SeqID_16914; Position on contig =54998..55043bp; Strand=+
ttgttgatcatatcaatggtgatggtgacaatgattgtcatcctga

SEQ ID NO: 16282 - DNA, 29 bp, Xenorhabdus bovienii
  Terminator location: Contig name=SeqID_16914; Position on contig =62247..62275bp; Strand=-; Gene name=RsuA
cgtcggatttttcggcgtttttcggcacg

SEQ ID NO: 16283 - DNA, 53 bp, Xenorhabdus bovienii
  Terminator location: Contig name=SeqID_16914; Position on contig =64535..64587bp; Strand=+
cactgtcttattaattaaataataaaatcagtaatatagtgaatttaatttgg

SEQ ID NO: 16284 - DNA, 44 bp, Xenorhabdus bovienii
  Terminator location: Contig name=SeqID_16914; Position on contig =64286..64329bp; Strand=-
cggttagtgcagatttctctgtattggtggcgatatttaaatcc

SEQ ID NO: 16285 - DNA, 64 bp, Xenorhabdus bovienii
  Terminator location: Contig name=SeqID_16914; Position on contig =65009..65072bp; Strand=+
cattggttttggtatgcttttgatacaaaaaggaagcaggtcatagcccatgtattcggtcctc

SEQ ID NO: 16286 - DNA, 45 bp, Xenorhabdus bovienii
  Terminator location: Contig name=SeqID_16914; Position on contig =77492..77536bp; Strand=+
gatcatccgcatcgttcatcgatgcggataattttatgaattacc

SEQ ID NO: 16287 - DNA, 41 bp, Xenorhabdus bovienii
  Terminator location: Contig name=SeqID_16914; Position on contig =78900..78940bp; Strand=+
ttcggtgtcttctggggggattgactgaactcttttaactt

SEQ ID NO: 16288 - DNA, 35 bp, Xenorhabdus bovienii
  Terminator location: Contig name=SeqID_16914; Position on contig =79258..79292bp; Strand=+
cccgctatctgaaagataacgggttcttatatggt

SEQ ID NO: 16289 - DNA, 52 bp, Xenorhabdus bovienii
  Terminator location: Contig name=SeqID_16914; Position on contig =79237..79288bp; Strand=-
tataagaacccgttatctttcagatagcgggttttttatttttcggcattta

SEQ ID NO: 16290 - DNA, 74 bp, Xenorhabdus bovienii
  Terminator location: Contig name=SeqID_16914; Position on contig =83039..83112bp; Strand=+; Gene name=CitB
tctattggataataaaaaatcggtaattgttgttaccgattttttattatccaatagataaattaattcaagat

SEQ ID NO: 16291 - DNA, 74 bp, Xenorhabdus bovienii
  Terminator location: Contig name=SeqID_16914; Position on contig =83023..83096bp; Strand=-; Gene name=CitB
tctattggataataaaaaatcggtaacaacaattaccgattttttattatccaatagataacatattgattatc

SEQ ID NO: 16292 - DNA, 59 bp, Xenorhabdus bovienii
  Terminator location: Contig name=SeqID_16914; Position on contig =89814..89872bp; Strand=-
ttttcaagtgcacaaaacggggaagttttgtggataacttgaggattaattttgccgaa

SEQ ID NO: 16293 - DNA, 43 bp, Xenorhabdus bovienii
  Terminator location: Contig name=SeqID_16914; Position on contig =97812..97854bp; Strand=+
ggtctttattctttagtgaaggaataaaatcattgttgatatt

SEQ ID NO: 16294 - DNA, 48 bp, Xenorhabdus bovienii
  Terminator location: Contig name=SeqID_16914; Position on contig =101583..101630bp; Strand=-; Gene name=Tra8
cttaactaccacctacttcagtaggtggtagttaagtttcaagtttaa

SEQ ID NO: 16295 - DNA, 37 bp, Xenorhabdus bovienii
  Terminator location: Contig name=SeqID_16914; Position on contig =101995..102031bp; Strand=-
gccggttcaaaagcaagagctggcttttttataaact

SEQ ID NO: 16296 - DNA, 39 bp, Xenorhabdus bovienii
  Terminator location: Contig name=SeqID_16915; Position on contig =2018..2056bp; Strand=+
gtcttttcctccaaaggaggaaaagacctttagctggtc

SEQ ID NO: 16297 - DNA, 43 bp, Xenorhabdus bovienii
  Terminator location: Contig name=SeqID_16915; Position on contig =2613..2655bp; Strand=-; Gene name=Nlp
caacacaggtaaaacttgttttacctgtgtgtctgttttcgcc

SEQ ID NO: 16298 - DNA, 37 bp, Xenorhabdus bovienii
  Terminator location: Contig name=SeqID_16915; Position on contig =4847..4883bp; Strand=-
cagtgaagttattaagtttcgctggttttgaaatagc

SEQ ID NO: 16299 - DNA, 52 bp, Xenorhabdus bovienii
  Terminator location: Contig name=SeqID_16915; Position on contig =7132..7183bp; Strand=-
gttatgccttaaaagccccgtagggctttgaggatagctatttatctgtagc

SEQ ID NO: 16300 - DNA, 37 bp, Xenorhabdus bovienii
  Terminator location: Contig name=SeqID_16918; Position on contig =6814..6850bp; Strand=-
tgtgccttgagcgtttggggcagatttttggtgaaac

SEQ ID NO: 16301 - DNA, 40 bp, Xenorhabdus bovienii
  Terminator location: Contig name=SeqID_16918; Position on contig =11286..11325bp; Strand=-
tgtaaaaattgaattcagtttggttatatatgtacttatc

SEQ ID NO: 16302 - DNA, 59 bp, Xenorhabdus bovienii
  Terminator location: Contig name=SeqID_16918; Position on contig =15495..15553bp; Strand=+
ggcagtgtcgcgttaacggcgacaagttagcaaaagtggtgttgccgattattggttct

SEQ ID NO: 16303 - DNA, 45 bp, Xenorhabdus bovienii
  Terminator location: Contig name=SeqID_16918; Position on contig =18022..18066bp; Strand=+
ggaataggaaagtcaactttcctattcttcacaatcttttacttc

SEQ ID NO: 16304 - DNA, 54 bp, Xenorhabdus bovienii
  Terminator location: Contig name=SeqID_16918; Position on contig =18002..18055bp; Strand=-
ttgtgaagaataggaaagttgactttcctattcctttgctgattcatgaatcac

SEQ ID NO: 16305 - DNA, 32 bp, Xenorhabdus bovienii
  Terminator location: Contig name=SeqID_16918; Position on contig =19325..19356bp; Strand=+; Gene name=PenP (BS)
ctaccggctgatgccggtaggtttatcggcat

SEQ ID NO: 16306 - DNA, 57 bp, Xenorhabdus bovienii
  Terminator location: Contig name=SeqID_16918; Position on contig =20086..20142bp; Strand=-
ttagcaccaagtatatgtggttgcccatgtatgtctggtgctggttatatgaatgga

SEQ ID NO: 16307 - DNA, 31 bp, Xenorhabdus bovienii
  Terminator location: Contig name=SeqID_16918; Position on contig =24411..24441bp; Strand=-
cggtcgaggagttgaccgggttctgtcctta

SEQ ID NO: 16308 - DNA, 34 bp, Xenorhabdus bovienii
  Terminator location: Contig name=SeqID_16918; Position on contig =25700..25733bp; Strand=+
tccctgatgatcagtcaggggattatcgctctgt

SEQ ID NO: 16309 - DNA, 46 bp, Xenorhabdus bovienii
  Terminator location: Contig name=SeqID_16918; Position on contig =28179..28224bp; Strand=+
gacaatgccttatcttctgattgtgagtattgtcttttacgtcgca

SEQ ID NO: 16310 - DNA, 48 bp, Xenorhabdus bovienii
  Terminator location: Contig name=SeqID_16918; Position on contig =29338..29385bp; Strand=+
ttttttccgaattctgtcagtcatatcggaaaacaggttttatttaaa

SEQ ID NO: 16311 - DNA, 47 bp, Xenorhabdus bovienii
  Terminator location: Contig name=SeqID_16918; Position on contig =31815..31861bp; Strand=+
ggttctggtgcattaacgtgcatacatggacgccccttgtttgccaa

SEQ ID NO: 16312 - DNA, 43 bp, Xenorhabdus bovienii
  Terminator location: Contig name=SeqID_16918; Position on contig =32433..32475bp; Strand=+
ttatcgggccgataccgggtatttccgataatcttcggctgtc

SEQ ID NO: 16313 - DNA, 29 bp, Xenorhabdus bovienii
  Terminator location: Contig name=SeqID_16918; Position on contig =32161..32189bp; Strand=-
cccggattatctgggagttgctggtgcat

SEQ ID NO: 16314 - DNA, 36 bp, Xenorhabdus bovienii; identical to SEQ ID NO: 15880
  Terminator location: Contig name=SeqID_16918; Position on contig =36815..36850bp; Strand=-

SEQ ID NO: 16315 - DNA, 35 bp, Xenorhabdus bovienii
  Terminator location: Contig name=SeqID_16918; Position on contig =38377..38411bp; Strand=+
caacagcatcggtgtgctgcttgtgttcactaatc

SEQ ID NO: 16316 - DNA, 40 bp, Xenorhabdus bovienii
  Terminator location: Contig name=SeqID_16918; Position on contig =39505..39544bp; Strand=+
cggcaagttagcaaaagtggtgttgccggttatttaggca

SEQ ID NO: 16317 - DNA, 31 bp, Xenorhabdus bovienii
  Terminator location: Contig name=SeqID_16918; Position on contig =39372..39402bp; Strand=-
ggaacgatgtctttgttccaattttattgtg

SEQ ID NO: 16318 - DNA, 41 bp, Xenorhabdus bovienii
  Terminator location: Contig name=SeqID_16918; Position on contig =63629..63669bp; Strand=-
cggcaagttagcaaaagtggtgttgccggttatttaggcag

SEQ ID NO: 16319 - DNA, 38 bp, Xenorhabdus bovienii
  Terminator location: Contig name=SeqID_16918; Position on contig =64361..64398bp; Strand=-
ttttacagttgatcgcgctgtgtaaattctgttgcata

SEQ ID NO: 16320 - DNA, 37 bp, Xenorhabdus bovienii
  Terminator location: Contig name=SeqID_16918; Position on contig =66112..66148bp; Strand=+
ttgctcaatgcggttattgagaaacttatcctggcgg

SEQ ID NO: 16321 - DNA, 49 bp, Xenorhabdus bovienii
  Terminator location: Contig name=SeqID_16918; Position on contig =83221..83269bp; Strand=-
taaaggtttgttttattattgaagataggttttataattttagatgatt

SEQ ID NO: 16322 - DNA, 41 bp, Xenorhabdus bovienii
  Terminator location: Contig name=SeqID_16918; Position on contig =85232..85272bp; Strand=+
ggacattccggttcttgcggatattgtcctttacgtaacat

SEQ ID NO: 16323 - DNA, 37 bp, Xenorhabdus bovienii
  Terminator location: Contig name=SeqID_16918; Position on contig =86184..86220bp; Strand=-
ttgactggtttttcatcagtcagtgtgtttttttgca

SEQ ID NO: 16324 - DNA, 48 bp, Xenorhabdus bovienii
  Terminator location: Contig name=SeqID_16918; Position on contig =87843..87890bp; Strand=+
tgaccgctatagagtaggcgctccttatagtggtcatttgcgtcatac

SEQ ID NO: 16325 - DNA, 42 bp, Xenorhabdus bovienii
  Terminator location: Contig name=SeqID_16918; Position on contig =89800..89841bp; Strand=-; Gene name=GloA
caagcggagagacttcagtctgcgcttgtagttcttgaaaca

SEQ ID NO: 16326 - DNA, 41 bp, Xenorhabdus bovienii; identical to SEQ ID NO: 16322
  Terminator location: Contig name=SeqID_16918; Position on contig =90774..90814bp; Strand=-

SEQ ID NO: 16327 - DNA, 29 bp, Xenorhabdus bovienii
  Terminator location: Contig name=SeqID_16918; Position on contig =92499..92527bp; Strand=+
gcggatcatgatccgcattttccattcga

SEQ ID NO: 16328 - DNA, 65 bp, Xenorhabdus bovienii
  Terminator location: Contig name=SeqID_16918; Position on contig =92336..92400bp; Strand=-
ttcaggaggttaatagtaggcggtaacgcctcatcgtctcattagcctctagggttctgtcgcat

SEQ ID NO: 16329 - DNA, 35 bp, Xenorhabdus bovienii
  Terminator location: Contig name=SeqID_16918; Position on contig =97695..97729bp; Strand=+
tttgtggatcgtgataccatggattaatgttgact

SEQ ID NO: 16330 - DNA, 40 bp, Xenorhabdus bovienii
  Terminator location: Contig name=SeqID_16918; Position on contig =99389..99428bp; Strand=+
tgcgtgccacttgtccaagtggtataccatgttagtcgat

SEQ ID NO: 16331 - DNA, 37 bp, Xenorhabdus bovienii
  Terminator location: Contig name=SeqID_16918; Position on contig =101940..101976bp; Strand=-
tattgcatagttagttaatgtgatattttatggtgaa

SEQ ID NO: 16332 - DNA, 47 bp, Xenorhabdus bovienii
  Terminator location: Contig name=SeqID_16918; Position on contig =103015..103061bp; Strand=+
tccggtttattcagtaaccgggataaaatcgcggagttatagtagat

SEQ ID NO: 16333 - DNA, 46 bp, Xenorhabdus bovienii
  Terminator location: Contig name=SeqID_16918; Position on contig =102628..102673bp; Strand=-
ttttattagcatgtactattatatatcgataaaattaatcaatagg

SEQ ID NO: 16334 - DNA, 50 bp, Xenorhabdus bovienii
  Terminator location: Contig name=SeqID_16918; Position on contig =109421..109470bp; Strand=+; Gene name=PinR
caccctgaaaattacactgtgaggtaattcagggtgtcattttcagaaga

SEQ ID NO: 16335 - DNA, 42 bp, Xenorhabdus bovienii
  Terminator location: Contig name=SeqID_16918; Position on contig =109901..109942bp; Strand=+
ttgttcattgtctatcgtaactgaataaaatatctatagttt

SEQ ID NO: 16336 - DNA, 43 bp, Xenorhabdus bovienii
  Terminator location: Contig name=SeqID_16918; Position on contig =115644..115686bp; Strand=-
cgagttattggtagttggctaatagcatgagttatttttcgtt

SEQ ID NO: 16337 - DNA, 44 bp, Xenorhabdus bovienii
  Terminator location: Contig name=SeqID_16918; Position on contig =118082..118125bp; Strand=-
cgcgattgcgcgcacattacgcgcattgcgttttttcctatttt

SEQ ID NO: 16338 - DNA, 43 bp, Xenorhabdus bovienii
  Terminator location: Contig name=SeqID_16918; Position on contig =118802..118844bp; Strand=+
cgacttcctgtggtgacacctggaagtcgattttgccctatcc

SEQ ID NO: 16339 - DNA, 48 bp, Xenorhabdus bovienii
  Terminator location: Contig name=SeqID_16918; Position on contig =119732..119779bp; Strand=+
tcagcctttttattcgggtacgatgggtaaggttggttctctctatac

SEQ ID NO: 16340 - DNA, 31 bp, Xenorhabdus bovienii; identical to SEQ ID NO: 16307
  Terminator location: Contig name=SeqID_16918; Position on contig =120819..120849bp; Strand=+

SEQ ID NO: 16341 - DNA, 47 bp, Xenorhabdus bovienii; identical to SEQ ID NO: 16332
  Terminator location: Contig name=SeqID_16918; Position on contig =125969..126015bp; Strand=-

SEQ ID NO: 16342 - DNA, 33 bp, Xenorhabdus bovienii
  Terminator location: Contig name=SeqID_16918; Position on contig =126786..126818bp; Strand=-
ctaccggcatcagccggtagtcgtttagtgagt

SEQ ID NO: 16343 - DNA, 75 bp, Xenorhabdus nematophila
  RNA gene sequence: Contig name=SeqID_16817; Position on contig =561..635bp; Strand=+; Type=tRNA; Gene name=Gly TCC; Product=tRNA-Val
gcgggcatcgtataatggctattacctcagccttccaagctgatgatgcgggttcgattcccgctgcccgctcca

SEQ ID NO: 16344 - DNA, 76 bp, Xenorhabdus nematophila
  RNA gene sequence: Contig name=SeqID_16817; Position on contig =642..717bp; Strand=+; Type=tRNA; Gene name=Thr GGT; Product=tRNA-Val
gctgatatagctcagttggtagagcacacccttggtaagggtgaggtcggcagttcgaatctgcctatcagcacca

SEQ ID NO: 16345 - DNA, 75 bp, Xenorhabdus nematophila
  RNA gene sequence: Contig name=SeqID_16827; Position on contig =15..89bp; Strand=+; Type=tRNA; Gene name=Undet ???; Product=tRNA-Val
gcgggaatagctcagttggtagagcacgaccttgccaggtcggggtcgcgagttcgagtctcgtttcccgctcca

SEQ ID NO: 16346 - DNA, 74 bp, Xenorhabdus nematophila
  RNA gene sequence: Contig name=SeqID_16827; Position on contig =95..168bp; Strand=+; Type=tRNA; Gene name=Cys GCA; Product=tRNA-Val
ggcgcgttggcagagtggccatgcagcggattgcaaatccgtttacctcggttcgactccgggacgcgcctcca

SEQ ID NO: 16347 - DNA, 87 bp, Xenorhabdus nematophila
  RNA gene sequence: Contig name=SeqID_16827; Position on contig =176..262bp; Strand=+; Type=tRNA; Gene name=Leu TAA; Product=tRNA-Val
gcccaggtggtgaaatcggtagacacaagggatttaaaatccctcggccttatggctgtgcgggttcaagtcccgccctgggcacca

SEQ ID NO: 16348 - DNA, 87 bp, Xenorhabdus nematophila
  RNA gene sequence: Contig name=SeqID_16829; Position on contig =5651..5737bp; Strand=-; Type=tRNA; Gene name=Leu CAG; Product=tRNA -Val
gcgagggtggcggaattggtagacgcgctagcttcaggtgttagtgtccgtatggacgtgggggttcaagtcccccccttcgcacca

SEQ ID NO: 16349 - DNA, 77 bp, Xenorhabdus nematophila
  RNA gene sequence: Contig name=SeqID_16834; Position on contig =651..727bp; Strand=-; Type=tRNA; Gene name=Val GAC; Product=tRNA-Val
gcgtccgtagctcagttggttagagcaccaccttgacatggtgggggtcggtggttcgagtccactcggacgcacca

SEQ ID NO: 16350 - DNA, 77 bp, Xenorhabdus nematophila; identical to SEQ ID NO: 16349
  RNA gene sequence: Contig name=SeqID_16834; Position on contig =759..835bp; Strand=-; Type=tRNA; Gene name=Val GAC; Product=tRNA-Val

SEQ ID NO: 16351 - DNA, 76 bp, Xenorhabdus nematophila
  RNA gene sequence: Contig name=SeqID_16838; Position on contig =18096..18171bp; Strand=-; Type=tRNA; Gene name=Lys TTT; Product=tRNA- Val
gggtcgttagctcagtcggtagagcagttgacttttaatcaattggtcgcaggttcgaatcctgcacgacccacca

SEQ ID NO: 16352 - DNA, 92 bp, Xenorhabdus nematophila
  RNA gene sequence: Contig name=SeqID_16846; Position on contig =53686..53777bp; Strand=-; Type=tRNA; Gene name=Pseudo TGA; Product =tRNA-Val
ggagaactaaccctaacggtaagggagctgtcttgaaaatagctagtagccgagaaatcggtgtctcagttcgaatctgagattctccgcca

SEQ ID NO: 16353 - DNA, 482 bp, Xenorhabdus nematophila
  RNA gene sequence: Contig name=SeqID_16847; Position on contig =2..483bp; Strand=+; Type=rRNA; Gene name=LSU_RRNA; Product=23S ribosomal RNA
gggataacaggctgataccgcccaagagttcatatcgacggcgggtgtttggcacctcgatgtcggctcatcacatcctggggctgaagtaggtcccaaggggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttg

SEQ ID NO: 16354 - DNA, 127 bp, Xenorhabdus nematophila
  RNA gene sequence: Contig name=SeqID_16847; Position on contig =535..661bp; Strand=+; Type=rRNA; Gene name=AJ414146 [D:103391..103624]; Product=5S ribosomal RNA
aaaacagaatttgtctggcggccatagcgcggtggtcccacctgatcccatgccgaactcagcagtgaaacgccgtagcgccgatggtagtgtggggtctccccatgtgagagtagggcactgccag

SEQ ID NO: 16355 - DNA, 77 bp, Xenorhabdus nematophila
  RNA gene sequence: Contig name=SeqID_16860; Position on contig =70490..70566bp; Strand=-; Type=tRNA; Gene name=Arg TCT; Product=tRNA- Val
gcgcccttagctcagttggatagagcaacggccttctaagccgtaggtcacaggttcgaatcctgtagggcgtacca

SEQ ID NO: 16356 - DNA, 1393 bp, Xenorhabdus nematophila
  RNA gene sequence: Contig name=SeqID_16862; Position on contig =81..1473bp; Strand=+; Type=rRNA; Gene name=AJ414141 [D:14272..17178]; Product=23S ribosomal RNA
ctgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16357 - DNA, 127 bp, Xenorhabdus nematophila; identical to SEQ ID NO: 16354
  RNA gene sequence: Contig name=SeqID_16862; Position on contig =1546..1672bp; Strand=+; Type=rRNA; Gene name=AJ414146 [D:103391..103624]; Product=5S ribosomal RNA

SEQ ID NO: 16358 - DNA, 76 bp, Xenorhabdus nematophila
  RNA gene sequence: Contig name=SeqID_16862; Position on contig =1759..1834bp; Strand=+; Type=tRNA; Gene name=Thr GGT; Product=tRNA -Val
gctgatatggctcagttggtagagcacacccttggtaagggtgaggtccccagttcgaatctgggtatcagcacca

SEQ ID NO: 16359 - DNA, 127 bp, Xenorhabdus nematophila
  RNA gene sequence: Contig name=SeqID_16862; Position on contig =1855..1981bp; Strand=+; Type=rRNA; Gene name=AJ414146 [D:103391..103624]; Product=5S ribosomal RNA
taaaacagaatttgcttggcagcaatagcgcggcggtcccacctgaccccatgccgaactcagcagtgaaacgccgtagcgccgatggtagtgtggggtctccccatgtgagagtagggaactgcca

SEQ ID NO: 16360 - DNA, 555 bp, Xenorhabdus nematophila
  RNA gene sequence: Contig name=SeqID_16865; Position on contig =1..555bp; Strand=+; Type=rRNA; Gene name=AJ414159 [R:133847..136753]; Product=23S ribosomal RNA
gcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16361 - DNA, 127 bp, Xenorhabdus nematophila; identical to SEQ ID NO: 16354
  RNA gene sequence: Contig name=SeqID_16865; Position on contig =628..754bp; Strand=+; Type=rRNA; Gene name=AJ414146 [D:103391..103624]; Product=5S ribosomal RNA

SEQ ID NO: 16362 - DNA, 77 bp, Xenorhabdus nematophila
  RNA gene sequence: Contig name=SeqID_16866; Position on contig =189344..189420bp; Strand=-; Type=tRNA; Gene name=Pro TGG; Product =tRNA-Val
cggcgagtagcgcagcttggtagcgcaactggtttgggaccagtgggtcggaggttcgaatcctctctcgccgacca

SEQ ID NO: 16363 - DNA, 76 bp, Xenorhabdus nematophila
  RNA gene sequence: Contig name=SeqID_16868; Position on contig =27328..27403bp; Strand=-; Type=tRNA; Gene name=Gly GCC; Product=tRNA- Val
gcgggaatagctcagttggtagagcacaaccttgccaaggttggggtcgcgagttcgagtctcgtttcccgctcca

SEQ ID NO: 16364 - DNA, 76 bp, Xenorhabdus nematophila; identical to SEQ ID NO: 16363
  RNA gene sequence: Contig name=SeqID_16868; Position on contig =40765..40840bp; Strand=-; Type=tRNA; Gene name=Gly GCC; Product=tRNA- Val

SEQ ID NO: 16365 - DNA, 76 bp, Xenorhabdus nematophila
  RNA gene sequence: Contig name=SeqID_16868; Position on contig =41449..41524bp; Strand=-; Type=tRNA; Gene name=Gly GCC; Product=tRNA- Val
gcgggaatagctcagttggtagagcacgaccttgccaaggtcggggtcgcgagttcgagtctcgtttcccgctcca

SEQ ID NO: 16366 - DNA, 77 bp, Xenorhabdus nematophila; identical to SEQ ID NO: 16362
  RNA gene sequence: Contig name=SeqID_16868; Position on contig =78933..79009bp; Strand=-; Type=tRNA; Gene name=Pro TGG; Product=tRNA- Val

SEQ ID NO: 16367 - DNA, 87 bp, Xenorhabdus nematophila
  RNA gene sequence: Contig name=SeqID_16868; Position on contig =79040..79126bp; Strand=-; Type=tRNA; Gene name=Leu CAG; Product=tRNA- Val
gcgatggtggcggaattggtagacgcgctagcttcaggtgttagtgtccttacggacgtgggggttcaattcccccccttcgcacca

SEQ ID NO: 16368 - DNA, 76 bp, Xenorhabdus nematophila
  RNA gene sequence: Contig name=SeqID_16868; Position on contig =79142..79217bp; Strand=-; Type=tRNA; Gene name=His GTG; Product=tRNA- Val
gtggctatagctcagttggtagagccctggattgtgattccagttgtcgtgggttcgagtcccattagccacccca

SEQ ID NO: 16369 - DNA, 74 bp, Xenorhabdus nematophila
  RNA gene sequence: Contig name=SeqID_16868; Position on contig =79314..79387bp; Strand=-; Type=tRNA; Gene name=Arg CCG; Product=tRNA- Val
cccgtagctcagctggatagagcgctgccctccggaggcagaggtctcaggttcgaatcctgtcgggcgcgcca

SEQ ID NO: 16370 - DNA, 77 bp, Xenorhabdus nematophila
  RNA gene sequence: Contig name=SeqID_16870; Position on contig =195106..195182bp; Strand=-; Type=tRNA; Gene name=Asp GTC; Product =tRNA-Val
ggtgcggtagttcagttggttagaataccggcctgtcacgccgggggtcgcgggttcgagccccgtccgcaccgcca

SEQ ID NO: 16371 - DNA, 1497 bp, Xenorhabdus nematophila
  RNA gene sequence: Contig name=SeqID_16873; Position on contig =194..1690bp; Strand=+; Type=rRNA; Gene name=AY278673 [D:1..1497]; Product=16S ribosomal RNA
agattgaacgctggcggcaggcctaacacatgcaagtcgagcggcagcggggggaagcttgcttccccgccggcgagcggcggacgggtgagtaatgtctggggatctgcccgatggagggggataaccactggaaacggtggctaataccgcataacctctgtggagtaaagtgggggaccttcgggcctcacgccatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaatagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatttgctggagacagcgaagtgccttcgggaactgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacc

SEQ ID NO: 16372 - DNA, 77 bp, Xenorhabdus nematophila
  RNA gene sequence: Contig name=SeqID_16873; Position on contig =1777..1853bp; Strand=+; Type=tRNA; Gene name=Ile GAT; Product=tRNA -Val
aggcttgtagctcaggtggttagagcgcacccctgataagggtgaggtcggtggttcaagtccactcaggcctacca

SEQ ID NO: 16373 - DNA, 76 bp, Xenorhabdus nematophila
  RNA gene sequence: Contig name=SeqID_16873; Position on contig =1978..2053bp; Strand=+; Type=tRNA; Gene name=Ala TGC; Product=tRNA -Val
ggggctatagctcagctgggagagcgcctgccttgcacgcaggaggtcagcggttcgatcccgcttagctccacca

SEQ ID NO: 16374 - DNA, 366 bp, Xenorhabdus nematophila
  RNA gene sequence: Contig name=SeqID_16873; Position on contig =2390..2755bp; Strand=+; Type=rRNA; Gene name=LSU_RRNA; Product=23S ribosomal RNA
gaggcgaaccgggggaactgaaacatctcagtaccccgaggaaaagaaatcaaccgagattcccccagtagcggcgagcgaacggggagcagcccagaaccaacatcagcatcagcgtcaggagaacggtctggaaaggccggcagtaaagggtgatagccccgtatctgaagacactggtggtgtgagttcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagc

SEQ ID NO: 16375 - DNA, 2355 bp, Xenorhabdus nematophila
  RNA gene sequence: Contig name=SeqID_16873; Position on contig =2770..5124bp; Strand=+; Type=rRNA; Gene name=AJ414159 [R:133847..136753]; Product=23S ribosomal RNA
gtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatcttcgggggtagagcactgtttcggctagggggtcatcccgacttaccaacccgatgcaaactgcgaataccgaagaatgttatcacgggagacacacggcgggtgctaacgtccgtcgtgaagagggaaacaacccagaccgccagctaaggtccccaagtcatggttaagtgggaaacgaagtgggaaggctcagacagccaggatgttggcttagaagcagccatcatttaaagaaagcgtaatagctcactggtcgagtcggcctgcgcggaagatgtaacggggctaaaccatgcaccgaagctgcggcagcaacatttcgatgttgttgggtaggggagcgttctgtaagcctgcgaaggtgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccggccgggcgacggttgtcccggttcaagcgtgtaggtgggaagaattggtaaatccgttcttctgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16376 - DNA, 127 bp, Xenorhabdus nematophila; identical to SEQ ID NO: 16354
  RNA gene sequence: Contig name=SeqID_16873; Position on contig =5197..5323bp; Strand=+; Type=rRNA; Gene name=AJ414146 [D:103391..103624]; Product=5S ribosomal RNA

SEQ ID NO: 16377 - DNA, 127 bp, Xenorhabdus nematophila; identical to SEQ ID NO: 16354
  RNA gene sequence: Contig name=SeqID_16874; Position on contig =124..250bp; Strand=-; Type=rRNA; Gene name=AJ414146 [D:103391..103624]; Product=5S ribosomal RNA

SEQ ID NO: 16378 - DNA, 2355 bp, Xenorhabdus nematophila; identical to SEQ ID NO: 16375
  RNA gene sequence: Contig name=SeqID_16874; Position on contig =323..2677bp; Strand=-; Type=rRNA; Gene name=AJ414159 [R:133847..136753]; Product=23S ribosomal RNA

SEQ ID NO: 16379 - DNA, 366 bp, Xenorhabdus nematophila; identical to SEQ ID NO: 16374
  RNA gene sequence: Contig name=SeqID_16874; Position on contig =2692..3057bp; Strand=-; Type=rRNA; Gene name=LSU_RRNA; Product=23S ribosomal RNA

SEQ ID NO: 16380 - DNA, 76 bp, Xenorhabdus nematophila
  RNA gene sequence: Contig name=SeqID_16874; Position on contig =3418..3493bp; Strand=-; Type=tRNA; Gene name=Glu TTC; Product=tRNA -Val
gtccccttcgtctagaggcctaggacaccgccctttcacggcggtaacaggggttcgaatcccctaggggacgcca

SEQ ID NO: 16381 - DNA, 1497 bp, Xenorhabdus nematophila
  RNA gene sequence: Contig name=SeqID_16874; Position on contig =3598..5094bp; Strand=-; Type=rRNA; Gene name=AY278673 [D:1..1497]; Product=16S ribosomal RNA
agattgaacgctggcggcaggcctaacacatgcaagtcgagcggcagcggggggaagcttgcttccccgccggcgagcggcggacgggtgagtaatgtctggggatctgcccgatggagggggataaccactggaaacggtggctaataccgcataacctctgtggagtaaagtgggggaccttcgggcctcacgccatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaatagcgctgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatttgctggagacagcgaagtgccttcgggaactgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacc

SEQ ID NO: 16382 - DNA, 630 bp, Xenorhabdus nematophila
  RNA gene sequence: Contig name=SeqID_16875; Position on contig =453..1082bp; Strand=-; Type=rRNA; Gene name=LSU_RRNA; Product=23S ribosomal RNA
tcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagccttgatttatcagggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatcttcgggggtagagcactgtttcggctagggggtcatcccgacttaccaacccgatgcaaactgcgaataccgaagaatgttatcacgggagacacacggcgggtgctaacgtccgtcgtgaagagggaaacaacccagacc

SEQ ID NO: 16383 - DNA, 76 bp, Xenorhabdus nematophila
  RNA gene sequence: Contig name=SeqID_16876; Position on contig =37191..37266bp; Strand=-; Type=tRNA; Gene name=Trp CCA; Product=tRNA- Val
aggggcgtagttcaattggtagagcaccggtctccaaaaccgggtgttgggagttcgagtctctccgcccctgcca

SEQ ID NO: 16384 - DNA, 77 bp, Xenorhabdus nematophila
  RNA gene sequence: Contig name=SeqID_16876; Position on contig =37275..37351bp; Strand=-; Type=tRNA; Gene name=Asp GTC; Product=tRNA- Val
ggtgcggtagttcagttggttagaataccggcctgtcacgccgggggtcgcgggttcgagtcccgtccgcaccgcca

SEQ ID NO: 16385 - DNA, 127 bp, Xenorhabdus nematophila; identical to SEQ ID NO: 16354
  RNA gene sequence: Contig name=SeqID_16876; Position on contig =37427..37553bp; Strand=-; Type=rRNA; Gene name=AJ414146 [D:103391..103624]; Product=5S ribosomal RNA

SEQ ID NO: 16386 - DNA, 1900 bp, Xenorhabdus nematophila
  RNA gene sequence: Contig name=SeqID_16876; Position on contig =37626..39525bp; Strand=-; Type=rRNA; Gene name=AJ414141 [D:14272..17178]; Product=23S ribosomal RNA
aagtcatggttaagtgggaaacgaagtgggaaggctcagacagccaggatggttggcttagaagcagccatcatttaaagaaagcgtaatagctcactggtcgagtcggcctgcgcggaagatgtaacggggctaaaccatgcaccgaagctgcggcagcaacatttcgatgttgttgggtaggggagcgttctgtaagcctgcgaaggtgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccggccgggcgacggttgtcccggttcaagcgtgtaggtgggaagaattggtaaatccgttcttctgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16387 - DNA, 76 bp, Xenorhabdus nematophila; identical to SEQ ID NO: 16373
  RNA gene sequence: Contig name=SeqID_16877; Position on contig =609..684bp; Strand=-; Type=tRNA; Gene name=Ala TGC; Product=tRNA-Val

SEQ ID NO: 16388 - DNA, 77 bp, Xenorhabdus nematophila; identical to SEQ ID NO: 16372
  RNA gene sequence: Contig name=SeqID_16877; Position on contig =809..885bp; Strand=-; Type=tRNA; Gene name=Ile GAT; Product=tRNA-Val

SEQ ID NO: 16389 - DNA, 76 bp, Xenorhabdus nematophila
  RNA gene sequence: Contig name=SeqID_16881; Position on contig =124550..124625bp; Strand=-; Type=tRNA; Gene name=Phe GAA; Product =tRNA-Val
gcccggatagctcagtcggtagagcaggggattgaaaatccccgtgtccttggttcgattccgagtccgggcacca

SEQ ID NO: 16390 - DNA, 127 bp, Xenorhabdus nematophila; identical to SEQ ID NO: 16354
  RNA gene sequence: Contig name=SeqID_16887; Position on contig =95983..96109bp; Strand=-; Type=rRNA; Gene name=AJ414146 [D:103391..103624]; Product=5S ribosomal RNA

SEQ ID NO: 16391 - DNA, 542 bp, Xenorhabdus nematophila
  RNA gene sequence: Contig name=SeqID_16887; Position on contig =96182..96723bp; Strand=-; Type=rRNA; Gene name=AJ414159 [R:133847..136753]; Product=23S ribosomal RNA
ctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16392 - DNA, 90 bp, Xenorhabdus nematophila
  RNA gene sequence: Contig name=SeqID_16888; Position on contig =17117..17206bp; Strand=+; Type=tRNA; Gene name=Ser GGA; Product=tRNA- Val
ggtgaggtgtccgagaggctgaaggagcacgcctggaaagtgtgtatacgtgaaaacgtatcgagggttcgaacccctctctcaccgcca

SEQ ID NO: 16393 - DNA, 90 bp, Xenorhabdus nematophila; identical to SEQ ID NO: 16392
  RNA gene sequence: Contig name=SeqID_16888; Position on contig =17334..17423bp; Strand=+; Type=tRNA; Gene name=Ser GGA; Product=tRNA- Val

SEQ ID NO: 16394 - DNA, 77 bp, Xenorhabdus nematophila
  RNA gene sequence: Contig name=SeqID_16889; Position on contig =43456..43532bp; Strand=+; Type=tRNA; Gene name=Pro GGG; Product=tRNA- Val
cggcatgtagcgcagcttggtagcgcaccgtcatggggtgtcgggggtcgtaggttcaaatcctatcatgccgacca

SEQ ID NO: 16395 - DNA, 75 bp, Xenorhabdus nematophila
  RNA gene sequence: Contig name=SeqID_16889; Position on contig =171780..171854bp; Strand=+; Type=tRNA; Gene name=Arg CCT; Product =tRNA-Val
gtccccttagttaaatggatataacgagcccctcctaagggctagttgtaggttcgattcctgcaggggacgcca

SEQ ID NO: 16396 - DNA, 76 bp, Xenorhabdus nematophila
  RNA gene sequence: Contig name=SeqID_16889; Position on contig =177723..177798bp; Strand=-; Type=tRNA; Gene name=Val TAC; Product =tRNA-Val
gggcgattagctcagttggtagagcatctcccttacaaggagggggtcatcagttcgaatctggtatcgcccacca

SEQ ID NO: 16397 - DNA, 76 bp, Xenorhabdus nematophila
  RNA gene sequence: Contig name=SeqID_16889; Position on contig =177805..177880bp; Strand=-; Type=tRNA; Gene name=Lys TTT; Product =tRNA-Val
gggtcgttagctcagttggtagagcagttgacttttaatcaattggtcgcaggttcgaatcctgcacgacccacca

SEQ ID NO: 16398 - DNA, 76 bp, Xenorhabdus nematophila; identical to SEQ ID NO: 16351
  RNA gene sequence: Contig name=SeqID_16889; Position on contig =177910..177985bp; Strand=-; Type=tRNA; Gene name=Lys TTT; Product =tRNA-Val

SEQ ID NO: 16399 - DNA, 76 bp, Xenorhabdus nematophila; identical to SEQ ID NO: 16351
  RNA gene sequence: Contig name=SeqID_16889; Position on contig =178016..178091bp; Strand=-; Type=tRNA; Gene name=Lys TTT; Product =tRNA-Val

SEQ ID NO: 16400 - DNA, 76 bp, Xenorhabdus nematophila
  RNA gene sequence: Contig name=SeqID_16892; Position on contig =140439..140514bp; Strand=-; Type=tRNA; Gene name=Met CAT; Product =tRNA-Val
ggccccttagctcagtggttagagcaggcgactcataatcgcttggtcgctggttcaagtccagcaggggccacca

SEQ ID NO: 16401 - DNA, 76 bp, Xenorhabdus nematophila
  RNA gene sequence: Contig name=SeqID_16895; Position on contig =2911..2986bp; Strand=+; Type=tRNA; Gene name=Phe GAA; Product=tRNA -Val
ggaactttggcgtagagggttcgcgcggatgcctgaagagcattaggactcggttcgattccgagaggttccacca

SEQ ID NO: 16402 - DNA, 76 bp, Xenorhabdus nematophila; identical to SEQ ID NO: 16401
  RNA gene sequence: Contig name=SeqID_16895; Position on contig =47445..47520bp; Strand=+; Type=tRNA; Gene name=Phe GAA; Product=tRNA- Val

SEQ ID NO: 16403 - DNA, 85 bp, Xenorhabdus nematophila
  RNA gene sequence: Contig name=SeqID_16895; Position on contig =308965..309049bp; Strand=+; Type=tRNA; Gene name=Tyr GTA; Product =tRNA-Val
ggtggggttcccgagcggccaaagggagcagactgtaaatctgccgtcacagacttcgaaggttcgaatccttcccccaccacca

SEQ ID NO: 16404 - DNA, 77 bp, Xenorhabdus nematophila
  RNA gene sequence: Contig name=SeqID_16897; Position on contig =62000..62076bp; Strand=+; Type=tRNA; Gene name=Met CAT; Product=tRNA- Val
cgcggggtggagcagcctggtagctcgtcgggctcataacccgaaggtcgtcggttcaaatccggcccccgcaacca

SEQ ID NO: 16405 - DNA, 77 bp, Xenorhabdus nematophila; identical to SEQ ID NO: 16404
  RNA gene sequence: Contig name=SeqID_16897; Position on contig =62153..62229bp; Strand=+; Type=tRNA; Gene name=Met CAT; Product=tRNA- Val

SEQ ID NO: 16406 - DNA, 77 bp, Xenorhabdus nematophila; identical to SEQ ID NO: 16404
  RNA gene sequence: Contig name=SeqID_16897; Position on contig =62306..62382bp; Strand=+; Type=tRNA; Gene name=Met CAT; Product=tRNA- Val

SEQ ID NO: 16407 - DNA, 85 bp, Xenorhabdus nematophila
  RNA gene sequence: Contig name=SeqID_16897; Position on contig =184984..185068bp; Strand=-; Type=tRNA; Gene name=Leu CAA; Product =tRNA-Val
gccgaagtggcgaaatcggtagacgcagttgattcaaaatcaaccgccttcgggtgtgccggttcgattccggccttcggcacca

SEQ ID NO: 16408 - DNA, 77 bp, Xenorhabdus nematophila
  RNA gene sequence: Contig name=SeqID_16897; Position on contig =268196..268272bp; Strand=-; Type=tRNA; Gene name=Met CAT; Product =tRNA-Val
cgcgggatggagcagcatggtagctcgtcgggctcataacccgaaggtcgtcggttcaaatccggctcccgcaacca

SEQ ID NO: 16409 - DNA, 90 bp, Xenorhabdus nematophila
  RNA gene sequence: Contig name=SeqID_16897; Position on contig =268330..268419bp; Strand=-; Type=tRNA; Gene name=Leu GAG; Product =tRNA-Val
gccgaggtggtgaaattggtatacacgctaccttgaggtggtagtgcctaaacaacgggcgtacgggttcaagtcccgtcctcggcacca

SEQ ID NO: 16410 - DNA, 76 bp, Xenorhabdus nematophila
  RNA gene sequence: Contig name=SeqID_16899; Position on contig =770..845bp; Strand=-; Type=tRNA; Gene name=Asn GTT; Product=tRNA-Val
tcctccatagttcagttggtagaacggcggactgttaatccgtatgtcactggttcgagtccagttggaggagcca

SEQ ID NO: 16411 - DNA, 76 bp, Xenorhabdus nematophila; identical to SEQ ID NO: 16389
  RNA gene sequence: Contig name=SeqID_16901; Position on contig =243..318bp; Strand=-; Type=tRNA; Gene name=Phe GAA; Product=tRNA-Val

SEQ ID NO: 16412 - DNA, 76 bp, Xenorhabdus nematophila; identical to SEQ ID NO: 16389
  RNA gene sequence: Contig name=SeqID_16902; Position on contig =2394..2469bp; Strand=-; Type=tRNA; Gene name=Phe GAA; Product=tRNA -Val

SEQ ID NO: 16413 - DNA, 93 bp, Xenorhabdus nematophila
  RNA gene sequence: Contig name=SeqID_16905; Position on contig =169..261bp; Strand=+; Type=tRNA; Gene name=Ser GCT; Product=tRNA-Val
ggtgaggtggccgagaggctgaaggcgctcccctgctaagggagtatgtggttaagagctgcatcgagggttcgaatccctccctcaccgcca

SEQ ID NO: 16414 - DNA, 77 bp, Xenorhabdus nematophila
  RNA gene sequence: Contig name=SeqID_16905; Position on contig =272..348bp; Strand=+; Type=tRNA; Gene name=Arg ACG; Product=tRNA-Val
gcatccatagctcagctggatagagtactcggctacgaaccgagcggtcggaggttcgaatcctcctggatgcacca

SEQ ID NO: 16415 - DNA, 77 bp, Xenorhabdus nematophila; identical to SEQ ID NO: 16414
  RNA gene sequence: Contig name=SeqID_16905; Position on contig =434..510bp; Strand=+; Type=tRNA; Gene name=Arg ACG; Product=tRNA-Val

SEQ ID NO: 16416 - DNA, 77 bp, Xenorhabdus nematophila; identical to SEQ ID NO: 16414
  RNA gene sequence: Contig name=SeqID_16905; Position on contig =598..674bp; Strand=+; Type=tRNA; Gene name=Arg ACG; Product=tRNA-Val

SEQ ID NO: 16417 - DNA, 1687 bp, Xenorhabdus nematophila
  RNA gene sequence: Contig name=SeqID_16906; Position on contig =54..1740bp; Strand=+; Type=rRNA; Gene name=AJ414141 [D:14272..17178]; Product=23S ribosomal RNA
ctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccggccgggcgacggttgtcccggttcaagcgtgtaggtgggaagaattggtaaatccgttcttctgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 16418 - DNA, 127 bp, Xenorhabdus nematophila; identical to SEQ ID NO: 16354
  RNA gene sequence: Contig name=SeqID_16906; Position on contig =1813..1939bp; Strand=+; Type=rRNA; Gene name=AJ414146 [D:103391..103624]; Product=5S ribosomal RNA

SEQ ID NO: 16419 - DNA, 77 bp, Xenorhabdus nematophila; identical to SEQ ID NO: 16384
  RNA gene sequence: Contig name=SeqID_16906; Position on contig =2015..2091bp; Strand=+; Type=tRNA; Gene name=Asp GTC; Product=tRNA -Val

SEQ ID NO: 16420 - DNA, 76 bp, Xenorhabdus nematophila
  RNA gene sequence: Contig name=SeqID_16908; Position on contig =164272..164347bp; Strand=+; Type=tRNA; Gene name=Asn GTT; Product =tRNA-Val
tcctccatagttcagtcggtagaacggcggactgttaatccgtatgtcactggttcgagcccagttggaggagcca

SEQ ID NO: 16421 - DNA, 88 bp, Xenorhabdus nematophila
  RNA gene sequence: Contig name=SeqID_16914; Position on contig =39452..39539bp; Strand=+; Type=tRNA; Gene name=Ser TGA; Product=tRNA- Val
ggaggggtggccgagcggctgaaggcagcggtcttgaaaaccgccgatgggaaaccatccgagagttcgaatctctcctcctccgcca

SEQ ID NO: 16422 - DNA, 76 bp, Xenorhabdus nematophila; identical to SEQ ID NO: 16401
  RNA gene sequence: Contig name=SeqID_16914; Position on contig =52268..52343bp; Strand=+; Type=tRNA; Gene name=Phe GAA; Product=tRNA- Val

SEQ ID NO: 16423 - DNA, 76 bp, Xenorhabdus nematophila
  RNA gene sequence: Contig name=SeqID_16914; Position on contig =79289..79364bp; Strand=-; Type=tRNA; Gene name=Thr TGT; Product=tRNA- Val
gccggcttagctcagttggtagagcaactgacttgtaatcagtaggtcaccagttcgactccggtagccggcacca

SEQ ID NO: 16424 - DNA, 88 bp, Xenorhabdus nematophila
  RNA gene sequence: Contig name=SeqID_16914; Position on contig =79371..79458bp; Strand=-; Type=tRNA; Gene name=Ser TGA; Product=tRNA- Val
ggaaggatggccgagcggtcgaaggcagcggtcttgaaaaccgccgatgggaaaccatcctagagttcgaatctctatccttccgcca

SEQ ID NO: 16425 - DNA, 948 bp, Xenorhabdus bovienii
  unsure (1)..(948): unsure at all n locations
ngcaaagccttgcanntgcctgcaggtcggccgatgatcgtttctatcgtgggcgcgtgattgtaaagataccagccgccaggcggaacatagatgaatgtcagatcctgttctgtcagatccggtgaaatttgtggattcaccagagtgactttaccgggcaaggcttcaaatgctgcatacaatttacgggtcagtacgccaatatcctgtgggctggcactcacacttaaattgttacgccgggcaaagcggatcaaattgcgataactcatcatcatggtatccagtaattcattatgagcatcacgcactagcccgattttccatgaattacggttatccagcattgccaatttgctggcatcccaaccccattcatgcgccagctgcgacatgacctgatggcgccatcctgtacagcctttatcctcgtggcttcccagcatcttttcgcaaactttcaggtaaaaacaacggcgcgccagatccagacgcgtgaaatcgttcgttgcggtgagataacgggttacacgctcaagcatcatgctataagaatcaaggccgaaggaaacaatagaaccatcatggaaatgctgtttcatctccattgacagcaattttccgttcggatattcccatgaataggcctccagcagcagacttttcaaaactgctttataaggagagtcaacactcttgtagagctgccacaggcttgccccanaatattcttctgctgacagttcgttcaacccgcccagatccagccactcgtttggcgtcaaacaccttgggcataaagagaaagcacatattcgtcatactggccctcttcttccacagaaccatcatccacaacaagcgcttacctgccataacagaccgaagtgcgataaaattcatccagccaagggtatgctggggtgttccggcatccttccccgt

SEQ ID NO: 16426 - DNA, 888 bp, Xenorhabdus bovienii
  unsure (1)..(888): unsure at all n locations
ttgnnnnnnnnnnnnnnnnnnnnnnnnnnnnnnnnnnnnnnnncacaggccatgaagataattgctgatcgccgccctgacacgttcccaagtcggctggttgtttggctcgaacatagcaaagctcatcgcgcgcttaacatcccgctcgacggtattaaacaggcggcgcacagggacatagcgccagttgtcactatcttccaacgttcttgcaccccaaactgtagtgccagttcggatcatattgatgacactaccagaggtatatacccactgctatacgcccgggaccaagaacgcaagctctaaagccccttttaaggcaacattaacggcagctttacacactgctcgacatacttcaactgaggcataaaccgctgccatcgccgcactcgtcggaatgctcgctttagcccacgccgttttcaaccacggttaatagaccgcagaatactgcgtggcggaatacttgtcctttcgactcttctgtcccgtttatcgtcaactctgtttcagattcttcaaaagaggcatataacccttttcctgcctgtcatactagactgactgacgtattaattgcttctccagtagccaccagcagggtcacatcatccaaagcagcaataatagttgctaaactcttatcttggctgttatatcagtagacatcgccattgccaacatatgccccgcaaagaagccaccaaattatctgtattatcatattcacccgccaatttaccagatccatccaggattaatacgggatgcagaccgttcgcgtatagctcgttggatcattgcccggaaaacagcacctgagcggcccttttggaacgcataggctaaccattaacttcctcattaaccccccgcaaa

SEQ ID NO: 16427 - DNA, 893 bp, Xenorhabdus bovienii
  unsure (1)..(893): unsure at all n locations
tgatacnnnnnnnnnnnnnnnnnnnnnnnnnnnnnnntagtcaaataaatttgagttttatttgaagtgatattgcacttgttctagttgctttatgttgtgttggcataaatcaccaaaaagggggagattgaaagggaaatgtgcccttgggccatttctaagtattttggtgattgagtgccaacacaagtgcttaaatgtgaatttatgctcatggatggacaaagtgcaaatcaagagtaaaggtatgtttctaagccttagtacattggttttatgtactaatatacttgtctaagtgttagaaacagaaagaaaagagatgaaaaaaggcttggctgggtacagccaagactcngcttggtctggcacaccggactgtccggtggtgcaccggacagtgtccggtgcgccaggctgactcggcgcgaagtggccgctctcgggaattcaccgacggcgtacggctaaaattcaccggactgtccggtgagccaacggtcggccgcgcgatctgcgcgggacacgtggccgagccaacggctagaagggggcaccggactgtccggtgcgccaacggctctctggcggccaacggtcggctgcgccattttagaaaggaaatcgggcacgacangggggcccggggtgcaaccggactgtccggtgcacccgacgacagaaagcaagattggccttccagatttgctctcaacggctcctagctgccttgggactataaaagggacccctaggcgcatggaggagaacaccagcaaccttagagcattcttgatcatccacactcaagccttgcgcattcgtttgtcattctcagggatttgagcttcgttctagggaaaccttgaaatagtcttttgagctccatt

SEQ ID NO: 16428 - DNA, 787 bp, Xenorhabdus bovienii
  unsure (1)..(787): unsure at all n locations
tgatacgaattcagctcgacccgggatctctgagcgaccagccctataagtatncgcagaccctcgtatagaacccacacgctatttcctaggtgggacaaacacgctggttactgcgggggaggcacacgcttttattttccacctaaaggggggggcgcgggactttgtaccgaaaataatggggccccgggatttcaaaatgttggcggggcccacaggaccaaaaaaagggggttttttaaacggggggggggcccccccccgtactttttttgggggaaaggggggtcaccaaaaaaaacattcccgggtggggttttgggggggggggtgaaaaaaccacggggggggccccccaaccccccccccccctttaaattttaacccgggccccccccggggggggggggggggggggccccccccctttttataaaaataaaaaaagaggggggggtgtgtatatatatacccgcgcccgcggggggggggccccattccctctaaataaaaaaaccccggcgggggggtggtaaaaaaaaagggggggggggggtttttaaatttngcgcgtctttttttttttggtggcgcccgccccgggggggggggggtttttttaattaaaaaacacacaccacctccccccccccccccgcctggttggtgtttttataaaaaacaaaacaaacaccggttggtgtgtaaaaaaaaaaaaggggggccgctcccccccctccccaacacaccaaaaaaaaaaaaaaaaaatggaaatgttatctta

SEQ ID NO: 16429 - DNA, 996 bp, Xenorhabdus bovienii
  unsure (1)..(996): unsure at all n locations
nnnaaaggggnnnnnngttttnnnaattttggnnggccccctggggcgcnaagncgggaaaaaaagaaagattaannctaataaggtancgatcgtnctcgngntnctctaggatctgtatcgccggcagaaaccatgaaaaccttaaacccgggaatagggggttttaaaccggaattttggaaaagtgatttgtgggaacaaaaaaaacctttttttttaaaacaaaggggttttttttgtgttcccccataaaaaaaaccggggggggaaaaattttttttaaaaaagcggcccccccaaaaaaaaagaaaaaatttttttttttttattttttttttggggggggggaaatattttttttttcttgtggggggggggggggggggggagaaaaaaaaaaaaaaaaaaaaaaaaaaccccccccccccacgaaanaaaaaattttttgttttttttttttattgggggtttttttttaaaanngnnnncnccccccccccctcccccccccccaaaaaaaaaaaagaaaaaaatttttatttttttttttttttttttttttttttctctccccccggcggggcggggggggggggggagaaaaaaaaatataacacacgggcggggcggggcgcacggggagatggggtcttttaaaacccctcttttttcctccccccggtggtgggggggggnnnnaaaaaaaaaaaaaacacgcgcgggggggggggggggggggagggggnaaaaaaaaaaaaaaaaaaaaaaaaaaggaagnttttttttttttttttttttttttttttttctttccccctcncnnnnnnnnnnnnccacnaaaaaaaaaaaggagagggggggggggggggggggggggtttnnnnnnnnnnntctttttctctttttttnnnnnntnatgaangnggggggaggaggagaaggaaaannnaaanacnncnccacccccccatccaccttttaattattatttta

SEQ ID NO: 16430 - DNA, 1018 bp, Xenorhabdus bovienii
  unsure (1)..(1018): unsure at all n locations
gtgtttgggnnnacttttgcggggngaggccnggaccccggggaggaaaaaagaaagtattttaaaaaaaaagactacaagaaaaaaaaaaaaccccgttttccgggggggcttcttgagaaaaaacccccccccccccaaagaaaaagtattaaccccctccccccccccggggggggggggggagaaagaaattttttaaatattaataaaaaaaagagcggggggggggcggggggggggggtttttgtctctctcgcccaccnccataaaaaaataaaaaaaaagaaagaaagggggaggggggaccccaaaagaaaaaaaaaaaaaaaaataatgaaagcagggggtntgntaatttgttgttttggtntgttgtccaccncaaaacaaacaaaaaacaaaaaaaanaaacnaatatattattatttnccgcgcttttcttcttttgcgttgtgntggtgnngggtgttttnnnnnnnttcaactccccctccccaaaaaaaaaaaaaaaaaacaaaaatttattatttttttttttttnnnggtggtgatatggagaataaaaaaaataataaatnnnnncgnccccccccccccacaaaaaaaaaaaaaaaaaaaaaaaaangnggggaggggggccggncccccncncccgccccccggcgggtgggtaggnttttttttttttttttttttgttttggngggggcgccgggnccgcggcnggggnnnggnnccccccccccccccgctctaacnccgncccatcaaatnaaaaaaaaaaaaanacnaatttattttatttttttttttttttntcgaacaacgacaaacataaaacaacaaaaannagcggcaaaagaggggcgccncatttttgtttttatatgaaatnaaaaanaatggttcttcaatttagaaagaaaaaagaggggggaggggngggnntgtntgggttctttttttttcgccccccaaaccaacaaaaaaaaacgctataaaaagtaaataaaa

SEQ ID NO: 16431 - DNA, 808 bp, Xenorhabdus bovienii
  unsure (1)..(808): unsure at all n locations
gaacatcgaccggaccggggatctcataccatggcaggggggatgaaaaaccggcaaaaggggaaggctccgaaacccatgggggaaagggaaaccccgggggacccccccccgggaaacggggggactttaaaacccgggggggggggccccccccggggggggggcccattttttggaaccccccggggggggcccttgaaaaaaaaaagggggggggggggggcgggattttttttttttttttccccccacccggcccccccaaaaaaaaaaaaaaggggggaaaaaaaaaaaacccccccccccccccccaaggggggggggggggggggggaaaaaaaaaccccccccctcctttttttttttgttgaggaagagaaaaaaaaaaagggggggggggggcgcaaaaaaaaaaaaccccccccgggggggggggggcgccccacccccccagggcgggggggggggcgccccccctcttctttttatttttgtgggggggggcaccccccccccgagaacaaaaaaaaaaagaggggggggggactctctcccaactggcgggggggggtgttttttccctccccccccccaaagaaaaaaaaacaaggggtggggggggaaaagaagaaagggggggcacccccccccccccccgtggggaaaaaaaaagaaacaaccgtcgggggggcaaaccaggggtgctcccccccccccccccggttcgcgttttaaacgaaggccggaaatcggtttatatggtgaaattttccaattccctganaccccctatttactatagcgg

SEQ ID NO: 16432 - DNA, 1092 bp, Xenorhabdus bovienii
  unsure (1)..(1092): unsure at all n locations
agatacgattcgagctcggtaccnncggggaatcncntnncntnaaaggnnnaagnnnnnttnncccnnttttnaaaancccnnnnnnnnnnnnnnnnnnnnnaaaaaagaggggggnaaaaaggggggnaaaaaatttttttanannnnnnnnnnnnnnnnnaaaaaaaaaaaaaaaaaaccccccttttttaaaaaaaaaaaaaaagggnnnaaaaaaaaaaaggnnaaaaaaaaaaggggggggggggcccccccgggggggggggggggnnnccccccctttttttttctccccccccgttgtggggggggggttttttttaggaagggaacccctaaagncctaaaaaaaaaaatttggcgcggttttttaaaatattaaggggccaaaaataaaaaaaaatttggggttttaaaaaaaattttcccnacccccaaaattttaaggggaaattttaaaattttaaaaaaccggggaaattttctcaaaaaaaccgtgggaaattccctttggaaaggccaaagggggggaaaaaaaaaaggggtgttttttaaaaaaagggggaaaccccccctttttttaaaacacccggttttggggaagacccccccccccccccctaaaaaaaaaaaaggggggtgtttttttttttttaaaaaaaaacaaaaaaaaaaattgggggagaaaaaaaaaagattnnttttttctcccgcggggggggggggaaaaaaaaaaaaaaaacacccaccacacccccctcttttgtggtggggggggggggcaaaaaaaaattcttttcataaatataaaaaagggccgccggggggggggatgtcttccccccccccccacacaaaaaaaaaaaaaaaaatcgggcgcggcgcgcgcccgttttttataaaaaaaaaaacacccccgccccgggaggggggnnnnnaagaagagggggggggggggttttttttttttttttcctncccccccccggcgggggggggggggccgcgaaaaaaaaaaaaaaaaaaaacaaataaaaaaaaaatgttttgtgggggcggcgcccccccccccccaaaataaaaaaaaaa

SEQ ID NO: 16433 - DNA, 985 bp, Xenorhabdus bovienii
  unsure (1)..(985): unsure at all n locations
nnnnnnnnnnnnnnnnnnnnnnnnnnnnnnnnnnnnnangaggnnnnngnggcccttccnactttacnaactncnctncccccnnnnttcccccactatnccccccggggggggggtgtttcccccccacccttcctctctccccttttgcccccggggccgggcggccggccnacccccanccnngccccccgccccccccccccgggagagagaaaaaatttttttttttntttttaaaaaanaaaccccccccccgccccccccnnnnnnnnnnnnnnnnnnnnttatataaaaataatnttattaataaaaannnnnnccgccccccccccncnnnggggggggggggggaaaaaaaaaaaaaccccccccccccccccccnnnnnnncccccccccccccccccggggnggnntttttttttttttnnnnnnnnnnnnnnnnccccaccccccccccccctcanccccccccncnnccccntcccccggggggnnnggtgnngnntgngggngggggggggggggggggnnnnnnnnnntnnttttttttttttttaaaagaaaaaaaaannncccccccncccntccctccccccttttttntnnnnnnnnnncccccccccccccccccnttnnnggggggggggggggggggaaaaccaaaaggggggggggggggggggggaaaataaatatatatatnnnnnncccccccccccccccccccccccggagagagaataattttttntttttnccgnnnnngnnnnnnnnnnnnnncccananaaccccnagnannnnaggnggagggaggggagggnnnnnnnnnagnnnnnnccccccccccccccccnccctntnttnnnttnnnnttnnnttntnttttnnnnnnnngnnnnnnnnggggggggagagaaaagaaaaaanannnngnnnnnnnagggagggagagaaaaagggagaaagggagttttctctt

SEQ ID NO: 16434 - DNA, 1107 bp, Xenorhabdus bovienii
  unsure (1)..(1107): unsure at all n locations
nnaaaagggggggnnnnnnnctttnnnncaattttatnnnnnngcgggccagggnnnncncngggngggagggnnccgcnagagaggggaaaanangngtaantgttttttaaaaaaaaaanggcgaattgnagttnnananncgaagnccngcggnnntcccccggggggnntaaccctnntcagaaagacccccggncggntttcggccccctccaatgggaagggggcttttcgggggccctggggggcggggggggggggggaaattgtgggggggtttggggaaaaaaaaaaggccggggggaaaaataaaaaaaaaaactccggaaacaaaaaaaaaaaaaaaaaaaaggccgcgggttcctccgggaggggggggttttggtgtgggccaaattcgccggaaagaggagttaacaccaccccccccacaaaaaaaaaaaaaaagcggcccccccaaagaaaaacggggggggagaaaatttttttggggggggagaaaaaaaaaaaaaaaatgggaaaaaaaagaggggcgggggggaaaaaaaaaaaacaacccccccggggggagggaagaaaaaaaaaaaaaagagggggggggggggttttttgttttttttaattggggggggggggagaaaaaaaaaaaaaaaaaaaccggcgcgccgcgggcgcaccataatttttttttttttttgtttgggggggggggggggggagggggggggggggggaacaatnaaaaaaannnnngggaggggggggaaaaaataaaaaaaaggggggaggggggggggggggtgttttgcaaccccccccggggggggggggaaaaaaaaaaaaaaaaaaaaanccccggggggggggcgncccccccccaccccccnnggccggggggggggggggggggggggcccccccccccccccccccaaaaaaaaattttttaaaaacacacccccccccggngggggggggagggaaaaaaaaaaaaaaaaaaaaaaaaaaatatattttggggggggggggggggggggggggcgcgcccaaaaaaaaaacncnnnnaaanaaaaaaaaaaannagtggggagggtggggcgggca

SEQ ID NO: 16435 - DNA, 793 bp, Xenorhabdus bovienii
  unsure (1)..(793): unsure at all n locations
tacttcgattcagaccgtactcgngatcctctgagtcntgatgctgctaatantttatttattcattattattcgaccaaaaantaaaacctcgttccgatatggcccggggaaattcacattcttttttctttggaaattttggcacaaaaggccttgttaatttttttatattttgggcccggggaatattttctggaaaaaatttggggggggggggggggcccaaaaccccgcgcccccctctttttttatttataacggggggggggggggcccgcttcttcctaaaaaaggggagaattttttgggggggggggtttttttttttttttgggggggccaccaacccttttttttttttttttgttggcccccaaaaaatatcccccgcggaagaaaaaaaaaaaaaaaaaaaaaaaactccccgccgggggggggggggggggggtggccacaataaaaaaaaaaaatttttgaggggggggggcgccccctccttttttttttaaaaaaaaaaaaaaaaaaaaaaataaaaattttttttttttttttctcccaccaccaaccacaaaaaatatatttttttttttttttcctccccccccgggggggggggcggcgctctttctttcccccttataaggaaaaaaaaataccatantnnnctctctataacacacaaaaaaagagaaagagggtgtttgtttttttttattatcttaaaccccacaaaccccccccccgcggggcgggggggggggtgttttttttttccccctcaaaaaaaaaa

SEQ ID NO: 16436 - DNA, 1285 bp, Xenorhabdus bovienii
  unsure (1)..(1285): unsure at all n locations
nnnccaaaaggggggggnnnnnnnnnnnnngcgcttctgnnnnnnncccattatacttggggggggggcggccggcccccccncnngnncgggccccgggggggcaggctntcnccncnccgccccttggagaaggcnncccagcaancanccaaaaaaaaaaaatgtaattttttaaaaaaaaaaaaaaaggaaggtacttcnggagaggaaaaaaggggggaaaaccggggggttaaaagggggggggggaaaaaaccccctcttgggggagaagaaacccccgaaaaagaaaatgggggggagggaggggaacaaaaccnnnaaaaaaaatttttatataagtgggggccccgcggggggggggaaaaaaaaaaaaaaaaggggggggtttttctcttttttgtgggggttaaaaaaaaaaggagggggggggggggcnnccccncccccaaaaaaaaaaaaaggggggggggtggggggaaaaaaaaaaaaaaaaaaaaaaaggggcnngccccccccgccggcgggggggggcggggggggggggngtaaaaaaaaaaaaaaaaaaaaaaaaaaaaaaaaaaaaaaaaaatttttttgaaagggggggtggccgggcccggccccaaaaaaaaaaacaaaaaaaaaaannagnnggngggggggggggggggggggggnaaaaannncnncnnaaaaaaaaaaaaaaaaagntatattntttgttnnttnnnnnggagggggggggggggggggggnggggggggnncnnnncnccccccccccaaacaaaaaaaacannnaaaaaaaaaaaaaaaaaaaaaacagnngggcagtcaaacatacccctcnnngncttctcccccccccnnnncaaaacgggccgccaaacaacaaacnaannaaaaaaaaaaaaaaaaacaacccacaccnnnnnncnaaaaaacggnnnnnggggaggggggggggnagagggngggnangggggggnggngggggagaggannnaaagagggaggnnnnnnanaaaaaaaaaaannnnaaaaaataattnttttttttttatatataatttnnagaagaagagaggaggagggnnnnnagagaggaggagggaggagtnnnnnnnnnnnnaaaaaaaaaaaaaaaaaaaacaaaaaaacaaaaaaacgcccctcttttttttttttttgttttgggggaagaaaaaaaaaaaaaaaaannngnnngggggnnnnnnntntnnnnnaantnntagaagaaaaaagacccgcgaccccca

SEQ ID NO: 16437 - DNA, 1143 bp, Xenorhabdus bovienii
  unsure (1)..(1143): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttaaaattccaagttcgtcccccggggatcctctagaagccgtagttcgatcccgatgagcttatgcaatagacttaggatagtagatgtatttgtacggtctggcgtatatttcgtgaatgaatgcgctattccctgttttgaggaggtgcaagtcttcttatgccagaaccctcccactgttgtgaggtcttcgcgcttcgactatcctcctgagtatcccgcgggagaaatgattgttatttggncactaatttattttttataatccaacgccccggcgtgaatacaaagaaaaaacaaaaatttttttnntttttttttncccccaagagcccttttcggnggttaaaccncccgcngnggnggnnaattccctttccnttaagaaagnnntccccccccctttaaaaaaatttggccccccnttaacgggggccggggtttttttttaaaaaattaaaaacctttcccgccctcccttaaatgtggtttggggtttccgggaagggaaaaaaataaaaattcccccccttaaaaaaaaaaccccaccttttcaatgggaaaaggagcctttttatttttttaaaaaaaggaaaatttttttggttttggcgggttggggggcccaaaaaaaaaatttttttttttgggggtttttttccggcacccccttcttctaaaaaaaaattttcgtcgaaattttggggctttttttaaacaaccccctttgggggcccccatttagggggggggttttcccttttttcccccccacaaaggtggtgtttaaaaaaaaaagggggggaaaaaaaaaaggnnattttttttttgggccccccctgaaaaaaaaaaacccccccccccctcttgtttttttataaaacggggggggtgttttccccccccaaaaaaataattttttttttaaaaccccttttttaaggggggggggcgcccccccccggggggggntaaaaagaggggggggaaaaaaaaaaaaaacccccccccccggcgtttttttttgttgggggggggagtttt

SEQ ID NO: 16438 - DNA, 825 bp, Xenorhabdus bovienii
  unsure (1)..(825): unsure at all n locations
gactggggctgctgcggttggtgcctattcggcaccatgcgtcttttctcgtgcattctcctcatgtccatatatcacgcccatcttgccattgctatcatcgttcaggaaccgcaggtcttctggattgttggggcgaatttccccgcgtttggttggtacccaggggaaaccttttggaaattaaaaccaccccggcccaaatggcgaggttcccccaaccggcgggggatttttttgggggcccctttgtgaaaaattttttttatttaaaaaaaaacggttttttttcccccccccccccgggtttaccacgggtttttttcccccccccccccggggaaaaatcccccccccgccaaattttttttgtttgggggggggggagcggcccccccccatttttttgttgggcgaaagaaaaaaaaatttttttgtttttggtggggnnnggggnnnnnnnaattttttttttataggggaaggggggggggggtgggttttccccccccacaaaaaaaaaaaaaggcggcgccgcccgcaaataaaaaaaaataaattgtggggggggggggggggggggagaaaaaaaaaaaaaaaaaaaaaagagagaaaaaaataaaaaaccctccctctttcccctcccccccncncncnnnnnnnnnnagaanttaaaggaaagaggaggggggggaggccccgggggtttcgcctctcttctttttttttttaaaaataaaaaaaacaaaaaaaaaanaaaaaaagggggngcggggggggggtgggnttntttgctttttttttcttataaagtatttaacaaaa

SEQ ID NO: 16439 - DNA, 1027 bp, Xenorhabdus bovienii
  unsure (1)..(1027): unsure at all n locations
nnnnnnnnnnnnnnnnnnnnnnnnnnnnnnnnnnnnnnnnttaacctcgcttagggcccgatnnaaaaaannnnggnnnnnnnnnnnnggcagctgctgctgcaggtcataccatacggatcagctgaggaccttcatggtaagcaggtccgtccggaaaaattttcgtttatggggggaattacgggggaaatggaaaagggcccccggggggaggggctccaaaaattggggggggggggccccccccccccctccgccatattattaaagaagccgcggggtggatatatttttctctcccacaccgggggagagttcccccccgcaaaaacacccccccccttttgtggggggaaggcccccctctctttttaatattttttggtggcccccccccacccccccccccgccccctctttttttttttgaaaaccacccccccccccgcggtttttttttttcttccggcggggggggggggggggggcaacacccccccccccccatctttttattttataatcacaggacccccggggcgggggggtttttatttttnnaaaaaaaaaaaaaaaaaannnnnnggggggggttggcgcttctttttttttttttttggggggtggggaggaaaaaagagaaaatatttttattttttttttttatattttaaataaaaaaaaaagagaccccccccccccgcgcgccgggcgggnggcggncgcccccccccccccccccccctctttttttaaatatacaaaaaaaaaaannaannacccccccccccccccccccccccccccgccncncgcccccccccgcgcgcttttgttttgttttttttttttattataaaaaaaaaaaaaaaaaaaaaaaannaaanaggananngnnnggacccccccccccacccccccccccnnnnnnncccnnntnnntttttttttttttgtgttttgtgggggggcgcggcgcggcgccccccnccccgctctagcagactagagtaatgatagagaa

SEQ ID NO: 16440 - DNA, 814 bp, Xenorhabdus bovienii
  unsure (1)..(814): unsure at all n locations
ttgtcgatctagtcggtcccggggtctccctgaattcttgtgagagggggttatatcaacccgctgtgtttttttttttttttttgggggggttcctccccccccacgagaaaaaaaaatggggggggggggtttttattccccccaaacaaatatagttgggggctttgggccccggcccccctttttttttagggaaaaaaaaaatttttttgatttttcccccccccccccttttgggggaaaaaacgagaaattttttttgcgccctttttttgttgtttgtgggggggggggggggccccccnccccctccccccccccaaaaaaaaaaaaaaaaaaaaaatttttgtaattttgtgggaagacccccccctttttggggccccctggggggggaaattttttttttttttttcttcggggttttttttttttttaaaaaaccggggggcccccccgggggtgggtttttttttttataaataaaaaaaaaaggtgtggggggggggggagaaaacacgcggggggggtttaaacacaggttttttttttttttttttttttcccaaacattttttttttgttttcgccccgccccccgttagtaaataaacatgtttttttcttctttttttttttcttcgaacctacnnaacgncagagggggggggggggggggggagaaaacagcacccactcccctccccctctcttttcttcttctttttttgtagggcggtgggcgggaggcgcgctccctcctttaaattatttttctttttcccccccccacntcctgnctcttttgttt

SEQ ID NO: 16441 - DNA, 907 bp, Xenorhabdus bovienii
  unsure (1)..(907): unsure at all n locations
tgatacgnnnnnnnnnnnnnnnnnnnnnnnnnnnnnnnnnntaanttcacattcgtacacatgatctgcaaagcaggggtcgactgaccgtagctttttgcccaatggaaattggcaaacagcccccaaaactgttattcggggttcctccaaaataaaaaacccccgcccttaaaagggttcttgggaaaaccgggtttttgcccccccaaaaatttttttgaaaaagtcgttttttggggggggggaatttttttttattttgggggcccaaaaaaacctccggggggtttctccccaaaaattttttttttttttcccacccccggtggttgaaaaaaaactgccgttgggggggaagaaaaaaaccccctttttttttttcccccccccccccccctcttcttcctaaaaannnnaaaattaaaacccccccccccccccgcgggggggggggggggggattattttaaaaataaacccccgccgcccccccaacccattattaaggggtttgttgtgggggtgggagaaaaaaaaaaaagaagaaacagagaaatttttttttttttttttttttttttttatataaaaaaaaacacagagggaggangggggggggattttattttttttttttattaaaaaaaaaaaaacaccaccccccaccacctttggtttttttttttgtttttttttttttttttttgggggggcggggggggggaaaaaaaaaaatataaattttttttttattttgttttcttttcttttttttttctcccccncccccgggggccaaaaaaagaaaaagagaagagcccnttttttttcttttcccccgccaatattatttttatagtgggggggggggggggagaagaaaaaaaaaaaatataaataaaaa

SEQ ID NO: 16442 - DNA, 899 bp, Xenorhabdus bovienii
  unsure (1)..(899): unsure at all n locations
nnnnnnnnnnnnggggggggggnnnnnnnnnnnnnnnnnnnnnnnnnnnnnnncctttcttgnggcngcnggcngncngncnngnngnnnncnnnggnnnnnnnnnnggnnnncnnncnnnnnnncnnnncnnnnnncnggcggggggnnnncnnggggggggnnncccncccnnnccccncngggggnnnnnccnngggggcgcgnccggggggggcnnnnnnnnnnncncnnncccgggnnnnncnctnnctntccggggggggggggggggccnnnnnnnccggggggggnnnnnnncnnnngggggnttaacggggtttttttaaaaaaaaaaaaaagggggctctaactttaatcgtggggccttgggnccctcgggnccggggntttttccccccgggcccttaatttttnnnaaaaaaaaaaacggaaaccgggcccctttttttgggggccgggtataaaaccccggggccccttaaggnnagaaatgggggggcccgcggaaaaccccggatggggaaaaacactctttttttcaccccaccgnggggggttttttgggggccgggaaaaaggaagagccccnncccccccaagaaggggggccttttttttcccaaaaattttcccccgggggaccccccaaaattttttnccaaaataagggggggggaaaaaaatttttttttagaaaacaccccccccccgtaaaaaaaaaaaacaaataaataaagggggcgcccccccccttcggggagggggcccccccccgggggggggagaaaaaaaaaacccccccgcggaaaaaaaaagtgtttttttggggggaaaacacaacaaaaaaaaaaaagaaattcttttttggtgaagaaaaaaaaacccccttgttgttt

SEQ ID NO: 16443 - DNA, 1178 bp, Xenorhabdus bovienii
  unsure (1)..(1178): unsure at all n locations
ngggaaaaanggggggggngnngnnnnnnggggggccngggggggcccatttttggggggngcnccccccccttggcggcggcgccggggcgncccccgcncccgggaggcnncnnggcaancngggcnaaaaaaatgtaattttttaaaaaaaaaagaaacncttcttgacgggggngnnnnnnagaaaaaaacccccgagctttcncgnnnnnctggnnnnatananantnntaggggnncggggnnctnttnnaagaggncnaacgnnnaantantatncggttttttatatncttttncccatncctattccggtttccgggttttattttccggggncccttttcctttatattttttcggggcccccccaaaacaaataatccaaggggtttcccaaaaggaaaaggtggcccctccttaatcggtgggaccccagggaacccgggggaaaaaccacacccaaccgcggaaaaatttccaataggggaattaaaaaaaaaagggggccaaaaatgggggaaaacacggcggggggaaagaggggaaaaacatcttttttaaaaagagagggggggggaaaaaaaaaaagggtaaaaaaattcttggggggcacccacaaaaaaagggggggggggggggagaaaaaacccctcttttaaaaaaaaaaaacgcgaaaaaaaaaagagggttcttttttatttttttgcgcgcgcccccctaaagaaaaagggggggaaaaaaaaaaaaaaaattttttggggggaaaaaaaaaaaaaaaaaagaacaccccccccacaagagggggggggggggtttttttttggttttttcccccggggagtgttaaaaaacaacagagaaggggnccggggggggggggggggcccccccccccccctttttttttttccttttccgcaaaaaaaaaattttttttttaaaaaaaaaggagggggggggcccccccccccaaaaaaaaaaaaaaaagaaaaaaaaaacttggttttttaaggggggggggggggggggggaagaatatatataataataatcccccccccccccccccgccggggggggggaggggggagaaaaaaaaaaaaaaaaaaaaaaaaaaaaaaaacccccccccgcccccaaaangggaaaaaaaatttattttttttttttta

SEQ ID NO: 16444 - DNA, 779 bp, Xenorhabdus bovienii
  unsure (1)..(779): unsure at all n locations
ggggggggggnnngnnngngggaatattttggggcccngctttggggnggagcnncnnnagngnggaggggngncggttgagaggcnanggacanggntantagttttttnngnnnnnnggaaataaatgttggggntgggaaaagcggggggtttttntgtttatggggnggaaaggggaaaaaaggggggaaaaaggggggggggggtttaaaggcaactttttttttaaaaaaaaaaagggggggggggtttaaacccccccgggggaaaaaaggggggttttttaatgggggggggggggaaaaatttttttttggggggaaaaaaaaggggaaagggggggggaaaattttttttccaaaaaaaaaaaaaaaaacccccccgggggaaaaaaaaaaaaaaaaaaaaattttttttttttttttttttggggggggaagagaaaaaaaaaaaaaaaaaaaaagggggggggggggggggggggggggaacgcaaaaaaaaaaaaaaaaaaaaaaaaaaaaaaaattagggttttgggnnnnnnncccgngggggggggggggcgnncccccccccccnnnntttctctttnataaaaaaaaaaaaaaaaaaaaaaaggggggggggggggttgnngnnnnntttttttttttttttttnnnccgcgcgcgccgcgnnccccccnnnngggggggggggggggggnngnnnntnttnntnntnntatataaaaaaaaaaanaannananangcccnngtgtgttggggggtggggg

SEQ ID NO: 16445 - DNA, 721 bp, Xenorhabdus bovienii
  unsure (1)..(721): unsure at all n locations
ncagctgctgctgcngtcagcagatacttgtccgcagcagatgacaccgcacgtctgaccaaagagaacagcgctgcaattccctctgganttgagcttatgatgggcacggagggggttccattacccccggggggcccccaaaaccctggtttggaaattcccatgggacccccctttggtggggggagggcccaaacccggccgccctttttaaagaaaatcccccgcgccgggaagggtttccccccccgggggccccccgggttttttttaaaaaaacgcccttttatttttccccccccggggggaaaaccccccggggtttttattaaaaaaggagggggccccccccccccccccccttttttaaaagaggggggggatcttccccccctctttaaaaaaaaaaaaaaaaagggggggggggaagaaaaaccttcctccccctggcgcgggggggaagaaaaaaagaaagggggggtttttttaaaaaaaaaaaaaacccacattctttttttgttgcccccccaggggggaaccccgggagagaaaaaaaaaaattttttttttctttttttttttcccaacaatagccgggggggggtttttttttttttataaaggggggggggcccgcccccccccccccctttttttttttttaaattaaaaaaaaaaggggggnnnnnnnnnnnccgttatttttttacatgccccc

SEQ ID NO: 16446 - DNA, 601 bp, Xenorhabdus bovienii
  unsure (1)..(601): unsure at all n locations
cccgcccaaggcngntgngtttttnggctcttgctgccgcagtctataaaagcaaaatcttgctgattgaaataaccagnnnntaggnnncccgnnnccctttnnnnnnaaaaantaaaaaaattnnnngggggggggannnnaaaaaaccccannnccccccgggggtttttttnnnnnnaaataaaaactttttttnnnnnnnaaacccaaaccgaaaaaagtatttaaggctnccactggaaattttaaatttccctcctggggcccatccctagaaccaaagaccgttaagtaaagcccctgggtttttagacaaggataaggccaatcccccctggttttgaagccttgaagggccaaaccccaaagggccccccttaaaaaaccggaggtgccccccaaacttgtttgtaccccaaggggaaacccccccgttttttttaagaagtgggttttttcccaaaaaaaaaaaaaaccccggacctcaaaaaaaaaaaggcttccaccccccccgaaaacaccccggggttttttttttcccccccgaaaaaaaacccccccgggcccccccccccaaaaaaatttgggggggggtctc

SEQ ID NO: 16447 - DNA, 768 bp, Xenorhabdus bovienii
  unsure (1)..(768): unsure at all n locations
nnnnnnnnnnnnnnnnnnnnnnnnnnncaactttggggggccnnncnnnnnnccannncgctttttttttaaannnnnnnnnnancacaanctttaggggattctttgtttttatatnnggcggggggggggnnnnaaaaaaaaaaaaaannnncgggggcnngggggggggaaaaaaaacccccccccccnnnggggggggggggggggtttttttnnnnnnnttttttccaccacaaaccccccncggcgggggggggggggaaantaanccccnnnnctnnggaaggggaatnccccccgggccctnncccnnccttnttntnnccctnncctgggggggccccccncctcnttnncccntttttgggggttttccccaggnnaaccccccccaaanaaaaaaaaaaacgggggnggacccttgggggttgggtttaaaacccccgggtaaaccccgggccaaaaaaaaaaagagggggccccaaggccagggccaaaccctaaaaaaccaaaaggggccgggcccccccccgaggggaaaataaaaaccccctttgtgggggccctttgggggcgccaaaaaaaaacggccccaggagggggggccctttttttaaaaaaaacccccccggggggccggggggggggtatcggcgcccccccccggggggttttttttnttccccccccaaagaggggggcccttttggggggggggggggggaaaaaaaaaaaaaaaaaaanncccccccttnttcccaccaa

SEQ ID NO: 16448 - DNA, 705 bp, Xenorhabdus bovienii
  unsure (1)..(705): unsure at all n locations
aaaaacagtggcggacctagcaagacttggaaatnnnnnnnngggggttnnggnnggggggggnnnngntgggggggccncnaaaaaaaaaggattaaaaaaaaaaaagctactgagaggaaaagggaaaaaccgggtttaccgggggggtaaaaccctttaaaaagaaaacccaaaaaaaaaaaaaggggaaaaagagggcggggaaaaaaaaaaaaacccgcggggagggggaaaaaaagggggaggggggaaaaaaaaaaatttttggcggggggaaattttttttttaaagggggccttttaaaaaaaaccccaaaaggaaaaaaaaagggggggaggccccccaaaaaaaaaaaaaaaaaaaaaatttttaaaaaaaaaaaaacccccaaaaaaaaaaaaaaaaaaaaaggggggggaagaaaaaaaaaggggccccaaaaaaacccnntntggggggtgaaagggttggggggggggggcccttctctttcgtaaaaaaaaaaaaaaaaaaaaaaaaaataaaatttcttcttccccccnnnngggggggggggggggnnnnnnaaanttaaaaaaaaaaaaaaaaaaaaaaaaaaaaaaaaaattttttttttttttaaaaaaannaaaaaaaaaaaaaaaaggggagaggggggggggggggggggggggggccacccaccccaaacccccacccaa

SEQ ID NO: 16449 - DNA, 758 bp, Xenorhabdus bovienii
  unsure (1)..(758): unsure at all n locations
gctttttatcctgagcatacgtttttcattcantggnggcgatggggtctttnnttncnnttaatggggtagggcntnntnnctntccttggggggggtnnnnantnnnnnnngnnnnnnnggttnttttttttnnnnnnnnnngggcccccttttttacttttgngnncctaaannccctttgnncccgagttcttcatanncgacaaaacnncggtnaaaatnacccggggnctaccccctgttaaatacggcttaanaacaaaaaacgtncttggcccaattcaaaccctttttcaaaccaaaaacaccccccaaaatatttccccttacccccaaaatttgggtttccaaaaaaaaaccccacccccccaaaaaaatttttcccccggttttcttgggaaatttttaaaaaaagggccccttttaaaaaaaacccctcttttttttttttaaaaaaaacccccttttttttttttacaaaaggagggggtttttttttttttcttttttttttccccccccccccccaaaaaaaaggggcccctttttgcccccatttttttttttttatttttttaaagcgcccccccccacacaaaaaaaaaaatttttccccccaaaaaaattttttttttttccccccccccccccttttttttttttttttttttccccccccnnncccacccccccaccaaatttatttttttttttttttttaccaacaaaaaaaaaaaaacccctctttttttttt

SEQ ID NO: 16450 - DNA, 1161 bp, Xenorhabdus bovienii
  unsure (1)..(1161): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcttaatcccccgggccctcttattntntttaattcctcatcctgactaattatggttttaacatcccccctgcttctcgggggaatnnccnccnnccnngggnnnnnngggcccaaaacttttncattcccctgccaaggnnntccctttttttaatcaaaaaaaggggggaacaataattnntgnccaacaaattttntccntccccaatccggncgggggcgggggaaatttaaaagccaaaaaatgggaagcccaaggaaaaaacaaccattaaaaattcccccccttttataatccccccaactnaaaaaaaagaaaaacggggaaatccttttcaattcctttgaaaaatttcaaagcgggttttccccccaataaaaaaaaaaaagtctttgaaatcccaaaaaaaataaaagggggccccccccccaaaaaaaaaatttttcccccccgggggaaaaagggaaaaaaaaaaaactgggaaaggggggttttttttgaaaaaaatggggccccctaaaagaaaaaaaatggggggggggggggggggaaaaatatttttttccccaccccccctcttttttttttgtgagggggccccccccccccaaaaaaaccccacaaaaaaaaaaaaaatgttgtgggggagaaaaaaaaaaaaaaaaaaaaaaaaaaaccccttctctcttcttcttgttttgttttaacacccccccccttctttataaaaaatttccccccccccccccccccccttcttttattaatatagagaaaaaaaagaaannnnaaaaaaaaaaatttcttttcttttttataaaaaaaaaacacaccccccccccccccccccccccaaaaaaaaaaaaaatatttttctccctccccccccacccaccccgcgaggcggcagataaatatattttttttattcttccttttacacaaaaaaaaaaaaaaaaaaaacaaacannnnnangnggggngaagaaaaaaaaaaaaaaaaataatgtttaccccccccacaccccccacccccctccccaatcaaacaaaaaaa

SEQ ID NO: 16451 - DNA, 988 bp, Xenorhabdus bovienii
  unsure (1)..(988): unsure at all n locations
nggcccagactttgncatgnccntgncaggnntcaaaaccccctctcttttttttttgtctagggcgccacccaaccattaaaaacggggaacaaggtggaacattttcttccttggnaccccaacccaacccccggggttaaaatccccggtcccaattggaataaaaaacaggaattaatttggccccttttttcttataagggaaaaagcccccccctttgtgcttttatataaagggttttcacaaaaaaaaccttggctttgggggaaaaaaaaaaaataaaaaagggggggggggggggaattaaaaattgggggggaaaaaacccttttttccccttttttggaaaaaacaaaaggggggggaagaaatccccccgggcgggtttggtaaaaaaaaagggggccccccccgggcgcgggtttttttttttgggggggggataaataaaaattatcccccccccccaaaaggggggggggggaaaaatttttttttggggggggggggtttttttccccccccnccnacaaaaaaaaaacccccccccttcttttntttttttttttttccctcccccccggggaaaaaaaaaaataaaaaataaatatnnntttttngggcgcccccccccccccccncccccccccaaaaaaaaaaaanntttttgttggtgggggggcggggtgnnnnnggagttgacgggggggggggagagaacaaaaaaccccacccccccggacgggggcgcccccgcccctttttttttttttttataataaaaaaagaaaaaaaanacaccccccttcttcttttttttgtagattgtaaaagaaaaagaagaaaaaggccncncccnctctctcccaattnaataccccgcnccccgcggggcgcgcggggccgggncngnggnnnnnnnaaaannaaaaaaaaacaatttttcttcccctcccccncaccccgctgttttttttctgtttt

SEQ ID NO: 16452 - DNA, 1042 bp, Xenorhabdus bovienii
  unsure (1)..(1042): unsure at all n locations
nnnnnnnnnnnnnnnnnnnnnnnnnnnnnnnnnnnnnnnnnnnnnnnnnnnnnnnnnnnnnnnnnnnnnnnnnntttccnnnnnnnnnnnnnnnnnnnnncccccngggnnncccncccnnnnnnnnnnnnnnnnnnnnnnnnnnnnnnnnnnnnnnnnnnnnccnnnccnnnnncnnnnnnnnnnnncnnnnnnnnnnnnnnnnnnncnggnnnnnnnnnnnnnnnnnaaagtttatccnaatttcgnagncttcgggttacccgggggggnaatccccttcttaggaggtccaaatccaggaaatccgttccggggaacattcaaataattcctcggcaaaaaaacggggctttaaaaggggaaaaaaaaaggccccggggcttggggggtcccccccctatttaaggggcccaaaaaaagggggcccaaaaaggggggcacccccgggggggtaaaccccccccgaaggggcgcggaaaattttttgggggggggccaagggaggttctcccccgcgggggaaaatatttttttttttggcccccccccccccccccccnnaaccccttttttttttttttttttttttttttttcccgccccccccccccccaacaaaaaattttttttttttttgtggtgggggccccccccaacgaagagagggggggggggggggggccgcggcccccctctccctcccggggggggggggggggggtgttttttttttttttttttttttttttaaaaaaaaaaaaaaaaaacccttctcccccccccnnnnnnnncccccnnnttttttttgggttggtttgnnnnncnaaccacacccacccccccccccgcccngtgggnnntgtggngggggggggnaaaaaaggggaaaaaaaaaaaacaaacccacccccccccccctcccccnnttntttttttttttttttttnnnnngnggggggggggggcgggntnntttttttttttttttttnnttnngggggggggggcgggcggggcggcggcggaaaaaaaaaaaaaa

SEQ ID NO: 16453 - DNA, 773 bp, Xenorhabdus bovienii
  unsure (1)..(773): unsure at all n locations
ggaagggggnnntttncccttggnnncgcggggnnaggggaaagaagtttaaaaactggattgaccntccgcgactaagcgacagctttagacatcagcattcaagggggccggaaggcaaggtagggccaaaggtaaattggtaaaacccctgaaactcccaaacaaaatttttgggcacccgggggttaaaaaaaaaaaaccgggggccccccgggggggggggaaaaacggggggggacaaaaaaaaaaaaaaatgttttttccccgcgaaaaaaaaccccccccccacacaaaaaaaaaaaaaaaagaaaaaanngggggggggggggtttnnnngagaaaaaaaaaaaaaaaaaannnccngnnaanaaaaaaaaaaaaaaaaacacgcggggggttgttttttttctctcctttataaaaagagtgtgggagagggaggaggggggggggggggggggggcaacaaaaaaaaaaaaaaaaattttttttcttctttttttttcctcgggggggggggggggggaaaacgccgccccccccaacctacaacaatttatttttttttttttctcacaaaaaacaaaaaaaaaaaaaaaaaggggggggggggnggggggggggggggggagaaaaaaaaaaaaacgagagggnaananaacacaccaccccccgcccccccccaaaaaagagggggggggggggggggttaaaaaaaaaaaagggggcgccccccaaacacaaagagaaggggcgggtgggaaggacaa

SEQ ID NO: 16454 - DNA, 1408 bp, Xenorhabdus bovienii
  unsure (1)..(1408): unsure at all n locations
gcagaggtggcgtacgcacaagcccggcgcggcccagtctttggnnagagataaagtttnnaaaaacggnattngggggnannnnnaancccnnnnnnnnnnnngagaaaaannaaaaaaaaaaaaaaaaaggggggggggggggaaggaaaaagaggaagagggagaggggggaggagaaggaagaggggaaagaagaagaggagaggagaagaggggagaaaaaggaaagagaagagagggaaagggggaaaaggaggaaaagaaagaaggaaagaaaaggaagaagagaggaggagagaaaagaaaaaggggggggggggggaaaaanaaaaaaaaaaaanaaaaaaaaaaaaanaaanaaaanaaagaaggnaaagaaaaagaganaagagagaaaaggaagaggggagaaagaagaaaggaacgagggaaagaagagaggaaaaggaaaagaagagaaagagaagagaaagagaacgaaggaagagagaggaggagaaaagaagagaaaaagaaagaggaagaagaaagggagnnaagaccgagaaaaggaggagagagacccccccgcgaaaagaggaagaggaccaagaacgcacaccaaagagaacacaagagcacgacccacgagagagggaacagaggaggggggaaaagaacgcagaggccccgcacccaaaaagagagagagagacaagggaaaaaagaaagagcaaaagagacaaggaaacgagcagagcagaaagagcaggagaaaaagacggcagaggggagcaggaaggggaggggcaaaaagaggaaaaggcaagagcagggagagagagaaggaagagaaggaggcaagagagaagcggcagcagagcgcaggagcagaggagagccgccggcgaggaggagagacgcgagagagacagagaagcagccgcgcgcgaacaagcagccgccaagaaaagagagggaggagaaggnagagagcaggaggagagaggngcacagagcagcgcgagcnagaggagagacaaaaaacggacgcgcgacggnaagaggcacnaaggagaggagagaggagagagccgacacagcgagcagaagagagacangcagagagagagcaccgaggaggagagaacggcgacacagggaagagcgagnagaaagagagagagccgcgcacgcgacgagagaagcacgcganaggcaaccgcaggaagagcagagcaagcagaagagcacaagcgagagncgggcgagcgagaccgagagaagnaggagagagcaaggcagcngnagagcgcagagaagccagcacgagacgnggcagagagagcgagagagagcnaggcacagaaggacgaaaggagagccgagagacggagagcagagagccgacggcaggccagagagc

SEQ ID NO: 16455 - DNA, 828 bp, Xenorhabdus bovienii
  unsure (1)..(828): unsure at all n locations
gggaacccgggggatcctctagaataggtggccatggtttcagggtcataggagacagcgatgcggtttcacagaaaaaccatctcattctggatggaaccgctaaccaccggcgatgatagagctacattttttgcctaggggcggaatatcaagtagcgatatctgcccccttaccccctaccccccccccaggggttttttttccccaaaatttttcccaggaaactctttcctggggaaaaccccccccccggggggggggggaaaacaccccctttgaaaaacccccccccaccccttttttttaaaaaggggggcccccccccccttttttttttttttggagagaggggggttcacccccccctttagggggggcccccccccggaaaaaaaaaccccctcttttttttttttggggggggggttttatttttggggggggggggtttttcccccccccccccccccccccccggttttttttttatatttgtttaagggggggggggagaaagaggggttcnncccccaaaaataataatggggggggggggggggcgcccccccccccccctcttttccttgtgtgtatgaaaaaaaaaaataaaaacccccncnntcttcccctttcttctttgttttggggcgggggggggggggggaaangggccccccccccaccccccccccccccccccncggggggggggtgaaggccctccctcccccccccccccccccccaaaaaaaaaaaaaaatanaaatgtggggggggggggggggccgcccaccacccctcttctttttttatagtgggcggag

SEQ ID NO: 16456 - DNA, 494 bp, Xenorhabdus bovienii
  unsure (1)..(494): unsure at all n locations
tcttgatcgctcgtccggtcttggcgcgctatgctatctccagcacaagtctagttcgaatatctgttactgaggatcctacccttttcaaaaataattcctcaaattttccccccaaaggttttaaactttttccggggcccccaaaaaacctcttccccggggttttccccctttttaaaaacccgcttttttttcggagattttttttccaatttgggggagaaaaaaaaaaaaaacaaaaatgggggggcggggctttttttaaaaaacccccccccccccccccaaatattggtggggggggcccccccccccccnnnnaaaaaaaaaaaaaaaacacccccccccccgttttttttgaaaaaataaaaaaaaaatatctttttttttttttttttttttttaaaaaccaaaacccaaccacccccccgcggcggggggggggtgtgggttttttttctccccccccccccccgggggggggggggggg

SEQ ID NO: 16457 - DNA, 987 bp, Xenorhabdus bovienii
  unsure (1)..(987): unsure at all n locations
gggaaaaangggggggccnccccccgccctngnncccccccgcnnnnnnngncncgncccggggggccncngngncgnnncggncccgggggcccgcgcccnnccccccccccccgccggnncccgcncnccgcccaaacaacggcccccccaaaaaaaaaaaaaataaacccccccnaaccccgngnaaaaaaagcccggagaactctccccccggtttcccccccccccgggggggggaaaaccccccccccccggagagggcccccccccacaaaaaacccccccccccttcctgaggaggtgttttaaaacccccccccccccccccaagagggggaaaaaaaccccccccccctggggggggggggatacccccccaaaagggggcctttcccccacaaccccccccccttttttttaaaaaaaaaaaaaaaaacccccccccccttttacccccccccccccctgatgtgaaaaaaaaaccccccccccccttttttttgcccccccccccccccccccggggggaaaaaaaaaaaaaaaaaaacccccccccccccccccccccggaggnggggcccccccaaaccccccccccccccccccncccccaaaaaaaaaacacccaaaaaaaaagagaggannnnggcccccccttttttttttttctctcccccccccggggggcccccccccccccggggaaaaaaccacccccccccccccccccccccccccccccccccccccccccgngngggggaaaagnttaaaaaaaaaaaaaaaaaaaaaaaaaannnnnnnnnnnccccncccccccccccccccccctcccttnccccagaaaaaaagagaaaaagcggggagggggggagggggggtttttttttttttctttcccccccccccccccccccccncccaacccacaagacagcagnaagnnnnngnngngngttttttttcctttaatttcattttatc

SEQ ID NO: 16458 - DNA, 1017 bp, Xenorhabdus bovienii
  unsure (1)..(1017): unsure at all n locations
nttgtgttaattttttataccacncnanaatttttttgtcggccgcgggaaaaaaccccctcttttcccggnnntttaaacccccccgccgcgnnnggggnggnnnnnnaaataataacccccctcttttncccctttttggaaaaaaaggggagaaaaatttttttttcgcgccccccttttttttttttccccnccccccccccaccacaagaaaagannannnnnnnnnnnnnaaaaaaatttataatttttttttttgtgtgggggggnnnncngccgcccgcagccnnnnnnnnnnnnnnnnnnnnnnncccccccccccccccccccccccccccnnnnnnnnnnnnncngccccccccccncccccccctcctggtaataacaacaaccccccccctttcngnnncccncccccccccccaaaaaatttttttttttttttgggggnnnnnnnnnnnnnaaaaaaaanncaaggagaaaatttttttgggggcggggggggggtttttttgggggttttttttttccccaaacaccacctccgtagttggcccccccccccccccgcttttttttcccccccccattanttccggggncccccccgggtttttggaaaaacccctttgtccccccacgngccccactctcccttaaccgaattatgttggctccctggaaaacccccccggggggggcccccaccccacgnagaagttttttgttgngtttatttttttcccgaaaaccccgcccccccctcttgngccccctcacccccccaggaangaaggnggggnggattaaaatannttttcccccaccccccccgcgnggtttgtatnnnaattttttnntttttctccccccccccgcnggtttttattttannntttgngnttcccccccccacgggttttntttccccccggggccttccttctccccgccggnngtttttttattttaatanaaagaggaggggncgggaaattattttctcccccccgg

SEQ ID NO: 16459 - DNA, 1098 bp, Xenorhabdus bovienii
  unsure (1)..(1098): unsure at all n locations
ataatctttatgagccgnnananntnncgnagccctncggnnttacccncggnnngnnanccctnctnagnngntccggnacgtntggaagggcctnctggcatagcaattcccgggaatggtttgattcaaaagaacgtaaaaaaggatcggccttttatcccgaaaaacccctgttacgggggaatggtcccccaagaggccgggtttttgggggtttttgggttttttaaagggcgccaaaaaggggggtctttggaaaaggaaaaaaaactctggccaccgggggggcccggggaaaaaaaaaaaaccctgttttttttttcccccccccaaaaataaaaattttttttttttgtccccccccgccaaaaaacccctttttaaaaaaaagggggggggggggggggggaaaaaaaaaaaaaaaaccccccccccccacaaaaaatatattttcccccccccccaaaaaaatatttttttttttggggggggcggcgggcccccccccctnntntnttttttatnaaaaagagaaaaaatatnnnnnttttttttttttgttttcttttctcttttctttagagaagaaaaaaaaaaaagaaaaaaaaagnnggnccccccccccctcctctcccgccaaaaaaaaaaaaaaaaaaaaaaaaaaaaaaaaaaaatatttttctttttctctccctccccccccccgcaagagagnnnntttatnnatattataatataaannaaaaaagggagagagagtgggtttttttttttttttttttttanaaaaaaataaaaaaaaanaaaaaaannnnnttttttcgttttgggtttgggggaagggggnnnaaaaaaaaaaaaaccccccccccccccacataatccctctttgggtttnnnnngggggggggggggcgggcgcgctctgctttttttttatattttttttttntaanataaaaaanaaaaaaaaaaaccaaccnagcccgacacaaactcccttttgtgatagtagtgggcgcggggtttatttttttttcttttttaaaaatatttcttccacaacacaaaaaaaaacaaaaaatatgttgatga

SEQ ID NO: 16460 - DNA, 949 bp, Xenorhabdus bovienii
  unsure (1)..(949): unsure at all n locations
nagcagctgatgctgcagtaagnnaaangctttccgntcgaaaattcaagcacttgtggggggtttgcggaaaaacccaaaggggggggggtgttccctgggtaaaaaacctgtttaaaggtgggggaagaaaatttagggttttttttcaaggggttttttccccaaaaaataaaaaagggggattggtgcccggcccccctgtggttcccccaaaggagttgtggaaccccccaacccaaatatttggggggttatggggtaggccaaaaaccccccccccccccctgtttttgtcccggaaaggggggttttttctccccccccgcccttgaagggggggaaccccaaaaccccggtggttataataggcggccacccccccccaaagagaaaggggtttttttttaaaaaaaaaattttcccaaaagggaaggtggaggggggggcttttccctcttttttgtataaaacaaaagcggcacaatgggttttgggttcccccccaacacaaaaaaattttgtgggggggccccggttttttttgcccctcccccccccgccgtttttcagatttaaaaaaaaacccccccccccttttggggggtgtttttttcccccaaggggggggtttttttttattccccccttttttaaaaaccttttaaaaggggggcgcccgcgcggaaaaaaaatggggggggaggtttttattagcggcccaacacaaaaaaaaaaaaatctctccctgcccgcgggggcatcaccacaaaaaggggtgtttttttttcctccccccccccgaaaacaaccctcccttttttttttttttcggggggggggggatgctcctcccccccaaaaaaaaccgccgcctcaacacacgctgcggggggttttttttttttttttttcttcggcaaaaaaaaaaaatacaacctctcccccn

SEQ ID NO: 16461 - DNA, 932 bp, Xenorhabdus bovienii
  unsure (1)..(932): unsure at all n locations
nnnnnnggggggggnnnnnnnnnnnnnngggggnnnaagttaacgagggggggccgcccccgggaggcctnnangnnnnnnnngtctttttnnnnnnnnttaaatttacacnnatatncgngancttncggtnacnnccggggnttanccttcttangattcaggncatacattnaaaaaatgggncaattatnaaaagaccaaaattcttggggccggggnaataaagcccaagcccccggatgggtttttaaaaaaagggttcttttaaaccaccggggaccaccaaaaaaaaaaacccctcctggggccttaacacatttttcttttaataaattaaacgccgccccccctatttttaagccccttataacccccccggggggtttttttttaaaaacccccctttttttgcccccaaatacattttgggaaaaaaaaaaagcgcccccgaaagaaaaaaaatattatttttttggaaaaaaaaaccttttttttttttttttaaaaaaaaaaattttttttgggggggaaaaaaaaaatctcttcttctgttgtgggaaaaaaaacccccccttttttttttttttagaggagggggggggccccccccccccaaaaaaaaaaaaanatttttttttttgggggcggctttttttttttttttttancacccataaaatttcgggggggggggggggggttttttttttttttttaaaaagggggcggcgtcttttttttaatattaaaaacgcgcccccccgcgggggggggggnnnccccnnncccccttaaataaaaaaaaaaaaattttattttcctccgcggggccggtgtntnntnnnngggnngggggggaagggaaagaaaaaaaaaaaccncaccaaaaaaaaaaaaaaananagatnagggggggggaaagccccccc

SEQ ID NO: 16462 - DNA, 902 bp, Xenorhabdus bovienii
  unsure (1)..(902): unsure at all n locations
tgannnnnnnnnnnnnnnnnnnnnnnnnnnnnnnnnnnnnnnttgctggtattgccaatgcggtagtgggaaatacagcaacgattaactggttagcattagccggagattcaataaaatccgcgatcacattgctgcgaccattccggggtttgccgattttaataaaaaatgtgaacaaccctgtggtttctatcttggcaatgcagcggcggatctgcgtttttctacaccgagtaaaaaggcgcagttcagtgatgcctcactgccggaaaatctcttcccgcaactgggtaaaacagacgttccttttactctgcaaaccttgcgctctcacgatcaatataacaccaccatctatggtttggatgaccgttatcgtggggtttatggtcagcgggaggtgctctttatgaatccagaagatattgctttattggggtatcaagcgggagatcgggttgatatcgagacggtatggaatgatggtattgagcgcaaagtgtatggctttaagctggttccttacgccattccacgcgggaatcttgcgggctattacccggaaaccaatccattagtgccgatggatagtatcggcaatggcacgggcacaccaacgtcaaaatctgtgccgtttaaataatctctgactgagattggtgaaagcggacttcagcgccttgtataaatttttgtagctcaatgaaaaatacgccttcaatcaggaggcggtatcagattccgtcagagcggttagcgggagtgccctgttgatttttgctgtcacggttcgtccattacccgccagaagaaactttttttctcatttcccataaaaaaatcatttcctattagtttgggaagaacaatgggtattttaacctttaatccccaatatt

SEQ ID NO: 16463 - DNA, 1222 bp, Xenorhabdus bovienii
  unsure (1)..(1222): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttggaagccaggctagcttgtcagggnaagcccgcttttctctacgccgagtcccaaccgaacgcctgtttctctaccgctcacacccgaatagaatgcttatatgcggtttagccttcagctgagctgcagccagaccataccccgtgccgtgtgtaaaagagactcaaaacgtgccaacgtaccccgtccagactcacccttcccagtggagttgcaccacacatgcccgcagaacgaaaccccctgccctcccccccccgacctctcggccctcctgcccggcgaccgaaggttccacgccatctgggggggccccacaaagaaccccttttttgggcccaaatgggacccccccttgtgtcccagaggggggggtttccacaagggccccaaaaaaaatttccgccgaaaaaaaatgggggggggaaagtttcctcttctaaaaaaaaagaggggggggggaaaaatttttttttttttttggggggggaaaaaataggggggggtcaaaaaaaattttttccccccacaaagggtggggggggggctttttttccccccccccgcgcgagaaagggggcccccccccgcgcccttcttttttttttttgggggagagaaaaacccccctccttttctttgtcggcagacagtggggggaaacacaaaaaaaaaaatatttttttttttccccccccccccccccgcccgcgcgcggcccattattttttttttggggcccggcccccccaccacacaaacaaaaaaaaacaaacactntttacttattatttctcccccccccctctctgtgcggggcgggnnanctccccacaaataaaaaaaaaaagattgcgccccaatttttcttttcccctcccccccctaaaaaaaaaaaatcttatttcttttttttttttttttgggggggngcccgaaccacacaacccccctgggggcgggggggggggggtttcttttttaatattaatattataaaaaattacatcccccctcgcgggggggggggggggagttcccaccccccccccccccctngtgcgtgcggggggggcggggggggggagacctatta

SEQ ID NO: 16464 - DNA, 904 bp, Xenorhabdus bovienii
  unsure (1)..(904): unsure at all n locations
atgcttacgaattcagctcgtacccgggaacctctagagtctnaaacaaaattacggtaatggttgaaaaaattncgggatttaccgggaaaggggaataaggcgacccctttcgggaaaaaattttccgaaaattccccaaaaaagcccacaaggggggggggcgggggttttttatatatttgggtaaaaccccccccttttttgtatggggggcggggggaaaaaaaaaaaaaaaaatttggggaaaaaaaaaggggggggggaaaaaaaaaaaaccccgcttttttttttatttttccccccgcggggggaaaagattttttttttttttatatataaaaaagagggcgcgccgccccaccaaaaaaaaaaagaggggggggggggggggggggggggtgtggttttttttttataaaaaaaaaaaaaaaaaacaaaagaaagagagggggggggggnnnnttatttctcccccccctccccccgggggggggggggtatattattaatataaaaaagagagaaagaggggggggcgccccccccccccccccaaaaacaaaaaaaaaaaaaatatatatattttttttttttttttttttttttttgggggggggggggggggggnncccccccccacccccaccccacaaacaaacaaaaaaaaaaaaagttgagagggggggggnggnnnggggnnnnnnnnnnnnaaannaaaaaaaaaaaaaaaaaaaatttaataaaaaattatatctcttcttttccgccacccaagagaaaaaagagaagggggcgggggatctccgacaaacccnnnccgccccttccccccaanntttttnnnnnnnntttttttgttttggggggggggggggggggtggggagaggaaagaacaaaaa

SEQ ID NO: 16465 - DNA, 1014 bp, Xenorhabdus bovienii
  unsure (1)..(1014): unsure at all n locations
aagatacgaatcgagctcgtacccggggaactttangaccccccaggtcataacaggggggaacctgntttttggggccggggggggcccattggggtttaaaatcaacccccctgggggaaaaaaccccccgcccacaaccccggggggggtttttttttgaaaaaaagccgggaaaaaccccggggtggcaaaaaaaaaaaaaaaaaaaaaaaattttttttttggagacccccccctaagaagaaaacaccatttttttatataaaaaagaaaaggggggggggaaaaaaaccacccccccccccccttttttttttttntttaaaagaaaaatataaaagggggaaaggggggggggggtggggttttttttttttttctccccaccccccacccccccctcctctttgtttgtgtgggcggggggnnnnnnngggtgttttttncccccccccccccccccncnnccccccccagaagagagagagagaaaananannnnnnaagggnggcgcggccccctcctcccttttttttttatttttttttctttttatatatgaagagagagggagaggagggggggggcgggggggggcgcacagaagaaaataataataatataattatattctttttctatattgggcttctccnnnnnaggagagagagaagagagacaagaaagacaacacccctcctcctctttttttctttttggggggggnggggggngcgccccccccccccccacccaatatatnataaaatatatagaggagaggggggggggggngaaaaananacacctctccccccctntttctttcttttttctctatacaaaaaaaaacacccacccacacatatatattttatatatgtaggggggggggggnncccgcccccccccccgnccgaaaaaaaaagagggaggacacnttcttttcccttcttttttnttttttagattcaagggggggggggggaccccctacaccaaaaaaacaa

SEQ ID NO: 16466 - DNA, 780 bp, Xenorhabdus bovienii
  unsure (1)..(780): unsure at all n locations
gactacgattcagtcgtctccgngatcttaggtccatcggttatcgtactacggtcgccgtttaataaccgcctataaatctggccctgaagggacgctaaggcttcccgggacataacggggacctttaaggggctttttcctgggaaaaataacaccccctttaaaagcccctttgtgtccccacccgggggggtttccccctttttttgggggggggggggccctttttttcgggggggggcccttttttggggacacccccccctgtgggggggggccccgccaaaaaaattattataaggcggccccctttctcaaaaaacggggttttataaaaacccccccccccccccccgaaaaaaaaaagggggttttctcccacaaaaaaaggctccccccgaaaaaattttatttttggggggggggggggaacaaaaatttttttttttttttctccccccccccccccggcggagccccacgaacccacaaaagttgtttaatttaatttaccccccccccccctttcccttttttttttttttcttattaaaaaaaaaacccaccgtgtgggctcccccnggggnnttttttttttttttttttttttttgagaaaaaaaaaagggccctttctttttttttttttttttttggggtgggggcgggggaccacaaaaaacaccaaacaaaacacaattatgagggtttttttgttttttttcaacaccgcccgccaggggcggggcgaacnnnncggtttttttttttctttcaa

SEQ ID NO: 16467 - DNA, 806 bp, Xenorhabdus bovienii
  unsure (1)..(806): unsure at all n locations
atggannnnnnnnnnnnnnnnnnnnnnnnnnnnnnnnnnntcaaccgataagacatcggagaaacgtgatgtctaaagaacgacaagcccgcaaataaggtaaaagacttcgacggggccccaaaaattttttactggaaccccccgtccaaaagggggngggtttaaaagggcgggacccccccccggggaggcggggaaaaacacagggggggggggttattttggcccccccttttggaaaaaaattttgggggggggaaaacacaaaaaaaggggcaaaaaagaaaaaaaaacttttttaaaaaaaagggcccaccggggggggagggggggggggtnccccggcgggggggcggggaaaaaaaaaaaaaaaaacacggtcttttgggggggggggggagcccccccccccccccttcttttttttttttcccccccccccccgcgggtgtacccccccccccccggggggggnntctctccccccccctccccccccacacacataaaaataaataataaatgggccccccccaaaaaaacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16468 - DNA, 955 bp, Xenorhabdus bovienii
  unsure (1)..(955): unsure at all n locations
ggccagtgtgatggttgttcccgccccgtgggcccccgtcccaggcttcagtttattggnngggcngatagntgtctgncctgacgagtttttttcgngncctnnncggaacccnnanaataacccccnngggaaaagggagccagccgncccacggggaaatccccncnacgcccccaaaccccgnnaaaaaaaaccccgcgaaaaaaaaaaccccccacgaaccggaccacgaaaaaacagccnaccaccccttcnncctccgtggggttttcgcctgcaaaaaatcctgacncccccccnnncagatcaaaacccacacgcaaaaaaacacctttttttgttggggggggcatggggcnngggggggctttgggcgggtttgggcatatatttaatttaccccaaggnccctttnnccaaaacttttggggggcnnttttttnnaaaaaaaaacccccctccttcttggngggggggccccttttttgnatggggccttttggggggggggttttgggggcccttttgggggggtttnnnnntttttttaaatttttttttccctttttnnaaaaaaaacctttttnnnatnnnnattttttttnnnnaaaaaaaaaaaaggggggggggnnntttatttgggggnaaaaaaaaaaanaaacccgggggncccccccaaaaaacccccnccttttttttttttnnncctttttttggggggggcccccccctttttttttttttntccccccccccncccaaaaaaaaaaatatattttnttnnnnnnnntgnnnnccccnaaaaaaaaacacgggggggggcgccccccataatatttttggggggggggggnanaaaaaaaaaaagggggggggggggggggggnnnnaaaaaaaaaacccccgcgggggtgttttttttttgggggggggggcgcnctctcttcttttt

SEQ ID NO: 16469 - DNA, 847 bp, Xenorhabdus bovienii
  unsure (1)..(847): unsure at all n locations
caatagcgacgggaccaagatttgggggagaagatatgnnaagtcatcatcgaccggactctctaccattgtggacggctgcagattgcgacagctgcagggtttctaggtcccggcttctctgttccgctggaaggatgcggaaataaatttccccccttaaaattggttcccaaactttggttttttaaggggggggggggaaaacccccccccgaaaaagacctttcccacaactttgttgtgttacaccccgtttttaataaaaaaaaaagggggttttctttttaaaaaaaccccccccgcggggggagttattttttttcttngagaacacccccccccccccctctttttggtggggggggaaaaaaaaacaacccttttcttttgtttgtgggcgcccaccaaacccccccgccccccttttttttttttgtgccccccaccccccaaaaaaaagggggggggggcggcacctattaaaaaaaaaaaaaagttttttttttttttttaataaaaaaacacaaaaaattttattttttttcctccctccccacaaaaaaaaaaaaatattntggtggggtgtgtgttttttttttttttttttttttcctcctcccccccccccgccggcgggggtggggggggggaggaaaacacaccaacacccacttttttttttttgngcgggccggcgcgcgggccgaaaaaaaaaaaaaaaaaaaaaaaaaagggggggggcggcccccccccctttttttttttttgggcacaaaaaccccttttctctttttttttgttggggggggggggggttttttttactcccccccccccgcccccc

SEQ ID NO: 16470 - DNA, 1009 bp, Xenorhabdus bovienii
  unsure (1)..(1009): unsure at all n locations
ggccccccaaggggnnnncncnaagattttnngaaaaattgtggnngccnngggggcgggnggggggnnccgcccccgggaagccaanagaacaccaaacacaanaggttattttttnnnnnnnangggggccataanaattgggntttgaggaaaaaggccaggattttgggcaaaaaaaaatttaaagagggggggtttttttttttataaaaccnaaaaaaaaaaacacccgcgggaaggggggggggnaaaaaaaaaattttataaaaaaaagggggggagaaaaaaaaaaaaaaaaaaaggggcggccgcgcgcgcgtcggcgttttttttttttttgggggggggcaaaaaaaaaaatgttaaaacgccgcgccgccccccccccccccgcgggggggggagggtaaaataaaataaaaaaaaaagaaaaatgggggggagggggggggaaaaaaaaaaaaaaaaaaaaaaaaaaaaaaaggggggggggttttgtgttttattttattataatataaaaaaaaaaaaaaaaaancaaaanacccnncncgaagagaggggggggttgtgggtggggggtgnntnttttagtntatntnattttttntttttttttnncnnaatacaaacaacacacccaacccncccncaccccnagagannnccnnnagcggcggggggggggggcggcgggggggngggttgnnaatnnnntnnnttacnntttatataaataatataaattaaaaaaaaaaacaaanacaccacaaccacccgtccccnccccccccccccncgccgggcgggggggagcggggggggagggnggtggngtgaaagggaggggggtgggcggggagatgagaagtgttaggagatnataagaatngtaggtncgagaatataagncaaaaacaacagaaagaananaagtatncaaggaatgggcaaaaggacacacagacaggngcgcgnagaagaaaaggatgcgacagaagtaaca

SEQ ID NO: 16471 - DNA, 1014 bp, Xenorhabdus bovienii
  unsure (1)..(1014): unsure at all n locations
ggggcccccaaagggggnnnnnnnnnnnggttttttnnnaaggcttatctttggatgccttgaaggtactgctagaagactagncataaataagtcagatagatagtataatccttccctagaattagcatatcttactatagatcagcggctacagatctcagtttgagagactacataccaatgtactccatataattcatgcatatgaaagagactcaaagataataatagacttcaattcatatgtattcatagtataatatattgaagcgatctataagtatatctgatctcaatgaaatcatatacatagaaaaaccctaaaaataacctatctccatacaaaaagagaaatcaaaatactagctaacaaattattttttaagttattttctactagtttattttcgtaattaatatttttactctctgggggcgctcatccccttctcgctttcccccccggccttggccccccccgccccgggggggggggggtcccccacccacaaaagggggggggggccccccccccgggggggggcccgggggggaggtttaaatctttcctcccgggggccttccggctacaaggatcaacgcccccccgggggggttcacccccccccccgggggggggggcccctcccccccccccccgggggggggggggggtantttnaaataaaaacactcanaaaaacctctccggggggggggggagcacacactccaagggggggggggggcgggcgcggnnnnnnccnnnntncangggggggnttaaancnnnnnnacgggggcggggggggggggagaacaaaatcccttnnttnnccgtcgggggggaggggnnnannnnnnnnnanccccttananaggggggggggggnagnccnnnnnccggggggggggggagggggnanntnnnnnnnnctnnnnnnccnnttaancacnanaatcnccnggggcggggggtcannnnngggggggggggggatntctcttntn

SEQ ID NO: 16472 - DNA, 898 bp, Xenorhabdus bovienii
  unsure (1)..(898): unsure at all n locations
ggggccagcnnnggttaagtcaatcaacgccngggggaactaaacgttnggggggnnnnnnnnnnnnnngggnttaaaaaaaaaaaaaaaaaaacccccgnnccccncccccgggggggagggttttttttttttttttttttttttttgggggggggggaagaaaaaaaaaaaaaaannggttataaaaaaantagtgannnaattttttatttgggggggggaaaaaaaggaggagaaaaatataaaaagnncccacccaaaaaaaaaacctgtccttttncctggtncgagccttttttaagggggcgggaaaaccccaaaaaaaaaaagggcctttaaagggggggggagcccaatttttccaacgggaaggggtcccacaccggaaaaaggggggcccggcccaaagggaaaggggggtataggcccccccgggggtttgggaacccggggccaaaaaaaaagggaaaggggggccctggggggccaaaaggaaggagggaaaaagagggcaaaaggggggccaaaaaaaaaagagggggggggccccacaccccccctggagagaaaggggggggttcctccgccaaagaagagaccccccccacccccccccgcggggaaaaaaaaggaggggccacaaacaaaaaccccaagaccttatgttaaaaaaaaaaagggggggggggtggttttcataaacgaacaccacacacccgaaaattgggggggggggggggggcgaaaaaaaaaaaaacaacaacgcccgcgggggggggggaaaaaaaacgacccggacaaaaaaaaaaaaaaaaggtggcggcccgggggggcgggaacaacaaacaccagaggaagggggggggggggtgcggtccacgcgaaagacaagaac

SEQ ID NO: 16473 - DNA, 891 bp, Xenorhabdus bovienii
  unsure (1)..(891): unsure at all n locations
ggncccaggggggntgaaagttttttngcttttgggaaggcgagtttnagggaaggaaggnaagtttcnnnnngattatgtctgaatgcacttcgccaggcaaaaacggggccttttttggccgtgggaaatatcaaaacattcctttcttttaagccgaccccggggggccttcccaataggggttttaattgagaatgggggggctacaaaaacagggttttttttttggggggggggggggatacaccccaccggggtttttcttaaaaaaaagaggggggggggggcgggggtttcacccactcataataaaagagggggccgcaaaaaaaaaaaacaaatcttttttttttttttttttttataaaaaaaaaaaaaaaaagggggaggggcgagcagacgcggcgcgccccaccttttcttcataaaaaacactaacaccgccccgggcgaggggggaggaggagatgggggtgttttttttttattatttctcttctcaaactatttatattatttttatgataagagggcgtcggcgccgcgctgaaatcgatctcaaaatggcccgtcctggtgtgggggtatttgttttttataatatatgttatgntatggatggcaagatgccgcccaggtgggcgtggtggtgatgtggataaaaaataaataaaagagaaccccccgccccgcgctcctctcgttttattctaatttataaaagaaaaaaatattgagggattgattgtngntngcccgcttcctctctgttcttttttcttctttttctttactccgttgtacacgcaatatagnagcgcccatgggcgggagaagttgtgctctgctctgtattcctattgtctcatgtaatatatatataataat

SEQ ID NO: 16474 - DNA, 970 bp, Xenorhabdus bovienii
  unsure (1)..(970): unsure at all n locations
nnnnnaaatgaggggngnnnnnnnnnnnnnnnnnnnnnnngnnnnnngnnnatttgtttgtcggggggttgtttttgtcttttnnnnggncgccgccctccnccnnnngngtggtgcatttctaggatttggttnnnnnggtgtcgnttttagnnnttnnnnntttnnnngtgggtgggggggggggggggggctccccccccccccccncgcacctcaagaaaagatagaaaagagaaaaanaaacccccccccccccccccccnccttttttttttttttgtgtttttgtgtgggnnnnnnnccccncccccccccaaaaaaaatttttttttttttttgcccccncctttttccagaggtttncncaaaaaaacaaggggnncggccnaaaaagggcgggaaaaaaatccaaaattaattttnattttttgnnacncggnccccaanaattttgcncacaggnggnaaaaaaccccaaagggggnaaaggggnttttggccctttttaatttttttccaaaaagggaagttttgcgcccaaaattttaacccccggcttttttttttgcgggggggganaaggcttttnatttgncctttcaaaaacacggaaacaaaggccccgggcnccggggtttggaattttttttttttgaagtttttttttgaaccnaagcgngggttttcttttgggcggggtcnctttattttttttaaaggggngccttttttttgggaaaaaccccttttgttttttccctttttttttttgnnnctttttgctttttttaaaaccttttttggttttttttccccttgttggcccttagaaaaggggggattttaaaaaaaaaatttttgtgggtttttttttttaaaaaggggggggggttttttttttttttccggcgcgggggggggttttttttttttttttttaaaaaacccccccccctttttttttttt

SEQ ID NO: 16475 - DNA, 1070 bp, Xenorhabdus bovienii
  unsure (1)..(1070): unsure at all n locations
ggcaaaagggggggccnnnngggggccttgngggggccctcgtgggnnnnnccccncgcccccggggcggccgcnnccgggccggagagccccgggaancggaggaaaaaagggtaatttttaaaaaaaaaaaaaaaaggaaggngctggngnccgcnggnnnannngagagggaggnacgggggngttcctttccccgggggggggaaaaccccccccccaaaagaaaacccccgtgccggggggggcccccccgccgcggaggggttttnnnaaaaaacaccctaactagggggggggggggggttcccggggggggggggggggcgcccccaccccccccccggggggggggggggggcaaaaaaaaaaaaaaaaaggggcgccggcccccggtttcttttttttttggggggggggggggaaaganaaaaaaaaaacaagagcgccccccccgccccggggggggggggggttggtttcgctctcccccccccccccgcgcggcggcggggggggggggggnnggnggggggngggcggggccgttgtcgggtgtttntttttntcggggggcggggngcccggggcgcgcccggccggccggcgccgcggccccgccgccgccgccgcggggggcggcgcgggggccccggcgcccgggcgcgcgcgcccccgcgcccccccgcccgggcccccctcggggggccgggggggcgggaacccctccactccccccccnccccccccccccccccccaccccacaccccgcggggggggggggggggggggaggccccccccgnnccccccccgcccccgcgcccggccgnntggcggccgggggtgtggggttgtggtgaagcggggggntcgcnccgcgggncgcgcgccncgnnnggcgnttggcggcgcggnnccccccccccccgcccgccccnccnncccacccccccccccgcnncgcgccncgcgntccnttncgcggggggccnggngaacgcggnggggggaggggggagaggncagcgcggcgncgggcggggcgagaacaagaaaaaaaaagaaa

SEQ ID NO: 16476 - DNA, 966 bp, Xenorhabdus bovienii
  unsure (1)..(966): unsure at all n locations
nggggggnggggggggggggngctttggggnncgttgggtnnnnnnngnaaggttttttgaaaggtgtctgcanattncagactnggtttcccggggntaccncngagancacctggctggcttgnaaaaaatnaaactggnnatncagtncattggnttnctnccatggngncccggttgntntggggnatttggncnccataccaggtnaaatattttgggccaaaaaaccaacccgggttacccccccaactggggggggaaaaattttaaaaagtttncaaaccccccccgggcccctttttaacccggggtcncaaaattttgggggataatttttaaccgggttgggcccttaaaaaagaggcccccccagggtaattttttccaaaaaacacaaaacccccaaaaatcttttttttttttcgggggaaccctttttcccatattttttaaaaaaaaaaaaccacccatttgggggggggtctttatatttttgtggggcaaaagggggggggtttttcgcgcgggggggggggggtggggaaacatccgtgtgggggggccttttttttacaacacccccgcggggggaaaatatattgggggggggtgtttttgggtggtttttttttaaaaaaaaaaaaaacaccccccggcggggaggagcccctctggttgggaaataaattatttcccggggggggggggcgccaaatattatttttttttttaaagaaaggaggggtggggggggaaataaaataatttttttttttttttttttttcccccccccgcggcggggggggggaggggtatttttttttttttttttttaaaaacaatgtttggtgggggggggcgccacaaaaaaaaaaaaataaaaaaaaaaaaaaaaaaaaaacccccctccttgtttgtttgttgttttaaaaaaaacacacaaaaaaaaaaaaagggtgg

SEQ ID NO: 16477 - DNA, 1183 bp, Xenorhabdus bovienii
  unsure (1)..(1183): unsure at all n locations
ggnnncccgggggcnnnnnnnagattttccgggcnagggttcnnnnngaggagcgcaccgccacgggcccagaccggctcagtctattggccnggnagaatagggttttngaagaacngnttatcccggggnnacccccagggacccgggcgganacccaaacgaaaccagaaaggggccgggggaaccgcccgagccaaaaaccggaaagggggggggaggagaaaaaaaaggggggggggggggagacccccgaagagaggggggnnaaaaaacgcgccgccgggggaggggggggccgaaaaaaggggggaccaccacagggggcggggaggcggccccccccaaaaaaaaggcccaaaaaaaaaaagngggggggggggggccgggcgcgccccccccccgggaaaaaaaaaacaaaaaaaaaggaacaaaccggggggggggggggggggaaaaaaaaaacncccggggggggggaaaaaaaaaaaaaaaaaanaaaaaancgngggnnccccccccccccccccaccccccccaaaaaaaaaaaaaaccnnnnnnnannnnnaaaaaaaccaccccaccccccccccnccccnnnngnnaannngnnnngggggggggccggggggngccccccccccccccaaaaaaaaaaaaaaaaaaaaaaaaaaaaaaaaaaggnnnnnnnggggggggcccgcgccccccccccccccaccccgccgggggggagagggggggggngggnnnnnnngnggnggggggggggggggggggggggggnggnnnnnnnancncccncccccaaanccannnnccnaaannnanannnnnagaggnaagaaggaaaaaaaaaaaaaaaaaanaannnannannccanncaaaaacgggaggcggaggagaagaaaaaggggagaggaaagaaannaaaannaannnannnnacagaaganaaaagaanaacgaaacccccacaccacccccaaccacncnaanccacanncaaaaaaannacacaaaaagagaaagagagaggagagcggcagagaaagcgaanngcanncacnnacaaanannaaannaaaacaaaaagaagaacnnaaaacaaanaaaaaagaagagannaaaagagaggaaaaaggaganaaaagagagggaagagcgccgcccccgcccgcc

SEQ ID NO: 16478 - DNA, 882 bp, Xenorhabdus bovienii
  unsure (1)..(882): unsure at all n locations
ggcgccccaaggggngnnngaaaagaacgnnnaagaaactggggnngnnngcnannacnnngnggnnngngggggggggnnnngggngggagtgaaggggaagggggnnnnnnncgnnngccggggggcccaaaaacccancaaaaaggattttttgcannnaggtcatgaagggggggccagaccacaggcccagagttccgaagaaaattctggggacaaaatncaacacttttaaaaaaagacggcccccaaaaaaaaccaagaaaccccccccaaagaaaaaagacgcccggaaaaaaaaacccggggggcccaaaaaggcaagcgcaaaaacccaaacaattgttggaacaaaagcccccaaaaaaaaaaaaaaaattttctttttttttccaaaaaaaggaaaccacccacacgggggaaaaccccggcgcgacgggggaaaaaaaaaaaaaccaaataaaaaaaaaacgagggggggggtctgggggggaaaaacaaaaatttttccgccggggggggaaaaaaaaaaaccctattctccccaccacaaacaaaaaaaaaaaaacaggggggaaaaaaaaaaaaaaaaagaaagttgtggcgggcccggcccacaacaacacaaaaaagggaaagaaaaaaaaaaaaaaagncgcaccaacccccccacaaaccggcgacagtacgctgcggcccaaacccccncccacccccccggggggggaaaaaaaaaaaaaacaaaaaaaaaacgttcttttgttctcggggggggaggaggggaagacaaacacacaaaaaaaaaattgtgaagtggaggggggggggcgggcgccaaaaccgaaaaaacaaaaaaaggaagcgggcgggagggggaac

SEQ ID NO: 16479 - DNA, 588 bp, Xenorhabdus bovienii
  unsure (1)..(588): unsure at all n locations
taacatcagtctaccggaccttaataacttatgtgnnagnggnnntggggnnttnnaaagggnnnttttgggggnnttttttnccccnntttttngtttttnnccccccctnttttttttttggggggggnnncaaaaccccccttttttttttccccccctttttggtgggcaccaaatccaacacttttgccctgaaaccttttgtggcccattaaaaccctaaatgcgccctaaagcggcgaactaaataatttgaatctttttttcattcatttatcctcatttttaaaaatcgggggatcccctcggtttccccaaatttatttaaaaacgggccttggatttatttgggccgaaaaaaaaaaactttaaaccctttttttaaaagggaaaatgtgaaaaggggaaaaatnaaataatatttttaatcccgggggttttaaagggggtttttttttttttaaaatttttgggcccaacctttttaaaaattttccgagggtttttttgggggtttaagggggggaaaaaaaaaacccccccctttttttttaaaaaaaaaaagcgcccccccccaaatttttt

SEQ ID NO: 16480 - DNA, 1063 bp, Xenorhabdus bovienii
  unsure (1)..(1063): unsure at all n locations
nnnnnnnnnnnnnnnnnnnnnnnnnnnnnnnnnnnnnnnnnggcagttatgctggggtgcctcgctttgcggctgtgatccggcccgcctgtctatgtcttaattcccgaagatccgtgagcgtgccgtgcagtagtgcactgatttcgtatcaaccgtttctctcggagtnnntntttttatttntnnnnnnggccagacttgtccattcccttgcagggtccccgcaatttaacttcggcccggtttctttggaaggttatttttctttgtgaaaaaaaaaaagggagaaaacctgtgggaaaacccctccccaaaaaaaaaaacccggggggaaaaagggcccccccttttttttaaaaagggggggttgtttttttcccccccaaaaaaaattttggggcgcgggggtttccaaaaaaaaaaaacccccctgggggggggggggggttttttttttanaaaaaaaaaaggctttttttttttttccccccggcgggggggggggggctccccccctcttttttaaaaaaaaaaaaaaaccaacacccggggggggggggggggagagaagaattttttttttttttttttttttttggcggggggcgcccccccccccccccccccccccggggtggggggggggggcgggcggcgccccccccctccccnnttttttttttttttttttntatataaaagaaaaaaaaaagagaggggggggggggggnagacacaaaaaacctacacccncccctttttgttgtttggtgtgtgggggngtgngagnnnagaaaaaaaaaaaaaacaaacaaaaaanaaccatcccntncgnccccnnnnccnnnngggggggggggggggggggggnnngngnnnnnnnnnntnnnntnnnannananncccnncctcccacncctttcttcnncttntttcttttttttctntttntntnattnnnttnnnttnnnnnnaagnagaaggaggagggagggagggncagnaggagnactannanaanaaaannaatntanttccctttnccctcccctcttctccc

SEQ ID NO: 16481 - DNA, 961 bp, Xenorhabdus bovienii
  unsure (1)..(961): unsure at all n locations
nggggnnnnnnnnnnnnnccttctttnnnnnnnngnnnnnnnnggggggnngntagggggntntnatttttnnnaggcctctgctgctgcagtctcatggatcagaagataaatgcgaagagtctggcttnacaccatgcataatctttcaggcaagccatttttcaaatgggaaaggccctttttgggggagaaaaattccccttttcccactttttgggggggaaaaaaggggcttttcccaaaaaaccaaaaaaaggggggggggggtttttttttttttcccacccggggggggggggggggggggaattatttttttttttggttgggggggggcgaacacccccccccaaaaaaaagaaaaggaagagggggggggggggccccccccccccccccctcttttgtgggggggggggggggggataataaaaaaaaaaaaaaaaaaaaaaaaaaaaacaaaaaggggggggggggggggggagaaataaaaaaaaaaaaccccccccgccccccctccccccctttaataaataaaaaaaaaaaaaaaaaaaaaaaannattgtgtgggggggggggggggggggggggggttttgttgttttttttttttctccccccccacccccccccnccccccccgcccccccccccccaaaaagagggnaaaaaaaaaaaaaaannnggggggggggggggaaaaannnnnggngtgtgtggggggggttntttcctccccgccccccccccccccccccccccccccccccccccccccccccccctttgttttggtgttggtgggggggggggagggggggtgagggtgttatataaaaaaaaattatnttataantnnnnnnnnnnncnnntatncccccggcggccgcccgcgcggggggggggnngnnnnngnnnnnnnncnnnnnaaaaaaaaaaaagaggaatacttctctca

SEQ ID NO: 16482 - DNA, 839 bp, Xenorhabdus bovienii
  unsure (1)..(839): unsure at all n locations
ncaactttggttggggcaccaaggaaccccctcttgttgaaatactcctcttaacaagggcaaggccagatggggccataacggcttttaccccccgccgaggggggttgaaaaacctttccgttccccccccttttttggggtatatgtatccctcctccgaaaggcccccccccctgacttaagtttttaacccccctcccccccttttaaaaccttactttgtggggggttcaaaaaaggtttttttttttctccccccccccgcccttttttttattttttggttttcccccccgggggggcccttttttttgttagagagagagagttatccccccttttttaantctcccccccggggggagggaagaggggaaaaaaaccccccggggggnnnntttttcccaaaattttgcggaaaaaattttgcgcaaaaaatttttttgttaaaccccctccttttatatgatgcaaaacccccccgcccctgtttttttttttttttaaaaaaaaaaaaaaaaaaaaacccccccccccttctttatccttttttnaaaaaattattgggagaaaaaggagaaaaaaaaaaannnaaaaaattttttctggagggccccccccccagggggganaaaaaccccccccggggggggggttttttgngggggggtttttttcctctttatttaaagaaaaaccccataccgggccntgtgggggggcgcccctcgcccgccttttttttttttttttttttaaaaaannaaaaaaaaaaattttgagaaaaaagagaagaanaatnttgtcccctctccccacaaaaaacttttttgggt

SEQ ID NO: 16483 - DNA, 695 bp, Xenorhabdus bovienii
  unsure (1)..(695): unsure at all n locations
gcatcttgctgcctgggtcacattacccatgattcaaacgacttggctatctgacttatcataccgatcaaggaatacccgtaacaaccccttttttagggcttttaagggttgccccatcggttgggcctaagggtttccttttaaaccctcggttttgggggaaaattcccccttggaaatggggggttccccccccttaaaaagggggtttttttaaaaaggggtttccccaaaggggggggggggggtttttcccccaaaaaggaattttttttttttttttccgggggtttccaaaaaaaaaaaaggggggggggggggggttttttttttttggaggagaaaaccacccctttttttttaaggggggttttttctcttcccggggggggggggaaattccccttcacctaaaaaaaaagagggggggggccccccctttttaaaataaaaaaaggggggggggggcccccatatattgtggttttcccccccccctggggggtcagcccatttaccccatattcntctctgncgacgaagaaaaaaccttttccgaaacaatgttttttgaaaaagnggtttcccaccgcgccttgttcattcgatggccccatgtgacgcagtctgaatgggccccctctctgattgcaccacgggacatgggttttttgaaaaaaatccatgccgaa

SEQ ID NO: 16484 - DNA, 439 bp, Xenorhabdus bovienii
  unsure (1)..(439): unsure at all n locations
agggnnnnttgggcccggcctgccgtgccggcccgcggcgcgccggggcccccttcagctgcgcgccgcgtcacgaaaacctcaaggaatcgtcgaacttcgatcccagggccccaaatcaccccgaaggttgccccatggaaaacccgggaaccccgttggggggaaaaaaaccccccgtttttttaaaaaccctttttttccaaacctttccgcgggaaaaaaaaaattttttttgtttnngcccccccccaaaaattttttttgccccccggggttttaaaaaggggggggtgggaggaaaaaaacctttggcggttgggggggggggaaaaaaaaaaaaggggcgcgcgcaaaaaaaaattaatttttattaaaaaaaaccccccccccccccccccttttttntgggtnataaaaaaaaaaaaaaccccccccc

SEQ ID NO: 16485 - DNA, 800 bp, Xenorhabdus bovienii
  unsure (1)..(800): unsure at all n locations
aggtacgatttagctcgaccgngatctctaagcggattcgacagatctttactgcagcataagaggctttcttattgcagctggtccttttgccaaaagggaaaaacgaaaattccccggttccccccccggggggaaaaaaagttttccccccaagggggttttttccccccaaccaaaaaaaaccccccccttttaaaaaggggccccccccccccccttttttttttttaaaaggggggggcccccccctcttctggggggagggggggggggggagaaaaaattctcctcccccccccccctccttctttttttttttatttattaagaaagagggtgttgttttttttaataaataccccccccccccgccctttatttttttccccccccccttaaaaatatttttcctcgccccccccgtggggtggcttcgtcgccaccaaaaaaaaaaaaatttttttttttttataggggggtaaaanccccgcagccaacccattttttggtgggccgcccgccccccgcgccaaaataaataaagcgaaccgccgccgggggttttttttttataaattttttgttagccggcccggggaaaacgacccccccccccctctcccttaaaatagggtgggggggggaaaaaaaacctcttttttttttccccgccgccctttcttttggtttaaacccgcccacttacctcttttaaatcaaaaaggcccgggtgtggggggccgctcttatccttggcaagaagcccttggttttcaaacgggtgttgcagaaaacca

SEQ ID NO: 16486 - DNA, 902 bp, Xenorhabdus bovienii
  unsure (1)..(902): unsure at all n locations
ngccccagggggggnnnnnaaatttttnaaaactattggggcngggggggnngngggcggggggcccgcccggggaaagnannagnaaggtcataannnngggcctttacgggctgncctgcgggttctggggaaaagggccccagggtcttggccgggtgtttaagcgggggaaaaaacccgccccccccaaaattttggggagagggaaaaccccccccccccggggggaaaaaaggggtttatatccccccggtttttaaagcgggggggcgaaaaacacccggggggggggggggtttttcccctccctttttgttgtaatnccccacaaaaaaaaccccgcgnggggggggggggggggataaaaaaccccccacccccccccccccccccgggggagggcaaaaaaaaaaaaaaaaaaaaaaaaaccccccccccccccccccccccaagagagggggggggggggggggggaactcacacacaacaaagaataggggggtngggggggggggcggggagaaaaaaaaaaaaaaacacaaacccccccccccccccccccccccttttnttnngggggggggggggggggggggggtgtgggggggataagaaaaaaaaaaaaaaaaaacaaacaccccntnnntttttcttgtgggggtgggggaggggaggagagaaagaaaagagaagaaggaagaaggnaanaagaaanacaactntntctcttttcgttagtggggggggggggggggggggggngnngnnnncnctnnnccctctctccccccncccccccccnctcccccccnccccctcccccacaccacaacaacaannacannaatcacnnntnatttntctttntnttcggtggtcggggcccgggcgcccgccc

SEQ ID NO: 16487 - DNA, 1038 bp, Xenorhabdus bovienii
  unsure (1)..(1038): unsure at all n locations
ggcaattctgtgcatgacctgccagtccttctttaataggctgaagttcctcccggcgtttaatcccccataaaaaaattttggggngggttaaatatttttgtgggcccttttttaattatggggatttgggatttttttggggggggtttttttaatgggggccccccttatggaaaaaaatccggggggagagaaatcttttgtttaaacaacacattattttataaaggccttttgtgtgggggaccccccccgcggggggtgttgttgttttgttaataaaaaccactttttttttaaaaaagaaggggggggccggcctgaaaaaaaaaacacacaatttttttttttttcccccccgccccccccccgcgcggggaccccccttggggttttttttttttaataaagggccccccccccccccctcttttttttttatttaaatatttattttttttgttttaaaaaaaaaaaaaaaacacaacacacctttttgtttttttttgtggtggggggcgccggcgccggccctttttattaaattacaaaaaaaacacccctctttcttcccccctgggtgtgggtgggggtgggggggggtataaaaaaaaacaaacagggagggggggggggggggggggcggcccacccaccaaaagaaaaaaaacaccccccctcgcttcttttatttttttatatgaggggtggggggggggcccacgccccccnnnaaaaaaagaanaccccaaaaaaaaacacccccccggggggggggggggggcccccgcccattatttatattttttttttttgtggggggggggaagaggggaaaaaccccaccccnnccccctttttttttttttntttttttggggggggnngnccggggggggtttangnannnctttttttaaaccacacccaccccccgtcttattttttgggggggggaatgtaaantttggttttccttctgcccacctaattattaatttttggtgaataaaacggggttacaattttataagg

SEQ ID NO: 16488 - DNA, 1376 bp, Xenorhabdus bovienii
  unsure (1)..(1376): unsure at all n locations
ccagagggacccccccccnnggtttttnnnaaggcctctggggaggaccacccggcttcggcgcagggaagcccacccagccgcacggcacgaagcaagcggnnangacnnnnannnntttattttttgtttttcccccccagattcctgacagggggggttttaggccggtttttggggccctctcttattggcccctttgcccccccccacaaatatctgnggggagacccctctttattttatatttttttttgttctcccaaagggggggcggggggggcacaaaaaaacccccgccccggggttttttttttgtgtttttttttaaaacccccccccaaacccccaccccccccccgnttttttttttttttngccccccaccctgggggcgcccataaaaatatataaattgtgttttgttttttttgggggggaaaaacaacaaatattttttttttttttttttttttttttttttttttttaacacaacaaaaccaccctttttttttttttttttcccccccccccccccttttttttttttttttttttgggggggggaaaaaaaaaaaaaatttttattttttttctcttcttcttcttctttggatgtgaaaaaaaagccccaccacccaccccccccgcccccgcgcgtgtttnttttttttaattaaataanccccctcactctcccgccagctacaaacacgcntttttttgttttttttttttttnnngggcgccccccccnccccaaaaaaaaancngtattntntatatatattatgtttgcttttctccgctcnnaaanacgnannaatngntgtacnannnggnnnnnnntgcactcgcagtctttaanttttgnncctgttgnaacnattnncnannntgnncaanccaannngtagcgnnantgnnnnttanctttcacttngcnatncnagntnnannttntcngttttnngacnntnncagnncnngnaactntnttncnngnnngnnnccaaannngnnctttnnnnannancnnanttnncttgnnnncnngntatcnntttntgnttnnngtnccnnannnnnngnannnnnttanngnncnanngnncnnngntttcnnnngnannnctgattnngnnnacngtttnntcnngnnntaannnnccgnnnantttgnnnncantttngtacttntttgnncnnnnnnncttcnngnnnnntanttnnnnannnaangccnttnnannnnngnngntanttnnncgnnnncnnnnntatcntttgnnttctnannttntncnagtnnnnncnannnncttcncntacnagnnnttgnngcanncgcangncnatttttgtnccattntg

SEQ ID NO: 16489 - DNA, 1061 bp, Xenorhabdus bovienii
  unsure (1)..(1061): unsure at all n locations
naaggggnnnnnnngnttnngggcctttgtgccgcgggagnggcgggggggggggggcnnnncnnncngggggaggggcncgctgagggggagnnaattaatgtttttannnnagcccatacttgncagnnctgcngttcctgnccagnaagnagnaanttaaaattggcctttagggggggatcctaaacggaaaggttgggaatttttttagggttttaaaaaaaacctttcgggcccccccgggggggaaaacctaaaaatttagggggcggcgggggtctttatgggggcccgccctttttttgtggggccccccaaaaaaaaaaggaggggcggggggggggcccccccaaaaaaaaaaaaaaaaaaaacaaccccccccgaaaaaagaaaaaaaaaaaaataaaaaccctggcggaaaaaaaaaaaaaaaaatgctttggtttataaataaacacccccccccccccgccctttttatatatatatgtgttgcccggccgggggggggggggggcccccaaaaaaaaaaaaaaaaaaaaaaaaaaatttctctcccttttttcctcccccccccccccctttttaaaaacccacaaaaaaaaaaaaaaaaaaaagggaagggggggcccggcgcccggggacaaaataccatataaataaaaaaaataagggaaaaaaanccccccccccccccccgcggggggggggggggggggggggggggggggtgtttttaaataaaaaaaaaaataaacaaaaaaaaagcgcgccccgcggcgggcgggcggggggggggggggggggnnnnaataaaaaaaaaaaaaaaaaaaaaaacaaaacaaacaaccctctccttcctttccccttctgccccncggccgctcggcggcgcgcacgacggaggtataggtnntttgtgnncatattccgccnccaaacacaaacaataaatatnnantnttttnnannnnnnncnnncnggnctctttccccccacccacccaccggcancggcacagaagaagataatatttttttgttaagcatangnctga

SEQ ID NO: 16490 - DNA, 863 bp, Xenorhabdus bovienii
  unsure (1)..(863): unsure at all n locations
cgaccaanagtcggngttatgacactgaaccaataatctttnntatacagnataaattaaccgacctattctatcaatttactgcccctttaattatcttaatgaacgaatttcaaccttttcgggtttataaatgggggaaacttttaaaagggggaaaagggcgctttggaattaacccttttaaaaacttttaaattaaaaaaaaccggtgtttcccaatccccccggggggtttttttccccccggggggagcccacccccccccccgggggggaaaaaaataggggggccccccccccaaaattttttttttttataataggggggtggggccgccaaaataaaaaaaaagttttttttttccccccccccccccctcttttttttttttcgcggggggggcgcgcgggggtttttttattttttttttccccgccgcgaaaaaagaaaaagaatatttttttttttttttttacaaaaaaacaaagggggttngnggggggggggaaaaaaggccaccctctttttgggatataatttgccccctttcttggtggggaatataaacaaaacccccccccccccccccataaaaaaaaaaatttttttttttttttttttccccccccaacgaaaaaaaaatttttttttgtgtgggaaaagaaaaaaaaacaacctcccccactcttttttttttttctccccccccgcgcgcgaaaaaaaaaaaaatgtattctttctttttttttttggggggggggggggcgaaacaaaaataattattnatttataatttttgtaggngggggagagagaaaacaggnagcgccccccccccctcttttttttttaccataag

SEQ ID NO: 16491 - DNA, 731 bp, Xenorhabdus bovienii
  unsure (1)..(731): unsure at all n locations
ggcacctgngctgtgncatgnacacttgccaggntntcatttcagngnnnctttntnntaatngnnnaananacntaatnntnggnnnnaanaaaaccaaagagnnnnaaagagggggggnnctttttggggnccggggtttttttttttttcccccccccccggggggggggggggggtttttttttttttttttttttcacaaacacaacccccccgcccggcgggggncacccacccccccccgnnttaaatatttgggggggggggggggttgtttntccccccccccataaatatatatgtggggggggggggaaatatttattttnnnaatttttttttcgaaaaccggcaaaccctttttgggaaaagatttttttttgtttggggcaataaaaaaaggcccaaaaaccccccctctgaaaacaaggtttgagaaaaaaaaaaaaaaagaaatattttttttcccccgattgtgggggggtttttttattttttggttttttttgggggaaatatatttccccccaaaattatttttccaccaaaatattatatcccccccaaaaccttctttttttttataaaaaggggcgttttgttggggaaaaaaaaaaaaaaagggggggggaaaaaaattttttttccaaaaaaaagaaagaaaaataatatttttttttttttttttgtaaaaaaaaaaacaaaaccgcgcgcgggaagattttttt

SEQ ID NO: 16492 - DNA, 879 bp, Xenorhabdus bovienii
  unsure (1)..(879): unsure at all n locations
gttgtttcagngnnatatnnncgnnganncttnncgngnnnttttttccnccncggggggggggggggnnnnntttnaanncccnnctttnnnnnnctttttnnnnngggggaaaaannnggggggnaaatatttttnnnnnnnnnnnnnccccnnnnnnnccccccccccnnnnccccccccccnnnnnncaaaacaacaaaacaccccnnnnnnnnnnnnnaaaaaaaaaaaaaannnnccccccccccccccccccccccnnnnnnnnnnaaaaccacccccccccccaaaaaaaaaaaccccccccaaccnaacaaccggggttttttttnnccnncgggncccttttttttttnnncccnagggnnnnnnanaaaanaaatttttnnnaaacccncccnccccaggggggncccnnaaaannaannaaattttnnaatttttnnaaaattttntncttttttttttttttnaaaccccccccaaanttttttncccccttttttttttttgggggggggggtttttttttttcccggggggggggggggattttttttttcgcgggggggggggggccccccttttttttttccttttttananaaaaggggggttttggggggcccccccctttttttggggggggggccccattttttttttttttaaaaaaccccctttttttttgggggggaaatttttttttttttaaaacccccttttttggggggggcccccccccaaaattttttgggggggggtttttttnnaattttttttttgtggggggcgccccgggggggggggggggaaaannaaaaaaaaaaaaaaaccccccctttttttttttttcctttttttttttttaaaaaa

SEQ ID NO: 16493 - DNA, 1072 bp, Xenorhabdus bovienii
  unsure (1)..(1072): unsure at all n locations
tgatcgatcgagctcgtaccgaatctctagttaggnntttcccggggnnntttttgggggggnnccccccccccttaancnnnaaaaacacaaaaacttttttttgtggggggggnggggnnccccccccccccctccccccccccccccnnttttttttttttttttataaaaaaaaaaaaaatttttttttctcctcccttttttttttcttcccttttttcttttcaccttctttggtgtgggggggggggggcgcaccctctttctttttttgtggggggggggcgcgctccgcacacgccccctctttattttcccccccccccccccccccacacacaataaaaaaataaaaatatacagtactgtggggggggcgcgcgggcgcgccgcgggccgcccccccccccctcctctcactctcctctttttgtggtgtggggcgcggcgggggggcccccctctccaccccaaacaaaaaaaacaaattatttttttttttgtgtgtgggggggggcgggggggggggcncactctctttttttttttttttttcctcccccccccccccccccccccccccccctccccttttttctttttcgccctcttatctttcctctcatctctccctcatacatctctacacactacacctacgggtgggggggggagtgggggtggttcttcccccccccccccccccccccccccccccccacaaaaaaaaaatataaacaattacccctgcattccgcggggcgcgggcggcgctcgctgctcgcggccctcnnctggccncccccacaccacacaacaaaanaacaaactatttttttctttttttctctcttctcttattatcttaaacaacaacaaaaaacacacacncaccacccctcgctggcgtcgcgcgcgggggcggcgtcggtcgctgagcgactctcgcccgcctttcctcctctattctctcctctctcttcctcncnnccccccccccnccccccccacatatatactcttcttctttatttttttttttttctcttctcacaccttaatacaacaa

SEQ ID NO: 16494 - DNA, 1332 bp, Xenorhabdus bovienii
  unsure (1)..(1332): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaataaaannaaatannataaaatcaaagnaagccggggaagcatttcttttttagaaagtgagntgtgtggnngnnaataaccaataatgggtagaataaaggttcgagtttaaagccttngnnatttctgnttggtcntnnnnnnnnnnnnnggagtgtnatatataagnnaaaaatnntncgnnaaganccntncgnnngnnntaaccncncggngnngngnnnaatncnncnntncnttaagttaagnnntcnncaanaacnnccaancnncnntggnnntntnaantntnntncnggnttaatncnntncaancnncttnntntnntaaatggntaaattaaagntaaccaaaaaaattncaaattaagnntccntnnctaaatttttttcccccaaagggggggaaaaataaaagaaatttttttttaaaggaaacnaaagggaaaaaaaaaaaagggaaaaaggggaaaattttcaaaattttttttaaaattttgggcggggggaaaaaaataaaaaaaaaaaaccccaaaaaaaaatttaaaatttttaaaaaaatttctcaaaaattttgtgggaaaaaaaaaagggaaaaaaaaaccncttttttttttttttttttaaaaattttaaaaaattttaaaaaaaagggggggtttttttaataaaaaaaaaaaaaataaatttgggggggggggggtaaaaaaaaaaaaaaaaaaagggggggggggggagggggaaaaaaaaaaaaaatttttttgagagggggtggggtgggagaaaaaaaaaaaaaaataaaaaaaggggggggaaaaaatatttttttggggggggggaaaaaaaaaaaaaccccaaaaaaaaagggtgttggggggggaaaaaaaaaaaatttttttttaacaattttttttaaaaaaaacgtgggggggaggggggagagggttttttttttgggggggggggggggggcctttttttttttgttgtgggncccaaaaaaaaaaaaaaaaaaaaaaaaagtgggggtgggggggcccccccnnaaaaaaaaaaaaaaaaaaaaaaaannnnntttttttttttttgtttttttccggggggggggggggggttggggaaataaaaaaaaaataaaagaggggggggggggggggaaaaaataaaaat

SEQ ID NO: 16495 - DNA, 899 bp, Xenorhabdus bovienii
  unsure (1)..(899): unsure at all n locations
ngacatcggcatgcactgcggtctaaagtgaccgtgaacgctgacgttggattccggctggtcaagagagccgccagattattatgcgggttctacatggcggacacgtcgcgttttataccagacaagtacccttggggaacttggacggtaaacttttgggaaagggtggggggggattttggggggaaaagggaacccttttttaaatcccctggagaggggggtttttttttcaaaaataaaggggggtgggggagaaaaacaaattttttttaatttacccgcccctttttaaacaccccccccaaaattttttttttataaaataattttttttgggccgccttttttttttgtgtgggggcgnntttttctctcccccgcggcccagaagaaaatatattttattttttttctctctcccctccgcgcctcttatttttggtggggggggggggggggggggggcccccccctcttataaataaaaaaagaaaattatcttcttttttttatattagcgggggggggggggggggggtttttttttttttttttttggcgtggagaacgaaccacccctctctcccccccagacggggggagggaggaggaattttttttttattttttttggcgttcccccgcagcggagggttttagtttttttttgttttataaaaaaaaaaaaggtgggagggggggggggggcgcgcccccnncccccccacaaaataataaaaaaaaaagaaaaaagagatgtgtgttgttttttttttttttttttttaaaaaataataaaaacaaaaacaaacctttttttgttttttaaaaaaaccaaaaacggggagaggggggtgtgttgtttatttttccttcataggaggggaggggga

SEQ ID NO: 16496 - DNA, 901 bp, Xenorhabdus bovienii
  unsure (1)..(901): unsure at all n locations
nnnnnnnnaaagggnnnnnnnnnnnnnnnnnnnnnngggcatattggaaggcctggaggccaaacnggaaacaagnnaaaaaaaggagaanaaangaaaatnctcncnaactagnaaaacaagtagggataagnggntncannnnaanacnanaagnnnnnnaaaaannncnnaaaaannnanggagnggngggnnnntannnnnnancnnnnnnnnaaanncnaaagggggggggggnnnnnnnnggnnnnnnnnanaaannnnnnnnnncnaaanaaannnnnnnnnnnnanaaaaaaannnnnnnnggggnnnnnnnncgggggggggcngggcccanncccccccagggcctcttttgggggggggcccnnnnnnaanataccaacnnnngnnncccccccngggggttnttttttttttttannnnnnnnnnnnnccngggccccccctctttgagtnaacnctcggggggnccccctttagagancnccnttcttctggnncccccgaagatattttnccccccgcccgggggcccctcttnnctcnnnaagggggaggnnanggagnaagggaanggccccctttttttttattaaaaaacaccccctccntgtggggccctttgtgtggttnnccgcggggngcccccaaacaaccanaatttaaatntttnnaaattaattgggggggccccccccgggggggtttataaaaaaaagaagggacccctctttttaaaaannnntatttttataccgcggggggggggaaaatnttatttattatttnntttttttccccccccccccccccccccaaaaaaaaaattatttttngccgggggggttttttttgggggggggggnnaaaaaaaaaaaaaccccccccacaata

SEQ ID NO: 16497 - DNA, 790 bp, Xenorhabdus bovienii
  unsure (1)..(790): unsure at all n locations
nnnnggggnnnnnnnnnnnnnnaccccgannnnnnnnccnnnncgggggnnnnnnnnnnnnnnngggggngggggnnnnnnnnnnnnnnnnggggggggnnnnnnngnnnnnnnngnnnnnnnngggnnnnntnnaagnnnnnnnnnngtagaanttntaccccannnantanncccgggaccccnccggttnccccccggggngnnntanccctnnnccnngaanggatnncccgntggtntntggnnataatntggntnnaacccccgnccataggtngggtntngggnatntnaaanatntncccantanaatnccctnaccccacccacctnaggncgggccccttaggnaatgggaaacccgggaattattggggncccctttaattccggaattnaaatggggttggggggtnccccccttttggggcccgggaaaggggcccacccctgcgggccnaaaaaaaaaaaattcccccccccggggggggtaaattttttaaaacccccccggggggcccccccgggcccccataaccccctccccgggggncccgggggggggggttttttaaaaaaaaaaaaaattttttttatannaaaaaatttttttggggggggggggggggggaaaaaaaaaaaaaaggggggccggccccccctcttttttttttaaaaggggggggggggcccccccccccccccccccatatataaggggggggggcccccccgcgggggcccccccccccccccttttttttataaccccccccccccggggggg

SEQ ID NO: 16498 - DNA, 1231 bp, Xenorhabdus bovienii
  unsure (1)..(1231): unsure at all n locations
aaaaaaggggancanaaacnnccccnnnngagaaattaaannnnnnnggagacatcancccgcagaggacgacggcctctgcggccccccgcgggttggtcccggcnagaaggaccgaccggaggagcagctcagcgaaacaagcacgcccacacgagcgaccacccacagcaggaggacacgggacgcgcgcagaccggaaggcctgaccaagcccacacgcgacaaggcagagaagaaaaacgaacgaggaggagagcgacaccccacaacaagcaccctcaaacccaaaaaaagttttnattgtttttaaagagggagagnnagggggcccccccccccggggaccacccccttgaaaagaaaaccccagccgccccccccctttctcccgcggggaaacgccccgcggcggcaaaaaaaaaaagaagaaaaaaggggggggggcgcccccccccccccaccaaataaaaaaaaaaggggcgggcgcccccccgccccccgtaggaaaaaaaaaaaaaaaaccacaccccgcccgcccccgccccccgngggggttatattaaaaaaagaaaaaaaataaaacccccccccgcccgcgggggggggggcccccccccccccccccccccccccggagggggaggggtttcaacaccccccccccccccccgccccggcggccccggggtgaggggaggagaaaaaaaaacaaaacaacacccacacccccggcgggcggggggggggggggnggggntttattggtttatattatcgtttgaggggaagcgganaggacgagacaacaccccgcccgccgcggcgggggngcgccgaaaaatgtngnttataaaaaaaaaaaaaaacacacaccacanaccggaggggggggggnngggggggggnggggnggnngntcctcttcctacaatccctcccccctcccccccccctcacccgnagagaaaggaggagaggagggcggggggggggggngnnnccggcgcccccccccccaccccccccctntcgttnttcggtgggtgtggtgcgtgnnttgggnnnnnaaaaaaaaaaaaaaacaacncaacacccctccccgcggcgcgcgggcgaccgctccgacgcccgttccgcgtggcggcgggggcgctggtgggcgacggaaaacaccacgnaaaacacacgnagcccgcgccccgccnncgtgcttcggtgtggtggggtg

SEQ ID NO: 16499 - DNA, 770 bp, Xenorhabdus bovienii
  unsure (1)..(770): unsure at all n locations
caacaagcccgcccaaaggcnnnnnccccaacaacaccttaaacccccnncnnnnnnnacnggaggaccaacccaaacatatttttttttttnccgggcccgggaacgcncaccacacaaacaaaaaaaggagacccccccaaaccattntaaaaatggaaaaaacccccgngnnnggnnannncccccccccggaaaaannnnnacacaaaccccaaaaccccccccccgaaaaaaaaanntttctgccaaatncaaagaaaaaaaatccaaaaatggccaacccggccgaaaaaccgttcccaaaaaaaaattaaaccctaaaaaaaaaaaaaaaaggttaaaaaaaaccaatccaaaaaaaaaaaattggggggcccaaaaaaaaaccccggaaaaaaaaaaaaaaaaaacccgcaaaaaaaaaatttaaaaaaagggcccccccccaagtttctttttttggggggccccaaaaaaaaattctaaaaaaaagggaaaaaaaaangggggggttccctcttaaaaaaaaaaaaaccgcccaaaaaaaggggggggggaaaaaaaaaaaaaaaaaaaaaacccccccctcccccaaaaaaaaaaaaacccccctgggggggccccctcttccccccccccccgcggggttttttttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16500 - DNA, 808 bp, Xenorhabdus bovienii
  unsure (1)..(808): unsure at all n locations
gccccaggggggnnnnnngttttnnngaactcgnggcnnccngcgcggagggccngaggggggnnnngnnngttttnnnngtgtttacnatatcggctcgcnctcgnngnancctctangtccnccaatgctgatgagctcggtgcaactaataacatcatcctccagcgttttcagatgatgcctgcttgcgtaaggcgttgggggaaaaaaaaggggcccattttgggaggaaaaccctttcccccaaaaaaaaatatttgggggcgggagattttttttcccaccccccccgggaaaaaatttttgtggggggggcccccaccccggggagattttttttttaccccccccccaaaaaaaangggccctctccggggggggggggctcctcttaaagtggggggcgccccccttgggggaaaaccccccgggggggggggccccctccaaaattttaaaaaaaaaaaaaaatttttttttttttttttttctccctccccccaaaaaaaaaaaaaaaagagggggggtttttttttttttttaaaaaaaaaaaaaaaaaaacttcttttgtgtgggggggggggggggggaaacaaaaaaaaaacaccctcctttttgtttggagggggggggggaaaaaaaaaacagcgggcggggggggaggaaggaaaaaaagagnnnnnaannnnnnnnntnntatnaataaatataaaaaaaacacccccacccccccccccccccccccccccccccccgcccgggggggnggggggggggggggggttttttgtattttataaaaaat

SEQ ID NO: 16501 - DNA, 752 bp, Xenorhabdus bovienii
  unsure (1)..(752): unsure at all n locations
tgtttnnnnnnnnnnnnnnnnnnnnnnnnnnnnnnnnnnnnntcattatggatctactgcgtccgatgctgtaggaagatgcacatgttcacgaaccagacggttgaagtgacatccgtgcatgagatacgtgactagagacttgtgtgatataggcatgncatctagctactatgagactacactgtatgattgggctgacatgatggagacgttactacagacaaggattgccaagggttgttggccgtaggacctttaatggttggggccttttacctgactttggtttgtcccaacactggcaagtttaagatttaggggccaaaaattaattattgtttccgggggcatatgcgccttgagggaaaaaaaatatatcttggtttttgccccccttaaaaaaaataatttttttttggcaaaattttttccccccccggcggagagagtttttttgggggggttttttggtcccccggggaaaaaaagttttttttttttgggggggaatattttctctcgccgcccccccaaaattttttttttcttctcccccccccaaaggggggggaaaaataaaaataaaaaacgcccccccctttttttttaataaaaaaaaaaaacatttttttggggggaaaaaaaaaaaaaaaaaattttctccccaccaaaaaaaaaaaaataaaannnngggttttttttttttttttttctctcccccccccccctcttttgtgtggagggcgcgg

SEQ ID NO: 16502 - DNA, 1111 bp, Xenorhabdus bovienii
  unsure (1)..(1111): unsure at all n locations
gggnnnngggaaaaaggaggggggnnaannnnnnnngnnnnnnattgtnttttnnnnnggnnnnnnggaagaattttacggnnnatattnngnangaggaacggggggactcccgnnnnaagagagggttcccnnggnnanncggagcnnnnnnaggtnttttttannnnnnnnnnnggggnnnttanngtgtntattatnccgnggancacaaagaacccnatccccggnttggctttattttcttnttnaanggattncctnnccaacccnatttttcaattnaaattaaccgggtataaactttggtttttttggggaaaggaaaaaagagtttaaaaaggaaaaatatgggtttttttaaaacaaaaaccccaaataccctttaaggagaaaagaaaaaaacgggataatggggggaagagaaaaaatttttggagagaaaaatgggggaaaaaaagagggggggtaaaaaaaaaaattgggaaaaaaaaaaaaaaaaaaagggggaaatttaatttttgggggggggggggaggggttttaagggggggggggaaaaaaaaaaaaatggggggaaaaaaaaaaaaaaaaaaaaaaaaaggggtggggggggcccccgggggcgggaaaaaaaaaaaaaaaaaactttaacttttggggagaaaagaaaaaaaaaaaaaaaaaaaatatattttttttttgtttnnnggagggaaaccccaaaaacgggagggggggggaaaaacacctttttctccatccntttttgttttttaaaaaaaaaaaaaaaaaaaaccccccccnnntttttttttttgtgggggtttgcgggggccgtggtggaaaaaaaaaaaaggggggccggcgggggtgnnannnnncgccccggggggggggggcaggaagaaaaaaaaaacccccctttttttgtgttttgttccccccncngagnggagaaaaaaaaagagagnggncgtgggccccaaaacaatatttaaanaaaaggggggggggggggggccgtttaaaaaaaaaaaaaaaatttgtggggggggggggggccggccccccttcttttttttatgtaaaagggggagaaaaaaaaaaa

SEQ ID NO: 16503 - DNA, 809 bp, Xenorhabdus bovienii
  unsure (1)..(809): unsure at all n locations
gaacttggggaanaagagcccnncggtttcnctcggggnntancctnctnganggatcncgtnnctntnnaaaggccggnaaattttnattgggncccccgggggnccctttttttnttanccccagaggnggggaannnnaaaaaatttatnngaggggggccccccccccctctttttttttttttttnnnnaaaaaccccaaaataaccccggccaaaaaaatttgggccctctttnttcccattttttnttcccaaaaaaaaccgcgtttgggggaaacccgggggggngcccnccaaaaaaaaatatgggggggngggggcccccagggggnggggggacccccgggggaccccacacaaaagggggggtgggggggttcccccggggaaaaaattatatttgggggacacccttataatttggggggggggggggggggggggggaaacaccccccccatataattatatttttgtgggggccccccaaaaacaccccccggggggggttttcccccgcgggtttttttttcccccccccaaagaagggggggaaaattccgccggggaaaataaaccccccgggggaaaaaaaaaggggggcccttttctaaaaaaaaaaggggaaaaggggggggggccccaaaaaaaanggggggggttttggggggggttttttttaaaaaaacgccgcgggagggggagggggtttttttggggtggggccccccccccccccccccctgggggggggggggcgccgcccccccctggggggggggggacccccccctcttttttttt

SEQ ID NO: 16504 - DNA, 896 bp, Xenorhabdus bovienii
  unsure (1)..(896): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnngtgttnnnnnnagagagggtnnttcttttttttaaagnnnnngnnnnaaanannantctttggggaatatttccctcccttttntgcagggggggcattaanccngggaacctnnagagnttnnncaccccccggggggagggnntttaatcccctnnctctnnggaaagggatnnncccggnttaanccatannaatatggnanaaaaccgaggaccccggaannnaaaagagaacccccagatttttataacccaaaaaaaattaaaaccccttttgggggcccgggnaaataaaattttttgagggggggaaccccaaagaggggttttttttggggggagaaggccccatttttgggggggtttttccttttcgggggggggggttcccctggggggtaaaagggggcccccaagaggggggaaaaaacccccaaccccccccatattttttaaaaaaatccaaaaaaacggggttttccccccggggggggccccttttttccacccccccgctttgggggtttcccccgggccccggggttttgggcccccccggggggggaaaaaaaaaaacgggggggggcccctcttttttaaaaaggaaggggggggggtttttttttccccccccaaagtggggggggccccccagggggggggttccccccccccgtt

SEQ ID NO: 16505 - DNA, 487 bp, Xenorhabdus bovienii
gcttttggtctgcctgaccacactttctttcactaatcatcccattctgttaccgatcatactgtaagatagactggttacgtgctatcaggtaatacgacctgttagtctgcaggttgccctggtggttagtcttttggaccccccaaattgggaacccaccccaatgttgggattttggcacggttttcaccccttttttttaaaaaaccccctttttcccgttttttggggggagaacccccccctttttttggggaaaaaaaaaaaaccccccctttaggtggggggggggtaaaaccgggggggtttttttggcccccccccccccggaaccaccacttttttttttttttggggaaaaaaaaatttttttttttcccccctttttttttgggggggggggacacccccccttttttttttttttgggcggcaaaaaaaaaaaaaaccaaacagggggggggggggttttttttgatcacca

SEQ ID NO: 16506 - DNA, 1010 bp, Xenorhabdus bovienii
  unsure (1)..(1010): unsure at all n locations
nnnnnnnnnnnnnnnnnnnnnnnnnnnnnnnnnnnnnnnnnnnnatcgaggttttttggcattctgggaaagaaaacaccactcaaatgggagggaaaggctccggatccactggaaaccaggtttccccctcctggaaaaccggggggggttgggccctttttttccccctggccaaaaaaaaaaacagggggtttttttcgtttttttcccccccggtttgggggggggggcccaaaagggggcggaaaatatttttaaacaatatttttgtgggaaaaaaggggggggcgcctcctcttccaagaggagggggggcgccaaaaaaaaagggcccccccccctctctttttttgtgggggtttttataaaaagagaaaggagaggggggcgcgggccccccccccccctttttttttttttttctcacccccaacacacccccccctcatttttgtgtgtgggggcgaaggacattctttctttttttgttgggaggaagacaaacacacacacccccccttttttttttttttttttnnnnnnnttntacagaaggggaggggggggggggccccccccccccccccccccccccaccccccaccaccaaacagatattttttttttgggggaccaccccccaccccccccctctccccccccccccctcggcgggagaggagagagaaaaaaaaaaaaaaacccccannnnnnnccncccccgccgcgggncggcgaanaaatattggggtttttccccttccttctttttttttttttttataaaaaananaaanaaaaaaaaccccaccccccccttgtgggggggggcggcgcacccacaacccaacaatatatnnntttttttatgggggggggggggggggggggcggggggtctcttccccccccccnnnngnntcttttgagannaaaaaaagaacacccccaccccccccccccccnccnnnnnnnnnanaannnancannnaaatatatttttttta

SEQ ID NO: 16507 - DNA, 1198 bp, Xenorhabdus bovienii
  unsure (1)..(1198): unsure at all n locations
nnnnnnnnnnnnnnnnnnnnnnnnnnnnnnnnnnnnnnnnnnnnnnnnnnnnnnnnnnnnnnnnnnnnnnnnnnnnnaaggattgaatccgggccgggccccggagtgacccacgggccagcccgaaccaggttagccaatngtgccatgaacgctgaccgggcctgccggggggggggggggggcgcgggaggannannnannnnaggatcgaannnnnnnnnnnnnnnnnnnnnnnnnnnnnnngcatctgaatcaggcccgaactggacggggaaaaatcctcaaaaatcccctttaggcccgggatttaaggggggggggggggcccccaaagggggggaatccgggggccccggtatttatacccccgggggggggcaactttgaaaaaattgggggggggcgagagaggggtttttttgggggggggggaggatggggggggcgtccccctcttggaggggaggggggggggngaaggaagaaaacacacccccgcgtgggtgggggaacaccctccgcgggggccagtaaaccaatttccgccttaggtgggggggggaggggcggggggggaaggaggggggcggcccaaaaaaaacaaaccccccccccccccccgccggtgtntttgtgttgggggggggggcggggggggggggaggactctgtgctaccccgcccgcgggcccgcccggtgtgggggggaggggggggggaagagaaaaaagaagnttcgcgggttgggtggtgtggcggggggcgggcggggggggggggcggggcgcgagggagggggagagggaggggggggggggggccgcccccgagggaagcggacagagggtggggttatttttctttttctcgcccctccccccgccacgaggaggaaagagaggacgaagcacgggggccgcgcggccgccccggcgggggggcggggtgggtggtgtgtggttctttggttggggnttggtggcgggcggggggagcgccggcctcgaggcccaccgcccctcccaggaagggggtgagcgggtggggcgggggaggggagccgcgaccggccgtcgtgtgttgacgggggcggtgggcgggcggcgtggcgtacaggcgcggccgcgcgccaccacggggnaccntaggcgcagagacnctcagctcggcgaggtcgcgcgtgcgtgtgggatgg

SEQ ID NO: 16508 - DNA, 1015 bp, Xenorhabdus bovienii
  unsure (1)..(1015): unsure at all n locations
gtttaagaggggttttcgtggngaaaaaagtttttttaaaaaaaaaagacttgtgntgtgtggncntagacactggccccgaggnttttttttnnccggtgggnnccttttnnttatatttccccccaannttatcccaaaaagaggnggggtaatattttttccaaaaaagcccaaaccccccggggataatcccccctctttttatttggggaaaaaacaaatttttattttggcaaagggggggggattaggccctttaaaaaatttatatttttatttttgcggaaacctcttttggggacaacccaagggcggggttatatttttttttttccccccgccaaaattgaaaaaaaatgttttttgggggatttaaaaaaaaaaatttttcccccccgctttttatttttttaaaaaaagagggggggggggggggggtatttctccgccgtgtgggggcccccacaaaaaaaaaaaaagagagagggggaggaaataaaatattttttttttttctcaaaacaaaattttttggtaaaacaaaaaacaccaaaaagaggggggggggttttttttatatcacccacatctgtggtgtggtcataaaaaaaaaaaaaaaaccaccggcgggggggtttattaaaacaaccgcacgcgcgttggggggtgggggtggttggncccttttaatataaataataaaccccccccacccccccccccccccncacgaatanatattatttttttgttttgttttgtttntcatccaaagancacacacccacaatatcaattcataaatatgtgaggggagtgggggtgttgtttttcttttttatttttagtatccccctccgccttcgcccgtgcggctggcgcgtcgtcgtgtctctatattttatatataaattattatattattatgatattgntctagtgtgtttagctagctttctccctacttcttgataaacatgaatcctatgtgccgcctcttactcttatcttt

SEQ ID NO: 16509 - DNA, 1050 bp, Xenorhabdus bovienii
  unsure (1)..(1050): unsure at all n locations
ggcaagctttgcatgnccntgcaggntccnnggcttnatnngacgcttgtccacttacaancgtnngctnngnattnngnntnngcnggnnntacannggnatnnacggcattgnaaaatggtttttnctgngcgggtggnaaanacattaananagttttatagcgngnccacactggcgcccgggggaaacccgccttcatttgggatcttgtccaatataacgcgtttctaacaaaccctgcgggcggtattagtgggcggtgggggggtggggtttcctcccgggggaagaaacccggggcattttttgtcggggggttttgaggagaagaacacaaaaaacaaaaaaaaaataaagtgtggcgtgggtgttttttttcccccccccaaaccaccctggtagttttgtgtgggagaaaaacacccctgcgggtggtgtgtgggggggggggggtgtgtgttttctcctccccacaacaaaaaaaaagtaattcgcgcgccgggaaaaaataaactctcttctctcctttaaaaaaaaaaaaacaaaaaagaaaatagtggtgttttggttatagaaacacacaaaacccaccccccccccgccccgccccctcctcacttactataatagagagttaaagcacccgtcttctttttttttttttattaaataatccctccccccccgccgcggggggggggggttttctcactttttttggggggggggtgtttttttttttttccgcggggggtttttttttattattgggggccccnccccccccccccccccacaaaaaagaaagaaggggtttttttttttttttttttttgtgggtgttggggacaccataaaacaaaaaaaaaaaaaacccccccccccccctcctccttttttttaatataattaataaaaaacccccccgccgggggggggggggccccccccccccctggaggtttttttttttttcctcccccccccaacgtttttttttcggaaattttttttacccccgcccggggtaacccaagggggggtgg

SEQ ID NO: 16510 - DNA, 953 bp, Xenorhabdus bovienii
  unsure (1)..(953): unsure at all n locations
gaggggggcggcccggggggcggccgcccgggccggccggcccggtttggcccgccgttattgctgncctgcggtnccttncgagggttaaacncaacttcttgtnanaaacgttgaaaaaaacttnaagcccccaatcgttcttggaggggcgattttanaacttttttccaaaccccgaaatttcgggaggtcccaaaggtgggtttaaaacttggcagaaaggaaaaaaaccgccctaaaggggggttgggccccccaaaaggggaaacaaaatccccgctaaaaaaagagaggtttttcccccgcattttttttagaaaaaaaataccgcgggggtataaaaaacccccgggggggggggggggggcgccccccccttttttaggggggggggggggggaatacctccttttttattttaccccgggggggggggggggttattttttccttttcgcgggggggaggagggaaaaaaaaatattttttttttggtgggggggagcggtttctccncncnccgcggggggggggggtgggctgttttttttttttttaaattgacaccagccagacgcgcgggcggggttgtttcttttttttttataagaagganaaaacaancccacccccccccgctggggggggggggggggggggtattcnatttaaacattaaatctattatattgtcaagttctttgtgaacttagtaatatacctctgcacgtatttggatggttgcacttttttattgtgagaaattgattaacgaatagtagtaatatattaaaagcgacaccattacttaacgcttctccttttctgtcttactctcccccctcatcntcccctcacatttctatatgtcttatgttagtcaattgctttctctcttcaatgtatganagcttcaatccatgctcactcacacccccgcaccctccccc

SEQ ID NO: 16511 - DNA, 1105 bp, Xenorhabdus bovienii
  unsure (1)..(1105): unsure at all n locations
aatggtttccgaaattccgggcctcggtaccccggggaatccctcagaggtctnaatcgtggtcaaacggcatccctttccgcaacggcttgaaaacttaagtggtacccggaccgggcacattcttcgtnctttttcagcccaaaaangaatggttaagggcaaaaaactgngcttacacctgttcanggcacaggngaaaaaactcctgggcgcctttggaaatttgacccaaaccggccgggcagaaaaaaatcagagggcctgtggtttaaacgggccccgggtttaacccccgcgaaagaaatttttgtgagaatacaaaaaaaaaataaagccctttttctctggttttctcttttttgggggggcgaaaaaaaaaacagggggtgaaaaacgtgggggggagggaaccccccccactttcccacaattttttttttagcggccccccccaaaaaaaaaaaatcttttttttataaactttttttgttaaaaaaaaagccgcccaagagggcgtttttttttttagggagaaggaggcgcgngggggtggaaaaaaaaaaaaaaacaaagagaaggggggggggttttttttttttttttaataaagaaagaagattttttttttttttgcggccgcacccccaaaacacacgaaggggggggggggtgtggtttaatcccaaccaaaaaaaaaaaaaaaaaggngggtgtggttgcnttttntnaaacnnnncnnnnnaaaanaaaannaannnnnnctctcttccctctcttctntnnnntcnngggggggggggggggagagaaaaaaaaaaaaaaaaanannnnnnnnnnnnnnnnnnnnnnngngnggggggggggngggggnnnnnnnnnnnaaaccccnncccccnnnccnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 16512 - DNA, 890 bp, Xenorhabdus bovienii
  unsure (1)..(890): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttngngnggnggcggcgggcggcggcggcgtggnttnntntnttntctantttttttctacttnntnnnggggngggggggnggnggngnngngnnggnnggnggngggnggnggggggggagaaggagaagaagagagaacaaaannttttaatttaacctttttttgcgcggggnnggggaaanaaanngccgnaaggaaagacccacccccgcgggnnnnnnnnntaccttccccccccggggggggnggggnnntnttaaaacccccccctctnnnccccntnnggaaaangggaaaaaaaatnnnccccaaaaannaaagagaattttttttaaattttttttttttttnnaaaaaggagannttaaaatttnnaaaccctgtgggnnnaaaaaaaacacgcncccccccgcggggtnnnnaaaaaacccggnnaaaccccgggggttttnacacccccggttttccccagagagggggnaaaaaaaaaaaattttttttggggggggccccccccgggggggggggttaaaaaaggggggggnnaacccccccggaaaaacccccaaaaaatttttttttncnccccccggggggggccccccccccnnaaaaaaaagggggggggccccccccccacaaaaaaatttccccccccccccccggggtttttttaataaaaaaacacccccccggctttgggggggggggggggggcccccccccccccggggggngggggccccccccaaaaaaaaagagcccgcccccccccccggggggagggggggga

SEQ ID NO: 16513 - DNA, 803 bp, Xenorhabdus bovienii
  unsure (1)..(803): unsure at all n locations
ggctgcgcggggggccgaggagggggnnggtaggttttggccttgatgacgattcggactcgtactcggggntcctctgagatncncatattnncttggnttggggggntttnnnaaaaaaaaaaaaaaattaaggggnnnaacccggnnccccccaaaatttttnaaaaacccccccccgggggnnnaaaagaggaaaaaaccccccccccccccccaaaaaaaaaattattaaaannnncccccaaccccccggggggccgaaaaaaaaacccaaaagggggttatatttttgggccgggataattaaattttttaaaaaaaaattaattttttttttggggatttcccggggggaaaaaaaattttttaccccgggggggggaaaatttaaaaatttttctcccccaaaaatttttaaaaaatttttcccaaaaatcccctcttacaaaattcttttttttttccccccctggggggcttcttttttttgagggggggtattggggttttttnnaaattttttttggagggggttttttttggggggagaaaaaaaaaaattttcncccccctcctttttttttttccccctttttttttaaaaaaaaaaaaaaaatattttcccccccgcggggggnggggnnnggtnttttttttttttaaaaaaaaaaaaataacccggggggggggggggngnttttnttnaaaatatatattattttacaccccccccccctccctccccccaacnnaatattattattttttattatattattncccataccccctctttcttt

SEQ ID NO: 16514 - DNA, 965 bp, Xenorhabdus bovienii
  unsure (1)..(965): unsure at all n locations
ngaaggggannagggaaagagtgtgtnnnnngntnttttaaagggaagggagttnnnnnccaaaagaagaggngnnnacnncnaaanacncgnggggcncnannancccnnncanncnccncnannnnnggccgagggagaggggaggaaaaaaaaaaaaatattgttgtgtgtatttttgttggtnggcnggggggggggggggnnnaaannaaaaanacaaaaaaaagaaagaaaaaagaaagaaaagaaagggggagaaaaaaaaaactttttnttnnggggggggggggggggagagagggggggggnnnnnnnaaaaaaaaaaaaaaaaannnnnnnnnagaaaagaaatcnnngggtttntatcaggaggagnnttaacnctnncttnngaanggatnnntnnaagagntnttnnccnctncccnccccncggtnnncgnnaaaaatcggggncttgggccgnccttncccccatatatggcggggggttnaaagggtgggccccttncccgggttttttttttttttccttggggcctggggggcncaaaagggccgngccccgggggcccccaaaaaaaaaaaaggggggggaaaaaaaaaaaggggtaaaagggaagaaggcccttttccccccccggggggaaaaaaaaaaaaaaagggcccggggggggggggaaaaaaaaaaaaggggggggggggggggcccccaaaaaaaaaaggggggaaaaaaaaagggggggaagaggggaaaaaaaaaaaaaaaaaaaaaaatcccccccaaaaaaaaaaaaatttctttcttgggggggggggggttttgggggggggaaaaaaaaaaaaaaaaaataactccgggggggggggggggggggccccaaaaaaaaaaaaaaaaaaaaaaatcctgccgaaaaaaaaaaagaaaaaagaggggggtaaaaaaattgggggggagaaaa

SEQ ID NO: 16515 - DNA, 958 bp, Xenorhabdus bovienii
  unsure (1)..(958): unsure at all n locations
ggattaaagacggttccgggatccctatagggatctcttgtaaagctgcacgatgccagtccatatcgccagaagcaagggtcgtgggccgagaccattcgccacaagcgaggcgcatcttgcaggccataaggcgagaagagcttctaagggaatgccatcttttgttggatgtttaaggacattagcacacgccgaaacaattatttatataatcaaacccaccaagggggggggagaaagactttcgtaaccccggccgtcggggggggggggggaaaaaaaanaaccccacacccccggngcggggggggannnnnngttataaaaanaaattttttttctcncctctttttttttctcttttnncttatttgggggaagaaagaaaaaanttttttttttttttgtggggttgtnnnnnnncctccttttctttaaaaaaaaaaaaaaaaaaacccccccccccccccctttttttttttttttttttttgggggggcgccccccctttttttttttatttttttnnnnnnttttnnnnaaaangtgttattnttctaatagttnccccnnanttattacnnnnaaaaaaaagggggggggggagggaaatattttttttccatatacaaatagataaaaaaacnccccctttctttttctcttctctttctatttttaaaaaagaaannnnnccccgggnnnnaaaaaaaangaacacacgcctttttgccggnttcccccttttnnnggaggggggggaanaannncccctctctctttctctgtgttttgtttgcccgcaccnggganacccgngngnncgnnaggccaannnggnnaaaannnggggtnnnnannccctttnttnntncnccttntnnnnattttnntnnncaaaannccggcgcccacgccccgcgtcgtgtgtattnnngnncggtagtgtnntttc

SEQ ID NO: 16516 - DNA, 1076 bp, Xenorhabdus bovienii
  unsure (1)..(1076): unsure at all n locations
gcctttttgggggaagaacccgcnnttttttttttttttnnaagagaagggacagcgagatctgaacagggngagggggggggacccccttttttctcnnttaanttttttaaagaaggaggggggggggggggggnnnnnncccccccnnnggagaannnnnnnaaaaaaaaaaacaaagagggcgcccccccnccccgcgngggggagaagaaaaannnnttntttttgtttcccccgaaagggaaaacncctaancggnccgaaaantttaaaacacttcnncgagggnnngggaaanccnccaantnnnagattggncttcgggnttaanatnaaattaatgggccttncccaaaaaaaaccattatntaatttcccaattttttnncccaaaaancccgggggggcctttttatttttaaaaaaaacccaaaaaaaaaccaaggggccccaaaaaaaagaaagcncctcccccccgggggggccccaaaaaaaaaaaaaanaaacaaggggggngggggggggggccctcttttttaaaaggggtgttttttttttttccaaaaaaaaaggggggggcccgcggcggggcttttctttnaaaaaaatatctntttttttatatatcccaccaccctcctcttttaaaaaaaaaaaaaaaggttttttggagagggggtaataaatatattttttaaaaaaaaaagaggagaggggggttttttttttttttttgtgtggaggggctcccccctcttgtgggggaaaaaccggcgagaatattaccccccccaacaaaaaaaaatagggggggggngttgggtncctcccccccccaaaacaaaaaaaaatatatttttttgtgtgggggggaggaaaaaaaaaaaaaatataattttttttataataaccctccctccacaaaaaaaaaaaaaccttcgcgccggtggggggggaggattttttttttttggaggaataaaaacaacccacccgcccccgcggccgaaataattatttatttttatatagaagaagagaagagatggttccctttctctcacaaaaaaaag

SEQ ID NO: 16517 - DNA, 919 bp, Xenorhabdus bovienii
  unsure (1)..(919): unsure at all n locations
nngggggggnnnnnnnnnnntttnnnnngtttgcgattaacccgcacccgggacccccagaggccgccccaacagcgcaaccagacgaccaccaccgccccccacggcggaggtgcccaaagggtccaagccgcgaccgactnannannnaattttcccaaacggacaccccacccccgngaccccccagagaccccacaaacgcgcgccttttcccaacccaggggcccccgggcccccccaaaaaccaccccccggttcccccccccccaaaaggggccaacacccccccccccccccctttaccccccccccggccccaaaacccccccccccgggaccccccccggggggaaaaccccccccgaaagtgcccccccccccaaaacccaaaaaaaantttgtggggaggagggagtntccccccccccccccggggggggcccccccccccttttttgccccccccccccccccccggaaacccccccccggaggaaccccccccccccccccccccgtaaacccccccgcgggggccccccccccaaaaaaaaaaggggggggggggaaaaaaaaaaacccccccccccaaaatttcccccttggtttcccaaaaccccccccggggggggggggggggggggcgccccccccaaccccctttaaaaaatattggggtggccccccccccccccacaaaaaattttaatttttttttttgtttttttattttggccccccccccccccccccccccccaccacaaaataaaagaggggggggggggggggggcgggggggggggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16518 - DNA, 1014 bp, Xenorhabdus bovienii
  unsure (1)..(1014): unsure at all n locations
ngcattgcttgcatgcctgcaccctcttaagnagctgttacaagtncaaacctttgcggccaccaagattccttccggggaaggagtttttccccccgtttaaaaagggatcccccccggttgggaaaaaccaggcctttaaaaagggttggggggaaaagggggcccccctacggggttttggagatccccccccggggttacccccgagaaggttcccccccttttgttccccccaaaaaaaaaaaggggggcgccccccctttttttaaaaaaagggggggggggggaaccccctcccccccctctctgggggggggggaaaaaaaacctctccttgttttggggcgccccccaccaaaacaaaaacttttgtgggggggggggggtgggtcagaacaaaaaaaaatttttttgtgggggggggagagagaaatattttttttttntgtttggcgcgggggggaaaagaaaaaaaaaaaaagtaattttttttttttttttttaatacaacaaaccccaccctcctttttttttttctcctccccccacccccacacaggaggagaggggagagagaatttacccccccccccccccaaaacacaaagaagaggagggaacccacccccctatttctctctttccatagagaaaagaaagtaataaagaataggtctgttggcgggcgcggcccctttccacaataaaataaaaaaaanatttattatttttttgtgatgggtgggggagaggatgcacccttctcccccgtcgttttgttttttttgtttttttttgtggcccccccgcccccaccacaagaataaaaacaacccctcccacccctcttaacaagaagagaaggacgccaccctcccctcctcccgcctcggagnaagaaaaaaaaaanaaaaatatatattcttttatccccccccccccgccgtggggcaacaacacccgccctatatgttttggtctttttacaaaacaacaatctaaacccgcggg

SEQ ID NO: 16519 - DNA, 923 bp, Xenorhabdus bovienii
  unsure (1)..(923): unsure at all n locations
nagggggggnnnnnnnngggngctnngngggactttcttggcagcccgccagncccagagaannaggcaaacagaccgcaccgccaccngccagaagggcccgccagngaggagtaccgccaaacnaccaaggggagcgggccacaacacagaaagacacccgcaaggagcagagcgagctaggggaaaaagacactgaccacgaagattaatccacggcgcctaggggggaaaaanacaccgcacccttaggggggagggggtcaatnagggggaccccaacctcgcatacaccaggggtcccttttttttaggaanannnggggggggccctcataaaaaaccttngnncctaggncccccgncccggattttccccccgaaggaccccaaagannaaccncggannaaacnnacccctatnncanncactnncgnnnccgnttnggttnttncccaaaacccaatgntnnggngnacacgnttntgccccctngnccncccccgnctttnccttggnaaatatggngaaaccccgnnnnagnntanaaaacaaanngnttgtncttnanncacctaatcncncangnccggttccaattccaaagggaaaaattgtttccccggttaaagcccgggtggccccccattcccaatnccctttttttttttcccccccgtttaaatttgggaannaaccccaaaagtttttaagggaattggaaattaaaaatttaaaccctataattccaaaaattttttaaccaattttaaaaaaaggggngaaaccaaccaaaggcccccccctaaaaagtttatattcccaaaaaaattttaaacccccaaggcccaaaaggggccccaattttaaaaaagggggtttttttgggggggggaaaaaaaaagccccccatttttaaaag

SEQ ID NO: 16520 - DNA, 847 bp, Xenorhabdus bovienii
  unsure (1)..(847): unsure at all n locations
aactgtcccnnnnnnnnnnnnnnnnnnnnnnnnnnnnnnnnnnnnnnnngnnnnnnnnnnnnnnnnnnnnnnngnnnnnnnnnnnnggngggnnnnnnnnnnnnnnnnnnnnngggttttnggnnnnnggggggccttggggggggngncctgaaaacccccggttttctagtagcncggnnnagaattgtaggccccggnttggnntaggttnnttntncggcaactggggnncncnggtntnncgnnacnatnnacnatnttnntgtnncaanantttnncaaatnacccggggnacggccaaanaccaggcggcncttncttttcctgggncggcctnccaaacaatgtttggggtccnaaaccccggaaaactgggaacccccggaaaagggtaagggcccaattaaaaaggggccccaatggggttccaaaccccccccttcccaaaaaaagagggttcccctttttttaaaaaaaacccccgggggaaaaaaaaaagggaaaatttgggggggagaggaaaaaaaaaaaaccccctccttaaaataaaaaaaaaaaaaaatgggggggagaaaccttttttttttttttttccgggaaggaggaggggggtgtttaaataataaaagaggaagagggggggggggtttaaaaagggagggggccccctctggggggggggttttttttttgagaggggggggccacaacaaaaggacgcccgtgggggagaaaaaaaaaaggggggggggggggaaaaaaaaaaaacacccacctccttttttttnnnatnaagggggggggggaggaaaaaccccccccccgcagggggggggctccccc

SEQ ID NO: 16521 - DNA, 773 bp, Xenorhabdus bovienii
  unsure (1)..(773): unsure at all n locations
agggaagcangttatgtttatttaagactactgtggncatgcctgcaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggctttccaaaaaaaatggccccttaaagcaaagggggggaaaacccccccggggcttttaaagtatccccggggggttccccccgggaaaaatccccccgggggccgccttctttttcccacccctcgccggtttacgagaaaacccgggcccctttttttttcctttttgggaaaggggggggggcttttctttaaataaaaccccccgggggggggatacaaacaacgggggggggggagggggggggctctcccaacaaagaggggggggggggggaccaaaaacaccccccccctttttaaaacacaccgccgggcgggggttttttatttagagagaaaatataattttttggggggggtgcacccccccccgggagaaaaaaacaaaattttttttccccccgccga

SEQ ID NO: 16522 - DNA, 902 bp, Xenorhabdus bovienii
  unsure (1)..(902): unsure at all n locations
ncagctgatgctgcagtcttgcggctgttatcagatagatatgatagtgtatcctgtattcaacatggggcagaaaatgattctcccctctgaagaacgccatgcagccctcaactggggttggtgcctcccattttggcgggaattttggaattcccctggaaaagggggggggaaatttttcccaggggggaaaaaaaaacaggttttttcccgataattgcgggggaaaaaattttttttattaaaagagggagaccccccctttttgggaaaaaaaaaaaacttttttttcttataaataataggggggcgcccccaccccgggggggaaaaaaaataaaaaagaagaaggtggggggggccccccccccccgtgggggggggacaacccccccacacacagaagaatttgttgtttttttttttttgccggggaagggaagcccccccccccccttttttttttttttttgtgggggggggtgaaaccccccccccgcgcaaaaaaagagaaaacaaccccccctctctcccccctaaaaaaagaggggggggggtgtttttataccctctttcccccccggggggaaaaaaaaaaaaaaaatttttttttttttttttcccccccccccgccccgcagagagaaggaagaatatttcttctttttaaaaaaaaaaaaaaaaatatcctccccccccccccccccctccccacaaaaaaaaaaagaaggtgttttttcccccccccccccaaaaaaaattttaccccccccccccccccccttttttttttttaaaattttgggggggcttctcttttttttttttttcccccccccaaaacccgcggggggattgccaaaaaaacaaattaaattttttttatttggggggggggg

SEQ ID NO: 16523 - DNA, 781 bp, Xenorhabdus bovienii
  unsure (1)..(781): unsure at all n locations
nnnnggggnnnnnttttaaatttgnnncccngggcnnccaggangcanntttttnnttttttcgattcgctgtaccggtcttaatcaaaaataactcatctttatggattgggctggatacagtttcgaaactttaggccctcttattcaggggaaattccggaaggggggggtttaccgggttttaaaaaaaaatctccacgggggggggggatttttttttaaaaaaaaccgggttcttttttttttttttgagaaaaaattttttttttttaaaaaaaaaaaaagagaggggtgttttaaaaaaaaaaaaaaaagtttttttttttttttttttttttcctccaaaaatttttttgttgggggggggggggtttttttttttaaaaaaaaaaatattatttgtttgggggggggagaaaaaaaaaaaaatataaattttcttttttttggtggggggggggggggggggggggggggggcgcccacacaacattttattagtttggggggggggggggggggggggggggggttttgnggnnnctnttttttttttttttttctccccccccccttcccccccccccnaaaaaaaaaaaaaaaagagggaggggggggggggggggggggttttggggcccccatccatcttcttcctccgcttcctgcgcggggggggtgttttttgtttttnnncnnncnnnaaaaaaaaaaaaaanaananncnnnnnnnnnnnatncttgtctgggtgggggggtgtttgggttggataaatat

SEQ ID NO: 16524 - DNA, 807 bp, Xenorhabdus bovienii
  unsure (1)..(807): unsure at all n locations
gacattttgggaagcccgcagtcgaaaacgggacagcgggacaggaagcagaagacagtaacacggggaatatcaaaaagaagaagcggcagatgtggaaggaaaggcaaaccgaggcagagaaggaggagaaagccaagtaaaaagagagaaaggtcctaggaggcggaggcacatggacacagcccgggaggttccccgaaagaacnccactatacgcttactaatgtattataaggcggggccactcaacgaaaaagcccagggcggttccttcctcgattaanaaaaganaacaccccgtcaaaccgaccaaatgataggaacgtttggtttcccccctacaaggcccccaaaaatttaaatccttccgggcccttttttaaaaaaagggggccccttccaaggggcccccccgggtaaaaataagggggaaagagaaaaaaaagagcccgggcgttaaatacccaaaaaaaaaaagggggaaaagcccgcggaaaaaccttaaaaaggggaaaaaaaaaaaaattaaaacaccgggggaaaaagagggggggggggaaaaaaaaccccgcggggttaaaaaaaaaaaaaaaaacaccccaaaaaacacccccccccgggggggaaaaagggggggggccccccacaaaaaatataaaaggggggaaaaacccccccgcgggttttttcccccccccccgggggggaaaaaaaaaaagaagagggggggtccctcttttcccccccccccccagaggggggaatataaaaattttaatttgtggttccacaaacaaaagaaac

SEQ ID NO: 16525 - DNA, 879 bp, Xenorhabdus bovienii
  unsure (1)..(879): unsure at all n locations
nnnnnnnnnnnnnnnnnnnnnnnnnnnnnnnnnnnnnnnnnaaccccnnnnnnnnnnnnnnnnnnnnnnnnnnnnnnnnnnnnnnnnnnnnnnnnnnnnnnnnnnnnnnnnngnnnggnnnnnnnnnnnnnnggnnngnnnnnngnnnggnnnannnnnngnnnnncgggnncnnngggnnnnnnngnnnnnnnccnnnnnngggnnncnnnnnnnnnnnnnngngnnnnnnggggnnnnnngggnnnnngnnnnnngggggnnnnnnnnnnnnnnnnnnnnnnnnnnnngggggcccaaaccctttgcccatggnccccgggnccaaggttccagnctttgnagaaataaaaatcgntgntgcaccccggcccagnccctgggcccgcctttcaaataaaatatccagaacagaaggaagccatcgggggtccgtggaatttgggcaaatgtttttcccatggaacgcgggtttttttttttaaaccccggaaaaaattttttccctggggaaaaaccccgaaggggccccaaatttttgggcggggggcctctcccaaagaaaatttcccaaaaaaatttgggaaaatctcttttgtacaaaaaggggggaaaaagggcgcccccctccccccccatgggggggaaaaaaagggggggccccccccacaaggtgtttccccccccgggggggggggggtttttttataaataaaccaccccccccccccccaaaaaaaatttaaaaaaccaacgaaggggggggggggccccccncnccggggggggggaggnnnnnnnnnnnnnnnnnnnnnnnnnnnnnnnccacacccccccccccnnnnnnaanttttttttttttcccccccacgaccanng

SEQ ID NO: 16526 - DNA, 1131 bp, Xenorhabdus bovienii
  unsure (1)..(1131): unsure at all n locations
ggccncgcgcgcggggggccccgcgagaggggagaannnggnttnnnnnacaaggggggttttnnnacttttaacttttttttttttttattnngggggggggggggggggggggannnananaaannaaaaaaaannnnggggggggggggggggggggggggcggcccccccnnggggggcgcggggcgccgaaatatttatatattattttttttnnttttccttcccccccnnnnnnngnnaaaaaaaaaaaaaaggggggggggggngngggggaccacccaacaaaaaaaccaggnnnnnnnnnnnnnnnnnnnnnnnnnnnnnnnnnnnnnnnaaaaaaaaanaaannnnnnnnnnnnaataaaaaaaaggggacgcnaaccggtgncccngggggnggnggggggttttttttttttaccacngcgcgccggggggggnnggggnnnnttataaaccccccccnnnnncccctnnnggggagaaacccggaaaattttcccccggaggnnnnnccaaaggggtttttaaaaaatnncccccccccccaaaaataagagagngggggggggggggngnnnnnnnaaannaaaanaaaaaaaaaaaacccccccaggagagggnnnnttttaaaaaaaaagtttgtttnccccccgccggggggggggccccccaaaaaaaataatttttccccccccaaaaaaagagagaaagacccgcnnccgcggggggtggggggggggttnnncncccacaaaaggagggggggnnnnnnaaagagagggtgnnnnggaaaaaaaaaaaaaaaatatggcgggcggggccnnggagggagaanancnttcttttctttttcaaaaaaaaaaataatnnnnnnnccnccccacaaaagagagagggggngggngnnnggggttnttntnaaaaaaaagggggggggnngggggagaaaaaaaacacaccccccccgccaacaaaaaaanatatagaattttggcgcgccgccccccttaaaaaaaaacaaaacacccgggggggggggggggggggggggggcccccccccccacccnccnnnaacnnnaaanannaaannaaaaaaaaaaaagacacacacccccccccc

SEQ ID NO: 16527 - DNA, 1152 bp, Xenorhabdus bovienii
  unsure (1)..(1152): unsure at all n locations
ggggnnnnnnnnnnnnnnnnnnnnnnnnnnnnnnnnnnnnnnnnnnnnnnnnntttttacgctggggtccccttcagatctgcagcagagaggggcagccctcttgtcacgaggatgggcgtaaagagcctgtttgtcgtgtagnnaggagcaagcggtggcctggggggggagttcttcccgccctgcgtcagcagagctctancgggtcggtcttgacgtaccttacggttgtggccgntaggtcatcgagaagggggnngagntnagccgtctacnnggggnncggagngaccggagaaccgnngtgccccnngaacngncgnnatcanngnnccctggngggcncttnnnnnnnnnnnttgnnnnnnnnnnnnnngggggcccaaagaaacctttttgtggccaaatgtggggccccccctgtggnccccaaggaggggggntttccccccaattgggncccccccccaggggnaatttaaaaagggcccccccgttaaaaaaaaaaaaatttaaagagggccccccccaaacccaaattttccccaaggggngggggggaaaatatttttttaaanaaaagggggccccggggggttttttccccccaagggggaaaaaaaaaaccccctttttntnttnttnnttnttttctccaaagggggaaaaggggccccctttttggggaanaccacccccaaaacccccttgttgttngggntttcccccacagagggcncccggggggcccccctttgttggggggggggnngnnntgtgttgggggtntttttttaaaacccnccccncttttttaaaaattttttcccccanaaggggnaaaaaagaaagggggggggnnnnaaaaaattntttttaaaaaaattttttttataaaaaattttcccccccaaaaaaaaanatttttttttttttttttcttccccccccaacaaaagaggggggggggggggaaagagaaaaaaaaaaaaaaataatttttttttttttttttatatagaagagagggggccccccccttctttctttttttttttnnnttttnnnttttttttttttataaaaaaaaaaaaaaatttttttttttatttnnnggggcgnnaaaggaggagagagggtctttttttt

SEQ ID NO: 16528 - DNA, 1027 bp, Xenorhabdus bovienii
  unsure (1)..(1027): unsure at all n locations
ggaactangggttgcatgacatcgcaggttcngngnaaanactantcgttatttttggcaaaancttcncggcggnagcccatttattngnnnctggggccgctttctgcctagggaacgttaattcggtgggaaaggaaaaacacgctctttgaggantaaatcaaaacggggccccctcaatatttgtgaaggagaagaaccgggggtatataaatttattttgttgcaaaaagaagggggggggcgccacttttttttctcccccacgcgagagaataatataaatctctgttttggggggtgagataaaaaaaacaagaaagagtctcactggtggggggggcacaacatatgggcgcgaagaaaaaaaaatataaaaatattaatggagggggggggggggggcccccccccaccagaaagagatgtaatataactcccgcgcggggggaaaaaaaaaacaaaacccctttctctccgggggggggggggggggtttaaaaaaaacccaccccccccccccgggggcgggggggggggggggcccccccctcctcgcggggggggggggggcgcggcggcgttaattattataaaaatanaannnnnnnnnnnnnnnnnnccccttctctattcttctttttttggtgtttgggaagaaaaaaaaaaaaaaaaataaaccttccccccccccccccaacaaaaaaaaaaaaaaaaaatttttttttttttttggtgatagaaaaaaaaaaaaaaaaaaacccccccccccccttttcttcttaataaaccccccccccccccccacaggggggaagggtttttcttttttttttttttttggggggagaaaaaaaaaaaaaaaacccaacccccccccccccacagaaggagagggggaggagagaagggtggtgggntttttttttttttataatataattataacagcgccgcccctcacaccctctttnnnnnttttttttnnnnnnnntctccgcgcgggtttatagtgcgccgcccc

SEQ ID NO: 16529 - DNA, 826 bp, Xenorhabdus bovienii
  unsure (1)..(826): unsure at all n locations
ntacttgacnaaaactnattnnnnnagggnnnnnnnnnnnnggggggggggngnnnntgtttttgggaggggnannannnnnttnnaagttttttnngnnnnnnnggctcatactgggtngncntgaaaaagcccggtttttttgtagacttnancgggancacctccatggtnnaagatagnnggctttttcttcattcttaactggngaggggttnanatgggtggaaaactgggatggantatcgcccgcttaagcaggggggtttcacgttacttacgggnccaggtaatgtggatcaatgggtaaagcccagcagtatcggggtcagcgattaaacaggtgaaaaaaaggggaggggcggggggtcaaagggggcccatttcccccttcccaaaggcttgttgggcccccgggttttttgggggggggggggggaaacccgggttaaaaaagggggtttaaaaggaaaaccccgggtttttgggggaaaaaaacgggggggttttttttccccggggaggggggggaaacattatttttttgggggggggcnagggcccccccgggaaaaaaggggggggtaaccacccccttttttttttttctccccccggttttttttttaaaaaaaaaaaaaacccccccccaaaaaaaaaaaaaaaagaaaaccccccgttgtttaaaagagaaaaaatttttttgttttaaaaaggaggggggggggggggggggggggcccctttttttttttttgttgtccccccccgtgggggtgggttgttcccccccccaaaaaaaaaaaaaaaacatttttttttttta

SEQ ID NO: 16530 - DNA, 609 bp, Xenorhabdus bovienii
  unsure (1)..(609): unsure at all n locations
nnnnnggggnnnnnnnnnnnactagggcctttgggagcccgntgggggaannnactnnnaggtttttnnnnnnnnnnggttcccacccgttgggggggnggggnngnngnggnngggnnnnnnnnnnnnnnnnnncncnnnccccncctttnnnnnngggggnggggggggggaaacnnnnnnaatggangnaacccnaaanacccannnnaaatccccggcccccggggttttttctccaaaaccccggggttttgggnttatttgggggtttttngcggcccccgggtttnccctncccccgggcccaaaggggggggnanaaaacccccaacccgggtttttggggggnccccccaagggggggngggggttttttttccccccctttgggggggnnnaaaaaaaatttnaaaaaaaaattnnaaccccccccggggtttaaccccccggggggggggcccccccaaaggggggggggnnnnccccccccaacccccccccnaaaaaaaaatttttttggggggggggggggnnnngnnnnnnnnnnaaaaaaatttntnnnngggggggggggggccccccccccnaggaaagggggggggggng

SEQ ID NO: 16531 - DNA, 995 bp, Xenorhabdus bovienii
  unsure (1)..(995): unsure at all n locations
taggannnnnnnnnnnnnnnnnnnnnnnnnnnnnnnnnngggtcggctnntatcaggcctgcgnatccccgccgcgggaattaaggggccccaatggttcggattttcaaactgggccgattttggcaaaagggtttttttttggggctggggggaaaaaaaaaaccctgtttttaaagggggggggtttaaaaaccccggaggggggggggtcccccccaaaacgggggggtttccccgccccccaataagggggtctttccaaaacaaaaaagaaaaaggagttttttttggggccaaaaaaaaaaattattccggncacaaaaataaagggtgggggggggggggaagaagaaagatatttttttccccccccgccccccccctctctttgggttcttctcgggggggggnataaaagaccaccccctttttttttttttcccgcccgcgggtgtttatataaataaaaccccccccccccctttttattgttggggggggaaaaaaattttttgtttttgggngggggcccccccccccccctcttttttgaggggggggggggaaaaaaagaaanaggggggggtaataaaaaaaaaagaaacccccccggcgggggttcttaaataaaaaaggggggccccccccctctttttgggggtggggggggggggtggcttctaaaaaaaaaaaaaaaaccccttttttttttttgttgggggggggggaaaaccaaaaacacccccccctcccctnttcttttgtttctttttctctccgctttgcggggggagttttctttcttttttttccccccccccccccccccaagaagaggcggggtggggttagggaggaacaaatgtagatttctatctccgccgnttctaacgnnttttnnttatttatatatctttacgaatgtgttagatgtttttttcttttttnttttctnncgggnttcgccccgccgcgcgcgccctcccgccccc

SEQ ID NO: 16532 - DNA, 930 bp, Xenorhabdus bovienii
  unsure (1)..(930): unsure at all n locations
nnnaaaaagggggggngnnnnnnngnntttttnngnncaatttctactttggggggnccggccggccnnnncncccgnggncggcgtggcnnncnnnnnncntggagaggggnagaaaaaaaaaaaaaaaaagaacttccaaaaaaaaaaanttaggacctggagcnaaaaagcaaaaaaacgngggtttccccggggggggaaaacccccctggaggaaccccaaaaaaccccccaaaaaaaaaggcggcggcccccaaaaaaaaaaagccccccgggggaaaaaaaaaggggggggagaggggggtggtttttttaaggcccccccccccccccaaaaaaaaaaaaaaaaaaaaaaaaggggggggtattggtaaaaaaaaaaaacaaacacggcgcccggcccccccacaaaaaaaaaaaaaaaaaaaccccgggccccctccctaacaaaaaaaaaaaaaaaaaaaaaaaaaaaaaaaaaaagggggcgttattaaaaaaaaaaatgaaaaaaagagggagggggggggggggggggggggggttttnnnnccccnttncccccccccgccgcccccggggggggggcggggggggggttggggtntttttttcnaannncccacccccccccccaccacacaaaaaaaaaaaaaaanatttttgnggggngggggggggggcgggtgcccctcctccccccccccccccccccccnngccccccagcaatccaaannaaaaaaaaaaaaaaaaanaaccncnncnacnntncgggggggggggggggggcgggggtgggtttntctgcttgggggtaattgttgcggggatgtgacccgaaaaaaaaaaaaaaaaaagccaaccnccccccccccnnnncgcnnggnncncccncccctcctgcctggctcttcgccccttgtaa

SEQ ID NO: 16533 - DNA, 914 bp, Xenorhabdus bovienii
  unsure (1)..(914): unsure at all n locations
agcaaccttaggcgggtngncntngaacactngcccangnttttttccangnntgnnatgngnnaanatgnanatanatnttncttattaccgtnntgnacnncgtnctnatgnanaaaaaggggctnncggnnaaggtgnatntncggnnnatgnatnnttcacnaccaccttnatttgggngaaggaaagnaaccaaatntttcaggnncggggggttgccaggctttttattggtacaacccggccattgattggcaaggggcagccaaacccgggggaatggatttttggttccagggcaattgggaaaatggcttttaaaaacgggcatttttggcccttttttccccccccgtttggcccccccttgcgtttccggggaaaacccccccgttttttttcccccccctttcccgggggagggggtttttttttcccccccaaaaaaaaaaaacaagggggttggtccctttcttttggggggggggggccccccccaaaataaccccccccccccccccacctttttttttttacccccagaagaagagaaagaaaaaaaaacccccccggcccccggcgaaaaaaaaaaccccccccccccccggggagaaaaaaaagagagggggtttttttttttttaaaaaaaaccaccccccccccccccccgggggggggnnnncccacccaataatatttattataaaatttgggggggcggggggggggtggggccaccccccccacaaaaaacaacaaaaaaaaaaggtgggggggtgggggaggggggnctaaaaaaaaaaaaaaaggggnttngngagaggaaacaacacacaacacccccctcccactcttnttnnnntnnttttttttnttgttgtaaaaaaaagaaaacaacaccacaacaacct

SEQ ID NO: 16534 - DNA, 1142 bp, Xenorhabdus bovienii
  unsure (1)..(1142): unsure at all n locations
gtagacatcttgggatatncgngancttncggtnactctcggggnnnttcncttncttgangatnncctntnacnctngnanacnnccantncttnnncggncncacncnacnanatggggncgnatnatnnncgtnagggngccaagggatacnctggntgggncnagnnnagnnnaccnagngnnncnannanaaagnttggnntttnncggntnggnnaaaaggntnncggtnnattnttnaagnnaagannccggccggggggtttttttgggcctttggaacaccccggaaaagnccccaacccaaatttttgggggnaaatagggaaaaaaatttttttttcccttcccttgggggntnggggggagagaaaaaacccccctctgggggaaaaaaaccatattcccccaaaacctttttttataaaaaaagggcccaaaaaaaaaaccgggtttttttttgtgtgcggacgcggcggcaacccttctctaaaaaaatatttttaaaaaaaaaataaaaaaaggggggggattaataaaataaacccccgggaaaaaaaaacccgcggcttttttatataatttttacccctgggggggggggggcccggccgccatattttctcccaaaacccccgcggagaggaggggggggcgccccttttttttttttatatatttttccccccccccccctcttaaaaaaaaagggggggggtttgccccccaccccctttttttttaatttttttttttttataaaaaaaaaaaaaaatgggaaagggggggggcgcgnnnnnnnnggcgggggncgcgccccgccggccgcnnnnnaaaatttntnnnaaaaaaaaaaaannnnnntaaataaataattatttnnnaaaaaaaaaaaaaaaaaaactcttttttttttnnncacttctctcggggggggggggcgggtgttgtgtttttttttttttttttttnnnaaaaaaaaaaaaacacaccnnnnnnnatcncncccccnnccgggggggcgcggnngggggggaagagagatnnnnnnaaaaagaaaaaaagngngggggggggnaannttttttttttttaaaaaaaaaaaaaaaaaaaaaaaattacttttttnttttataga

SEQ ID NO: 16535 - DNA, 799 bp, Xenorhabdus bovienii
  unsure (1)..(799): unsure at all n locations
gatacnnnnnnnnnnnnnnnnnnnnnnnnnnnnnnnnnnnatgcctgatattctcagaagcagggtaataaaatccggtttcctggtntggagccaaagccaattccaaattaattccgggcccctttcggncaaaggtcccaattgtggggtttttttttcccccgcccttaaaaaattcccctccccgtgggggggagattttccctcccaaatttccccaatgtgggccaaaaaaaaaaaaangaaggggtcccccccggggcccaaaaaaaaaaaatttttttttcnccccccgggggggggggcgcccaaaaaggnnnnaaaaaaaccccctttttttttttttcccccaaaaaaaaaaaaggagggcccccccccaaaaaaaaaaaaaaggttatgtttgtgggggcggnngnnnncacggggcccccccttccggggggggggggggggggttttttttttttttttttcccccccccccccccccccttttttttttttttttttataaaaaaaaaaaaaaaaaaattatgtggtgggggggggggggggcccccccccccccccccaaaaaaaaaaaaaaaaaaaaaaacaaaccccccaccaccccccctgtttggtgggggggggggggggggccccacccccccccccctggggcggggggggggggggggngnggggaaaanaaannnnnnnnnnntttttttttttttttttttttttctttttnnanntnannntntnntttctntntnnnnnnnnnnntttnncncccccccacccaaaaaaa

SEQ ID NO: 16536 - DNA, 725 bp, Xenorhabdus bovienii
  unsure (1)..(725): unsure at all n locations
tatacatcagctcgacgggatctctaagccttgcactggctggctcttgagactgcacgcttccaggcaagaacacagcggttttgattggcgctaaggaaaccccattctctggggccactaaactttccaaaaaggcctgggccgaaaaatattggttttttttttccccaaaaaaccccccttttttgtcccccccaaaaaaattaaacccctccttgttgtggggaaatttttttttttggagggcccctccccccccccctttttgaagagggggggggggggggtttttttttttcccccccccccccccgccgggggggaaacccccccccggaaaaaaaaaaaaacccgggggccccccccccccccccctttttggggggggggggggggcttccctctttttttcccaaaaaaaaaaaaaaaaaaaagggggggtgttttttttttttttccccccccccccccccccccccncccggggggggaaaaggaaagcggggaaaacccgcccccccccccccccccccccggggggggcgcccccccccccccccccaattcaccgcccgccccccccccccccccaaaaaaannnttaaattggttgtgngnggcggtttttattcccccccccagggaggggcggggggcccccccaccgttttttcttttttttttgtttttttttttnaacaacacccacccaaaaaacaaaa

SEQ ID NO: 16537 - DNA, 1275 bp, Xenorhabdus bovienii
  unsure (1)..(1275): unsure at all n locations
ggggnnnnnnnggggggnnnnnnnnnnnnnggattttnnnnngaaattctttgggnaanngnncacggagcnacccngnnnaagagccaaggacncggcnanaagttttttcnnnnccgttttacttaggagnnatatacgagccttcggtttacccgggngnntacctnctnanggtnctttnccgttcggaaatcccgncgttatttttttccctgaaaagttcctgtaggtttcaaaaactgggtatcggccgccttttacattggttggaacccaggtaaacacaaaaggcctctgtggggaaaaacgccccccccgtgtaacaaaagaattttcaaattccccaagggggccgcggggattaaaaccttttttttggtaaaacccgggtttgaaaaaaaggggggcgggggttttaaaaaccccccccaaaaaagaggggggggctgtttcccccccctcttttttttataggggaaaaaacaagaaacaccccccccgcgaaaaaaaaaaaaatantttttttttttttttttttttttataaaaaaagagaggcggccccgcccccccctctttttttttttttttttataaaaaagaagagggcgggcgggggcgggggaaaaaaaaaaaaaaaaaaagaggggggggggtggggggggggggcggcctcttataaaaaaaaaaaaaaaaaaagagagaggaagggggtggagatntttttttttaataaaaacaaaaaaacaaagagttgtgggggggggggggggggggggcgccccccccccccctccccccccccccgcgcagaaaaaagaagagaaatagacacccccccccccccccctctcttctattttttttttaataaaaaaagaaggcgcagggggcgcccccccccctctctcttttctttagggaggnnggggggggggggggggggnttttttggttttttttctcccctctcccccccccccccccaacaagaccncggggggggaggggggggggggggggntttttttttgntntggggggggggggggggggnggnnnnnttttnncncccccccccccccccccccccccnccnaatnaatannaaaaaaaaaanaaaaaaaannnnannnaaggagagngaaggggggagagaaaaannnnaannnnnnnnntttttttttttatattnnaaaaaaaatnnannannaaacnnacacccccccccccccccccggngtgggtttaagataaagagaaaaaaaaaaaa

SEQ ID NO: 16538 - DNA, 735 bp, Xenorhabdus bovienii
  unsure (1)..(735): unsure at all n locations
nnnnnnnnnnnnnnnnnnnnnnnnnaaattttttggnnnnnnncnnnnnnnnnnngnnnnnnnnnnnnnnnnngggnnnnnnnggggggnnnnnnnnnnnnggnnnnnnggggggggggggggnnnnnnnngnnnnnntggggggggggnnnnnnnngnnnnnnnnnnnnnnnnnnnnnntgggttttttttttttaaaaaaaaaaaaaaaatttgggatttttcccactgcggggtatanccnggacttcgggtntcccccgggggggnntaacccttcttggaaggatccccgccttttttttcttggggggcccttttggaaaaaaagcagggtaggttccgttttggggggaacccattttttttttaaaaagctttgggaccccccaaaatctgncggggggttaaaaaaaaaaaaaatggggggggggccccaaaaataaacccccccccccagtggggggaaaaaaaataatttttccccccaaatttttttttaaaaaaaaaaaaaaccccccttttaaaaaaaaaaaaaaaaaaacccccttttttttttttttaggggggggtgttgttttttttttncccnccccaaacaaaaaaaaaaactcttttttctttttgtttggagataaaaaaaaaaagggggggggggcggggccacaacataatatttttttttttttggggggggggggggggggcgcggcgcgcccccctccctctttaata

SEQ ID NO: 16539 - DNA, 1143 bp, Xenorhabdus bovienii
  unsure (1)..(1143): unsure at all n locations
nnnaaaagggnnnnnnnnnnnnnngnnnnnnnnnncccccccctgngnnnngnncnnnnnnnnnnnnnnnnnnnngnnnnnnnnnnnnnnnnnnnnggggggngnnnnnnnnnnggaagngggnnnnnnnnnnnnnnnggnnnnnnnnnaaaggggnaaaagnnnngnnnnnnnnggnnnnnnntttaaaaaaagtnnnnnnnnnnnntnnnnnnnnnttnnngnnttnnnnnngaattttttcttttttctttnngnnnnnnnnnnnaagagaccaactcccctcccaatctctttaaagnnccccttaaannccccccctaagncccccgcaaannttnnnccctaatatnntaaaataaattntnnnnnggggnngaaatnnaaaaaaaccnaaaaaatttccccacctnggggnngatnacactgggnnaatatnacccctngttttttttcccccccaaaaaccccctnccagnccttttcccaatccggggtaaatttggtaatcccttttttttttttcccccccaattccatattaaaacccccaaggtttnaaaaataaaaataaatatttcccccctttttccctctattcccccaaaacccctctttttttaacaaaaaaaagaaaaattttcccccccccttttaataaccctcccccccccaaaaaaaaaaaaaaaaaaaaccccccccctggaaaaaccccccccccccaaaaaaaaaaaaaatatttttttaaaaaagaaaaaaaccccccccccccgggnnaaaaaaaaaaaaaaaaaaaacacccccccttcaaaaaaaaaacccccccccccccaacaaaaaaataaaaatccccccccccccaaccactcctcttttttttatattataaaaaaaaggggggaggggtgttgtcctcccccaaaaaaaaaaaaccccccccccccccaccaaaaaaaaattttttttttttttaaaaataaaaaaaaaaaaaaaaaatattattccttttttcctcccccacccacccacaaaaaaaaaaggcctccccntnnttntttttttgaaaaaaaaaaaaaaaaacacacccccccccccccccccacanaaaattctctncccccccccccacaaaaaaaaaaaaaa

SEQ ID NO: 16540 - DNA, 684 bp, Xenorhabdus bovienii
  unsure (1)..(684): unsure at all n locations
tgatcatcagtcggaccgggtctctaagctactatcactcgtgcaatctctagtttagcaaaacgtctgcattcagggataagatgaaagccgcatttgaagtacggggaaattcgtaaccggcccaatgggttgggaaaaaccccccccccccccttttgggatttggggaaaaatttgaagagggggggggttttgggttttttccccctttttttttttccccaaggagtggccctcttggttatataaccgggggggggttcccttttttctttcaaaaggggggggggggggttttttaataacgaggaagggggggggggggggggggaacctcctttttattttattgtgggggacgggggggggggggggggggttttttttgtttttcccaattctcttcttttataagaaaagggggggggggaaaaaaaaaaaaaccccgggggggggggggggtgtttaaaagagggggggcgcaaaccccctttttttttttgggccccttgggcccccccttattaggtttcccccggggggggggggggggnaaaaatgggccttttttgtgtgggggttttttttttttttttttttaaaaaagggggggcgcgggggccctttttttggggcctctnggggggggggaaaaaacatttggggggggttattttttgg

SEQ ID NO: 16541 - DNA, 882 bp, Xenorhabdus bovienii
  unsure (1)..(882): unsure at all n locations
gtgccttgacgnanattncgagcctncgggtactccggnggnatnccnctagnagtcgtatnntttgatgaatcgggccccatnaacattcccaagaaccctggggccggggccattnggggggcaccaggagaccccggttaccccttttttttggaaaccccgggcccggggggctttgcctggggaaaaccccttttttttccaaaaaaaagggggggggccccttggtgattgttttaaaccccccttgggggtttttctctccaggggaacaacctcctttggggggggggggggggggccccccccttttttaaaaagaaagcgggcggcggcaaaaaaggggggggggggctcaaaaaaaaagagggggtgttttcctccccccccggggggggggggccccaaaaaaaaaaaaaaagggggcggggggaataaacttgttgttgtttttttttttttttagaagggggaaggacccccccccccccgcgggggtgggaaaaaaaaaaaaaagagaggggggggnnnaaaaaggaaccacacaccccccccccccccccctttttttctttttttttttttttttaaagagaaggcccccccccccccccccccccgtgtttgggtntncccccccggnccccccccccccccccccccccaaaaaaaaaaaaaaaaaaaaaaaaaaaagaggggggggggggggggggccgcgcgccccccccccccccccnctnaaaaaaaaaaaaaaaaaaaagggggggggggggggggggggggggggggtttttttttttttttnnatatataaaaaaaaaaaaaatatnnnancccccaccccccccccccctcttctntctgttctgtggggggggg

SEQ ID NO: 16542 - DNA, 667 bp, Xenorhabdus bovienii
  unsure (1)..(667): unsure at all n locations
nnnnggggggncnnccnnnttnnnnttagagggaanaggctcncccgggtcctctagggcagtagcttaccgctttatccctctgattcccatancggacccgtccccgggntcctctgagatccactttttcttgtcatttgaacgacanaagttactggggnaacaatccaacgaaggccccacctttttggccctttggggcccattcggaaaccaaattttacccccgggaaaacttttacaagaggccctttttggggaaataacccggggatattttttttcccaaacaaaggggggggaggggtttacacccgggggtaaaattttgaaaaaacggggggcccctgaaaaaaaaacaaacgggggtttttgggggggggaataatatcgccccgggaaaaaaatttttaacttttttgggggggggaaaaaaaaaaaggagccttttttttcgggggggaggacacttttttttttacaaaaaaaagggggggggggggggtttttttttcttttncccccccccccgcgaaagaaaaattttaaaaaatggtgggggtaaaaaaaaaaaaaaggggtttttttttttccccctccccaaaaaaaaaataggtatttgttggggggggctcccccacccccctttatgtagagaggagcg

SEQ ID NO: 16543 - DNA, 1095 bp, Xenorhabdus bovienii
  unsure (1)..(1095): unsure at all n locations
nnnnnnnnnnnnnnnnnnnnnnnnnnnnnnnnnnnnnnnnnnnnnnnnnnnnnnnnnnnnnnnnnnnnnnnnggattaagattcgatctggtaccggggttcctctagagctcnnnccncnnnnnnnnnnnnnnnnnnnnaaaaataaaatcgagctcgntaccggggatctctagagcatgagaagtaaanncgccgtgactataaagtttttaggaggggaaaatccccggaatttttgaaaggggtttcccaaatttaaggggttcaaaaatttttaaagtcccaaaaagggggggggaaaataaaaaccttttttgggggaaaaaaaaacccgatttttttttaaaaaaaaaaaaaaaaaaccgggttttttaaaaaaaaaaaaaaaaaaaggggccgcgtgtgttttttttttaaaaaaanaatnngggaaaagaaatttttttttttttggggggggcgccctttttttaagggggggggggggaaaaaaaaaaaagaagacactcccccccccccccctcccctcctcccgaggannggggggggggaaaaaaaaaataaaaaaaataaaaaaaaaaaaggggggcgcgcggcgcccttttttttttttttttttttttttttttaaaaaaaaaaaaaaagagagggggggggggggggggttttaggaaaaaaaaaaaaaaaaaaaaaaaaaaaaaaaaaaaaaatcccccccccctccccccccccccctcctcnccccccnnnnntngtttttttttttttgggggggtgttnnttnttgtgttttttttntncnnnnnnnnnccctctccacccccaaaacaaaaaaaaaaaaaaaagagaggggggggggggggggggggggttgggggnnttnnnnnnccccctttctctctttcccacctccccnccccctcncccnccgcggagggaggggggagggggagagaaggnggaggagngnnccccccncccnnccccccnncnnnnnnnnnnnnnnntttttttttaaannnnnntttttttttttttttttttttntttttataattaaaaaaaaaaaagggggggggggggggcggggga

SEQ ID NO: 16544 - DNA, 919 bp, Xenorhabdus bovienii
  unsure (1)..(919): unsure at all n locations
nnaaaaggggggnnnnnnnnnngnnttnnnnnngccccttttnngctgcctgcaggnncgatgatccttaggatttttgctgttcttcgangagggagcaaatttccncttatagggnactggagggaccccctgtagncatcnctgaaggttgagacaganngacagncctttnccnnngattggcnnaggannnnacanatnnatnnnnnngntttttannnnnngggggggnnannnnnnggggggggggggtgnnnccnnnnnnnccnnnnnnnnancnnncnnnnnnnnnnagggggggggaggtannnnncnannnnnntcnaaaggagtnnnnngggnnnnnnnngntnnnngggggttnttttttttnnnnnnnnnagagacccccctagtatatctgtggngccctttgttccccctaagncccgagttttnnccgagggncccttattgggnnggaatttttntcttttttnnctaanaaaaaccccaccctttagagnttnacctttttncccactttccccctggggnnnttgggttttncccctttaaggnnaaatggggncccccaaaataagggggggggccccgcccccttttttttttttttaaaaaaaccccggccccccctcttttttttttttncccgggttttccccacaatttgtggggatattttttttttggggggggttttttttttaaaccccgcggatttaatntnnnttttttatatttnaaaaaaaaaaatggtggggggggggcttttttttttttttttcccccgagggaaaaaaaatcccccggggggggccccccccccccaaaaaagagagggggggggggataaccccccccccccaccccgggnngggngggnggtgggngttttattactccacccccccct

SEQ ID NO: 16545 - DNA, 1156 bp, Xenorhabdus bovienii
  unsure (1)..(1156): unsure at all n locations
gggctttgaaacttttaagtatttttnnangtcactacggcttaaataagcggaaattcggggnnccnctagagccggcccnnnnnttnanggctaatttctcaccccccaccacctttgggggtggggggggaggggaaaataaaacttacancggggggtcatttcctccaaaaatacctaccccaaactccccccctcacccacacaacaaaacaacacacacagacccacccccccccccctccacccatccctcaccctctcttctgcgaccccccccccctttcggggggggggcccccccttttttttttttcccccccccccccacccccacacaaaaaaaaccccccccccccaccaccaccccccccccccccccaccccccccccccctaaacccaccccggggaaaccaacacaaaacacacacttattcacccaccccaaccgggcgaccggcccccaccccccccccttttttttttttccgcgaccccccccacccccacaccaccccccccacccccacccacaacccaaccacaacccccacccacccacaccccaccccccaccccccccaaaaaaaacccccccccccccccccaaaccccacaccaccccacagcacacacccacaccaaccccacaccacacacacnacacacccccccccccccccccccccccccacccnccaccaccccaccgccgcccaccacacaccacccccaccccaaaccaacacnccaccccccaccaccaacaacctaacaatacacaccacacaccccacacgcaccccacaccacccacataaacccacccgacacccacatacaaatcacaaatacacacaccaacacacctaacccncaccctacacacatcacacacatccnctccccacccaccctctctcaccatatcacaccacccactctactactgctcacctcacccgcacatacgccgacccctcacccgcacccacccnctccaacaccactaccaccacaccacactccacaccctccacctcaaccaaatatactctaattacacacacacgcaactagatccatccgcatcctcctacacaccncaacacacaccacacagcactatcacacacatcancaaccacgcg

SEQ ID NO: 16546 - DNA, 1283 bp, Xenorhabdus bovienii
  unsure (1)..(1283): unsure at all n locations
nnnnnnnnnnnnnnnnnnnnnnnnnnnnnnnnnnnnnnnnnnnnnnnnnnnnnnnnnnnnnnnnnnttttnnttacccnnaattttcnnnnnnnnnntccnnnnnnnnccccnnnnnnnnnnnnnccnccnttttccnnncnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnaacccnnnggaggtgnnttttttaaccnnaaaaaatttttcccgnnaagaancccctttccggnggnnnttaaaaccccnccggngggggggggggnnaaaattccccccttttcccnttttaaaggntaaggagtttcccgggnccccaaaatttttttttttaaaccctttggggngggggtttttccccttgtggggttttcacaaaaggaggttgggggtttntttttttggccccttgggcnttcncntggttnntggcctggggnnnttaggttgggggcaattcaattcaattcntggggggggtnctttttttaaatttttcggggggggaaaatataatattttttccccccgggaaattcnccccggggctgtgaaattttcccggggaaatttgccgctttttgcgctgtggggggggaaccttcccgcgttggggagaaaggccatatttaaaggcgcttgggaattcccgtgggaacaaattataattcgggccccaggggggttttatggggggggaatatttttttgggggggtttaaaaagggggggtgtcccctggtgggcggggggccaaaaatattgggtggaaaaaaaaattgttggtttttataaacccccgccggggcggggtgggggggggggaaaaaaaaaaaaaacacaccacccccccccccgcccgggcgttggttttttttttggggggaaaaatatttttttaagaaggaggcacaaacaacaccccccaaaaaaaaaaaaaggaaaaaagaaaaaaaaaaaatattgggggggggggggggggggggggggggccacaaaaaaaaaaaaagggtgtggggggggcaaaacacccccccccgcccgggggggtgtgtttttcccccccccccccccccctcctcttgggggggggggggaatataatattggggggggggnnccccataaattcctccccccccgcaagaaaaaaaaaaaaaaattatttttttttttatttttatttttccccgcccccccgggggggggtttaaaaa

SEQ ID NO: 16547 - DNA, 1066 bp, Xenorhabdus bovienii
  unsure (1)..(1066): unsure at all n locations
gggcccngagggnnnnnnnnnnnaaaatnnnnnaaacaacgggggngggnggnnnnnnttnngggggnggggggggnggnnnnnngnnccggagaaggnnnnngnaaaannncgncccccacgggttaatttntannnnnnngggggcccaacataaacggggggcccgagaanccccacgggccccgagaggattttccccccccctgtgaaaaaaaccgagaaggggtgttaaaaatttcccaagaagaggttaaaaaaaaaaacaaccccccccccggaaagaggggtaaagggcccccggggnaacccccggttaaaaaccccccccggggggggggggggggggacccccccccgggggaaaaaaaccccgggggagaaaaaagaggtttttgggggaaaaaaaaaaaaaggggggggcgccaaaaaaaaacccggggaaaaaaaaaaaaaacgccccccccccttggggggggaaaaaaaaaaaaaaaaccccccccctggggggcccccccccccccccccctttataaaaaaaaaaaaaaaaaaaaaaaaacgagggggggggaggaaaaagagaaaaaaataaatatagggggggggggggggggggaggaaaaaaaaaaaaccccccacccacccaccagagagagggaggggggggggcgcgccccccccccccccacaaaaaaaaaaaaaaannnnaaaaaattatttttttttgtggggggggggggggggggggggggggnnnggggcnnnccccccccccccaaccaaacaaaaanaaaaaaataaacacnaacntaaaaaacttttaacnacnnnnnncngngngaggaggaagggggagaaagaaaacnaaaaaacacacaccatcccccncaccacanatacctntnntnanaaanaaannaaataatantnnnnnnnnnnnnnnnnanacntnntttnntttntnttttcctttttcctnnnccaaccccnaacnnncgaggggagtagggggngganagncgncnnncnacnncaccnccccccccnaccacaaaaaaaaaaaaac

SEQ ID NO: 16548 - DNA, 1010 bp, Xenorhabdus bovienii
  unsure (1)..(1010): unsure at all n locations
gcacccattgggtantggatgccaggttcacctactcccctttataatattaaggtaatggggccgaatattacccccattaccttaaaatattaggnncattttggttgtttttttttcacaaaaaagtcccaagggagggctttctcttttttccaacaccccttttatttaaaataaggggggggtttaccgggaaaattggggaaggtgaccccatataacacaagtgggggcacctccctaaaaacccccccaccctggggggacacacaaaaaaaaaccccctccggggtagtccccacccctcggaggaggtgttttttcttttttcccaaccaaagggggggtgtgggtggggcacccacctcctttttgttttattaacacccaccccccccttctttttctctttttttttttgtgggggggggggagaaaaaaaaaccccccccccctaataaaaaaaaaaaagggcccccccccccgccgtttttttttttttttttttgggaagaagagaccgccccctccccaaaaaaaaatagggagagaaaccgnccctttataccccccctgctgggggggggcggccccactcccccagagccgggggggttaggtttttatttggccgggggcccccttcttgggaacgtttttcctccttttccgtggaagaaacacaaacaataggttatagggtccctggttttttaattctcccaataaacatttcttcctatttaaaatggaaaaagtggcacaggttttaaccattatataacccgacctaccggcttatgtcaaatacttggcgggcggagccatttggcggggctataagccaaagaaaaagaaaaagtcccgaggacaaagtcagcccgccaatgggnggttttttccacatagggctcccgccnnccctctggcgcgagttattcccaaaaaaaatagggacgccttccnagtcaagaaggttggaccgaaacccctggcaggaccttaat

SEQ ID NO: 16549 - DNA, 1104 bp, Xenorhabdus bovienii
  unsure (1)..(1104): unsure at all n locations
atggtttccgaattncgggcctcggtaccccgggggattccctctgaggtctgggaagaagtgctcgccgggatcatcgtgccgaagtgggccactcggacgtggntaaaaactaaaaagggtgggtttgccgggaggtaaattaaacataattacccgcctgccggganagggtttggagaataaaatttgaaaaaaagggggcttccacccccccgggaggatatcccaaaataaaaaaggggggggggtttttttttttgggggggtaaattctccccccccagggggggtttaaaaaaggggcctcccccgggggtggggtgggcacccaatctttttttgggggggtggttgtgtggtgggaaaaccaaaaggagggggttttttttttttttggggggggggggcgcccccccaaaaaaaaaaaaaaacctcttcttttttttttataaaagggggggggggggggggggggggggccgcccccccccnctnnnnnaanannnntnnnttggnnaananaaaanaannnnnnnnnnnnnnnnnnnncccnncnnnnnnnnnnntnnttttttnttttttttcnnnnnnnnggggnggnnggggnnnnnnnnnnnnnnnntnnnnnnnnnnnnnnnnnnnnnnnnnnnnnnnncncnnnnnnnnngnngngnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaanaaaanana

SEQ ID NO: 16550 - DNA, 938 bp, Xenorhabdus bovienii
  unsure (1)..(938): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnagaaaaaaaannnnnnnnnnnnnnnnngtgtttttttaanttaaaatanaaaaaaaaaaagagggggcctccaaaaaacacccaatcccgggtnnnggcccttggggtttacccactcacgggccccgggagggnnnnnttggcgcngtngncncccnatatttgagttttttttttanctttttttttttttttttttnnnaanaaaaagagagaaancccacccttttttttttgggncnccccttttctttttttttnncaaccttttggggtttggggggnanaaaattttttatttttttttttttaaaccacccccgcgggtttttttnncccccaaaaaaaaaagaaggggagggccccctttttttttttggngggcccccctccctctctcaatttttttatttgnaacaccccccccccgcggtgtttttttccccccaccaaaaaaaaaaagggggagggggccccccctatttttttgtgggggggggcccccttcttttttttt

SEQ ID NO: 16551 - DNA, 1007 bp, Xenorhabdus bovienii
  unsure (1)..(1007): unsure at all n locations
nnnngggggnnnnnnnnnnnnnnnnnnnnngttttctcttgtcggcccggggccccgggnccccccggagccctctccgcgcgttggcccatgggatgctctcgtgctgttaggggccccgccgccccggctttananttattaaacgtaatcggacccgttacccggggacctctaggggccctggaggaaatcccttttaaaaaccaattttttcaccaaaaggggctttattgggccctaaacctgggtaaagggcctttttcccagggaattttaaaaccccgggcggaaaaaaaaagggggggggggcaccccccttgttttccacccacccccccacaaaaaaagagggggggggggttttttttttttctctttttttttggggggcggccccccccccccgcaaaaaaaaaatttcctccccccccccaaaaaaaaaaaaagaaaaaaagggggggggtgggggcacccctctctttaattatataaaaaaacctccnccaccaaaaaagtggggggggtggggggggggggggtnacaaccccccccccccccccctttttttaatatataaaagggggaggggggggggggggggggggggggaggggaccccccccccccccccccccgccccccgaggggaggggacccccccccccccccccccacaacaaaaaaaaaagaggagggggtggtggggggtgaaaaaaaaaaaagaaagaggggggggggggggggcggcccgccccccctctatatnnanaanaccnaacctaccccccctcccccccccccgcgcgggcgggggggggggaggggagagaaaaaaaaaaaaaaaaaaaaacaaaccagggggggggggggggggggggtgtggtgttttttttttttgttttttttttnnnnntttnnnnaaaaaaaaaaaaaaaaaaacaaaaaaaacacccacccccccccctcttctcttcttnttggtgggaagagagtaaagaaaaaa

SEQ ID NO: 16552 - DNA, 1120 bp, Xenorhabdus bovienii
  unsure (1)..(1120): unsure at all n locations
nntttttnnnnnnnnnncnncnnnnngnnnnntctctatggggggnnannnnntgggggggnnccnnnntnnnngtttttnnnnnnnctagtttaaagaatancgggcctncggtaacccgggggaactctctaaggacattccataattcgtgaacctttggaaaacgaagcggccttgtaagattgtttccagaaaaacccgggtttgggtttttaccccatttttaaaaaaggggttggcccccgggttttttaaaaggggaaaacccttttttttttccccccaaaatttttttattttttttaaagggccccaaaaattttggggagagaaatttttttttggagaaaaaaaaaaaaaaaaaaaaatttttttttttgtgttggtgggggggcccaacaaaggggggcgacaaaaaaaaaaaaaacataaaatttattttttttttttagaagaaaaaaaaaacaaaaccccgggcgccgcggggtgttttttttttnttaaaaaaaaaaaaaaaaaaaaaaaaaataaaatttctctcttttttnnnnncccccccttttttttttttttcttgttatggtgggggaggggagaccaacccccccccccccgccaagaaaagaaaaaaaaaaaataatttggggggggggggggccgccccccccccccccccccccggagaaaggagagggggggtgggttgtttctcccccccccccggcccccggggggagaggaanaantaatgaattttttttttttttttttctctctccccaaccaaaaaaaaaaagaaaaaaggggaggggtggggggnnnngttttttttttttttttnnnnnnntttttgngggngngnngggggnnnnnnnnnnnnnnnannancaaannnnnnnnnnnnnnnnnnnnnnnnnnnggnnnnnnnnnnnnnnnnnnnnnnnnnnnnnnnnnnnnnnnnnnnnnnnnnnnnnnnnnnnnnanncnnnnnnccnnnnnnnngnnnnnnnnnnnnnnnnnnnnnnnnnnnnnnnnnnnnttnttnnnnnnnnnnnnnnnnnnnnnnnnnnnnnnnnnnnnnannnnnnnnnnanaagaacccctcaaccccccccca

SEQ ID NO: 16553 - DNA, 1151 bp, Xenorhabdus bovienii
  unsure (1)..(1151): unsure at all n locations
nnnnnnnnnnnnnnnnnnnnnnnnnnnnnnnnnnnnnnnnnnnnnnnaagaatgcagccccaggggaaactgctcaacatgccagcgaagggcccaccagcaaagggaagagtcaaaggaaagcaaccgataactagctcatcctcacagntctacggagggtttgtaaggcccaccattatgctagacgctacctgccgtagaagacaccagnaaaaatnnnnnnnnnnnnnnnnnnnnnnncccaaaaaactttttccaattgcccctgtcaaagggtccccccttaaaaggggggggaaaagtggggggattttcccaatatgtgccccacaacgcgtggaaaaattttcccccccccccccccaaaaaaaaaaaaccccgccgggggaaaaaatgtgttttttaaaaaacaaaacacccccgntttttttgtttctccccccccccnntaaaaagaaaggggggggggggggggaggaaaaaaattccctcccccccaccaaagaaagagggnggggcacttctttttttttttttttttnttaaaaagaaaaaaaaagaggcgtttttttttttttttttttttcttcccccccccccccggnnnnntaaacacacccccccctccttttttgttgtggggggggggggggaaaaaaaaatttatttttttctttttttcttgtttgggagggggggggggggggnnnannaaaaaatattttttttttttttttttttttttttttttttttnncnccccccccccctccccnncccttgtctcctccgggtgggggggtggggggggggagggggggggggggggggggggcgcgcccccccctccccccccccccccccctcccccccccccccccncccccccnnnnganagaaaaaaaaaaaaaaangnggaaaaaaaagaagagagtcgggngcgggcccccctctcctttttttatatataaaaaaataaaaaaaannnnnnngnaaaaaaaagntgttggggggggggggggngggggggngnnnncnccccccccccctccccttctccctctntcttctccaaaacntncnnccnnnnnnnnnnncnnccnnnaccgccccgcccaccaacaccaccaaaaaaaggaggagagaat

SEQ ID NO: 16554 - DNA, 615 bp, Xenorhabdus bovienii
  unsure (1)..(615): unsure at all n locations
tgaacaatcgagtcggagttgggatctcagagcacccctcgaatttgctgcgctttttgttgccggccccccttggaggcccaattccaaaagtttggcgaaaccccggaaaaaaattgccgggttttttttcgcggggattttttttggggcgtttccaaaggggggttttttggggggaaaaccccccccccccccaaaaaaaaaaaaaaatatttttttttttttttgggggggggggggtgtttttttttttttggggggggcggtttctgatgggggggggggggggggacaaaaacaaaaaaagggttctctcctgctgggggggggggggggctgtttttttataataatcctcttattatccccccccccccccccgggggaaggaggaggaaaaaaaacccaacctttcctntgtgctttccgcgcggcggcggccgctttttcttttaatanattttagaggggggggcggccgccccgcccaccnccaaacataaaacaaagaggantggtgtgtgggtatggggagaggtttgttctctttctctcttccctcctccccncggcgggggggggggggggaggggtttttttttttttttcttt

SEQ ID NO: 16555 - DNA, 1447 bp, Xenorhabdus bovienii
  unsure (1)..(1447): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnngnnntttatgtaatcatagactctnatatacgcatgcgtctggctccgccggagnatcccccccatcagtaagtagagcgaatgcactagcatacctgacatagagatcaggtcgtctactggtatcacataggcacactcaacacagactcggccagacccatcatattatatctacgcaacatgcggatatccagttcactctctaatgtagactcttgcacagnaccgagagcacctagctagctagatagacgcncgcaatctactaaatnangcacatgtagcatccctatcnagatagtcctncagctccatcctnccagcgagagagtagagtggtgtgtgtgtgtgtgtttctctnncccngcacgcgagagaaaatttttatgttgtagttttntagnancantcgacgccgccgccgnacncgnncgngnnnnnctcnnntctcntccacaagaaagcacncaanaacaacagccacnatcttgttntgctttctcnttnctcttcnttccccnccgccgncccgcgncgcgcgncgnccnctntcgcccggtaggagaaggaggagcagagagcagcagaganncncncnccccccnccncccnctnatcacttattatttttcnnttctccaccaccgncgncgcacggacgcacgaatgaggtaggaagggtatannnnnnaanannaattnnattttatgttttttttgtttatnatatataataaaaaacaacaaaaacaacccacccctctcccccctccccccctntttccccctcccgggtggcgggggnggaaggtgtaagatgaggagtaatgtgggtganaggatgcgagcagcctgcgggcacggaatcgaaggagaggcgcggactcgcatcccgcagctaacaccctcccccttcttcccccaaccaccaaaaaaaaaaaaaacaatattttttttttttttttttgggggccgcccgcccgccccccccccctccacccaggggaggagagaatttgtgttttttttgttttttttgtcccacccccccccccaccccccccccnctgatcnnttttttttttttttttttccttaccaagaagagagcgagggggcggggcgcgctcctcccttatctttttttnatttagagaaaagaaggagagaggagcagcgcgcccccccccccccccctcctcttattttatcttttttgagagcaacaccccccccccccaccaaatataataaaaattttttatttttattcgtgagcgggggagcgcacccaaccacaaancccacaaacacacaaccccacactcaatcttcctcttatctgt

SEQ ID NO: 16556 - DNA, 762 bp, Xenorhabdus bovienii
  unsure (1)..(762): unsure at all n locations
gttgtttcattcagcnggtcccgggatctgtgagcccttgggttggggtggaggccntgccgtcggcggggtgtcgctggctctaccnnntnnnnnnctgggtttcgaattncggacttcgtncccggggntaccnctaagacctgaacgtgacggnctttttgggccggattttcggccagtaaaaatacaaaagcttggggggaaaaaaaaggcgttaaaaaccccgggggtttttttaaaaagggggggcnnaaaaaccccccctaaaatttttcccccccccggggtgataatagggggggggtccaccaccccaaatattgggggggggaaaaacccccccccccccccggttggtgttggggnggacccccccccccgccaacaaaaaaaaccccnnntctttttaaaaaaaaaaggggggggggnnnnnnnnnnnnncccnccccccnncnnnnntggnnntnnnnnnnnnnnncccaannancannnnnnnnnnnnnggnnnnnnnnnggncnnnnggnnnnnnnnnnnnnnnnnnnncnnnnnnnnnnnnnncccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnncccnaanccaaaaa

SEQ ID NO: 16557 - DNA, 832 bp, Xenorhabdus bovienii
  unsure (1)..(832): unsure at all n locations
tgtcaaagtatttctcccaggaaacttgaggnnaattcnggctgcggttcccggggnatccctctangatcccagcanagcatcgcggcagatcgcatgaanaatccgggtgtgtcttggaaggtaatggttccgtacaccacttcagtacaccctatcaccagcggtatatacatactgcgttcgacgggaaaagggtttactgacaacaaccaaaaaagggggggtcctttttaacccctttgcaaaccagcctggagccaacccttaaagggggggggggtctattttggaaaacccttttttatttcccccgcccagcccccaaaaagtgtggtttaaggggaaaggcccaattttaaaaaacccctttttttttaaagggggggggggatttttcccccctttaaaaaaaaaaacccggggggggaaaaaaaaaattttttccccggggggggaaaaaaaaaataatgtttttaaaaaaaaagaaggccccccccccccccccctcggtgggtgaaaacaacaaccctttccttggggggggggtggttttttttttgccctccccccccaaaatatttcctctccaccaaaaaaaaaaaaacccttttcctcataagggagggtgtgtgggncccccccccctccccctgtcttataggcgagaacctgtcttccttcctttcggggcgggggcgggggggtgggccactttatattttttcctctccggcgggcgcccccccaccaccccttgtcgccggcgtgcacacccgaccccgacgccagcgggcacgaacactattcttcccgcgtggcgcccgccccc

SEQ ID NO: 16558 - DNA, 1080 bp, Xenorhabdus bovienii
  unsure (1)..(1080): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnccccccttcagcccgcaggcctcctctggtagctagattcncggtctttcccctctcccgcggcgactctgacttcatccctantnatgtgtggggggggggggggggggcccccccccccccccacaagagagggaggagaaggagaaaccccccccccccccccccntttttttttgtgtgggggtggggggggntgccccccccccccccccaaaagagtgtgtgttgggggtgtggnnnnnnnnnancccacnnccccccccccaccccccacnttgtttgttgtgtgtgtgtttntgcaagggttcaaaacaatttttttnnttcaatccaactggntaaaacggcncggngaaggggnngnacntnnatcncagnnaaaatttntaacagggcggggttttganaacccaaagnaatggggaaccaaaaaaaaaagttgggctttttaattccccaaaanaaatttttaaaaaaaaggggggcaagggcccaaaaaaaaatttaaacccccccccccgcgggnggngggnnnngngnnggggggggggggngnnnnngnnntnttttttttttttttggggggggggggggggggnnnnnanaaaaaaaaatttttttttggggggggggggggggggnannnnnnnnaanaaanaaaaaaaaaaaaaanaannnngtnttttttttttttttttttttnnngtnnnnnggnnnnnnnnnaggagaagaaaagagaaaaagtagaagggaaagnaagaaanaaaanaaaaaaaaaaaaaaaangnnggnnnngnnnggnnttgtgtttttttttnttttggtttttgnattgnnnnnnnggggnnnnnnnngggggnnggggnnggaaaaaaaaaaagggggggaagaagaaaaaaaaaaaaaaagaaaaaaannaaagngnnnnnnnnnnnnnngggggnnggttttttttttgttttgttttttttttnnntttgntttgatccac

SEQ ID NO: 16559 - DNA, 934 bp, Xenorhabdus bovienii
  unsure (1)..(934): unsure at all n locations
aaggtataacgaatatcgaggttggtaaccgggggaatcttctgaggtattatggaagttataaaggggttgaattaaaaaactcattcgtgctgggccggtcagggggtaataaaaaaaagaancncggttttgggttatttttaaacgctaaataacttttaaaaattgggggcttaaaaaaagggttttaaaagggggaagggggttttttttttaagggggggaaaaaaacagagaaaaattgggggggttaacccccaaatgggggggtattttttttaaaaagagggggggggttttttggggcccaaaaaaaaatttttttgtataaaaaaaaaaaaacggggggggggggaaagggggggggggctattattggaggaaaaaaaaaaattttggaaaaaaaaagggggggggggttttttttttttttgggggggggggggggggggggccaaaaaaaaagaggggggggggggggggttttttttttttttttttggggggggggggggggggggggaaaaaacaaaaaaaatttttttttttttttttttttcccccccccctcttttttttatttttttgttggggggggggggggggcgggggggntttttcttttttatataaaaaannnncnnaaaactttttttcttctttttttgnnnnnnnnnnnnnnnnnnnnnnnnnnntnntnnnttnnnnnnnnnnnnnnnnnnnnnaannnnnnnnnnnnnnnnnncnccncnaaaannnnnnnnnnnnnnnnnnnnnnnnnnnnnnnnnnnnnnnnggngggnnnnnnnnnnnnnnnnntnntttttttntnnnnnnnnnnnnnnnnnnnnnnnnnnnnnnnnnnnnnnnnnnnnnnnnnnnnnnnncnnnnnnnnnnnnnnnnnnnnnnnnntttnttnnnnnnnnnaca

SEQ ID NO: 16560 - DNA, 724 bp, Xenorhabdus bovienii
  unsure (1)..(724): unsure at all n locations
tctcccccgacctcctagtctatctctcttccccctcttccccccttcactctcaccttattcccctacttcctccctctatctttttcacctcttctctccaacatgcctatacacccccttttttctttttttttccancaccccgttttggaaaatttttttttttccccccccccccccntttttattttattttaaccccccccccgagaaaattttcttccccgggcccccggttttttttnncaccccccccccccccccccccccccggggnnnnnnnnnnnnnngnntttttttttaaaaaaaacccccccccccccccccnntttttttttnnnntnaaaaaaaaaaaaagaggggaaaaaaaaaaaaaatccttctttccccccccaaaaaaaacccccaccccttttcttttttttttttttaaaaaaaacaccccccccccccccccccttttttttttttnnnnnnnnnnnnnggngntggggggggggggggggggggttttttttttttttttttttggggggggggggggggggggngnggnnnnnngngnnnnnnnnnnnnnnnnnnnnnntttttttttttttttttttttnnnnnnnnnnnnnncccccccccccccccccccccccacaaaaaaaaaaaaaaaaaaaaagaagggcccccccccaacanacccaccccacaaaaaataaaatnnnataaattt

SEQ ID NO: 16561 - DNA, 824 bp, Xenorhabdus bovienii
  unsure (1)..(824): unsure at all n locations
naagtaaaattaagtcggggcgcgggggccttaaaggaaccccctcgggggcggagagaaaacccccctttttaaaggggagagaaaaaaaaaaaaaanacggggggggggggggggttgtttcttcttttgggggggggggagaaaaaaaaaaaaatttgggggttttttcgggggaaaaatcccctctttggggggtggggcgccccccccggggagnannnaaaaagaaaaaaaaaaggggttttttgtgtttccccggggggggttttccggcggggggccccccacttttttgggggagggggggggaaaaaaaccccccccgggnnggggggggtcgggggggggggggggggttttttcttgggggggggggggcccccccaaaaggaaaaataagnaccacccccccnaatctcggccccgggggggggggggggcnaaacccccnnnaattttataaaaaaattttaaccggggggtttacccccggggtggggggggggggggttttttcgggggggggggttttgtcccccggggggggaagaaaaaaaaaagcggggagaaaaaaannnnntccccccaaaaaatttttttttttttgggcgcgcccccnncnnnnaaaacggggggggagaggggggggtttttaaccacccctttttttttctaaaaagatttttcctgggggagacaaaataaagtgggggggcccctcctttttttataaaaaaaaaaaagaggggcgggggaagaaaaaaacggggggcggtgtttataaaaaaaaaaaaaatnttgttttctcttttaaaaaaaaa

SEQ ID NO: 16562 - DNA, 570 bp, Xenorhabdus bovienii
  unsure (1)..(570): unsure at all n locations
tgnnnnnnnnnnnnnnnnnnnnnnnnnnnnnnnnnnnnntgccgaattaaagcaaagcatgaataaccactgctgatgcgatatagcctgggggagtattactttttaccctttctaggtttggcctacggggggaaaattaaggggggggttaaaaaaacctttttttttatttttcgcggggggaaaccaccttcccttttgggggttttcccaaagggggaaagggggtaaaaccctttgtttttttttttgggggggagatttttttaaaaaaaatttttggggggggggggggaaaaaaaaaaaaaaagggggtttttttttttttttttaaaaaaaaaaacccgggctttttttttataaaaaaaaagaagagaggggggggggggggggggccccccccccccccgccggcggggtggtgttttataatttaaaaaaaaaaagggggggggggggggggggtgtggttggtttatatatataaaaaaaacaaaaaaaaaannnnnnnnnnnnnnngggggnnggngngnggnnnnnnnnnnnccnnnncnnttctcataaaaa

SEQ ID NO: 16563 - DNA, 1084 bp, Xenorhabdus bovienii
  unsure (1)..(1084): unsure at all n locations
ttgtttcggaantngggctcgggacccggngancctggggagggggnnngncnggggggggnnnnngnnnnnnnngtttttnnnnnnnnttagtttatgcgnnattncgggccttcggtaacccggnngntancctctnagngtncagtncagttncacccgcttgataaccttaatagnccccttggnctgaaccaaacgntgggncctttgaataagggtatttctggaacggggtaagaaataaaggccgctcccggttcccccttggttttgggggaggcccccccgggggaacccggtgtgataaattttgtgtttcggagaatttttcggggccacccacacagggggggtttttattagaaaaaaaacccctccgggggggggggtgggcggcttctttttttattaaaaaaacaaccccctcccccccccccgggagaaaatatattcccccacaaaaagaaaggtggggtgtgggtgggtgtgaatataaaaaaacccaccaccccccccggtggtgtttaaaaaaaaaaaaaaaaaaaaaaaaaaaaaaacaaacgcggccgcgggggggggggggtttttttttttttttttttttttttataaaaaaaaaaaacaaaaaaaaaggagcgcccggcggggcgggggtgtgtttttttttttttntttttattttttttataaaagaaaaaaaaaaaacccccccctcccccccccccccccgccggggagggaggagaagaaaaaaaaaaacacccaccccccccccccccccccccctctctccgcccccggggggggtgggggggggggggggggaaaaaaaaaaaaaaaaaaaaacaaaaaaaaaaaaaaaaaaattttttattttttttttttttttttcttctttttttttttttttccgggggggggggggagggnnnnnnnnnnggggnccctttttttttntttntnctaccnccaccacaaccnacnnanannnnnnnnnnnnnnnnggggnctccnnggggggggggggggggggggggggggggggggggggggggnncgncctntttttatatttttttta

SEQ ID NO: 16564 - DNA, 837 bp, Xenorhabdus bovienii
  unsure (1)..(837): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccttaattaaaaccntnngnnccctaaaaaanncnctctgggnncccggaaaaattnnnnccctccccctaacttttnngccctttaaaagaaaaaaaaccggggtttttttccccccgaaaaaaaatttaaaaaaaaaaagggggggggggttttttnttttaaaaaaaaaaaaaaaaaaaacccccccgccgggggggggggggggggnnnnnaaaaaaaaaaaaaaaaaaaaaggggggggggnnnnnnnngggggggggggggggnnnnnncccccccccccgggggggggggggaaaaaaaaaaaaaataanttttttttttttttttttnntntttttaaaaaaaaaaccccaaccaggaaaggccttttttgtggccccccccccaaattattaaaaaagtctgaaaaacaaaaaaanaaaaacacacgggtaaaatcctcaccaatnaantaacaccaaangccttgaacagcagtcaaatcccatcagcagnnnaanaaaaacaaaaaaaaaagnccgcaaaaaaaaaagggaaatngagggaactcncncaaaaaattttgnaaagggggnnaacnnggggcgaagggggggggggggaaaaaaataaantaanaaaaaaaggcggggggaaaaaaaaaaaaaacngnggggggaaaaaagaaaagggggnncaaattttttgaagngncaacnncgga

SEQ ID NO: 16565 - DNA, 1092 bp, Xenorhabdus bovienii
  unsure (1)..(1092): unsure at all n locations
gggggttggnnngtgggcggtngggggggagaatggttgggtggggcggganaatggtggnngtggaagagcggcactttggggggnnnnnnataactagtcgnnnnnnntntgggggggggggcgggggcccttnnnnaannnnnnnnnnnngggggtgnngnnnggnnnnnnnnnnnnnngggggggnnnncntttttttttngggggnnnggggggggttcggggggggggggnngnncngnngggnnnnnnnggttttgggggggttttttttccccnnggggnncntttttggggggggggggggggccccccnnnttttttttttttttnnnnnnnnnnncccccctttnnnnnnnncgggggggggggggggtttttccccccnnnnnnnnnncccctccccccccnnnnnnnnnnnnnnngggggnnnttntnnnncnnnnnnggggggggggnnnttttnnnnnngggggggggngccctctttgggggngggncncccgggggggggggggggggnnnnnngnnnnggnggggggtttttgggtgggtgttnnnnnnnnnnnnnnnnnncncncnnnnnnnnnnggggngggggggggggggggggnnnnnnnngnntnnnntngnggnnngnggcnggccccccgnttgnttgtctgttntcncncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16566 - DNA, 1083 bp, Xenorhabdus bovienii
  unsure (1)..(1083): unsure at all n locations
nnnnnnnggggggnnnnnnnnnnnnnnnnnnnnnnnnnggcccctggggggggnnngngccggggncccccgggggggggcggggggggngcacttnnnncnggngnnngggggaggcnccccnccccnnnccctggggagggnggggggggancccaaaaccncncngggcttgttttttggggcaaacaccaaaggaattttgtggggggggaaaaaaanggggaaaaaatctcgggggggttaaaaaaaaaaagggggggggggaaaaaaaaaaaacccccccaaaaggagaagggaaagagcaaaaaaaaagggaaaaaaaaaaaaatccccccgaaaaaaaaaaaaaaaaaaaaaacccccaaaaaaaaaaaaaaaaagggggggggggggggggggggggggttttnnnnnnaaaaggggttaaaaaaaaaagggaaaaaaaaatnnnccccaaaaaaaagggttaaaaaaaaaaccccaaaaaaaaaaaaaaaaaaaaaagagaaggggggggggggtgggggcccccccacccccccccaaaaaaaaaagaggggggggggaaaaaaaaaaaaaaaaaaaaaaaaagaaggggggggggggaaaaaaaaaaaaaaaaaaaaaaaaagggggcggggcggcgccgccgcccctccccccgttttttttttttttaaaaaaaaaaaaaaaaaaaaaaaaaaaaaaannnnnnggggggggcccccaaattcttaattttttttnttntttcccccccccccacccaaaaaaaaaaaaaaccccggnaannnnnnnnnnggggggggggggngaaggaagnnaaaaaanaaaaaaaaaaaaaaaannnaanannnnntnaattatttttataaacccaagacaaaaaanggagaggggggggggcgggggnngggnggnnnnnnnnnnnnnnnnnnnnnggnnntnnggggncgccggggnccccgcgccggggcggggggngggggggncgggccnncgcnnnnnnnngggnnnnnnnnnnnnggnnnnnggngggggagaaanncnnnnnnnaaaagnaagaaagagaaggagaaa

SEQ ID NO: 16567 - DNA, 815 bp, Xenorhabdus bovienii
  unsure (1)..(815): unsure at all n locations
gccatcttgctgcctgcggtcgccagggctgaatggatgaacgcatnnccagtgngngnccgnnccttngnnnacnnaaaaanaaggaanncccnccgggnnncnnnttttaattttgggggtttngggggggggnnnnnaaaaatatagggggnnnagaaaaannnaaacaccccccccaaannnagggggggnnnaaaccccccaaaaaaaannccccctttttgggggggccccccaacccccagngaattgggtttaatgaggcccctttttcccccggggttgggggttccaagcccaaaagcccagccgtttttaatgcatttggccccgtggggtttttttttgggccggaaaaccccccgttccgggaaaggtcctttgggtttgggtttggggaataatggaaaaaccccggggggccctttccgggggcccacttttttgggaaaccccccccggaattttttttcccaaaaccggggggaaaaccgtttttatttttgggggaaaaaaaaaaagttttttaaaaattccccaagggggggaatatttttggggaaaaaaaaaatcgccggggaaaaaaatataacccctgtggggggggggggaaaaaatgcgggggnnncccccccccccccccttttataaaaaccccaatttggggcgccccccacaaaaaaaaaagcgcgcccccccccgcgncggnccccccccccccccctttttgttnnttttttggtgaagaaaacaccacccccaccccgcggggggggggggtttttttttttttaaaaaagagggggcccccc

SEQ ID NO: 16568 - DNA, 814 bp, Xenorhabdus bovienii
  unsure (1)..(814): unsure at all n locations
gcctctttcttgctggcctgnancggtacttcncccctttttgnnaccccccnctttnnncttanggaaaaaaaccaaacccccccctttcnnnnnntttttttagcgggnnnnnnnnttttttttggggggnnnnngggggggtttttcccccccgcgcggggggagcccccnnnnnaaaccccccccttttttttttttttnnnnaaacccccccccccccccccggggggnttttttttttttttctccccccggggggnattttacccttnaggcccccccccccgggntttttanccccccccccggggggggggnnaaaaaaaaagtggggnaaaaaggggggggccccccccttttttcccccttttttggggnnttttttttaaaattttttgnggntttttttcccccccccccggtttttttgggggnatttttttttttttntnnntnnnnntttttcccctcttctttttattttttttaaaaaaaacccccccccccccctttttttttttttataacccccccccccccccccggggcncccccccccctcttttttttttttccccccaggggcccccccccgggggggggggnnngggggggngggtttttttctcccggccccccccccgggggggggggnngggnngtntttnttttttttttttttttttanaacccccccccccccctttntttttgggggggggggtttttttttttttttttattttgagagggttgtgttttttttnnnntnnggngcgcgcccccccccaaaccggggggggttcccccc

SEQ ID NO: 16569 - DNA, 949 bp, Xenorhabdus bovienii
  unsure (1)..(949): unsure at all n locations
gggtttnagggtatttgggnnagttttactnngtgattcgattcggaccgtactccggngacctctangtcagatcagatnatattatcgngcatacattctgtggagcggactcaaatggccagtagtngaacccgttcaagaattattttgccccaaaggggaaaaaaccggaaaaaaagattttttgccccccccgagaaattcccccgaacccccatttggtgggtgggggggggccccccccccggggggaaacccccgggtttttaaaaatatttttgcgcgggaaggggaaaaaaaaggggggggtttttttttaccccccgggcgaaaaaaaaaagagggggggggggggtgaaaaaaccccctcttttttggggggggggggggggttttttttaaaaaaggggggggggggggggggggggggggggcttttttttttatataaaaaaaggccgccccttttttgtagttaaaaaaaaaaaaaaaaaagagagggggcggggtaattaattattatatttttcctctccccccgggggcgggggggggtgtggggtgttttttttttttttttgtttttgtgtggcggcgcgggggaaacccccaccactatttttatttgggggggggtgggggggggggggggggngggggattgtgttgttatcaaacgccctccccccccacagcggcggtggttttnttgggtgtttttttcttgtgggggcgcgccccctcaccccccccanaaaaaaaaaaanaatnnannactaaaaaccccccccccccgcccccccccacccgcgcggaaacgaaaaaaaaagatnntttnnnnccgggcggcggcgggcccctccgcgctctttttttttntnnttttttttntnnnccccccccccccccccaaccacacaacctataaccggcgcgcgcggtgtgg

SEQ ID NO: 16570 - DNA, 673 bp, Xenorhabdus bovienii
  unsure (1)..(673): unsure at all n locations
agctgagtgccaagttccttgtgaatgcaggttgggggggcncccccnaccnnnaattttaattattgatagggcctcggcaccggggatacccagagggnacctactatcgggtttttaaaacccatttggtgggtggccctgataaaccgtttttttccgcccaaacaggaaaaaggggggggtttgcccccccccctttttggaagggggggtttttgggggggggggggaaaaaaaaggggggtcccggggggcaattttggggaaacaccccaaatgagggccccaaaaaaaattttccccttttttggggggggggggggaacccctttttttataaaaaaaaaaaggggggggggggttgtctttttctctaaaaaaaaattttttttttttttcccgggattttttttttttcccgccccacccccttaaaaaaataaccccctccccccccccccggggggggggggcccccccgggggggggggggggcccccccctcccccagtaaaagggcccctaagacgaaaaccgctgaattattgatattgccgccttcatggaaaaaccatcatcattgccggatctgcatactgctacgaatacgaagtagttnctgacgactggancttgctngaacggtatacagatgatacggnnatctgag

SEQ ID NO: 16571 - DNA, 849 bp, Xenorhabdus bovienii
  unsure (1)..(849): unsure at all n locations
tggttcgaattcagctcggacccggggatctcagggctcaacgggcggnngtcntggnggtgcgngnngaaatggggggcnnnngnaannnnnnnnnggnttttaannnttagtttaccatancngactcggtacccggngnacctctangacccatccctcttttcacttaactgttcagccaggcgacttaaaacccggaattgggacgggccaatttggggccccggagagatatataaggggttttttattggggaaaaaaaccgggggaaacaagggggggcgggggggcgcgcctcttaagaaaaaaccggcggcgccctctatatggagggggggcccccccccctttgtttttgtttgtggggggggggggnnnnaaaaaaaaagggggggggagaaaaaaatatttttttggtgggggggggggcggggccgcaaccacaccccaacagaagagagggggggggggggctttctttttttgtggggggaaagaaaaaaaaaanntttttttttttggggggggcggcccccccccccgccgggggggggggtgtttttattattttaataatcccccccccccccccccccccgcggcggggggnnnnntttgttttttttttttttttttcccaccaccccacccaanccccgntggtttgggggggggggggggggggggggaaaaaaaaaaaaaaaaaaaaaaaaaaatttcttctttttttttttttttgggggggggggagaanaaaaaannnannntnttnnttttttttnnnggggngnnanaaacaaaaccccctccctnnnnnnnnaaaaaaaaaaaaaaaaaaaaaggga

SEQ ID NO: 16572 - DNA, 1024 bp, Xenorhabdus bovienii
  unsure (1)..(1024): unsure at all n locations
ngactacttgtggncatgacactgcccagntnctctnnattaacaggnnccgtncagtcttncatttagaacgncaatnncaggtnagncccgncagnnaaatncanacttanatggggaatcctggttggcccacggccttntggnattatcccaggncggcccttcncngncnagnntatttttttttggcttnggnnttcctnggccccaggttaaaaaaccttcccttcggcaaagcccttgtggggatttcaagggcgaaaccccgatatcccagccaaaaatgcgcccgggtttaaatatcacaggcgacatttctggcccgggaattttatttccccccaaggaaggggaaaccaggtttatatttttccgggccaaaactttccggaaaaaggttaaaaaattcctttttggcgcccccgagaaaacacccccccccccgggggaacattggaaaaaacaaggggggtttttttttgttcccccccccccacccccccccccgagaaaaaaacggggggaaaaaaagggggttttttttttctttttggggaaaaaaaaaacaccctccccccccccccccccccaagaagggggtgttttttgtgttgggggggggacatccccccccccccctgaaaatnnnnnataattttttttttggttnaggagggnnttttttattataataaaataaatttttttcctccccnnnnngggnaacacccccccgccccncgcggggggattttttttttttttttttttttttttggggggcgcccctctctcttttttgtgggggggaggagaaaagannnnttttnnnnnnnntnttcttttttttctccccccccccgcnnngggcgcggggnagnaaaaaaaaaaataanaannnnnnaagaagaaggnagaagngaggnnttttttttttttttcttttttnnnttntntctttnncctcgnnnnnnncgcccccgcnnccgccccggcggnnngnagnaagcataaactaatc

SEQ ID NO: 16573 - DNA, 902 bp, Xenorhabdus bovienii
  unsure (1)..(902): unsure at all n locations
gccatgccttgcatggcctggcagctccagtaataaaattcgctgtccttaaggatcccccatcggaaggcaggcaaaatttgggggggggtgggataaaaggggggggcggcaataaaaaaagggtggggaaaaccccgggaaaaaactactgggggggcccaaaaagaagagcgcccccccacccttttttttttagaaacccccccttcttttttgggggagggggggggaggaagaggactcttcaccccccccccccgggggtggcgccccccatttttttttttttcccccccccgccccccgttggttttttaaaaaaaaaaaaaaggggggggggcggggcgcccaaaaaaataattttgtgttttttttttttttnatgaaaaaagaggggggggggggccggaccacaacccacccacccccccccttttttttttttttatttcttccnccnnnnnnnnaaaagacgaaaaaagaagaaattgttaatttttttttttttttttggggggggcgcggcgccccccccccgcccccaccctctccttcctctctcttttttttttttttgtgtgttggagggggggggggagggagacatatttttttnttttttttttttttattttttttcnccccccccccacccccccccccccccccccccccggcttttttgggggggggggggggggcgcccccccagggagaattttatattccccttttccccccccccccacaaaaaaaaaaaaaaaaaatctctccttcccccggtgggggtgggggggggggccccccccccccccccccccccaaaaaaaaacaaacaaaanttttttttttttttttttttttttttgtttcaccccaccccccccccccaaactttn

SEQ ID NO: 16574 - DNA, 1011 bp, Xenorhabdus bovienii
  unsure (1)..(1011): unsure at all n locations
nnnnnnaaaaggggnnnnnnnnnnnnnnnnnnnnnnggccctaccttgcatgcctggggtgccaccaccatgcaataggaagtgggacactcccaagcaggggggaccnagcaaacacaacaaaaaacagatatttttaaaaaaaaaaaggcccccttaaaaactcttggcctagagcccccggccccagaaatcccccctccagaaacccccaaataaattttaaaagggtttaaaaatatgggaaaagcgccccccaaaatatttgggggggggaatatttttttaaagaaaaaaaaaaaattttttaagggggggccaaaaaaaaannnnccccggaagaaaaatattttgtccccccccccccccccccccccccaaaaaaaaaaaatatttcgcccacccacacccccccccgcgtataatttctttatggtgggggggggagtgaaataaaaaaaaaaaaaaaaaccacccccacaccttttttttttatataaaaataaaaacacccgccccccccccaaaaaaaaagnnnnnnnaaaaaaaaataaaaaattttttttttttggggggggggggggggggggggggggggggggggggccccccaccaaaaaaaaaaaaaaaaaatgtgtttggggggggggtngnngccgctccccgccccccaaaaaaaaaaaaaaaaaaaaaaaaaaaaaaaaaaaatattttgnggggggggggggggnnnnnnaggaaaaattttttttttttnccccccctcccccccccccccacaaaacacaccactttttnttaaagngggggggggngcgccccacaccccccccccccccccccccccccccnnncnnnnnnngggnnnngggnnanncccccnaaccaaaataaaatatatatttatanaaacnaacnnnnnncccnccccccccccccccccccccncncccccccccccnnngncnccnnnccgnnnngngggggggggggggnttgctcttttttttt

SEQ ID NO: 16575 - DNA, 1035 bp, Xenorhabdus bovienii
  unsure (1)..(1035): unsure at all n locations
gggggggnaaaggggggnnnnnnnnnnnnnntttttnnnnggccactactcaagaggcccgcagggcccaagggcagtacagcggtacccgccgagcgagaccgaaacagcacggcagaacagagacaacagaccaccagcaaacgagagacagggagaagcgcaacagacccacaagcaggacaggagcacaaacgaacaggggcacttttctactgtggcacctaggaacccggcccagaggtctccccgtnttatggcacaatcgccaacccataganccagtntcggtngcaggaggncaataatagaaccggtcctactnggnnnacgttccccctntncacaaatggctanaagnncggnctgnacaccaaannaannaagtnccggnngggttctgggggtcaaaagtcaaaaagggggtttttttttttttcccccggcggggtaaaacccaaaaaccaaaggggaaaaaaaccggttgggcccaccccaaaaggggcccaacccctataaaagcgcccccccgggggtcccccaaacaaaacacctttccccaaaaagggggggggggcccccccgcccaaatacccggaaaaaaggggaaaaaaaacccaatttggggcgggccccgccaaaatggggaaggcccaaaaaaaaaacaacaggggggcaaattcgggggggggcgcccccaaaaaaaaaaaacggggggacaaaaaaaaaccccccttcaaatggggggaaaaaaaaacccaagggggggccgcccccccccaagggggaacacacacaattttttttgggcggggggggggggggggagccctcctcataaccccccccacacatattataacccccacccccccccccctattggggggggggggggaaaaaaaaaaaaaaacaccccccacccccaccgcgggaggggggaaagaaaaccccccaccccacagaaaaagaaggaagaggatgttcgcncacaaactcccaaacaacacaccacccaaccaaccacacaataag

SEQ ID NO: 16576 - DNA, 972 bp, Xenorhabdus bovienii
  unsure (1)..(972): unsure at all n locations
ngcaactgctgtctgcagacgcctttttgtgggagagaaccttcctgtgcgcagcaaggaggagcatcttttttgttttccttaagagtgggaaggaattttttcccgccttttttttttttttttattcccaaggggcggggcccccccccacccccccaaagggggggggagggtttttttttttacttcaaaaaaaaaaaaaaattttgtttttttttttnggggggggggcgggggagaatttttgggggggttttttttttttttttttttttntgggggggggcccccggggggcgcacaaacacaaactgcggggggggggggggttttttttttcctccccccccgaaaaaaaaaaacaatttttttttttttgtggggggagaaaaaaaaaaaaaaaagggggggggtttttttttttttttttttttctaaaaaataagcggcgaaagaaaaagaggaccggcccccccgccgggcggggtgtgttttatactccccccccgccccccttttttttgggaatatatttttttttttgttggggggcgcgccccccccccctccccccctcccnncgcccganaanaatataaaaaaaaggaggcgcccccttttctctcatttctatttctctccccccccccacgcaagaagagcggccggcgggggggcgagagacaaacaccccgcatcctttaataagacaccggcaggcgggggaggggtggggtcgcgactatccgaagaaagagggggggggatggggtggctagattacttttcttcccacaacctcccccataacaaaacgaaacaaaccaccccccacccccgccctcatgaccaaccgaggccacagacggacaagcaatacgcgctgtgttttgtgttcgactncacatatagaaacacgcacaanaaagannnaaacgcannncacannnnnnacacatattctttatg

SEQ ID NO: 16577 - DNA, 1003 bp, Xenorhabdus bovienii
  unsure (1)..(1003): unsure at all n locations
ttgggatttttttggggggcgggngncccgcttcgnggggagcggcnnnnncnngggaggnnanaaaaaagggntnnttgtntttttaaaaaaaaaggggtcataactactgtgggcctgggcccttggcccgagggtttggggnccccggggtttttgggggcgggggggccacaaccggggggttttaaaaaccggggggggaaaaaacccccccctgttttttttttggggaagaaaggaggggggttttttttttttttttttttgttggggggggggggggcgccccccccggggggggggggggggggagggggggggtttttttttataaaaaaaccccccccccccccccccccccttcttttttttttttttttgggggccgcggggccccgcctttttttataaaagaaaaaaagaggggttttttttttttttttttttttaaataaaaaaagaaaaaaacaaacacaccccccccccttttntttttttttttttttttttntttnnnnnncnnnnnnaanaaaaaanaaaaaaaaaaaaaaaannnntttaaaaaanattttttttttttttttttntncgggcggccggcggccnncatttanaaattaaaaaaaaaaaaaaataataatttttttttttntnnnnnnnnccnnnnnnngggggggggggggggcgggcgcgccctctcttnnncttctctctttttttcttctnnntncctcnnnnnnnnnnnnnnnnnnccggcnnnnctgttcccnnnccccttttnnnnnntgattntnnnnaaaaaaaaaaaaaaaagaagagagaagagaggggggnnnacgacaaaaacnaacaccacgaccnngaaaaacgaagaggggnnnnagacagcaaagagnnnagaagcaagagaagnnncgggnnncnnnntnnncggcgcccgcccnncncccctctctctttcnnnnncccgtcgtatcttnnctcctcttttttttttttt

SEQ ID NO: 16578 - DNA, 954 bp, Xenorhabdus bovienii
  unsure (1)..(954): unsure at all n locations
nnnnnnnnnnnnnnnnnnnnnnnnnnnnnnnnnnnnnnnnnnnnncccccccccccttnnctctccntnnnnnnnnnnnnnnnnnnnnnnnnnnggnnnnnnnnnnnnnnnnnnnnnnngngggnggnnnnnnnnnnnnnggggggggggnnnnnnnnnnnnggggggggggggtnnnnggagagattnnnnnnnnntttttttttttttaaaccccccccccccnncnggagagaaaaagaaaaaaaatttttttttttttttttttttnnnnnnccgtagtctcggntacccgggggnnnatcctcntagttacctcntagncncncantnttggncncgntntggnaaccacgnntaacgtctagccactggccggnctcaatcaattttcggccggccacccagnaatttggaagccggccggggccggttccnttaaaacggggtaattttcccctttggggtccccaaggaaaccccccggccccaaagtggggtggggggggcctttgggccgggggaaaaataaatccccgggggccccaaacctttttttccgggggggggggggcccccccggaaaaaaaaaaaaaaaaacacccttccggcggggaaaatatttgggggaaaaattccccgcggggaaaaaaaaacggtttttgaaaaggaggggggggggaccaacaagggttgttggggcccccccccccctttttaaaggggggggaaaaaaaaggggggcgcccttttttgtggccgccccccccccgngggtggaataaataaaaagagggccccccccttttttttatttatctctccccacacaaatggtgtttgggggggnnnnnnnnnccccgcgcacccactttttttttggggaaaaaaaaaaaaccgcggcccggggtttttttttttttttttttttccccccccccgccccccttgttt

SEQ ID NO: 16579 - DNA, 594 bp, Xenorhabdus bovienii
  unsure (1)..(594): unsure at all n locations
actttcgattcggctcggtcccgggtccttagtcgcagggcaccgcctgaagtcactcctagctataaaatggagagtggtgcttgttatctgctgtctacggaagaggggtgggtcccggggacataatttcggccgaaccaaggttttacggtttcagggaagttttcccaacaaatttttccccttttgggggcccctttttcccccaagggtggggtttttggccccccccccccttttttcccccccaaaaaccccccccctttttttttcccgctttttttttttttttaaaaaaaaaaaggttttctcccccccctaaaaagggccccccccttttttttttttttttttcccccccacaaaaaagggggggcccccttttttttttttttttggggggggggagnaaaagaaattttnnaaaaaacccgcggggggattttttttttttttaccgcctcccccggggggggggattttttttttaaaaatattttttttttttttattaaggnnnnnnnannnnnnnnccccccccccccccnnaanaaaaaanccccccccccccctctttttttttgaaaaaaa

SEQ ID NO: 16580 - DNA, 904 bp, Xenorhabdus bovienii
  unsure (1)..(904): unsure at all n locations
nnnnnnnnnggggnnnnnaaatggnnnnggnaaagacctctnnagcagagagtcccctccctaagaggccccnnnnnnnntnnnaannnnannnnnnnnnnnnnnnnnnnnnnnnnnnnnnnnnnnnnnnnnnnnnnnnnnnnnnnnnnnnnnnannnannnnnnnnnnnnannnnnnnnnnnnnnnnnannannnnnnnnnanaaantttttatttttataaaanaannnnanaannnnaanaaanaaaaannaannattttttttatattttttttttnnaaannnnnnttttnnnnnnncccggccccccatantaaccgtggnnncccttaaanncccccagccccgaanttnncccccctncccggaaagggnaaaaccccgggaaattggggntttaaantaaaaaaagggttttttttttnnnnaaaaaantttaaaaaaaatttnaaaaaaaatcccttggggnaccacccccccttttnnncccccaaaaaattaatttaaatttggaaatnaaacagtnnggntgnattgnaaaaaaccttttaaatgtcaaaccctccccttccgccaaaanaacacccaccgaaaaatcccccttttccaaaaccctaaaaaaagcccctccgggggnnnaaaaccacaaggtttttttggggggggaaacacacaaaaaaacacccacaccccngaaaccgccccccccacaattggaacaaaaaaaaaatggcaccaccccctttgccaaaaattttgggggtctcgtgggggggaaaaccaaaaaaacccccccacanaaaaacaaaaagcccccccgnnnncccccccccaaaaaaaaaaaaaaaaaaaagggggtttttncccccccccccgcttatnnnnnnnnnnnnnnnnnnnn

SEQ ID NO: 16581 - DNA, 818 bp, Xenorhabdus bovienii
  unsure (1)..(818): unsure at all n locations
cttgatcagccgactgngatctcaagtctaccatggtactgggatctagtagacgangtaccgntaaagaaccgctgatttaaataactcgtaagctngcacgggggggaaaaggacccccgggaacccgttttaaagggaaatttttaaagggggggaagggggttaacacaaattttataaaacccgggtttttccccggcgttaaaaacccggggggaaaaaaaaaaaaaaaaagccttttgttaaaaaaaaacaccccccccccccgggggggattttttttttggggggggtttattctctttcttaaaaacagaaaaaaaaaatataatatctttcttttctcctccttataccaccaaaaaaaataatttttttcttgagaagaattaattttgaggggcgccgccgccaaaagaacccgcccatataattcttatttttttgagaggataaaaaaaaaatttttttttttttctttttggggggggggggggtgggcccccccccccccaacccccaccttttttttttttttgttaataaaaaaaaaaacccccgggcctggttcgggtggaaaaaaagaggaaaaaaagttttttttttttttttttccgcccgccccggccccccnnnnnnnccaaaaaggnnaaaggaaggggaaggtttttttttttttttctcttcccgcaaaaaaaaaaaaacccccgcggggccgcgcccttttttttttgttttttnnnntnnngaaaaaaagaggaacccacccaccccccccattaaaaattnggnccccccccgcccgcccccccctt

SEQ ID NO: 16582 - DNA, 889 bp, Xenorhabdus bovienii
  unsure (1)..(889): unsure at all n locations
nnnnnnnnnnnnnnnnggggnnnnggggaagggnnggggggggggtnnnnnntgaaggnnnnnngggggnaattctatcgactcggaccggggactcattcatcacgacatataactctgtacgatattcacagctactacaggtaatcccgttatgggaaatggggtttgtccgcctccagtttaggctggggaaagggtccccccaatccggtttttttttttccgggccatttgtttccccccctttggggaaaccctccccccggggggaaaaatttttaaaaaaaaaggggggcccccaatttccggggggccccccaaaaaaaaaaaaatcccccccggggggcccgggaccccccctctttttaaaaaaaaaaattttggggggggggaaataacccccccccccccgggggggggaaaaaaaaaacacccgcggcgggttgggaaaaaaaaagaattgtttttttgagaacaaatggccccgccccccccccacaaaaaaaaaaacatttttttttctcctcaaaaaaaaacaggggccccccccccgttgttgtggttttttctcctccccccttcnaaccccaaaaaaaaaaaaaaaaagagggaccccccccccccctccccccccgcggggggggggggggggggcccccccccccccccccccccccaccttttatatttttttttttntttctctccacaaacccccccaagataaaaaaaaaaaancacaacacacccaccccctctgtgggggggggtgggggggggaagaaaaaaaacccnnnnannccccccccctccgtgggcgggggggggtggggagggggaaaaaaaaaaaaanaaaaaaaaaacaccaccccccccccccccccct

SEQ ID NO: 16583 - DNA, 544 bp, Xenorhabdus bovienii
  unsure (1)..(544): unsure at all n locations
gctgcgttgtgctgcgtctagtagtcgcttgtcttgtatacgtaaagctatatggctcattagacttgggtagggaacatctgaggggctagtgggtattaacaaatttgccctttaattaatgggggggttaaaaaaagggacccattttgggagaaaaggggcctttttttttaaaagggggaacccgccccccttttttttttccccgggggggggggggcccccccccgggacaaaaagggtgccccaaaaagagggtttttttttaaaaaaattggggggggaaccttttcccccccccgcngngggggggggggcttcagaaaaaaaaaaagggggggggtttcccaggccacctccttttttttttttttagaaaggggggggaaaaaaaaaagaaaacgggccccccccccccccccccaaaaaaaaaannnnttttttttttttttaaaccccactttttttttttgggggggggggggggggggggtttttttttttttttttttttttaaaaaaggggggggagatatttttt

SEQ ID NO: 16584 - DNA, 924 bp, Xenorhabdus bovienii
  unsure (1)..(924): unsure at all n locations
nnnnnnnnnnnnnnggggngggggnngnnnaaaaaagaagaatcgaggcggacggttctctcaggagaaatttattattatatttnnnagccaacttgcatgtcccctttgccaggtntttccttgtgagaggggtttttttttaannaanaaaaaaaaaacccaacccnaanccccnaaaccaaaaaanaaaaaaannaccgggcggggnnccccccccggggggnnaaaaaaaaaaaaaaaaaacgggggggncctttttttttttttaaaaaaaggcncccccccccccccaaaaaaaaaattttttncccccccccttttttataaaaaaagaaaatnatttttaataaacaccccccccccccccnaannaaaaaaaaaaaaaagaagagggggggggcgccccnccccccccccncncccttttttttttttaaaanananaaaaaaaaaaatttttttttttggggggggaaaaaaaaaaaaaagagggggggggggaaaaaaaaaaaaaaagagaggggcggngngcttttttttttttaaaataaaagaaaaaaaaaaaggcccgccccccccaaaaaaaaaaaanaaaanaaaaaantnnnnnnttttttgttctgtgggggggggggggggggggggggntttttttttttttgcgggcggggccgcccccccccncncaaaaaaaaaaaaaaaantttttttttttggggggggggnggnnnnnnnnnannnnaaaannnnnnnnccccnnccccccccccccccccccnnnancgaaaaaaaagaaaaaaaagaagaaagaataggngtgttttttttttttttttgtttttgncngcggccgccccgcccccccccccgcggcaagagaaaaacacaaaaaaaaaaaggacgccctctctctcatttttt

SEQ ID NO: 16585 - DNA, 946 bp, Xenorhabdus bovienii
  unsure (1)..(946): unsure at all n locations
nnaaagagggnnnnnnngggttttnnngaattttgggggggccgggnccccngccctgggcggcccgcgggganagaaagaaaaagttttanaaaaaaggcatgattgncagcaagcaagtcctgncaggctagtnatncaagncaggggaaaaaatgggccacttgagaccggggaaaaaaagggatttaaagaaagtggtggcacaggttttttggggtttttttccgggggggggtataaataaaggggaaaaggggggcccccaatggggggggggggggaacaaataattttttcccccccccccccggggtgggtggggaaaagtggttttataaaaaaaaaacaatatatttttgtgttgtggggggaaaaaaaaaaaaaaaaatatttgtggggggggggagaaaaaaaaaaaaaaaaaaaaaaaggggggggggggggggggtngnnggggggggaagnnaaaaaaaaaaaacaacaaccccgggggggggggggtgtggggggnnnnnnnttaaaaaaaaaaaaaaaaaaggtgnttttggggggggggagagagagacagaagaaaaatatatttttttttttttaaaatatattctctgccccccccccccccgcgccccccccaaaataaaaaaaaaaaaaaggggaagagggggtggggggggggtntttntttttnnnnnnnnaaangtnaaaccaccccccacccacaaaaaccccnnnaggggggggggggggggggggggggagagggggagnnnattttnttttttttatttttttttttttntcttccccccagggcncgcggcgggcgggggnnatnnnnnnnattntnnnttttttttttttttttttgnncnnnnacannnccnacgnnncaagagggaacggaagggagagacnnnnnagaaggaaagaatgatttttatga

SEQ ID NO: 16586 - DNA, 815 bp, Xenorhabdus bovienii
  unsure (1)..(815): unsure at all n locations
gcatgcttgctgcctgcagtcccttgtaganaacaacagcgtttgatcgatcaggagcctatcagtcgtagtacgagttactggcttaaaccgctgacgaagagacctttaggcaagcagagttaagaacccagcatgttaccaaggagtgggggtttgggccaaaaaattttgggggaaagggggaaacttttcccccttcaccggggggggggtgtttggccctttttttttaaagcttttttgcggaaaaaaaaggaagggtttcaaaaagggttaaaccaaaacccaaatttttttttttgggggggaaaacccccctttgtgggaaaaaaaaaaaaagcccggaaaaaagggccccaaaaaaaaaaaaaaaaaaaaaaaacccctctttttgtgtgtggtggggggggggggttttttaaaagggggccccctggggggggggagaaaaaaaaaatccccccccttttataaaaaaaaaaattttttttgggggaacccccccccctataagagggtttttttttcccccggggggggggggaacaaacccttttctttttttgggggggggggggggggccccccccccccggggggggggggggggcaccccccccccgggggggggggcccccaaaaaaaaaaaaaatatttttcggcccccccccaaaaaaaagaagagggggcgccccctcccccccncgtgtttttttgttttataaaacaaaccccccaccccccccttctttttggtgggcgcgcgcccccccccctcctttttttttttttttttccaccccccccccccc

SEQ ID NO: 16587 - DNA, 869 bp, Xenorhabdus bovienii
  unsure (1)..(869): unsure at all n locations
atgatatcgaattcgagactcggtgaccgcgggatcctcctctgtgcccacaaaaaataatnattttaccgctttcatgcccccccccggcgcgggtggcgcccctcttttaatttactgacccggcgggggcgcgaaaacccccccccccccggcgggggggggggtgttnttttttttaaaatnttagagaaaaaaacaaaaacaaccccccttttttttctttctccccctcggaaaccaccacaccccccccccccctaaaaaaagggtattccctttttgttttctcgcgccgggggggaccccccacaaaaaccacaacacaaaacaacccgcggaaaaccacccatagngggggggagggggccccccccccccccccnngggnggggggcgggaggggcccccctcttttttttttccccccccccagaaaaaaaaaaaaagaggggtttttccccccccccttttttcccccccccaaaaaaaaaaaagcgggggggagaaaaaaaaaaaacacgggggnnaanaaaaagaaaacacccccccttttaaaacaaaaaaaaaattttttttttnctgtgtgtttttgggagagaaaaattaccccccccacccgccgcgcggggggggggagcactaccgtgggggttntgtcttcccactcctccacacccccgaagatttattctcttctctnggggccccctcctgtgttttttttttccgcgcccccccccccccctcttatcgttgggcgggagggaccaccccacccaacagaggggggcggggggggccccccccccccccccacaaagcagccaggacgccccgccccgccccaccaaaaaatcgctccnccc

SEQ ID NO: 16588 - DNA, 887 bp, Xenorhabdus bovienii
  unsure (1)..(887): unsure at all n locations
tttcaatagcgggcccggatggtaagcgaaccnagtttttncgcttaatttcggatatcggactcggtgcccggggntacctctaggatccgacaactgcgtagcaggcgagactgagtcactaatactcgctatccttatgcagtcatcgtgtactatgacacgtttatacagaaagcaaacaataatccatgtgcacgccgaacaggccacacgttgaaaaccaggccactctaatgatgctgccccatgttggcgaggatgcgcgctaataccccatagggggggatgtggaccaaatgggcctttcacccgaagggaattggggggggcttcaactcttttaaccacaatgccccgggtttgcccaaaaaataacttggaagggggaaatattttccctcaaaaaacggaaacctttgggaggaaagagggtttcaaaaacccgttctaggtaaaaaactcttccaaaaccacccctcccggaattttaacacccgcccctctgcgtataaagagggtgtttccccaaaaaaattacccgccaaaattttaaaaaaccccaagggttttgggggtgttaaaaacccaccaaggggggggtgggggagaaaaatttggggccccccaacacaaaagttttcgccccccacctccccttcaaaaaaaaagaattctcttaaaatattgggggggggcccccccccacccccccttctttttttttttttgggggggggggggattaaaaaaaaaacatttctttttcagaaaaaataattttttttcgggggggagagatctcccccccccccctcttatanncttttttttttgtttggtggggggggttttattattttgcggggaaaagaaaaaaaaaaaac

SEQ ID NO: 16589 - DNA, 1110 bp, Xenorhabdus bovienii
  unsure (1)..(1110): unsure at all n locations
nggggnnccccccccgggggggcnnncnnnnnnnnnnnngncnnnnnnnnnnnnggcccattacctcttgcataggccatggcaaggtncaccccaattatcactgannaaactaggtagtcttatgtacaagagggtgctacatgcatcccatgctggaaggtccaggtcagatggtggaggcacacagtgatcccaaagtgggagggaaanagtgaatataancactaacctaaaacaagtgggaactaatataataaaaanananaannaagggacaccattaagaaaattnnntnngnnnncctaagnnnnncnnctnngnnnncnngagnntnnnncnncnctnnnncnncaaaaaancgnnnctnnnncntaaacnncaangnnnnctnnnaannaggaanctnnnctnnnctnnnntaatnnnncttnnaaaaanaactnnncnaannnnaacnnaanaanaaaannanaacnnccaaantngnngncnnnctngnnncnncggnctctggnnnaaagggnggntngggccaaatnnaaaantngggggncaaaaannccnccaacnnccgngcccccccaaaaaacncttngggggaaaagggaaaaaaaaatttgggcccccggtaatccctgggccttgggaaaacccccaaaaaggnccggaaaaataatcaaaatttaaaaccccccaaaatgggggcctttttttaaaaaacgggggcaaaaaaggccccctaaaaaaaaaccgggggaaaaaaaacccctcttccgggggtaagggaaaaaaaaaaaaaaaagaggggggaaaaaaaaatttccggggaaaaaaaaaaaaaaaaacttgtgggccccacaattattttttaaaaaaaaaaaaaaagaggggcaaaaaattttgggggaaaaaaaaaacccccgggggggggggggtgttttgntgggttctttttctccgggggggaaaatgtggtcnaaggggggaaaaaaaaaaatgggggggggggaaacaaaaaaaaaaaaaaaaaaaaaattgtgtttaaaaaaaaaaaaattttttttaaaaaaaaaaaaatggggggggggggcgcccccccaaaaaaa

SEQ ID NO: 16590 - DNA, 1160 bp, Xenorhabdus bovienii
  unsure (1)..(1160): unsure at all n locations
gatagtttgtcgnagttncgngaccccccccaccccggggggtaccctttagggtcctcctttaacggtgttgggttttttccccatcccggatggggcccaccaaaaacaaacaaattcccctttttttaattttcaaggggttggaaattttttgggaaaaaggccaggttttaccccataaggggctttagaaacccttgggggaggtgagccctgcacaattgttccccccgggggggggaccccctttttttttttgttggggggaaaaacctttgaaaaaaaagggggggagaaattggtggcggaacaacaccccagaggaaaaaaaaaccacacccccctccctcccatatatatatattttttttgtggggggggaggcgccactccggcgaggggagagagnnaatataatatattttggtgggagaggagaaaatccgccgaaacaaaaaaaataccactnccggagagggggtggttttttttttttatcaaaaagaaaagaagggggggttttcttgttatatggatagagaacaacccctacttctatctctatgtgtgttttttttttgtgtnatatataaacaacaccccacctctttcttttcttttntnttnatggggggggagcaagagaagaagagagagagnaagaggggngggngnctctttccttttcctctgttttctggnnggcggcggacggagccaacanaacactatatatattnatgttacttcggncggaggaggaggagaaaagaagataaaataatatatattattntatatncctcgcccncgcncacaggacaaaannanagaagagagagagagaggagaatgagaaatcaatacnacatacccatatccnnatnnatgnagaggggnngnnggnggggcggggncgnncgctcctctcttcttctctctctttatctntctacttnnnatagagaagnagagagaattatcnncccttctctctgtctcttctctcttctnnnctnnagaggnnaggaggagagaagnagaggagagagggagagnaaggaggagagttagcttagtattnnatatgaggnnaagaanagaggnnaacgagnagaggccagcnccggnnnaggagtggagagagggagattatc

SEQ ID NO: 16591 - DNA, 972 bp, Xenorhabdus bovienii
  unsure (1)..(972): unsure at all n locations
gcccagaggggggnggnncnnngntcnnatgtccttttttccccccccccggttaggttanttttatgggaaccgnnnaatataaannnnggccnnggggggnnaaaaaaccttttccnnnnnnngggggcggggggggntttttttnnnnnnnnnnnnnccccccaaaaaccccccccntcccgggggggggggnngggggngggggggggnnnnnnntttttttttaaaaaaaancccccctcttttttttttnnnngnnnntctttttttttttnnnngggggggggggaaaaaaaaaaaggggaattncctaaggggntggggnccgnnatattttnccanaaaaaaacccgaagggggtttttttttcccggnccggggggnnnacaccacggggggcccgggttttttccccaaactttttttccccccgggggccccaaaagggggggcccaaaaaaaaaaaccccctttttcccccccctttgggcccctttggggaaaaacccgggccccattttgggggagggggggnaaaacggaaatataggggccaaaagggggccccaccaccaaaactttttggggggggccccccaaaaaaaaaaaaagggggataaatttntattttttttnnaaaaaacccccccaaaaaggtggggggcccccccccgccgtgtggggggaaaaaaaaccgggccccaaaaggggaggggcccccccccgctgcggggaaaaaaaaaaagacccccccttttttttttgtgggggggcccccccccccttattttttttttggggggggggaaaaatttattttttttttgttggggggggccccccccccaaaaaaattaatgggggggggggggggcaaccacccacccaggggcgggaaaatatttattatctacacccccccccccttctttttntttnnnaaaaaaaaaaaacaaacctttggtgggg

SEQ ID NO: 16592 - DNA, 1051 bp, Xenorhabdus bovienii
  unsure (1)..(1051): unsure at all n locations
cccaagggggagngannngnnnccctttatttnnnnactctccatttttagccaagcccggnncagcgtaccacttctccttacggtagtgcaggggagcactccgtctgaggaggagctcctcactacanaannatctaatatgtattttttntntnnnnnnnnnnnaggctctttgaacctttngnnncctagannncntnngnccgagnttncttgnntatatnntnttttnngggncttttncgnccccctttggnnacaccccggcgccgcggggnaaataatttcaattccggggggggtggccttggaattatggccctcgggtgtattttctttctcgcccggccctcttgggggggttggggggaaaaaaaacaacaaattcccccccaaaaaaatatttaccccccctctttggtatttctggggggaaaattagaaaaaccctccaactttttttaaacaccctttaataccctttggtttttttaaataatagggggggggccccccccccccccctcgncatttttgggggaataaaaaaaccccccctggggggggaaaaagataaacccccttttttttataaaaaagaaaaagggaaattggggggggggggggatttggggacttttcgggaaaaccggggggaaaatcaccctttttttcttttggcgggcggggaaaaatatttttttttttgggggggggggggggggntttttttttataatattattcctgcgagggtgagtttttttttgtggtgggctatcacaacaacaaaagaggggagtttgtttttttttntttccccccctctccctttttttttttttttttttnccttctccttctccttttgtatgtggtgggtggggggagannccacaaaaaaaaactttttttttcttcctctnccctctccnnttttttgtttttttttccccgctatctacttttttttcttggaggancctctaatcacgttgcnaggggtggcgcgcgttcgccctatggtgtcacgtctctttcacttctg

SEQ ID NO: 16593 - DNA, 808 bp, Xenorhabdus bovienii
  unsure (1)..(808): unsure at all n locations
gggaagatctttngttttgnaggttaacttgctgccgccgtcctcctaagcatgacgtgtagatcttcgttcgacatcgctatcgatggcttacaagctggcttatgggtccttgctacaagttaacagggggagggccattcctgcccctgaaaaatcccctttgtttaaggggggggaaacggagaactcttaaacccttagggcgcccccccctccccttgggggaaaaacccccaaggctcctggggggatttttttttttaaaaccaacattttaaaaaaaaaaacanaaaaaattttttggccctttttttggggggccgggggggagaaaaaaaaaaaaaaaaacagcttttttttattttcaccccccccggggggggagggtattaattttttttttttttttaaaaaaaaaaaaaaggggggggggggggaaaaaggttataaattttaatnccgctttttttcccccaaaaaaaaaacactttttttttgggggggggggcccccccctccccccccgggggggggggaagggggtggtccccccccatctccccaacaaaaaaaaaaaaattaggtttttttcccttcttttttttccccccnnnnnaaaaaaaaaaaaaaccccccccccccgctcccntttttttttcctcnntttttaaacccgggtggggggggggagagagggaaaaaaaaaaccaccccccctctcccccctttttgtggggggggggggggagggggggnaaaaaaaaaaaaaaaggccgggaagaaacccgtgtttttttttcttttt

SEQ ID NO: 16594 - DNA, 839 bp, Xenorhabdus bovienii
  unsure (1)..(839): unsure at all n locations
actactggagaccccgttattcgcttcgacgcatctttgcttacgtacggagccataaatcgttttacggtcaactggcaactaaaaaaatgggcctggccttggcaccgccctatttggaattaaagggctgggggccccctttctgggaaaaaccccggagaccccccccccttaataaacccggggtgggtgatagaaaaaaaacaccgccgcggcgcggggggagtgttttctcctcccccggggggggagaggagtgtgttgtttttcttcctcccacacacaacaaggggtgtgtgggggggaagaaaaaaaaaaaatatttcttcttcccctctgggggggggggggaaaaataaaaaaaaaagcggggggggggggggggtctctttcttcctcccccccccccggggggggtttttttttttggtggggggggcgaagcaaaaacaaaaacttttttttttttttacacacaccacaaacaaaaataatgggggggggcgcccccagcgggggggggggggcgttcgtcttttattttataaaaaaacccccccccccccccccctctttttatttttttttgtcgggggggggggggagaaaaaacccccaccccccccccctcgccgcgggtgggggggggggggtgtttttttttttttttaaaaaaaaaaccccctctctttcctcctttttttttccttataaaagagggaaaacccgggtttgctacaaaacaaacaacaccatgtttttggggggacatgaaacggtggtggtattgnnngncccccccngggtccggcaaaacagaacatggtggagcttga

SEQ ID NO: 16595 - DNA, 1129 bp, Xenorhabdus bovienii
  unsure (1)..(1129): unsure at all n locations
ggtctctgcggtggggtgcgcctcgcccgaaggggnggnngngnnnggtntttnggnnncctaggtctcaattcncccaaccgcccggnattaacttaaagngccgcgcncncnnncggggcggngggggcnnannaacaaaaaaaaacctctcttttctancttccccccagagacgtttattgtattgcggcgggacatgggagtagtctaaatgttttacttactctgttttttattgttctaaaatgagtttttctgccccccacctcaccacgccatgtttcccccccccctatcattaggattgaactcgcgaccccccgccgcagttagcnnaanannatgggaggggnactttaaaaccttcnctttngnggaagggtaattnccccggaatcccccggagagggggggttttttttttttttggggggggggggggcccccctttttttnnaaaaaattatgagggggccccccccttttttttnnaaaaaaaaaaaccncccccccccnccnccaaaaatttatatacccgcggggggttttttatatttttttggggggnnngaggaaaacccccgggnngaaaaaaggggtgcccccnccccccccccgcngngggggcnccccccccaaagagaggaggnttttataaaancccggggggggggnggcccttttttgggggnggggnnccaaatatttttttttggaggagcggggggcccaaaaaaaaaaanaataattatttgtggggggcnnccccccccccaaataacggggggggggggnttttaaaaaaaaaacacccccccccacaaataatttatttcccccccccccccccagaaagaggagagggggggggnggntcccccccgcgcgcgggggggggggnnnaaaatatttaccccctctttttttnaaaaaaaaattatttattttttttttcnnnncnaaagccggcgccaaaagaggaggaggggcgggttgttttcngggggggtttttttttttaatcccccccccccccacaaaatttattttgggggggnngggggnngnnccccccccccccccccttttctttnnnncaataaaatttttttttttttttttggcg

SEQ ID NO: 16596 - DNA, 889 bp, Xenorhabdus bovienii
  unsure (1)..(889): unsure at all n locations
nnnnnnnnnnnnnnnnnnnnnnnnnnnnnnnnnnnnnnnnnnnnnnnnnnnnnnnnnnnnnnnaatgagctgagtacttatgaattaaaaaagtatgagagtaatgannnnnnnnggnnnggaaatatgctgagtccatgaaaagtcgtgcagaatttattcctaattgttcttgtaaaaagaaaaaaaaaaccctggggggggggggaaaaaggggaaaaaaaaggggcgaggggccaaaaggggtaaaacgggggaaaaaattttttttagggggggaaaaaattttgggggaaaaaaaccncccccctttttttttttggggggggtgggggggaaaaaaaataatataagaggggngggggcccccccaccacttctccccgccgcgcggggaaaaaaaaaaaaaaaaaatgtttttttgggtggaaaaaaaaaaaaaaaaaccaccccccccccccccccaaaatatttaaaaaaaaagaagaaattctttttttttctaaaaaaaaaaaaaaaataaattttaaaaaaaaaagaggggggggggggggggtttttttttttnncaaaattataaaacaaaaaaaaaaaaaaaacccgggcgggggggttttttgttttttttttttgtgttggtggggccgcccccttgctcttntncccccgggccgcgcgccccccccccncacaaaacaaaaaaaaaaaaaacnncaacannnntctctcccccctcccccttccgccgattggttttgtatcgttttggtgggggcgtgcgngggtcggcggggcgcaaaggcacaacaaaaaaaaaaaaaaaannacacaccccccccccnactcggcngnggnggggggggggggggggaggtgtgttatctttttt

SEQ ID NO: 16597 - DNA, 864 bp, Xenorhabdus bovienii
  unsure (1)..(864): unsure at all n locations
gcattctgctgctgcagtcccgagcgcccatcgagccatcaggatacgcgctgcgcagacacgtgacgncgatcaacacgcagcggtccgccgtcgggcacaaacgcttatgggttccgatttcccccacaatggttaccgggggttttcgggttcggggggaaaaatttaccctgttgggggcgaaaattgcgcccccccaaaaaaaccaaaattgggggggtgtttcccagggggggggggggggttattagttttttttccggggggtttttttctccccacagaggggggggnccccccggcgcggggtgccaaaatttttttttttttcctcccccccccccccacctctttttttggggcccccccctctttcttctctccccccgcgggagaaaaaaaaaaaaaaaaaaattttttttttttttgttttctccccaaaaaaaatattattttgttgggggggggggggggggtgctctggccttttttcttttttttgtgtgggaaccttcccccccccccccctctttatatttataaaaagaaggggggcgccgccctttacggggccccccttttttttttttgtggacccccccccccccccccttttttttgtgtgtaaacacaaaaagaggggggggggcgcccccccccctctcttttttttgtttttctttttaaggaggggggcggttttttataaaaaaaaaaaagaggggggggggggggttttatttatataacaaaaaaacccggcggtctttttttttttttccccccccacacaaaaggggccgcccnnnnggggggtttttttttttttttctcccccccccggggggggggggggggggg

SEQ ID NO: 16598 - DNA, 419 bp, Xenorhabdus bovienii
  unsure (1)..(419): unsure at all n locations
nnggggnnnnnnnnnnnnnnggcctgggtcgcggggcggaggctcaaagttaagtttgtgctgcgtccaatagtatgtttgtgaagagcttcctgtagaaagaagctaagtaaaaaggcaacagaaagggaaacccggttttggaaaaggttacggggcggaaaactggggtcccaatttttagaatttcaaattttttttttgggaacctttttttaaaaaaaaaacgggggttttttttggggggaaaaaagggaagaccaattggggggggaaaaaaaaaaaatttttggggggggggaaaaccccccccccccaaaaaaaggaggggggggtgttttaaaaaaaaaaaaaatttttttttttttaaaaaaaaaaaacaacccccccttttttttttttttaaaaaaacacccccc

SEQ ID NO: 16599 - DNA, 793 bp, Xenorhabdus bovienii
  unsure (1)..(793): unsure at all n locations
atgcannnnnnnnnnnnnnnnnnnnnnnnnnnnnnnnnngtcccgactgctgaaacatttcgccagcagctactgctgcacacccgagaacagagcgctgctctggccgttaatcccattttttacaagcccgaaggcttccccaggaaaaaacctgggaacggggtttttcttttgcgaaattccccaaaaacccccccccaaaaaaaagggggggggccaaaaaaaaaaccccttttttgggaaaaaaattttccccccctggggggggggcaccccccggggggggtttttccccccccccccccccccccccggaggagggggggccgcccccccccccccccaaaaaagagggccccccccccccccctataaaaataaaaaaaaaaaaaaacacccttttttttttttttccccccacaaagggattttttttttttttcttccccccccccagggggggggggggggggggccaaaaaaaanncccccccccccccccaaaaacaaagaaggggtctcccttctttttggtgtgtggcccggcgccccccccccctctttttggggggggggggggggccccccccccccccccccccccccggcggggggcattttttttttttttttttctgccccgcgccccccccccctttttantttgtgttatgggggngggggnnnccccgcgggaaccccccccccnnnntttttttttttttttttaaaaaaaacaaaaaggggggggtttatctgtttttccccccccccccccccccttttttta

SEQ ID NO: 16600 - DNA, 904 bp, Xenorhabdus bovienii
  unsure (1)..(904): unsure at all n locations
cactcggnnaggcccgcccgggaccccagagccggggccccctcgccgacgcgcgggagaccntcnacaggaggggcaaaaaccctatnaaanagttttttacnaacaanaagatctttggggggaataacggagaactccgggtncaccccggggggggggtaacccttccggaggatcccggcctggcaaaaaaggagggcctgggctggggcagggggagaaaaaacgggcggggcggaggtaataaaccggataaccggaaggggggcagggaaaaaaattccgcccagggccgggggcaaaaaaaaaacccggggggaaaaaacccgggggggggggggggaaaaggggacccaccgggggggggggggggggggccccccaaaaaaaaaaaaaaccccccccccccccgcggaaaaaaaaaaaaaaaaaaagagggggggggggggggtgggtttcccccccccccaaaaaaaaaaaaaaaaccgcgcggggggggggggggggggggcaaaacaaaaaaaaaannnccgcgggaaaaaaaaaaagaaaagagatccccccccccccccccccgcgccgggggtggggagaggggggaaaacaaaccaaccccccaccccccgccgcgcggggggggggnnngcgcncgcgggaaaaaaaaaaaaaaataaaatatatggtgggggggggggggggggggagaaaaaaataataaaatatattctcccctccccccgccggggcggggagagncnaaaaaaaaaaaaaagaaaaggggggctttttaaaaaaagagggggggggggggggggggttcccccccccccccccccccctccttttttttctttttctttttttttggggggggggggggggagaagaggggagaaaaaaa

SEQ ID NO: 16601 - DNA, 912 bp, Xenorhabdus bovienii
  unsure (1)..(912): unsure at all n locations
nccccccccccccccnntttttttntgtttgtttttttttccccctnanacnggnnnttgatccatcgactcggacccaggacctctactccgccactcaggccaaacagctggtaggggggacagttgaagngcgaacaatgctaccggggcctgcctacgcgccgagaaaaacggaagaaaaaacattttttgtattcgggctaccaaaaccccccccctttttatggggtgggggaacccaccccgcgggttttgacttctccgaaagggattttaaggggggggggccgcttaataaaagggcttctttttaaaaaaaaacccccgagaacggggggtttttttccccccccccccccccccccccccggaaaaaaaaccccccccccccgccgggggggggggggaagaaaaaataaaagaggggggggtggccccccaccggggcggccgccgcttttttttttttcttttttcccccccccccccccccctttaaaaacccgccggcgccccataaagggggcggtcttctttttttcttccgcccgcggcggagaaatatatcaaccccaccccctccccccccccccagcttgcgccctctcttccgtggtcccagccgcgggcgccacgtttcactccacctctcacgcccatcgtttgtaggtagggccgcaccaccccacccccccccccccgcggcgagaaaacaaacaaaaaaaataagaccggcgagcttgaccacaccaaataaacaaaacaaccccctccctccccctcccctcctctccacccactttactctattcacccctntcnntncgccccgcccgcctcccaccgcgcggcccngccncangactnnnttttntatatattcttctttcgagcgcaccgcagcccgcn

SEQ ID NO: 16602 - DNA, 687 bp, Xenorhabdus bovienii
  unsure (1)..(687): unsure at all n locations
gcctgcgggaagcccgagnttattatgcttattagcttttgtgcgctaccattcacatgcgagctagctcgaaccagctgctaagagaattaacctagtctgcccgaagcctggacaaagcatacccgaggaaggttccagccagcttctcgccaattttgtaacccgtgaccaaagaataagggggaaataacccggtttaggggaattccctaaaaaaaagggtgtaaaaaaatacgcccaaggggggggggggggaaaaaaaaaaatttttggaaaaatttttcccccttttggggaaatttggaaaaaaaaagggggttttaggggnncnnnaaaaaagggggccccccccggggtttttccctcccccccaaaaaaaaaaaaaaaaaggggggggggggggggggggggggggggtcacaaaacccaccttctccttttaaaaaaaaaaaaggagggcgccgctggatgtaaagaataaaaacccccccccccccccaaaaaaaaaagggggggggggacaaaaaaaaaaaaaaattatttttttttttctaacaaaaaaaaaaggtttttctttcttcttttattattaagagaggagcggggnnaaaaaaaaaaaaaaaatttttttcttttttttttaaaaaaaaaaggggggggggccgttttttttttcccataaat

SEQ ID NO: 16603 - DNA, 1040 bp, Xenorhabdus bovienii
  unsure (1)..(1040): unsure at all n locations
nggggggnnnnnnnnnnttnnnnnnttcctctttttcngccgctctgggggggggncccntgttttgggaggggnnnncncnnnccaaaaaggtttttttaaaaaanaatttagttttaggannnnatancgagaacncggtttacccgggggntaccctnctngaagatccaatgnaaaaaacnnnccccaactggcccagacaataaaaaataggnaataaattcgggggttcaaaaattggcgccaatgggccaaaaggccgggtaacctccctactggccaaattttggctttggaaacctggcgaaccctggaaaggggaaaaccgggaaaaacccaaaggggggcccggaaagcttttttcaaaaaaaaccccccgggaaaaaccaaaaaaaaaaaaaaaccccctccccttttataaaaaaaaaaagggccccccggagggggggggggggaaaaccccccctatagggggggggaaaaaaaaaaaaaaaaaacagggggcggggagaaaaaaaaaaaaaggggggccccgcccccccccccggcgaaaaaaaaaaagcgcgaagagacccccgcgggaaaaaaaacccccccataatatttttcccccgcgcgggggcgggggggggtgtgaacaaaaccccccccccccgaaaaaaaaaaaaaaaaaaggggggttgggggagggcgcaacaccatcctaaaaaaaaaaaaaaaccccccccccnccccccccccatngggggggggggtattttttccttggnccccctttcttncccccttcgccggggaaaaaaaaaaaaaaaaaaaaaaaaagcgggagggggggggaagcaaaaaaaaaaaaaaaaaaaaccccccccccccccctttttgtttttttaaaaaaaaaaaaaaacaaacccctcttggggctgggggggggggggggngggnnnnnnnaaaannnnnnnaaaaacaacaccccacacccccccccccccctcccnnntnnttttttttttttnnnngctgggggggggggggaggaa

SEQ ID NO: 16604 - DNA, 1032 bp, Xenorhabdus bovienii
  unsure (1)..(1032): unsure at all n locations
aacgccttacggaattncgagccacggtaacccgggggataccctctagaggtccgggaatctcaaatatccccctctcccggttttggattgtaagtaagtaagcggacgtggattccttgggatggcaatctggttggaacaagggggcgaacacaccgaatcacaagccagtacaagagatactttaaactaacaggtgtgtaattggcaccggttttgcggccaataaatgggcattggaaccggaacatggcttgaaatgcaattnggnngccaaccttagtgccagtttttccctcaataaaaaggaaaggcaaactttttttttgcccggaattttgggaaaccttgggaattgggcatatccaaggggggtgggaggggggaaaaaaccccaacaaagttttttgaaaaaatttttgggaaaaaataaaacttgttttctcccccggggaaaaaaaaatgtgggaaaaaaaaacccccccccacatttaggggaaaaaattttcttccaaaaaaggagcgaaaaaaacccccgggggaaaaaaattttgttcccaaaatatattttttttggggaaaaagggtttttttttttttttcttttcaaaaaaaaaaaggaagttttttttttttttttaaaaaaaagaggggggggggggctttataaaattaaataaaaaaaaagggggttctcccccccccggggggtgtgaaacaccccaaaaggggggggggggcaaaagaaagaaaggtttttttatatttttttnaanttcccccccaacaaaaccccttttaatttttttgtggggggggggggggccccaccccggcgcgcgtgtgaaaaaaatttttcctcttcctttagaggaaaaaaaaaaaagaggggggggtgtttttttttttttttctccccccccaccccccccccaaactaatggagggggggggggggggggacacttcctcctcccgctgaagaagaaaaaaaaacgcgcgggggggggggggaaaaaaaataaataa

SEQ ID NO: 16605 - DNA, 1026 bp, Xenorhabdus bovienii
  unsure (1)..(1026): unsure at all n locations
tgcttacgaattcggcctcggtatccggngatcctctanagtccctcannatataggggcaaanttnatcccagctgntgcaaagattttcaccgaagctggccatcaaaattgctgcctggcgaagttttacccaaggcctttggtttttttccccgggggagaaaaaaggaaaaattcttttttttcgggcccctttccaaaaaaaagggtttttttttgggaaaaacccacatttaacacgtttttggggggaaaaacaccccttttttttcccaccccccccaaaaaaaaccacctttttttttttattagggggggggggagaaaaaacaccccccccccccccccccgcagggggagggggtgggtggttttctaacaaaaaccaagagggggggggttgttttttataaaaaaaaaaaaaaaaaaaaaccccccccccccccggggggggggggggggggnggggtgtttttttttttatttgttggggcccccccaccaccaataataagggggggggtgggcggccccccccccccggggggggggggggggaaaaaaaaaaaaaaattaatatattgggggggggggggggggggccccgcgcccccccccccccccccccccccttctttttttattattataaacaccccccccccgcccccgggggggggggggggggggggggggggacaaccaaccacacccccncttttttttttttttttttttcttttttcccccccccacccccccccncnanaaaaaaagagagcccccccctcccccccccccctccctttctttaaaataaaaaaaaattttccttctttctctcccacaaaaaaaaaaaaaaaaaaagaagggggggggggggngngngnnccgccgccccaccccgccccaccaaaaaaaaaacaaaaaaaactngnnggnggggggggggggcggcacccacacccacctaccatctntnttttttttgtttngggggggggcggggcggcgaagacccca

SEQ ID NO: 16606 - DNA, 858 bp, Xenorhabdus bovienii
  unsure (1)..(858): unsure at all n locations
nnaaaaagnnnnnnnnnnnnnnnnnncccttgngnngccccggccgngcggngcggggggggcgggngcccggnncgggggggggggcccccccccnggnccgccccggnnggcccgcngccnngggggggggcggcccgcccccccgnncgggnnccngcccgggncccgggccgggggggnccccgcgncctggggggggggnnnccnggngggccgtggggnanaaaaaaaaaattaattttttttnnngggnnnnaaaaaaaaagagcctcctcttttttaaaccccggaaggnnnccctttaaaanacccacccagccccccccgaaaaattttttcttaaactaaatnttnnnnaaaaaccaagttttttttnccccaaaaannncaaaaaaaccaaaaaaaagggcccttctnncccccaaaacacccccccataaanccccccccctaaaaatttttttttnccccggggggtnttgggggcccccccccaaaaaaataaanaaaaaaaaacccccgcgcccgggnnnaaaaaaaaccctctntttaaaaaaaaaaaataataaaattttnaccccccccccccgtttttttncccccccccttggtggggggggggagaaaaataatnnnaaaaaaaaaaacaanaaaaaaccccggcgcggttaaaaaaaaaanaaaaaaaaatttcttggtgggggggnnnnngaaaaatnnnnnaaaaaaaaacaccccccaaaaccccccttttttgaaaaaaaaaaaaaatggggtcgccgaaaaaaaaaaaaaaaaaaaaataaaaaaatcccccccgccccccccccggggtttttttaaaaacaaaaaccc

SEQ ID NO: 16607 - DNA, 917 bp, Xenorhabdus bovienii
  unsure (1)..(917): unsure at all n locations
nnnnnnnnnnnnnnnnnnnnnnnnnnnnnnnnnnnnnnccttcnnnnncncngnnncnnnnnnnnngngngggcgccgnggggtnncgggggnttagnnnnanagcctgattgcagcctgcatncggctggagacataagtaatgtcaggactccatccgataaccattggaaatactggaacgaccccttactgctttaagaaaggcctaaccctagggcggaaaacctttaaacaaagaacaaaaggttaaaaacggcccctataaaagggggggaaaaattcggggaaggcccaaaaagtttttttgaacaccttgggggggggggggttttttatggggagccccccccattttttttttgtttttcaaaaaaaatataaacccccccttgtgcaaaaaaaaaggccccttttataaaaaaaaaaaggccccnnaaaaaaaaaaaaacaaaaaagggggccccccctttttgtgggggggaaatattttccccccccccccctttttaaaaaaaaaaannggggagggggggggccccccctcttctttttttaaaaaacaacaccctctctcctgagaaaaaaaaaaaactttttttcttttccaaaagaaaaaaaaaaaaaagtttttttttataaaaaaaacaaaagagaggggggggggttgttttttttctcttctttctccccccccgggggggggggcgccgaagggggaaaaaaaaaaaaaaaaaaaaaaaaacctttccccccccccccccccccggggggggggggggagaggggtttccttctacttttttttcccggcgggggggggggggggggttattttttttttttctttttcttcttggagnnngaaaaaaaagaaacncccttcccttccttnnnggctggggggagagggggga

SEQ ID NO: 16608 - DNA, 775 bp, Xenorhabdus bovienii
  unsure (1)..(775): unsure at all n locations
tgcnnnnnnnnnnnnnnnnnnnnnnnnnnnnnnnnnnnnnnnnnttacctgcttattataatattgatttctattcccgatcgtgagtgcttaagaatagaaagccaatcacgataagtgtaaaaaacggaaaaagactatatagggtaggtcgatattgattantattttttaggtggaaaagatgaatcgctttgaaccattcaacctcccctttttgggccttccccttttgggaaacctaaaggggttaaaacgggtttggccctttaaactttaaaaaaggggggttttgtttttgggccgccccaattttggattttgcatagaaacggggttttttttccccttaaaaaaccacccttttttagggttgggtcccccttttgggggaaaacaacacaaaaaagggggggttttttttttccaaatttttttttgggggggaaaaaaaaaaaaaactcctccccccccccttttccggggttttttaaaaaaaaaaaaaaacccccccccaaaaaattccccccccataaagggggttgtgttttttaaattttggggggaaaaccaaattttgtgggggggtttttttccccggagaaaaaaaaaattttttttttttttaaaagggggggagaaaaaacccccatttttttttttggaaaaaaaaaacaccttttatttaaaaaaaaaaaataataaacccttttcgggggggggaaaaaaaaaatatttggggggtaaaaaaaaatttttctttggagagaaaaat

SEQ ID NO: 16609 - DNA, 1123 bp, Xenorhabdus bovienii
  unsure (1)..(1123): unsure at all n locations
nnnnnnnnnnnnnnnnnnngggggggnnnnnnnnnnnnnnnnnnnnnnnnnnnnnnnnnnnnnnnnnnnnnnnnntttactgtacnnatatnnnnnccttcngggccccnnnggggggcctctnnaanccngnnnccnntggcggcgggccncccncccccccccccccccgggggcnnnnnnnnnnnnnnnnnnnnnnnnnnnnnnnnnncttttttannnnnnnncnnnngttggaanttnttaccccgnnnnnantanncgnggnanntnnncgngnttnnncnncggngngnggnnntancnctnnctngganggatnnctntncccttncttngggggnccactggggnnnaaaaacttnccaannnacttncttnnacttnccgggnaaatatttattttgggncgccccactttggtcccatccaaaataggccttttaaggggggccgcttttaggggcttgggcagggggaaaaactttaaattttcccgccccgaaaagggaaaagggcctttttccgggtttttttttttaaaaaaggggggttttttttgggggaaattttgggggggggtttttttgggggtgttttaaggggggggaagagccccccccctccggggggggggggccctcccccaaaaaatgggggggggtttttcccccccccttttttttttttttttttccccccccccaaaaaaaaaaaacaaaaaaaaaaaacccctccctcctccaagaggaggggagggggggggggggattatataaattgggggcggccgcgcccgaaaaaaaaaaaaaaaaacncccaaaggggggggggggggggggggggggaagagagaaaatatttttttttttttttttaaaaaaaaaaaagaaagggggggggggggggggggcccttctcctccttaaaaaggggagaagaaaaaagaaggnaatttctcccccccccccccccttctttttttttttttttatattaaaanaccccccacccccccccccccgcccgcggggggcgggnngagnanaaaaatttttatattggttgttggggggggggggggggaggaggggttttnnttttttttttttatttgtgagat

SEQ ID NO: 16610 - DNA, 826 bp, Xenorhabdus bovienii
  unsure (1)..(826): unsure at all n locations
tgttcgatcagctcgacccggatccttaatctctgatacgccgtcgctagcttgtgcaacatacgagcggtgaagggtttattggggacaatcccaaaatgggtggaaccaaaaaatttcgtggggaaccgtttttgggtttgggaaattttggggaaaatatgggaaaatcttttttcccccccccctcgggggggggaaatcctttgtggttttttcccccccaacaaaatatttttctcttcccggaaaaaaaaagaggtatatattaaaaagccccccnngncaccccccccccccccggattttaaaaaaaaaaaaaaaaaaanncttcttcgggggggggtcacatgttctcacaaccaagagcggggggggggggggaaaaaaaaaaaacaaaaaaaaaatgtattgggggcgcggccccccccccctgggtggggcccgcccccccccccccccccccccgcggggggttgggcccccccttggaaggataaaaagaaaaaggcggggggnnccaaccaaaaccacaacagaggggggggggcgtttttccctcccccccggagagaaaaaaaaaccctccctttttttttttaaaaaaaaagaaaagggctctttttttttttctgggggggggggaggggacaaacaaccaaaaaaaaaaacccccccccccctctttttggtgggggggggggggggagaaaaaaatatttttttttttcgccccccccgccacaaacaaaaaaggaaagccggggtgctctctaaaaaaataatttttttttattttcgggcgaaccgcgggttcgggaagctt

SEQ ID NO: 16611 - DNA, 1018 bp, Xenorhabdus bovienii
  unsure (1)..(1018): unsure at all n locations
atagcttttnacgnnaatntncgnagncctncggcttatcncccggnnngnnatcccctnnctnannagntncagntnnanctnncttnngncgncnatnncatngnacnattgnntttncgncccccaanaaacattncgggttttttgcccaattaaaaaccacggcaaaggtgggttttcccaacccgccaattgagaaccccccccaaaataaggccccttcttttggggggaaaaaagggtgtttttttctttaaaaccccaaaaggtggggccccccccttataaaaagcccccaaaaaaggggggtgcgagtaattttttttcccccatatttttaaaaaaagggcggggggggatatattttttgtaaaaaaaaaaaaaattttttggggggggttaattattatttttgttgggggggggggggggggggggaaaaaaaaaaatatttttctctttttaaaaaccgggggggggggttggggggggtgttgttttcaaaaaaaaaaaaaaataaaagcccccccccgcccaaaaaaaaaaaaaaatttttttttttgggggaggccctttttttttttttttgttggcggggggggcgccccgccgccgcccccccccccccccgtttttttttataagaaccccccccccccccccccagagaaggaggagggcggttccctcccccccccccccccaacaaaaaaaaaaaaaggagggggggggggcngagnaaaaaatatatttttttttttttttttctctaacacccccccccccctccactttgtttttgggtnnnnnaaaaaaaaaaaaaaaaaaaaaaaaaaaaaaaacgccccgctccccccccctcccccccncccccccnnnnnatttttttnttttttttttttctttctcttctcctccccgcccaaaaaaagaaaaaaaaaaaaaaaaaaaaaaaaaaanaaaannntnttttttttttttttcnccccctccccccgcttcaaaggttttgtta

SEQ ID NO: 16612 - DNA, 892 bp, Xenorhabdus bovienii
  unsure (1)..(892): unsure at all n locations
tatacnnnnnnnnnnnnnnnnnnnnnnnnnnncagttcaattttgtagatacaaggggatggttcactatacatatgggggtgtagttgtgctaacgtggccggcggagaagtgcttgagccctgtagtagcgtagctggcggtgcggccctgggtcctgctgacgtttctttgccttcgtagagagttgagaacaatcgacgtcatggacgcatgcagggaaccatcattacctgttgccggagtaatctagatgtgacaccggtcttgttccttcgtagcctgagacgactagctagaggtagggtaatgatgtatcccctatagcgtagtcggtccgaggccgaggtcgggtgaggcggcgacttctcctgaggccgaggctgaggtcgggcgaggcgggggccttctcccgaggccgagactaaggccgaggcctggagtcgggcgaggcggagaccttctcccgaggccgagactgaggccgaggcctggagttgggcgaggcggagaccttctcccgaggttggggctgaggccgaggcctagggtcgggcgaggcggagttccctgttgcgcccgaggctgaactcgggagaggtcatgacttactgttgttagtcttaccctggtggctggcaccgtagtccgaacggggtgaataatgctgttttcctgccaaaacgatcagcaaagggccgaagcgactgcagtcatttccaccttgccgaactgagggcgcgtgttaggataacgtgtcacgagatcccgctttaaacaacacagcgccaccgcacgctcacacagcctttctacacccccccatcaaccacatactgcccaaccctcacatccccccccccgcgggcgcccgccctgcgaaacagccaca

SEQ ID NO: 16613 - DNA, 745 bp, Xenorhabdus bovienii
  unsure (1)..(745): unsure at all n locations
nttgcttttttacggantatncgnagncttncggtnacttccgggngnnttnnccttctnngnnggntnccatngnananacttnntnaacccatttnccggggccattacccccgggcttgtttccaactaaatccgtccaggatggcgttcggccaaggggnaaaaccagtccggggggtttggttctttgacccaaagaaaggtactttgggactccctgggcagggggccttggccatttttttttcccccccccaaaaaaattttttcccattccccccccccgggggggccccccgggtatatttcccccaagttttcttttttttttttggggggggggggcgttttttttttaaaacggggggagtttttttttttttggggagatctccccccccccggaggggggtggttttttttttatccaccccggggggggggggggggcccccaacgaggggcccccccccccccgccgctttttttttttatatataaaaaaaaaaagcgggcgcccacaaaaaaaaaaatcccttcttctctcaaagagggggggggggggggcccccccccccccccccctcttcttttttttttaaaaaaaacccccccccacccccccgggggggagaggagggcgactctctttttttttttttttttgttgttgggggnaaaaaaaaagaaaaaaacaaaaaaacaccttatcttttttttatttttgaagtagagaagagga

SEQ ID NO: 16614 - DNA, 1021 bp, Xenorhabdus bovienii
  unsure (1)..(1021): unsure at all n locations
nnnnnnnnnnnnnnnnnnnnnnnnnnccttggnnnnnncnngggggggnncgcnggggggnnnnnnnnggttttttnnnngtttcttggnataacaacccggtacccgnngnacctctagngtcctatttatttttncggaaacttctttgtcataannatcaaatgnagccctagcagnnggntaaaagcccgnnggngccgttccacttncaangccccaagcnangaaanagggcccgcttgnnngaatttaatgccaccttgnaaattttgggnggtcaaaggacactgggccccttttgcaaattattggcgggaacacacaaaaataaaaaaaaaaaaattttgcccctcggagattttttcttctttgggaacagggggggtgttaaaaaaaacacgaaaaccaaaaaaagagggtgtttttaaacacccccaagagtttttcccccccaaaaaatattattttttgtgggggggggcgccccgagaaaaatatttttttaataaaggcgggcggcgcgccttttttttttttgtttcccctccctcccccccccccttttttttttttttgggggggagaaaaaaaaaaaaaaagagagagagggggggccggccccccccctcttttttttttttgggggggggggagaaaaaaaaaaataaaatattttatttttttttggtgggaaaaaaacaaaaaaacaaaaaaagaagaggggggggggggggnnaaaaaaaaaaaaaaaaaatatattataatataatgtaggggggggggggggggggggggggggagaaagaacaaaaaaacacaaaaaaaaaaaannnggggagggggtgtgttttttttttttttttttttggggaagaaaaaaaaaaaaaagaaaaaaaaaaaaaaaaaaaaaaaagaggggggggggggtgggtgggttggtggggcgacgaaaaaaaaaaaaccacccccaccacccaagaaggagagaggggggggggggggggagagagcacttaaa

SEQ ID NO: 16615 - DNA, 626 bp, Xenorhabdus bovienii
  unsure (1)..(626): unsure at all n locations
tgtttcgaattcgagctcggacccgggatccttaagtcactgcccagcacacttaatcgcaaatatatatctgagggcggagtattgctcctacttgccgggatcactgaaaaacggcaatgccccgcgggggtaagccctccggggggtttttttttggaaaataagggggcaaaaaccctcctcggggggggctggggaaaaaatcccccaaacaggggggccccccccccaaaaaaaccccccccctaaaaattttggggggggggggaccccccccccccacaaaaaaagtttatttggggggagaaaaaaaaaaaaaacatttttttttttttttttttgaagggtcccaccccccccccccctttttttttggggggggggcggcacaacaaaaaccccccccccgggggggtttttttttttnaaaagaaaaaaataaaaaaaaaaaaaggggggggggggggggtgnaattntntnaaaaaaaaaaacccnccccccctcccccgcggggaaaaaagaaaaaaaaaggagnaaaagagnngngnnnnnnttttnnnnntttttttttttttgtttttttttttnngnagtggngagcgcgcacatagtaaaacaaaaa

SEQ ID NO: 16616 - DNA, 941 bp, Xenorhabdus bovienii
  unsure (1)..(941): unsure at all n locations
natgttttacganattncgagcctncgctatccgggggatcctnctagngtcccccatgaggttctattccattggtgaaaaacccatcgtttgccttccggttggggaaaaaatcccttttttccgggaggggagattccccacggggttttctttttttggggagaggccccccctttttttttaaaaaaaaaaaaggggcgcccccccttcctctttcccgggggggggggcgcaacacaccccccgccgggggggggtattttttaccccctccttagtaaacaggaagttttttttttttttcccccccccccctctcttttttttttttttgggggggggtgttaaaaaaaaaaattttttccccccccccccctcctttttttgggtgggggtgggcgtaaaaaaaaaaaaaaaaagaaggagaagaagaaatatataacctcctttttttgtttgggcccccaacgaaaaaataaaatataaaataaaatggggtggggggggggggggggggtgttttttttttttttttttgaggggggggtgttttttttttttattttatttccacccccccccccccccccctctaaaattttttattgggggggggggggggggggnctttttccccccccccccccccccccttttatttataaaaaaaaaggggggaggggggggggggggggtccttcccgccccgcggcggggggagagaagcgaaaaaaataaaaaaaatttttttattttgttttactaaattttctccccctctcttgggttggcgggccgcaaaaaaaaatattcttttttttttttttttcttgtgggggggggggaagagaaaaaaaaanaaaatacccccccccccccccccccccnnccnnnnnncgggnnngnnntntttttttttttttttgatgaaaaaaaa

SEQ ID NO: 16617 - DNA, 565 bp, Xenorhabdus bovienii
  unsure (1)..(565): unsure at all n locations
gcttgcttgatgcctgcggtcgttgagataaagatagtcgacgttggaatgctgaagtgatcagagctagacagcatttttgaacatggttgcatcactttttacaaggactacgggaggttaacaaccctttgggtttccaatccgcccctcccaaatccctttttgggacaccttggggggaaaacggggggggaaaaaaaaaaaaccccggggggttaaaacaaaaaacccgcccaagggaaaacggcccccccctttttaaaaaaaacggggggggaaagggggttttttttaaaaaaaaaagggggnnnnggggggaaaaaaaccccctttttaagagggagggggggttttccccccccccggggggggggggggaaaaaaaaaaaaaggggggggggggggggggggcccgccccccccccccccccctccggnggggtgttattttttgggggggggccgggggcccccncncctgggggnnnggggggggggggggcccccccccccacccccccccgggggggggggaaaaaaaaaaaaaaaaaagggggggggg

SEQ ID NO: 16618 - DNA, 1117 bp, Xenorhabdus bovienii
  unsure (1)..(1117): unsure at all n locations
nnnnnnnnnnnnnnnnnnnnnnnnnnnnnnnnnnnnnnccccnnnnnnnnnnnnnncccccttttcttcgggncgccccggagccctccgctcacggcactacagacgcagccgcggcaagcaccaagcgacccggctaaaccccccccaactgaggacgggaggacagacaaagccacaatctgctgtatctgacacgcgatccttccttatgatcaacaaataaaaagggcccttttttaaaactttgtggcctaaccctaccccaggtttcttaaactttttaaaccgaaaaaaaaataaaggtggagagggggaatttataaaggcgcgggaaaaaaataaaaaaaccccgggggaaaataaaaaaaaaaaaagcgcccccctttttttgtttccccccccccccccccccccctttttttttttaataaaaaaaaaattttgtttttttctcccccattttttgttaaaaaataggggggcgcaaacacaaaaagggggtttttttttcttctacacaaaggagggggtctttttttttaaagaggggggtttttttttaaaaantttnaagngggggaagaacgcgcccccccccccccgggggggggggggggggggccggcgcgccccccctcaaattttttattgggaaagaggggtggtttttaaaaaaaaaaaaaaaaaaaaaaaggggggggggggaaaaaaaaaaaaaaaaggggagggggcttgttttttttaaaaaaaaaaaaaaaaaaaaaggaaagggggttttttttttttttttttttttttttttccccccccaaaccccaaaaaaccacccaaataaaaaaaaaaatttggggggggggggggggggggggggggggggnnnnnnnaaaaataaaattncccnaaaaaaaaaaaaccccaccccccccccccctgnncnggggggggggggggggggggttttttttttttntnnnnnnnnnnnnnnnaaaaaaaaaaaaaaaaaaaaaaaccccnncccnccnnnnccnnnnnnnnnnnnnnnnnnnnnngnnggggggagggggggggngnncngnnnnnnnnntantcnnctataataataattaacaaaaaa

SEQ ID NO: 16619 - DNA, 907 bp, Xenorhabdus bovienii
  unsure (1)..(907): unsure at all n locations
gctggccggggcccttgagcggtgggtnnngntgggggggnnnnnnnnnnngntttnnannnctagcttaaccatancggactcgtnacccggggacctctangancgatgaccccacctnnaatgacgagagatacccccatnccctggatattccgggccatccccaggaaagaaaaacaaaggttttcccgaaccggtgtttttggagcaacataattgtgaatattgccctcttttttaacgagggggtttaaaaaggcccccttttttttctccaagggggggaaaaaaggggggggacgaacaacaaatatattgtggggagaaaaaaattttgttttgggttataaaaacaacacccccgcccccccccgcggggggggggaaggaaggaagggaaaaacaaaaannnnnnggggggagggggggggggtttgtttgtttacaaacaaaacacaaccacacctttttttgtttttttatataaataaaccccaacccctctcttttttgtggttggagagggaaaaaaccacccccccctccccccggcgggggggggggggggggggggggaggaaaaaaaaaaaaaaaaaaaagaggggggggggcggggcgggcgggggggaaaaaaaaaaaaaaaaaaagcgcccccggcgcgggggggggggggggggggggagaaaaaaaaaaaaaaaaaaaaataaaaaattaggagggggggggggggggggggggggggcccgcgcccccccccaaccaacataaaataaaaaaaaaaaaaaggggggggaaagggggggggggggggggggggggggnnnnnnnnnnnnnnnnnccnnnncncccccctctttcccntnttcttttttnnnnnnnnnnnaaattataaaaaaaggagaaa

SEQ ID NO: 16620 - DNA, 827 bp, Xenorhabdus bovienii
  unsure (1)..(827): unsure at all n locations
nnnnngggggnnnnnnnnnnnnnnnnnnnnnnnnnnnnnnncctttnnnnnnnggcnggngggggnnnncntngggnngggttgttagncctgggggaggggggcggaaagaannaaaaattattttttaaaaaaaatttaattttaaaggaattatgcggaacttccggttaaacccggggggggataacccttttttaaagaaaattccaaaaaaaaaaaacctttggtcgggggttttttttatttaaaaaaactttttgttgattttttgggggggtttttgaaaaaagggttttttaaaaaaaaaaaaaaaaaagggggggggcctcttggggggtgtgggggggcccccccacaaatttttttttgtgggggggagaaaaattttttttttttcttttccccggggaaaaaaaaaaaaaaaaaaaaagggcgccttttttttttgaaaaaaaaaaaaaaaaacccccctcccaaaaaaaaaaaaaaaaataataattttttttaggggccccccngggggaaaaaaaaaaaaaatttaaaaacccccccccccccccccccccccccaccaaaaaaaaaggaaaaaaaaaaaaaaaaacaaaacccccccccccccaaaaaaaaaaaaaaaaaagaaaagggggagggggggggggggggggtttttcccccccccccccctccccccccccccccggggggggggggggggggggggggggggggggggggtggggtttttttttttttttttttttttttttntttttnnnnnnnnnnncccccccnnnncnnnctttaattattctttcttcccctca

SEQ ID NO: 16621 - DNA, 671 bp, Xenorhabdus bovienii
  unsure (1)..(671): unsure at all n locations
accatcggatcagctcgaccggatctctgagccagcgctgagcagaacaaaaaaagctcgacggcatttggggngacggatctgcgacgggataacattccgggggctgaaggggccggaaactacaagttgcccaacggtttgggcctattttgggggggccctctttaaaaaaagggggggaaaaaactttttttggggagaggaagaaaaaacccctccgtggggggggggcgttttttttcaaaaaaaaaaagggggggggggcggcttttttttttttttccgaggggggggggggaaaannnngggggggggannnnngntttaaaaggggggggggccggggnnnnnggttttttttttgggtgtcccacccccccccccccccctccccnaaaaaattgggggggggggggggcgccaaaaaaaaaaaaaaaaaaaaaaaatttttctttcctctcttcttaaaaggaaaaaaaaaaaaaaaaaagggatttgtgggttttgttttgtgtgagaaaaaannnnnncnnnnnnnnnncncccnccccacccccccccnnnnnnnnnnnnnntnnnnnnnnnnnnnngnnnnnnnnnnnnnnnnnnnnanannnnnnnnnnnncnnnnnnnnnnnnnncccccncccnccaacaaaaaaaaaaaa

SEQ ID NO: 16622 - DNA, 785 bp, Xenorhabdus bovienii
  unsure (1)..(785): unsure at all n locations
gactggggatgatcgagtcgcgcaattagaaacatgcaacataatgatactgacgatgacacgtatgattgacactgttatcctaaatagaaacattttttctgggagatttgacagaaggttaaaaggtccggcccttttaatgaaaaaaaaaccccgggggaaattttttgggggggggttccctgggaaaagcttttttttttttttttttccccgggggggggggtttttttgggggggggggctctcccccccaaggcggggggtgggggggtggtaaaattttttttttcaaaaaacaaaaatatattttttttttttttttttttcccccggaggggggggggtttttttacgggcgggggggatggaaaaaaaaaaaaaaagtttttttttttttttttctcctctcccaggagagaaagggggagagggccccnccccccccctttttttttttttcttttttttttttttttttttttttaaaacacccccacaaaaaaaannntttttttgaatttgttgtgttatttttncccaccccccccccccccccccgccccacaaacaagagggggaggggggggcgctttcttttttttttggtttggggggggggggggggggccaaaacactcttctctctttttttttttttattacnnannnnaaaaaaaaaaaaaaaaaaaaaaaaaaaaaaanntngttttattnnnnnnnnncccgcgggggggcgagcccccccacnnnccgnnttattataataaaaccgggggggg

SEQ ID NO: 16623 - DNA, 640 bp, Xenorhabdus bovienii
tagtcgacgggactcaatccctcaaatctgctgtacagggggcacagggcaaattcgcaggtcttcttagccggttccaaatttccccggaaaaccctttttcccccccaccctttgggaatccccgggggggatttaacccccaccggggttttttaaaaatttccccccacccgggggtccccacgggggggggggaaaaaaaggtgggaaaaaaacccccctccttttttttttccccggggggggggggggggggggccccccctttttacacaaaaaaaaaaaaaggggggggggggggcctgggtttttttctccgggggggggaaaaaaaaaattctcggggggggggggggagagaaaaaattttttttttccctccccgggaaaaaaaaaaaaaggggggttttttttttttccccccccccccccggggggggggtgtttttataaaagggggggggggggggggttttttttaaaccaaaaaaaaaaaaaaaagggggggagagaaaaaaaaaaaaaatttttttttttaaaaaaaaaaaaaaaaaaaccccccccccaaaaaaaaaaaaattccgcccccccccccccccacacaaaaaaagaaggagaagtgttctttttttttttt

SEQ ID NO: 16624 - DNA, 1096 bp, Xenorhabdus bovienii
  unsure (1)..(1096): unsure at all n locations
nnnaaaagggggnnnnnnnnngnnnnnnnaaaacccttaannnagccncnncccnnaaaaccgcagagnccacaacacacggnaanacaaagactaaagaaagagaaacaccaacccaaagacaacacacccatacagagaaaagaggagagagagaccnctcactaccannccaagcacaacaaaaaacaannanattnaaagcagnncatnaatataaannncanncaaccccanagaaataattttttnacannttttttttcttttttttttttttttttaggaggagaggggnaaacgagaacaaaannnaaaannnngggggggggggngggttttcgctttactttacgtgnttggccaacnggggaaanaanngcgnaaaaaatctccccccccnggnttntttcccacccccccggggggngngggnnttaaaaacccccccccnntccttttgaaaaaaaggaaaaatnccccttttnaaccaaaaaattggggnaaacccaaattttaaaaaacccccngtttttttgggtatataaattttttggaaaaacccccccccccttttaaaaaaaaaacaacccnaaaaaaccccccngngttaaatatatttgtggnaaaaacaaaaaaaaataaaattttncccccccccctctcttntaaaaaaccaccanaaaaaacatttttttaaaaaaacccccccccccaaaaattattttaaaaaaaaccctcttttttgnaaaaaaaatattcccccccaaaaaaaacccccccccgnggngaaaaaataaaataaaatatattttaaaaaaacacccccccccccaataaaaacacacccccaaaaataatttcctcgggggcccccctccctcttgcgccccccccgnggtgttttaataataaaaaccccccaatttatataaaaacacccccccccccgggtaatttttttttttaaaaaaaaaaacccccccccccccccccccccccacaaaaaaaaaaaaataataaaatgggggaaaaaaaaaacacacaacaactttttttttttccccccaccaccaaataataatctccccccccc

SEQ ID NO: 16625 - DNA, 1020 bp, Xenorhabdus bovienii
  unsure (1)..(1020): unsure at all n locations
nnnaaaaaggggggnnnncgcccattcccttnnnnnccaccctttcgtccctacggaccccgcgacccccgggaaccctcccaaagtccagcggctggccctgacggtgctccgcgcgtccgcctccccgcgcgcgggcacagcccaccacacccccggcaggagggcccacaccactatcccacccatctncctccacccactctccaacccgcccccccccacctcagaaacttctaccccacnnnncnaccatacccgnnngnatcctnnccgcgnntnntccnccnccgngngngnnnntatccncctnncctnnagaaangatnncccgtntnnnnatannnangnccctnnccnanaagaannggatnnatnccnatggncccnccgncctnncccctngnnccnaccttnnaccnaagngnttntttttttgggggccccatataaatccgcgggnnaaacccccccggcccacccnaaggtttccccacccatatcccagtgttcaaccctcccggnaaaaaaaccccgggccccgcccgggccctggggcccgcctcttaattttttcccccggggctttccccggccccgggggggggtaaaaaaaaaaccccctttgggggaaagagaaaaaaaaatcttttaaaaaacccccccagccccccccccccaaaattttatataccccccgggggaaaaaaaaaaaccccctaaaggtggggccccccccttttttgggccccccccaaaccccccccttttgggaaaaaaccccccccccggggaacaccaccaaaaaagggggggaaaaaaaaattttttccccccccccccctcctttgtcccccccccccccaaaaaaaaaaaaaangaaaataaaaataaanaacacaggggggggcggacggcaaaaaaaacacaaaacccctcctcatattaaacccccaccgccccgccccgcacccaccccccctttaattataacaccccccccccccccccggcgggggg

SEQ ID NO: 16626 - DNA, 773 bp, Xenorhabdus bovienii
  unsure (1)..(773): unsure at all n locations
nnnnnnnnnnnnnnnnnnnnnnnnnnnnnnnnnnnngagtggtttaagagacggtggattatttttgtgccgagtccgttctgtaaccttgcgnggtatacanattcagnnttgngnaatnttaanaggtnggcccncaaaggcnnccccgcgggggnnnanaaaaannaaaaaaagggggggaattttttttttttnaaaaaagaaaaaaaaananaaaaagaaaaaaaattttttgngntgngngnnnggggggngnnggggnnnnggaagaagaaaaaatnaaaaaaaaaataaanatnntaaaaaaaaagagacaaaagnnnnaaaaaaaaaaagaaaaaagaaggggggnnggngnngggnnnncnnnncncccccnctctcncttttcttttttttntgttgtgggggggnnggggggggnnnnnnnnnnnnnccccccccccctcttttttttttttttttttttttgtgggggnnggggggggggnnnnnnngnngaagaaagaaaaaaaaaaaagnannnntnnntttttttttttttcttnntttcttnattcttnctttttcnnnnnnnnnntcttatgnnnnnnctatttnaaattnattnnnaatattataatttatgnnnnnnnnatattatggnatgnnatattnatatncttattatgncttttnncttttgttnnctnnnctcttttttgnnntgnnnngttctgntttttgtnngngnnntntttgnttgntnnnnnnnnntttttnatgtttgt

SEQ ID NO: 16627 - DNA, 1102 bp, Xenorhabdus bovienii
  unsure (1)..(1102): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaaaaaaaaaggtgttgtttattttttttctttataaaaaagaaaaaaaaaaaaaaaaaaaaaagagagagaggggttcctcctttattttcttaactggtgggcaaaaggggnnnggggganaaaaanaaaaannnnnnggggctattggaggggaaaaaaaaatctccacccccccgcgcgggggtttttttttncccctcccnccttttagcagagggggggagggagggggggggaaaaaatttttttaataacaccccccccccctctttaantttctttcttttnnnggggggaaaaaaaggggggggaaaataacncccctttaaaaaantttataaattnnnnntttntnttttttttttttnnnnnnnaaaaaaaaaaaaaaaaaacaacccgcggggggaggggggggggggnnggggtttttttttttttttttttttccccccccccaaaaagaagaggggaggagaacccccccccccgggggagggagtttttttttttttttnncaccggcgggggggttttaaaaaccccccccccccttttttttttttttttnnnnnttttttttnnnccccccccccaaaaaaaaaaaaaaacacccacccctcctcttttttttttgggggggggggggggggnncccccccccccttttttttttttttttaaagaagaagaaagnnnnnnnaaaaaaagagaaggaga

SEQ ID NO: 16628 - DNA, 1191 bp, Xenorhabdus bovienii
  unsure (1)..(1191): unsure at all n locations
gggggnaagagncgactcggattnngggggcaggaggggggatggtccaagccgggggatggggaggganaggtagggngnngaataanacaagggggagggttcttagggaaannngggggnccnngcnnggggttgtttttttttaaagggnnnnngggggggggagccaattcanaacctgttnnngnggngnggggaannnaggggccttaccgngtgcttttggtggggggggggggnnnnnnnnggggggnnnnaagggaagagaggggcggcgcgggcttttttttttttattttttttgggggggggaaaaaaaaaaaaacttgttgttttggggggggccacaattttttttttaattaaaaaaaaggggggaccgcttgttttgtagtggggggggggaggggaggggggggggtttttttttttttttttggggggggggggggggggggggggggggggggggggggcagnaaatttttttcttttttggcgggggccgggccgagccctaacaataattaaaaaaaaaaaaaanaaaaaaaaanntccnnnggnnngggggggggggggggggggggggggggggggggggggttgttnntnnnnnnntnnnnncnccccccccccccccnncaaaannaaaataaaatataaaaaggggnnnnnnnnnnnngngggnnngggnnggggnnngnggggngnnggggggnnnnnccgggccnnccctcttttcgtttttttttangggggggggggggggggggggggggggggggggnnngggggnnngnnnnnnnnnnnnggnnnnagnnanaaannnaaaaannangaggcccggccaggngggccaggcccggggggcgaggggggagnnnggngggnnngnnnnanagggggntagggggtgtaggggggttgttnntnngggtnntnnnngggaggggngggtggnnnngggggggggnnnangggaggggnnnnnnnnnnnnnnnnnnnnnnnnntnnnnnnnnnnnnnnnnnnnnccnccccccttcccgcccccctnntnnntnannnggnnntanaaaaaatnatattntatnaatattatttnntatntttttttttnnnnntnccnnnnntnnnnnccnnnanccnnnnnnnnnnncnnccnngggccgggccggggccgggccccg

SEQ ID NO: 16629 - DNA, 1191 bp, Xenorhabdus bovienii
  unsure (1)..(1191): unsure at all n locations
taaaaaagggggnggngggggnggggggccgggnggggccccgcggnnnnnnnngccngggggggggnnnngnntggaganaggaaaaaaaaaaagaccctaaaaaaaagagctaggcnnaanaaagacccggttccccggggnaacccncaaggaccggaaaaancaaagaaggaaaaacctccncacnaaaggcccccaaggggaaccccccggaaaaaacccccccaggggaacaaaaaaaaagggaaaaccccaaagggccgnncccaaaaaaaaccaccccggggggggagaaggagccccaaaaaaacccccgcggggggggaaaaaccccccccaaaaaaaaaaaaaacgcccccccacaaaaaaagccccccccccggagaaaaaaaggggnnccccacaccaaaaacaaaacaccccccnccccccaaaaaaaaaaaaagaagaaagagggggngggnnggggccaaaaacaaaaaaaaaaggnccccccccccgcgcggggggggggggggagaaactaaaaaaaaaacaaaaaanaaaaaaaacgcggcgccccccaaaaaagaagagagaggggcggccgcccccccccccaaaaaaaaaaaaaaaaaaaaacacccccccccccccccnnnnnnnngaacnggaaaaaaaaaaaaaaaaaggaggggcccccccccccccccggggggcgacccccccccaaaaaaaaaaaaagaggggggggggggggcgggccacaaacgcggggggggcccccccccccccccccccccgggccgccaaaggcaaaaaaaaaaacaaaaaaaacagggggggggggggggggggggnnnnnccccccnngnncccggcgcgggcgcggcacagccacgccccccgcggcnggngnnnnnnnnnnncnnnncaaaaaaaaaaaaaaanggcgcgggcccgccccccaccccgcgcccgnnnncccgaagncgccngccgggngggggaagcgcgggccggcagcaccannnaaanggnngnggnnncnaaacacaaacaagaacaaaaacacaaacacnancnccaacaacccccccaaacaaacggccccgaacggcanggcggaccggggcgcnnngcgccgccccgggcccagggnnggncggcngggcgcacccacccacccgaggaacaaaacaaaaaaac

SEQ ID NO: 16630 - DNA, 1011 bp, Xenorhabdus bovienii
  unsure (1)..(1011): unsure at all n locations
caagccttggcatggncctgncaaggntcactgncatgtcntaatgaccaggatnagtatatattactatagtacgtggacactatgcggcacagttatttntgtncncatgatntcgtgatacacatgcctggactcgactgttaatttacatgggtgctacanagatttcgttgctatgcgacacagcaaatccgacctagtnatcgccggcagcacgcataatgatccacttggcacgnatanagagttactggntgataaaagtacactgatcaaattggtngtagataaatttaatgtggcagcagcgccatttcagggaaaataattcccattcatgcccccaggggatggggggattccaaagggaaaagaccccattcggattgcctttttccccattagtcccagggggggttttcgggctttgccgggtttttcaaaaagcctagccctgggaataaaattttttaaaacccttttccccaaaaacacaaaaggaaatttttttttcccgtggggggagaaaatttcaattttttttaaccccccggggggggaacccccccccccttacaaaaattttaaaaaacccttttttgttgcccccccacggggggggttaccaaaattttcttggttttgtttttttttttcaggggggaaaaaaaaaaattaatacacggggggggtttttttgttgtgtcaaaaggggtgtgtttttttttttttcttaaaacccaaaaaaggggccctctcctctctttatatttggggggaaaaaaccccccccggggtgttttttttttttttttttttttttccccccccccccggccccgcccaaaaaaaaaaaaagggaccctttttttttttggggnngncccccccccccccaaaaaaaaaaaaaaaaaaaaccccccccccccccccccccaacccctttttttttttttatcacgggggggggggggggggggaaaacccccccccctccccccccccccg

SEQ ID NO: 16631 - DNA, 1148 bp, Xenorhabdus bovienii
  unsure (1)..(1148): unsure at all n locations
attcattcttccggaatattcgngnctctcggttaccccgggggnattccctcttagaggtacgttncgtcaattaaaaataccaatagnataaagtaaaaaacgaaccaaaatggtttcctttatatgtggttaaataaaaaaaagatagaaattatctttcattttttgggtaaatatnaaaccctaaactttaaataaatccaaggnatttccggaaaactcaaattttgtatttggggggggcttttttttgccccgattaagaagaaaaagaaacccctttaaataaaagaaaaaaaaaggcggcgggggagaaaataattttttctcttctatatataagggggggaaaataatattggggccctctctttggagagacacctatataaaaaaatatattataatctggggggggggggctccttttttataacccccagaaaaaataaatatttggggggaaaaaataaaatttttgtctcctcggggggggggggcccctctttctttttttgttggggtnnnnggttggggggggggggggggggggaaaaaaaaaacgcggaaaaaaaaaaaaacccccccctctttttttttccccccccccccccacccccngggggggggggggggggggggggggggnnaaaaaaaaaaaaaaaaaaaccaacaccccgcggcgcggtgttcttttttttataaaaaaaaaaaaaaaaaaaaaaaaaaaatattttttttttttttgggggggggggggggggggggggggggggggaaaaaaacaaaaaaaaaaaaaaaaaaaaaaattatttttttttcttttttttttcgcggggggcggcggggggaaaagaaagaaaaaaaaaaaaaaaaaaaaaatattccccccccctccctctcttcctcccccccccccccggggcgcgggggggggggggggggggggagaggaggcccccccccccccccccccccccccccaacaaacccnaataaataaaaaaaaaataaataaaaaaaaaaaccccccctntnttcttctcttctctttgtgtgtgggggggggggggggggggggggggggncccccacacacaccaacacnacnnnnnnnnntntgttggggggggtggagggggttt

SEQ ID NO: 16632 - DNA, 972 bp, Xenorhabdus bovienii
  unsure (1)..(972): unsure at all n locations
ggcagcttgctgcctgcaggtcattcctacacctngaataacgccgcaatatcctttccgagtatggcgaaccttatgatcgccttatacgtgaaaaagaacgccagcacattacctctatttccagaacgtcagcatggaaactggaaaatgaaggccgtttccctgcccgtaagccattaggtcgcaattcctgtgcttggttgctcagtgatttgctgcattgggtacgtaatccgccaacagtagaaaacgtaaataacccgtattagcttcaaggccttcgatgtagccggaaatgtttacgtgaaagaggcgggcattgatgccaaggcaatcagagcaagccatgacgatcacatccgccagatagtccgtgaagagatacgccagttcgtcaatcgtgagagcagaggcaatggtttattctcaaggcggtgacgctatgtctcaaccccgtatctatggtagcaaatggaacaaggcacggctggccttcctacaacaacatcccttatgtgtcatgtgtcaccagcaagggagagtgaccggcgcgaccgttgttgaccacatcatcccgcataagctgaaaggggcactggattccggtaacaagccggagatagccaaagcacagaagctattctgggataccaagaactggcagcccttatgtgacagtcaccataactccactaagcaacggatggagaagcgcggtaaggtggtcggttgcgatattaacgcctgccattagatccccattcccactgnnantnataagatgaccgaaagacgacaaaccttactgatgntcaaaggctttgatggctctctgaacgagcagcaacagaggcacgtcgataactggcctgacacgatacgccaactgaatgatgactacccagaangtgaggcactggattgcatttggttatatcggggcagaacagcaatgaaagcaactgggga

SEQ ID NO: 16633 - DNA, 770 bp, Xenorhabdus bovienii
  unsure (1)..(770): unsure at all n locations
caactttgttggnggaagcccccngcctccgnccgnggngaacngcgccgcccagcaattccgcggaagggcccgaccgccagggcgccgccagcgggggacaagcagggaggccgcgccccacaggaccaaacggagtttcttggctactggccaccgcgcgggtgccacgcagcactggtgcgcctttatatgacctttgctgcagcgggtatcttacgcaggacatgatgacaggaggtgttgcaccgggatggatacctgggctacatttcatttttgcagaaccacaagcgcttttttatttggggggggggggaccggagaacacaccccggggnatttctaaaaaagaccccccgcttatttggggaccgggggctccttgggttatttagggaaagaatatttaacttttttgccggggttaaggccccaaaaaaaaaacccaacggccccaatatccccttattggaaacccttttttccccaaccggttttttaaagggggttaaaaaggcccccaattattttaaaaaagagtttccccttctccgggggtttccccttgggggatataaaaaaaacccccccctttttttttttttttccccccccttggggggccccttttttttcctctcttttttttttttaaaaaaaagaacccccccccaagagggggggccccccccccccaaaaaacccccccccaccccccttatatttcccccaaaaaggggccccccttatttttcccccccaaaaac

SEQ ID NO: 16634 - DNA, 773 bp, Xenorhabdus bovienii
  unsure (1)..(773): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnttttnnnnnnnnttttgnatntgnnnntccccccccccccccngnnnnnnnnncccccccccctccntttccccattttccccggcccttccgggtaccccccgggggggggttccctcctttggctcctcccaattgnnaccctaattgccacctccctcttagtcttttttgctnttatcaggtttgtttttgggggnggtccggggccctttattccgggtttttgttccattttgggggttagacccttgcccagaaggcccggtgttcctttcccccttttccctccccccccttccccttttccccctttcccctttttttaagggccttttttttttcccctccccctttttccggtttttttccccccccggcggttttttttttttttcaaattttccccggttttccccccccccgatttttttttgggggggggggcccctttcccccccctttttttttcccccctttttttcccccccccccgttttttttttttttcccccccccccccctttttttttttttttttgggggggggttttttctccccccccccccccgngnccccccaaccccgttcttcttcttttcctcccggg

SEQ ID NO: 16635 - DNA, 901 bp, Xenorhabdus bovienii
  unsure (1)..(901): unsure at all n locations
nnnnnnnnnnnnnnnnnnnnnnnnnnnnnnnnnnnnnnnnaagaaggcccctaggaataagttttttgggggccccacccccccccaaggaaaaaccaaggtgtttttatttttttgtggcgaaaaaggggggtttttgggaaaaaccccggcggttttttttaaaagggggggggcccccccaaaaaaacacacccccggggggattttttttttaatataaaagagggggggggggcggccccncttttttttttttttnnnttttcttaaaaaaaacagcccccccccaaagcggcggnnnnnaaggggttttttttaaaaaggcggtttaaaaaaaaaaagagggggggggagaaaaaaaaaaacccccgaggggggagaacaaaaatttttggggggggggggggtttttttctccaaaaaaaaaaaaacaggggagaaatattttttaaataaanccgccccccctctggggggggggggggggggggggggggggntntttttnttttttttttttttttncttttttaacaacccccccccgaatggggggggggcgctttttnaaaaaaaaaaacaacacccccccccccngcgggggggnggcgcgccgncgccnttttttttttatataaaaaaaaaaaaaaaaccaacaatttttttttttatttttgggngggggggggnnnnagagnnnacaaaaaacaacacccccacctccncccaactcctaataaaaaaaagnaaccccgagagaaagcgcgcccccccgccctnnccagctcnatttttttttataatatnnatttagnnnnnnannttnnnaannncnaattcaacgaccggcgacgnnnnnngccgcnngnnncgcggccgcgcccgccccactncacaa

SEQ ID NO: 16636 - DNA, 1019 bp, Xenorhabdus bovienii
  unsure (1)..(1019): unsure at all n locations
cgcgcggtgcgccccgcccgagggcccggccccgggttcagtctatcnngnnnnggtagacttaggcgggatatacgaagaacccggntnttttccnnncnccggggnnggnnnnnnnnggnnnnnnggggggggnnnnnnnnnnnnnnnnntnntttntnnanaaaaaannannnnncccnnnnnnnccccccttttttnnnnnnnnnnnttttttttttttttnnnnnnnnggggggggggggggaaaaaaaaaaaaaaaggggggggggggggggaaaaaataattattncnnnnnnnnnccgcggggggggggggcnnnnnnnnnnnnnncnnnaaaaattttttttgggggggggggggggnnnnnnnnnaaaaattaacctggttnttnccccttattnaacataaggnaaanctcggnctncccaaaaaaaataaccccatagggcccttggggaaaaaaaaaagatcccaggaaaaacaatggattggccgattaccatcctttcggcaccttggcccatcggcnattttaacgtaaccgngnaattggccgaaactggtttcctggatggccattccgtcaagtatactggagccccaaaggggcaggccctttgttattttaagcccggagtcacgggccaaatgggttggaggaggttttccccgcgcctctttttaaggggggaaaaaattttttaaattatcaccacaccgcggnggaaccccctttggggttgggagaaatatttcttgggcaaatttttaaaagggggggggagggcaaaaaagagggggggggggccctccccggtttttttttttttattccccaggggggggggggggaannaaataaaagaggggttttttttagagggggggccncccccccgggtgctttttatattaagggggggggggggtctctctctattaaatnaaaaagaggtgtggttaaaatggggggggggagaattttttttttttttaaaaaaaagaaagagggggt

SEQ ID NO: 16637 - DNA, 1224 bp, Xenorhabdus bovienii
  unsure (1)..(1224): unsure at all n locations
nnnnnggggggggggggnnnnnaanaaaaaannnaaaannnannnnnannnnnnnnnnnggcggnncncaacccccgagggnnggnnngggggggggcccacccgcaacaagggngggnngngngnnggggaacccccccnnnggnnnggnngnnnnnnnnnnnnnnngggnnnngnnngnnnnnnngnnngnnggngggnnggnnnngnnnnnnnggnnnnnnnnngnnnnnngggnngnnnggnngggcccgggccccngccgccggccgnggnncggcgcccgccccccccccccccgnncgcggncgcgcngccggcngnnccgnccccccccnncccccggcgggncggcggnccccnnccccccgcccccccccccngggggncncnnncggggcgcgnncgnccnnccgggccccnnccgcnnnnnnnnnnnnnnngggggcccccaaagaacctttggggccaaggggcccccctgggcccgaggggntttccggggnggnntggcccgtggnaatccgnntttacgtgnacaaagacaagggacaccgaangccgnnnnnnnnnntntttggtttntcaaatntaaaattggtcaggccccgnntaanttctcgggttggnccgnaaatttttttgggtggccccctaccttttntggggnttaattttgtnggggntttggnggnaaaaaaatttttttttccttggcccccaaggcccttccacccgggnttttttttgggcccccgcggggttttaaaatttttttcccccccctttccccttccccaaagaggggggggttaaaagaggccccaagggaaaacccccccctttttctttgggggaaaaatggggaaggggaaaaacccccaaaaaccccccctcgtgggggnnnggggaaacacccccccgaaaagaagggggggggggccccacaaaaaaaaaaaacaccccccgggggcccctcccccgggttgttgggggagaaaggggaggaggagagtttttttttttttnntttccctcccccccccggggtgttgtggggggggaaaaccccccctgtgggggggccccctttttcccccccgcggggccccggggggggnngggagggttcccccccccccccccccccccccgcgggggggcggggggganaattttttttttttcccccccccccccccacacaaaaaataaaaccccccc

SEQ ID NO: 16638 - DNA, 759 bp, Xenorhabdus bovienii
  unsure (1)..(759): unsure at all n locations
ngactgcgtgatgcctcaggttccgatagccgagctccaagccgctgagcctactgactncgcagtactatgtctaccgatggactgctctgctatactgagacctccgacggctgagcttggggatgcaaaacggttttaaatttaaaggggccaaccccttttttgtgggggggatatttatccccaaccccgtgggggggttttccccccccgggaaaaaaattttttttagaaacttttggtggtgaccaaaaaaaactctctcccggggggggtttttttttcccctcccccccggggggcccccccgggggggaaaaaaaaccgccggggggggaaaaataaaaaaaaaaaaaaaaaaaaattttttttggggggggtttttttttttttattttttttttttccccccccacaaaaaaaaaaaaaaaattttttttttgttgggcaaacacattttctctttggaaggaggggccccccccccccccacctcttttttttttttttggtgaaaaaaaaaaaccaaccccccccccccccttttttttttttttntttttttgtttgggggggaacccccccgccgtggtttttgttttttttctcccccccccctcttatttttcctaaaaaaaaaaaaaaaaaaaaaaaacaccccccccccccccctccccctcttttttttttttttttttttttgtttcgcccccccccccccccccccccccccgaggaaagaagagaaagaaaaaa

SEQ ID NO: 16639 - DNA, 833 bp, Xenorhabdus bovienii
  unsure (1)..(833): unsure at all n locations
aatactggtgcaagactcgcagttctgaatggagcgccgaattttctggcgcagcatgagtatggcatttggaaaccactggaaaaaagttcctccaaaagggggcgggaaaaggccttttgggggtatttaaaaaattttgggcgaagatggggggaaacactgggggcgcttttttggcaaaaaaaaaaagggggggagaaaaggggagaacccccgggcggcgggttttttttttatcccaaaaaaaagggggggcccccccccccccccccacaaataaataataaaaccgcgcgcgggaggagagagagaaaaaaaaaaatacacaacaaaaaatataaatttatggtggggcgcgttttttttttttttggggggcgcgcgtttttttttttttttttagaaaaaaaagaggggggggggggaccccccatccccttctcgttggggnngtgtnggggggttttttaatcgtggccaaataaaanaaaataccacacccccgcgcggcgngggngnncncttctnnctttttttttcttttgggggggggggggagggggggaaagaaaaaaaaaataattatcttcttctcccctcccccnnnnnntctttttttttttgggagggtgggggagaagaaaagaagaaannaagncnaaanaaccacccccccccaccnaccnatnaataattattggggggggggtgnnggngcgcnacccccccccgaaaaaaaaaaaaaaaaaaaaaaaggggacgcgcccccgcncgncccggcgaggagaanaagaanattatttattttttttaataaaccaccccaccgc

SEQ ID NO: 16640 - DNA, 897 bp, Xenorhabdus bovienii
  unsure (1)..(897): unsure at all n locations
gccccaaggggnnngnaaaattnngggaataatgggaggccgcanaaanngggnnnngggcgngtngnngggngggggngggggnngnggggnngggggggggggnnnnnnnngggnngnngggggggggnnnnnnnccnnnngaagaggnnaagaaaaaaaaagananaaannaattcctttttttcccaccccccccgcttaatattaccggggncccgaaacaaccaaccccaatttttccccncccctaaaccggntatgtaacccctggcctanaaaaaaaaatccccttccaaannaccaaaccccgncgtttccaacccaaaanaaaaaaaaacccccgttnccccttttttttnccctnncccaaaacctccctgggggggttaaaacccaaaaaataaatttgnggaaaaagggggggcccccaaaagnaaaaaaaaaaaaaagaaaaaccccccttttttttttaaaaaaaagnnggataaaaaaataaaagngggggtttttataaaaaaccccccccccgaaaaaaganaaaaaaaaaaaagggnaaaaaaagggggcccccccccccccccccaaaaaaaaaaatattntccccccctccgggnggttttttttttgagaaaaaacccaccccctttggcccccccccccaaaacccacccccacagggggaaagacctcccccctcttttaaaanaaaanaaaaaaaaatatcccccccccccccccccccggggggcccccccccccctccccctgtgngaaaaaaaaaaaaagaggggaaaaaataataaaaataatttcccccccccccccccacaaacaaaatataatgcgcccccccccttttttggcccccccccccccttntnttttgnaaaaaaa

SEQ ID NO: 16641 - DNA, 1005 bp, Xenorhabdus bovienii
  unsure (1)..(1005): unsure at all n locations
gcatgcttgcatgcctgcaggtcgtacattgagctgagaaatggatgggctgaattcgattttngataacgatnctnnctngggggnnnccccnnnnnaannaaaannttaatnnnnnnnnnncnnnccccccccccccccccgggggnnccccccccccccgcggcggccgngnnnnnnnnggggggggggaaaaaaaaacccccccccccggcggggggggggnnnnnnnaaaaaaaaaaaaaaattttttttttttggggggggggggggggnnnnnnnnnnaaaaaatataaaaaataatgggnccggnncccncggncnccctctttttnccaaattnatatatccggntgttnnccncnccccaaaactctgggggttnncnccaaaaaataaatttcccaaaggggggtttttttaaaaaagagagggcccttaaattttttncccccttttttaaaatttttnaaaaaaacacctctggggggccaaacnccgcgggagaggggaatatatttttaaccccaagggggggcccccgcccccgggggggaaaaaaaaattatcacgcgttgttttttttttccccccccccccccggggggtgttctccccccgcggttttaaaaaaaaacacccaaaatttttccccccgccgcggggtttgtttttaaaaaaaaagaccccccccaccaaaaaattttttgggnaaaaattttttttgtgaaaaaaagagggggcccacaaaaaaaaacccccccccctttttttttnnnaaaaaataatttttccacaagggggggggggttgtgggttttttcttttccaaaaaaaaaagaagaggcggcggcgttgttatttaattttttgggggggggggggtgttttttttntttttttatgtttgaaaaaaatagagagggggggggaagaaaacaaagcgggggggggggggnccnccccccccctnaaacacaaaaacatanggggggggggggccca

SEQ ID NO: 16642 - DNA, 877 bp, Xenorhabdus bovienii
  unsure (1)..(877): unsure at all n locations
nnnnnnnnnnnnnnnnnnnnnnnnnnnnnnnnnaaataatttagtcgacgggacttaattcatttagaagagaaatgacccgaagtagaaaacagctcggcatgaaataatgaaattagatttagaccaaacaatccatgtgaccatttttacgtacagaaaaagataaccatcatcatattatcaagcgcgaagataaaacaaaacattagactataaatagtcactaataaatcttacagaaaacggtatcctcagggataggggatattcagaacataacacaaatactaaccatcaatattagcacgctaatttattcctatattccccttggggggggcnnnnnnnnngagatgtntaataacggcanaaaaanctcgcgaggaaggcccttccggggggttttcaccccccccgcnnggggngggngnannaataccnccctttntccctattgaggagtatgaggctctccgcggntttggangtttttttgagtnttccccccgagtttggggnttttnaaaaannttaanattaaagaccggncccccccccccccccccaaggggnnnaatctcggtggtngaaaccccccgcgttttttcccccttgtcgtnggttttcccaaaatttagtnnggttttgggtnggtttttttttggggggaaaaaagggggggggggcccctttcttcctccaaagaaagggggggttttttttttttttctccccacaaatttgtgtgggggggnnncggcggctttttttttttttttttaaaaaaccccccccccccccccccggggttttgggggggggaaaaaaaaaacattcttctccccccacaaaatattttctcccccccaaaaaa

SEQ ID NO: 16643 - DNA, 925 bp, Xenorhabdus bovienii
  unsure (1)..(925): unsure at all n locations
nggaacaccagacctaaatacccccaccanccnnggganaggaacagnagagacaaagaaagggaaggagagggaaaagaaacnggaggcaagagaagagagaaaagaagagagaagaagagaaagagagaaagccaaaacaaaaaggagagagggagaaaagaagggaagagagagagaaaaaacagnangagcggaagggaagagcccaaacaacaanagggggggggaanacangaaaaaanagggggagacccagcaagaggtcccttctttttttgcgcgccgccccccgggccccttaaaataaaataacccggangggnccccnagaaaaaaccaccccaaaccggcaagnnntttttcttttaaaaggggggggggcccaaccctttnngcgngagaacccgaacccccccccaagnggnnnaaaaatnacaccccccaaaaaaagagggttgggggtttgggggggnccctnttaaaaattccccaaaanncccccccaaccccgggggntttgtgggccccgggggggccccaaaagttgtgtngnaaaaaaaaaacacccccccccaaaaaatngtggggnaaaaaagaacccgcggggggttttnaaaaaaaaaaccccccccgtggtttcccccaaaagaccccaaaaaacccccaaaaaaccccgcggggccccccaaaaggggggaaaaaaaaaagcccccgcgggggggnccccccccagaaggggggggggggggagaaaaaaaaaaaaaaggggggggggccccccccccccccctttcccctcttcccaacaaagaaccgcgcggcgccccccccggggccccccaaaaaaaaatgttcgttggggggggggagaaaaaaaacccccccccatcttatttccccccccccccccccgggccccacc

SEQ ID NO: 16644 - DNA, 852 bp, Xenorhabdus bovienii
  unsure (1)..(852): unsure at all n locations
agttcgaatcggctcgtacccgggatctctngtcagagagcatgaatagcgaaaattccacattggcttgggcggaactcccgaagaaatttgcctgctaccccaaagcaccttttgcccaaaattattcgcgaccaaaccgggggccaaattttttggtaaaaaaagggggagggggctccacacgggcccttttttttctcgccccgcgcgcccctgggggatataaaacgcggccccctcttttttgtttatataaaacccccccggcccaaaatatattgggggggggggggggtttcgcccctcccccccccaaaaaaaataagggggggcggcgcgggggcgcggtttttattatatttttttttgtaagaagaaggggcccccccccccccccccggggggggggggagaggaaggggccccccccccggtgggcgccgccctccctcccattaaatgggggggggaggggaagcccctgggaaaaaaaaaaaaaacggggccacaccccgttggttttggggggagcacccccgggggggggggtttaaagaaataacacccggcgggggacatcgcccccgggggttgtttatcctcaagacaaagagatgccttttttgaaagcgtggggctttaaaaaaccagcgggcgcatctttttcaggcaaatagaaaacaccccgcggggagggggaaaaaaagtttttcccacctgcctccatcaaagagtactggaagaaaacgaaaacatctcaagcngggggcggtcccgaaccctgttcgaagagtaagggttaacttaatcgccctggcgaggcctgaagtatggctttgacccaccctc

SEQ ID NO: 16645 - DNA, 1296 bp, Xenorhabdus bovienii
  unsure (1)..(1296): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgggtttctatgggtgcggcgttggcctgtgttgttttgtctttctttttgaactctcagatgctcttgattgcggttaagagtataagcactgtttttnnntnnnnnncnnnnnnnnngcaaaattttatttccttggtggggnccccccccgggaaccaaaaannncctccctccattgggagngggttagggggattttttttttttaccaagaacccccccaaaactttgtttggtttttttttttttttgccaacaccctggggaaaaaaaagggtttttctttccttttgtggggggggggtgttataaaaaaaaatttttttccccccccgctttttttttttggggggggggtttttttttttntaaatttatcccccccccccccccccccctttttttttttgggggggggggaggaaatttattaaaacccccccctcttttttcttttttttttttttcttctctcttacacaaaaaaaaaaaaaaaaaaaaaaccgcccttttttctttttttttttttttttttgggggggggggggcgggccccctcccctttccttttttttttttttgtgtggggggggaagaggaaaacccccccccccccccgcgcgagggggggaggggggggggggcgccggccgccccacccccgcaccggcggcgaggcggaaaaaancacacncnctgtgttttttttttttttttttttttttgtttggtttttccgggcgaaccggggggccccccccccccccccnacacccaaaaaaaaaaaannaaannnnagggnnggggcccccccccgccggggntgcgtacggtcgacatacgttattctcgcgtctgttttctctcttcctattttcctcttgtctttccacctcagatctatggcccgncatgaggccgggtggtcggtttgttatctcttctcctcttttctgttctcagcttnnganacccttnannnaagcaggcccncccccgngaggggcgaaaccagccancggaagattaaatatatagatattgggggttggggtctgtgtgatgtttnggncnancacacgcggcacccnnacnacaccgcacacacccaccaacccncnatcttcgtnacntctttttntttcttttttctactccttcctcagcgcggcttgatgggagg

SEQ ID NO: 16646 - DNA, 981 bp, Xenorhabdus bovienii
  unsure (1)..(981): unsure at all n locations
gcgtgtttgnagggcggaggaaaggtncgtctttgaanngttctattgggattcagactcggttctcggggntacctctgagtctcaagnagtggtncgtgnnacggccgntgncgtnaccagncttccagncagggtttnntgcccaggaatncttggcgnccnaggggnccccggttttccttatttnctttcccctgggggggggaatttcttaagccccggggtggccaaacccaaggggggggaccccatttgggggggcaagggaagcccccttgacaggttccaaattttttcccccttggggggggccaaaacggggaaaagggggtttnaaaggcggtaatataaaaaaggcgcggtgggggggagacatttttccctccaaaaaaaaaattttttgggggagaaaaaatcttttttgggggcctttttttttttaaggggggggggaacacaccccttttttaaaaaacccccctcccctctgtggggggggcggcgccacaaacaaatagggggggggatattatataaacccccctctttggtgggggggcccccccccttttttttttttttttttttttctgcggggggggagaaaaaaaaaaatatatttttttttttttgttttttttccccccccccccccccgggggggcggaaaaaataattttttttattnnngggggggggggggggggggggggtgttttttttattctccccccacccgcgacccgnntttttttttttttttaaaaaaaaaaaagagaaaagagggcgcgggccgcgggcgcnncnnngagggnnnnnttgttattnntttntnnaaataaaaaaaataatnattntggggggnnccgcgggcgcggcgcgcnaagaaaaaaaaaaaaaaaaaaaaaaannnnnnnnnnnntttttttttggtgtgggtgnnggggggggggggnnnnnnnnnnnnnnnnnnnnnnn

SEQ ID NO: 16647 - DNA, 931 bp, Xenorhabdus bovienii
  unsure (1)..(931): unsure at all n locations
ggggaaataaccccntnntttnnnnnngncnncnnnnnnncnnnnnnnnnnnngggggnnagggcngnnnnnnnnnnnnnntttggagagggggcnnnnnnnnnnnnnnnnnnnnnnnnnnnnaaggttattctttttttttnnnnnnnannaannntttgggggagattttttttttatnaacacagcaggntaataataaaaaaggggggggggagaaaactccccgcgcggggggggngttttccccccccccccggggcggggggggggggggggaatataaacaaaccccccctcaaaaagaaaacgcgggttgggggggggccccccggggggcgggggggaaaaaaaaaaaagnnccccggggggccgcgggggaacatttttttagaaagaggggggtgcgccacaacaaaaaaggggggggggaaaaaaaaaacaaaaaaaaggggggggggggggggggggggctttcttatttttcaaaaagaggggggaacaacccccttttttcttggggggggagaaaaaaaaaaaaaaaagnnaaaggggggggggggggaatatttttttttttaaaaaaaaaaaaaaacagccgccgcccccctgcccnngggggggggggggggggnnnttttgggttttttcccccccctcccccacaaaaaaaaaaaaaaggggaggggggggggggntggnnnnncccccnncccnnccggggggggggnnaggnntnnnnaatcccctcccccctctaaaaaagaaaaaaagaggggggggggggnngngnnnnanaaaaanaaaaaaaaaggcggcgcgcgccgggagggngagtttttttnnnntttttttttttnttggggggaggggaggaggagnagagaagaaagaagaagnaaaagnnnnngcgcntctgactctaggtccg

SEQ ID NO: 16648 - DNA, 779 bp, Xenorhabdus bovienii
  unsure (1)..(779): unsure at all n locations
atgnnnnnnnnnnnnnnnnnnnnnnnnnnnnnnnnnnnnnnnnnntccagacacgctttacgtgtcagcttcgaaaacgtacgctttattttttggccggttaggaaagcttttgccattgggggggggcaagcccggttttaaccgcccttgcaaacccaaaggggtttttacctgtgtttttacccgggggttttttttggggaccgggggttttttttttgggggggccgggtttttataaaaacaaggggggggggggaaaaaaaaaaggcccaaaaagagggcccctctttttattaataaaaaaacaaaagggtttttcctccacgagagaaaaaaaaatatttttttcgncnnnnaaaaaaacaaaccaccccgcgccgggcgggttattatatattaataaanncccaaaaaaaagaaattcttttctcttcttgttgtgggggggggggggggggggggggtcctcccgcccccctcccagacgaaaaaaaaaaaaaggggtggggttnttntgttttttattannnnnnaaaaaaagaggggggggggggggggggggggctcttttttttttttttatatttaaaaaaaaaaaaaaagggagggggggggggggggggggggaagaaaaaaattttttctttttttttagtnnnnnnnnnaaaanaaaaaaaaataaaaattttttttttttcttttttgtgtgtggggagggggnnaaaaaaaaacacccccccccccctttatttatataaagggggaggagggga

SEQ ID NO: 16649 - DNA, 728 bp, Xenorhabdus bovienii
  unsure (1)..(728): unsure at all n locations
gggccccctggggcgccggccctgtctgcccccggcgagggccgcgctgccgtacgcggcccttacgagcggctgacccaggggggggccgcggccgccaggattttaaaaattagtttagggaaaancaaactcgtacccggggacctntaagagcaacaaaaaacagcccctgaaaacaaggggccggggaaattaaaaaaaaagggggggcccccttttaaatgggggggcggaaaaccccaaaaaaaaacccccgaaaaaaacgcccgggcgcggggggggccccccaaagggggggccaaaaaaaaaaaagggggggtttctctccctcggggggggggtttttttgaagggggggaaaaaaacccgggtttaaaatccccctccgccgggggagggaaggaaaatattttttggttgcgggggnngcccacccccgcggggaacaaaaaaaagaaaaaaaaaaaaccccccccttcccccccaaaaaaaaaaaaagggagggggggggggcgtccccctcttcttattttttttttttnnnnnnaaaaaaaaaaaaaaannccccccnnnnnccnnnnattattattttncccccccccccgccgcccccacccccctttttttccttttttttttttttttnttnntggggggggggggggggggggggaaagggaaaaaaaaaaaaaaaaaaaaaaaaaaaaaagccctctcccccccca

SEQ ID NO: 16650 - DNA, 894 bp, Xenorhabdus bovienii
  unsure (1)..(894): unsure at all n locations
nnnnnngggggnnnnnnnnnnnnnnnnnnnnnacctttccctatcggcccggccccggggaccctctggggcgtctgcccagagcatngatccgngcgcgtntttaannnnnttaggttttacgnattgcngttncggtnacccgggntactttaagatctaaaaagaggttttttaagaaaaaatttttatttttgggaaatgggcacctcccctttttctttttaaaaaatcccccaaaaagggtttttttttttttaaaaattttttttttttctgggaaaaaaaaatttttttttttttaaaaaaaaaaaaggggggggggggggaatttttttttttgggtgggaaaaaaaaaaaagttttttctgggggggggggggtttgnnnnaataaacacccccccccccaaaaaaatttttttttttttttttttgtgggggggggggggaaaaaaaataccccccggggggggagagaagtatttatttttttttttttttttgagtaaaaaaaaaaaaaaaaaaaaannnnnnnnnccctttttttttttctcttcgggggggaggggaggaggccgcacccccccctttttttttttttttttttttttttttttttnngggggggggggggggggnnnngnncnnnnnnccnnnnccnccccctcttttttttttttnncnnnnatttttttttttaaaaaaaaaaaaaaaaaaaaaaagaagagagtggggggngnnnnnnnnnnnnnnnntntttttttttttcttccccccnccccctcccagcannggggggggaggcaggnggggggntggnngtttttttttttttttnnnggacggggngggggacgggagggagnnaaaaaacccatacactcatccccta

SEQ ID NO: 16651 - DNA, 711 bp, Xenorhabdus bovienii
  unsure (1)..(711): unsure at all n locations
nnnnnnnnnnnnnnnnnnnnnnnnnnnnnnnnnnnnnnnnnnaggttaagaataaataaccctgatactgagaaggggtgtcaaaagaagccgctgaattaaggaagattttaagggcgtgacttggccccaggggttttaaacccccgcccttaaaaccccaccggggggggaaaaaaagggccaaacccccaacccaaaaaaaaattttttaaaccccccttttttttttgccggaaaaaaattagaaactttttttttttttaaaaagggggggaaaaaaaaaaaaaaagggccccccaagaggggggggggagggggcccccccccccctccgggagggggaaaaaaaaaaaaaaaatactctcgcggggggggcccccccaaaaaaaaaaaaaaccggcggcggtnnnannnccacaaaaaaaaaaaagaggagggggggggacacccccccccccccaaaaaggggggggggggttttttatccccaaaaaaaaaaacccccccccccccccccctttgggggggggtggcggggaaaacccccccccccccccccngnggggggggggggccccccccctncccttttttttcacacaaaaaagagggggggggggggcttcttccctcccaccaacagggggagggggggggggctctttttgggatggnnnacaaaaaaaacaaccccccctttttcgctct

SEQ ID NO: 16652 - DNA, 933 bp, Xenorhabdus bovienii
  unsure (1)..(933): unsure at all n locations
ggggnnnggggggggnnnnnttttttttnnaacattttgnnnnnnccgnnntnnnnnnnngnnnnggnnnnnnnnggnattnntnnngnnnncnnnncngnnnnnnnnnngnnnnnnncnnnnncncngnngggggnccncnnnnggggngaggcnnnnnnnnnnnncnnnnnnacnnnnnnnncgcnnaagggnnnggnnnnnnnnnnnnnncnnnnnccgaaaaatagagaggnnnnnnnggggnaannnnnggggggggnnnnnnnnngggtttttttttttttttngggggggngnnngctcaccaacttttntggccttaaacacataaaacttccagttnttttctttgggcctgggcccctctnccaattnccccaaaatttaatcccatacccccaaaaaaagagtttaaaatttttgttgggggggcccgggtntttttttcccccccttgggccccccaccaaagaaaggccccccccctctttccccattttttgggntggcccccctttttgnggggggtttatatttttttgggggggggaaaaaattcctctccccaaaaaaattccccccccgnaaaaaaaacaccccccccccctctcttattatattttcccccccccctcttatattataaaaaacccccccctccaaaaaaaattttttttcccccccccncccaacaaaaaaaaacacacccccctcccccngaaaatataaaaaaaaaaaaaacccttttttggtgccccaaaaaaaaaaaaaccccccccctttcttttttttttcttttcncccccccccccaaaaaaaaaaaatattttttttttttttttttgggcgcccccctcccttttttttctttgaaaaaaaaaaaaaacaaacacccccccccccttcttcttttttttataataaaaaaaa

SEQ ID NO: 16653 - DNA, 899 bp, Xenorhabdus bovienii
  unsure (1)..(899): unsure at all n locations
atgatgtagctaaaaggaatttagaagactagtatttcgtatcgaattatacctaccgaattgttgattttcgctgcaagcctggnagnnnnnnnnnnnncccaattgatttccccttcaggcccccccagggggggggcaaaaaatttcctcacaaatgggggaggggccccccccctggttttgggaaaaccccccaaaaaaaaaaaggggcccaaaaaaaaaaaccctggggggggggggggggaatttctcccccaaaaaaaaaacatccccccccggcggcctccccccccgcggggggggggcccgccgcccccccccggggggggggaggatttttattttcccccgcgcgggggggngccctcctctcccccccccccgggggggggggggcggccgcccccccccccccccctctctaatttttaatttttcttcttctcccctcctcccccccccccccccccccccagaaaaaaagaaggggggggggngnnaaaaaaagagaaaaaaaaacacaccccccccccccttttttttgttttttagcgggggggccgcccccaccaaaaaaatttttgtttttttattataaaaaatagggggggggggccccgcaccccccccccctttttttttttttgtgggagggggttttttttttttttttttttttttttgttntatgnaggcgaggggaggggagagagagcggccttctccccctttttttttttttataaaaaaataaagaacacccncgccccccccccccccccccgggcggcgcgttttttttttcattttcctcctccccgggggcgggggggggggggggggggggngnngnnttnntaatttntatttaacataaaaaaaaaaggagggcgggg

SEQ ID NO: 16654 - DNA, 666 bp, Xenorhabdus bovienii
  unsure (1)..(666): unsure at all n locations
tgattcgaattcagctcgtacccgggatcctctgagtcctgaaccgtctgctgatcgtgttaaagcctttttgcttggcggttgaggcctggccccccctaacccatggttggggggaccaaaattttggggattttttctgggtttacccagaaaccccccttttctttggtttggaaaaaccccttaaaaaaaaagggtttccccccccggggggggcggggggggaaaaaaaaaaaattttttgtttgtggggggaagagaaaaaaaaaaaatttttttttttttttttcccccgaggggggggggtgttttaaaaaaaaaaccccactcttttttcccaaaattttttttttttttttgggggggggggggggggtcccctctccccccaccaaaaaaaaaaaaaaaatttttttttttttttttttttttaaaagagggggtggggggcgcggggtttttggattatagncaacacctcaaaaaaaaaaaccccccgtggtttgtttttttgattttttttatataaaaaaaaaaaaaacccccccccccctcttttttttggtgtgtggtggggggggggggggggaaaaataaaaaattattttttttttttccttctcnccncnnnnnnannnnnaataccccttgcggggttgggga

SEQ ID NO: 16655 - DNA, 905 bp, Xenorhabdus bovienii
  unsure (1)..(905): unsure at all n locations
tgagtttactaggttgggcgtcggagatagggagcgaaggtgagcattgcggaattaacccaggccacagcannnntnnnaccaaaaaatgtggtatggccccgggggggggggcccctaaagaagcgcggggtgggggaaaaaaaaaataatggcggccggaaaaaaaaagaaaaatccccccccccttttttttttttttgtttgggtggtggggcgcgccacccctctttttttttttttttttttttatagataaaaaaacacacaccggggggggggggggggggaaaaaaaaaagaaggggaggtgtttttgtttctctcctcccccacaattaaaaaaaaaaaaaaaataatttttttttttttttattaaaaaaaaaaagggggggggggggggggggggcgnngggggggttattattgtttttttttttttttttttttgcaaccccaaaacaaaaaaaaaaaaaaaaaaaannnnaaatttnttttcttttntnttctcnnctgtgggggcggggggtgtgggtgggggttgaagttnnaaaaannnnaananaaaaaaaaannaaaaaaatnaaatatnnngggggnnggggggggggggggggggcgcgcccccccccccccccccnctnttttttttttttttttttttttttttttttctctcccccccgcccggggggggggggggggccgggaanaaaaaaaaaaaaaaaaaaganannnaannnnnnnnnnntnnnnnnnncncccccccccccccgcgggcagcggggcgggcgtttcttttttcntatttcgtctgtccntttcttnnntgntgnttttttnttggtgttgttgttgtgtgngcggttggngtgtggtttagaanagaaaaagaaaaaaaaaaaa

SEQ ID NO: 16656 - DNA, 910 bp, Xenorhabdus bovienii
  unsure (1)..(910): unsure at all n locations
tgctgcctgcaggtattattgaaaggaaattgttactcttcnggcgaagacaaaggcttccactccgtaactcatcattcgccgtcgttccgcgcatctctccatcttttgagggagcatccaaagcaaaggacttcgtctttggtataatcttcactcatttatttatgaccaaagggggagagagtaattctgagggctctaatgattccgtttttggcgattcatgccaaagggggagaaagtatgagcccaaagcaaaaggaccgcaccgccaccaatttgtaaaattttagtttttcaaagagtattttcaaattggtatcttacttgtgatataatttcaaattggtataacctcttcaaaattaatatcaaaaccctcttgaacattaagaggaggttttcattaagggggagttttgtttagtcaaaggaaaagcatttgaaacagggggagaaaatttcaaatcttgaagacgctttgcaaaatcttattcatttacctttgactatttgcaaaagaactttgaaaaggatttacaaaagaatttgcaaaaacaaaacatgtggtgcaagcatggtccaaaatgttaaaaatgaagaaacaatccatgcatatcttacaagtatttatattggctcaattccaagcaacctttgcacttacattttgcaagctagttcaatcacgtacttctatacttgctttggtttgtgttggcatcaatcaccaaaaagggggagattgaaagggaattaggcttacacctattttcctaantgattnntgtngntgaattgccccacacaaataatggnactaactagtttgctctagngnattagttatacaggtgtcaaaggtttcacacttagccaataaaaagaccagtattgggttcacaaa

SEQ ID NO: 16657 - DNA, 794 bp, Xenorhabdus bovienii
atgatacaattcagtcggaccggggatcctctaagcatcatctaatggggttccatagggtcctgtactgatatgactaactatatgccttataatcgggggattatctaaaaaatgatgtttgagaattgcccggatttatccgacttttgcccgaaaatttgtttgtgtacaaaagggaggctttctccccaagaaaaaagggacaaaagggtcctttaaccccccggggggaaaaaaaaaaaaaaatcaaaaagggggggggagggctttttttttttctttttaaaccgtggaaaaaatccacacagagaaatcctctcttcccccccccccattatttttttttaatgggggggggggaggggggggtgtattcccccccccccccccccggggggaaaaaaaaaaagttttttttttttttccccgcgggggacccccattttttttttttttttttttttttttttgttggggggggggctttccttcccccccaccctcaggggggggcgggagagggaaaaaaaaaaaaaaaaccctccccccccccccccccccccccccctctgggggggggagaggtggtgggttggtgggagaaaaaaaaacaacacaaaaagaaaaggggtgccccccccccccccccccttctcttttttttttttattaaaaagaaaaaaaccacccccccccccccgggcgcggggggggggggtgttccctttttttttaaaaaaaaaaacaccgcgggggggggggggggggggggggcaccacccccccccccg

SEQ ID NO: 16658 - DNA, 948 bp, Xenorhabdus bovienii
  unsure (1)..(948): unsure at all n locations
gagcctagcngnnattcgagccttcggtactccggnggatccctctagnagtcccgactccccttnncttngnanncgctnaggtgggtagnggcctcccggtttgaaattaccggggggctcccgaattcgggcggatttttggggctaccccccagggggaaaagagggtcttgaaaaaaaatttcgcggggttttggttttcctttgtgtgggggggctaataattcgggggagaaaaaaaacctctttttgggtttaataacccgccagggggggggggcgcgcgcaaaaaatttgtgttttcccccccctcctctggagggggggggggggggggcctcctctccccccccccggcggcgggggggggggagcacccacccacaccacaccccacccgaggggggtgggggggggggggggaagttattttttttttntttttttttttggggcggcggccgccccnnnnnnncccccccccgcacacaaacaaaaaaaaaaacaacaccccctctttcttttttttatttggagggcgggggggtggtgtttttttttttttnttttnntttttagggaggaagaaagaaaagaaacaaaaaaacacctcccgctttttttttttttttttggggggccgccccccccccccctctccccaccggaggaggggggggggggggggggggggccttttttttttttttttattttttgtgggggggggggggggggggggggggaaaaaaaaaaaaaaaaaaaaagggggggggggggggggggggtttttgggcccccccctttctccttcttctcctcaaaagagacaaggagagaggggggggggggggggggggggggggaaaaaaaaaanaaanaannnnnnnnncttttcccnncccccctcctcccccaacaaagaaacagaaggggggggggggc

SEQ ID NO: 16659 - DNA, 1045 bp, Xenorhabdus bovienii
  unsure (1)..(1045): unsure at all n locations
cccccccagagggggncgcgccnnnnnnnnngaaagggnnangacgaaaaaataagggnannnggggagccagaaggggggggagnaaaacaaccaaggacccggaacagaggggaaggggggggcaccnataggaacaagaaganagccccccacaccacaaacaccaaacncccaaagtttttttngggnnnnnnngggggggggtgagggagggaaaaaaggggagaaaatcgggggttaaaacagggggggaaaaaaccccgaaaaaaaggggaaaaaaaaaaaaaaacgggggggggggaaaaatttaaaaaaaaaaaagggggggtttgggggaaaaaaaaaaaaaaaaaaacggggggggggtcccccgggggggggggggagagagggcggggtatttcttaaaagggggggcgggaacaaaaacccccttccaaaaaggtggcggggagaaaaaaaaaaaaaaaaaaaaaaaaaaagggggggggggggggggggggtttttggggggggggggggggnnacaaaaaaaaaaaaaaaaaaaaaaagggggggggggggtgcccccccaacccaaaaaaaaaaaaattggtttttnttttttncngggaagaaaaaaagagaggggggggggggngnntnttttttttttannannaaaaaaaaaaaaaaaaaaaaaaanatcccccggcggccgggggggggggggggggnggggggncccccccccccccgccccagcgcgcccccctttttttatttaanaaaaaaaaaannaanaangaaaaaaaagaagaggggggggggagagaaaaaaggggncnatttaaaaataaataattttcctcnccccccccccccccaaccttnnnacaaaaaaaaaaaaaaaanaannnttaagnnncagcgcggggggggaggagggngcgggntcgcgccaacgctccacacctatnnaaaccatnaaaaaaaaaaaaaaaagaaagagaggcagagagagaggaaggngggngaaaanaacacaaaaaaaagaaaagaa

SEQ ID NO: 16660 - DNA, 805 bp, Xenorhabdus bovienii
  unsure (1)..(805): unsure at all n locations
ngatcaatcagtcggaccggggactctttaaaaattttttgggggggggggggttttttggccggggggggaaaaaattaaccaaggggggggttttttctttttttttttccccccccccccgggcgggggaaaaaataaggaaccccccgttttttttctcgcgcgggggggggggggcttttttttaaaaaaaaaacaggcgcccccccccttcttctctttgggcccccccccgcgggggaaaaaaaaaaaaaaaaaagagggggggggggggccccccgcccccccccaaaattttttttcttttaaaaaaatttgtttagggggtgttttttaagggcccccacatggggggggccctcccccaaaaaaggggtggggtgttgtggaaccccccccccccccccccctttttaataaaaaggaagagcccgcccccttttttcctaaaaaaagggggggggggggggggggggaaaaaaaccccccacccannnccccccgcgtgtttaaaaaaaaaaaaaccaaccggggggggggataccccccccggcccaaaatgggggagaccaacacccccggcggtttttttctttttctttttttgaagagagggcgtttcttttctttttccttgggggggcgggggggggggttttatttgtccgggcggggttttttttaaatataaaaaagacggtttgccctactcgcgccgcaaaacatcccccccggaggaagggtgtgttattcttcccgcgggccgtgcaacaaaacaccaagagaggggatgtgaaccgag

SEQ ID NO: 16661 - DNA, 665 bp, Xenorhabdus bovienii
  unsure (1)..(665): unsure at all n locations
gcgttgtgctgcgtctgctttaccgcagcgcggaggtggctggatgacaatctgaatgagtgcatgattcctgcgacgtgcgagacaatgcatgcatcgctgcacggatgtggctttgctgacgaaacgccgcaccactgcattggcatgtgggggaaaaaattcccgcgggataaaccccttttcccccccctttaagaacccaagggggggaaccgggtttttgggggggattttaaccatttttccccccctttgggagggggggccccccaatttttgtttcccccccgggggtttttccccccccccccccccccgggggggggtccccccccgccttttttaaaaaccaaatttttttttttagggggggttaacccccccggggggggggggaaaaaaaaaaaaaacaaaaccccccccccccccaaaccttttttaaaaaaaaaaaaaaacccccccccccccccccccaaaaaaaaaccccccccccccccccngggggggcggggcttggttttttttttttttttttttttttttttattgtggnnnnnnnnnnaacccccccccccccccattatttttttttttttttttttttttttgttggggggcccccccccccccccccccccccccctttttattttttttttttt

SEQ ID NO: 16662 - DNA, 522 bp, Xenorhabdus bovienii
  unsure (1)..(522): unsure at all n locations
tgttcgtggctgtccgggatcttggtcgggagcgctcagcgcggcggtgtcctggattgagcgcgaagcttggtggaccgttcgttacgaaaagagcggacggttcttttagggtggttccggttttaaggttggttgggggccttttcgggttggggaattcccggttaccgggggcgggaaaaggggggggggtttcccccaggggggccccccctttgggccccggggtcccccccccaaaaaaggggcccttttgggggggggcaaaaaagggggggcccttttttttagggtttttttttggggggtttaaggggggttttaacaaaaagaggggttttttttgnccccttgtttgtaccccccccccccccctattttttttggggggggggggccccacccccccggggggggaaattaaaggaaggcccccccccccccttttttttccccgccccccccacacacgaangggggggggggtttttttttttncccgccccccccctccggggg

SEQ ID NO: 16663 - DNA, 1249 bp, Xenorhabdus bovienii
  unsure (1)..(1249): unsure at all n locations
gccaaggggttccccgccccaggagaaggcccgttnagtntttttcnnnnnnggtagaattacggatataaccgaactcggggactcccgggggagactcctttaaaaaaaaaaaaaccaccctcttcctttgggggtgggggagggattttttttttttaataataaaaaaaaggggggggcgccctccccccccctttaaaaaagggggggccccaacaaaaaatatttattggaaagggggcgggggctgttttttttttggggggggggggttttatataaaaaacaacacccccncnaananacacaacaaattttttttttttttttttttgtggggaggaggaggggggggggggaaaaaaaaaaccccccaaaaaaaaaggaaaaaaaaaatttttttttttttttttgaaaaagggggggggggntnaaacaagattctctaaaaaaaaaaaagaaaaaaaaaccggggggggggagaaaagaaggcccccccctttttttttnntttcttttttttttggcccccacccccacaaaaataaaaaaaagnggggggggtgggggagggaganaaaaaaacccacactccncgggggngggagggggagagagaggcccccccccacctctcaaaaaaanattattaataattaaatgaaaaaatatatttagttttggaaaaaaaataataaggaaatannnngngggggaggaggggggaaagaagaaaaaaaaagaggagggaagagaaaagataaaatttttattttatttaaaaaaaaaacacaacctccccctctttggtggggggggagaagaaaaaanaaacaaacaacannnnnnttataataatattatataattttttgggngcgccccggcgcccgcgccggagnaaaaaaaaagaaaanaaaagagggagcggaggggaagaaaataataaaaaaaaataaaaatctatcctctccncccgccgctngtgtctcttaggtatctatggnagatagagnncggcggcggcggggncggcgccncnctcntttctttcttttctctcttctctcttgntgtgtggnctgtgggngatgggaaagaaaaagaganaacaaaaaaacaaacaaaagagnannagnnnngagacgntnagagagnatggnagntngcgcggtttgcgtntatgnngnaancacaccattnnctagttatatnactccttctatacacaaacaaaaaacacaaa

SEQ ID NO: 16664 - DNA, 838 bp, Xenorhabdus bovienii
  unsure (1)..(838): unsure at all n locations
actctgatcagctcgactcggatccttaagctatatgattcagcatgcagatgtgccataaatggatcccgtgatgggaaaatacggggaaccccctaattaaccggccctttgaacattggggcaaaattattgattcaccttttttggccacaaaaaacaatgggggggagtggggagacccacccacgcggcgcggtttttattttngattttaagagaaaaattctcccgcggggaggaagaacaaaaaaaaaatatgttttttttatttaccaacaccccgcgcgggggggagacgagaaaaaatttttttatcaccacaatattttgggggccccccctttctccccctccctgggggggggcccgcgcccccccaggggcccccccctccccttttttgagattttcctccccccggggcggggaagaatttaatttttggggcgcacacccaaataattagagggggtgcccgggaaaacacaaataaatgtgggacccacctctttttgtttttttggagaaaaagagcgcgggggaacccacacacaaaaaaaaatactatgtccgccccccccgggggaggggaatatttttttggttttttttttatttaaaaagaaaaaaaaaaaaaccctcccccttttttttttttttccccgggcggggcggggaaaaaaaaaaaaattttttttttttttacttcccccccccccccaaaaaaaaaagaaaagggaaggcgggatcacagattttttttttttttcatggaaaaaaccagcgccatttttttgccgtcttcccagcggtagagctgaaaatatatttattt

SEQ ID NO: 16665 - DNA, 905 bp, Xenorhabdus bovienii
  unsure (1)..(905): unsure at all n locations
ggggacttcaggggggnnngnngttttttnggccttcttgctgcctgcagtctgtgccgcggctcaactggccctgcctcctcgcggatcggcgctgctgaccctcaaataaaactacggctgatgctgtttaatggggcgacaatctggggggtcaaagcccttaacggtgggggggtttcccccggggcccctttttcccaaaattcccccccgtgtaaaaacgtttttttgggggggggggggaaaaaaaaaaatttttcctccccaagaggagaaaaaacccccctctcttggtgggttggggggcgccccaccctcttcccaagaaaaaaaaaaaaaaaaaagggggggggggggtttttttaacacctcccccccccccccccccacacttttattttttttttcttttgggggggggggggggcgcgcccccgcccccccccccccccttttttttttataaaaaataaaataccacggcccccccgggggggggcgggggggttgtgggtgttatgtacaacacacaccacccaccccccgccgccacaagtttttttttttttttccccccccaacccaacccacccgcccgcgggggggggggacaccaaacaccaaaaagaagaaaaaaagaggggggggggggggggccccccccccccccccaccacaccgtttgtgtttttttttttttttttttttttttccccccccccccccccccccccctccccccatatatattgtgaggngcgggggcccccccccccccccccccccgcccccgccgggaggggggnaaaggnnaaaaaaccccacgnagnnttttttaattttttntttntaaaaaaaaaaatatttcctccccccgccgcgccctccccccccctaaaaac

SEQ ID NO: 16666 - DNA, 598 bp, Xenorhabdus bovienii
  unsure (1)..(598): unsure at all n locations
caacttatcctcatcttcaatacctactactaaaccttacgaaccactactantaaaccccagtccacacaaatcacnaggggggggggggtaatattctacacatgttaaatcctccacaaanaaattaagagttcgacctaaacacatcgaggagaaggnnntcnnntntttttttttannnnngccggcccctaataatttgggncccttaaanccctcgggncccgaaantttnnccnaaaaaaaaaaaaccatanngtttngannaaaccaaaacccggggnccctttnnaaaacaatttttaanccccctccgttttttgggcccaaaaaaaaagttttgggggcccccccccgttttttttntcccccccaaaaaaaatttttttntgggggggggngnntntttaatattaattaaaaacnccccccccccccaaaaagaaagaagaaanannannnnnatataaaaaaaaaaaaaatatnaaaaaaaaagnaaccncctccttcttntttngtnnntnngnanaaaaaaaaccccnaccncnggcggnngtttnattnnaaataattataaatnatatnaatnnagnaa

SEQ ID NO: 16667 - DNA, 833 bp, Xenorhabdus bovienii
  unsure (1)..(833): unsure at all n locations
atgtttcgaattcgagctcgtacccgggatctcaggtagcgcgcaatctacaggtattccgagaaaggttatatgatgcagatctgatgccccagtatttgatgcatttgggaaaagctaccccgggcttctaaaaccgaaaaaaattttgccccccaagggggggcgagccccaatatttggtggacgcggaaaaaattttggggggggggggaccccctcaaggggggggccccccccctttttgggcaaagggggggaaaaaaagccttgtttttttaaaaaaggggggaaaaaaaacaaagaaattctatttcttttttttttttatataaaaaaggggggtgggttaaaaccccctttttttattttctttcgccgggggggctttttttattaaaaaaaaaaaaaaaaattttctcccccccccccccaaatttttttttttcattatattatgagtgtgggggggggggggggggggggtttttttttttttttttttccccccccccgcgcttttttttttttttttttttttatttttgtgggggaggggggaggggggggaaaattctctccccccaaaattatataaaaaaaaaaaaaaaaaanngggggggggggggggggggagaggaggaggagagagaggaaggacctccctttcttctttcttaaaaaaaaaaaaaaaaaaaaaaaacccccccccccgaaaaaaaaaaaaaatttttttttttgttctttcgggcctttcnnnnngnaaaaaaaaaaaaaaaaaaagaaaaaggggggggtccccccccccccaccaaatattatttaattattta

SEQ ID NO: 16668 - DNA, 738 bp, Xenorhabdus bovienii
  unsure (1)..(738): unsure at all n locations
ggggcctttccttntagggtgccccctgannncnctanccaaagtcctttttaaaaaaannnttaggctttaaaccnaaaatatnccggggtctcccggggntcccccccggggnggggtataccccctctttaagggaaggccccccacaaaaggaggggttttttccacaaaaaactctttttttttttttatattttttcccccccccccccgggggggggggttttacacaaaaccccccccccggaaaaaaaaaaaaaaacacacctctttttttttttttttttttgttaaacacaaaaccccccttttttttttttttttttttctcaacccccccccccccccccgcggggggnnnnnnnnnnnnnnnnnnaattctnnncccccccccttttttttttttaaaaaaaatataaccccacccccggcgcggcggcgggcgcggggaaaaaaaaaaaaaatattttttatttttttttttccccccccccccccccccccctccctccctcccttgggggggggggggggggggggggggggggcgcccaccgccccccccnncgcgggggggagggggagaaanntnaaaaaaaaannannnnantttttatttttttttttttttttttttnnnaanaaananaaaaaaaaaaaaaaannananannnnnnccnnnnnccccccccccccccccccccccccnnaaacgagaagaaaaacaaaaaaaaa

SEQ ID NO: 16669 - DNA, 706 bp, Xenorhabdus bovienii
  unsure (1)..(706): unsure at all n locations
actcttggtgcccagtctggagcgtantccgacaatactgctgacattagcggctcgctaaaccgcttctgaggtttgctccgaccccactggccgggaacgaaaaaccccaaaaaggggggcccccgggggtttataccaaaacccccgtgggacccttgggggaaaaaaaaggttttttttaggggccaaagggggggggggggcgctcttttttttgggggacccccccccccctttttttattccccccccccccccccaaaaaaaaaagccggggcggggtttttttttttttcctccccctcccggggggaaaaaaaccactgggggggggggggggagggggtgggtctcccccccccccccgcccttttttttttttttatccccccccccccggggggggggggggggtgtttttttataaaaaaaaaaaaaaaacccccgcggggcgcacccacaaaaacccatttttttttttttttttctaacaaaaaaaaagaaaaagagggnggngnggccgggggggcgaaaaaaaaagaaaaaaaaaatttttttttttttttttttcctgggggcccgcccccccccccccagaagggggggggggggggcgccaccccctctttttttctttttttnncgggggggggaggaaaaaaaaaaanaaaagaggggccgacccccacaaaaccccttcttc

SEQ ID NO: 16670 - DNA, 908 bp, Xenorhabdus bovienii
  unsure (1)..(908): unsure at all n locations
ggggggaggggggggggaatgggnnnngccnntgggggggggggnnnnnnnanaagaaaaaaananancnnnnnctacccccccggggttcctttttttttttnnnnggcannnncnnccccggggggggctctttttactttctttnggggggggggggggnnnnncctcnggggnnnnccccntttgggggggcccccggggggggggnntttttttttggggaaaaancccgcggcggggaaccttttnnaacancctgggnnnacttttncccccgggttnaactttttnccttttttgggggttaaccctttttttttttncccggggggnnttaacnccaaggggccgggctcctggggatatgggggtgggggggggggttttcccctttcccaaaaaaaccggggggcctttggggggggcgggggaaataggggggggggggggggttccccccccttttttccaccccgggnnagggggggggggccccccgggggggggggcccccaaaggggggggggggggggggaaaaaaaacggggggggctcgggggggggnttgggggggggcgtggggggggacacccccccccccccggcgggganaaaaaagggggggctcgggggggggggggnaaaaggggggggggggananaaaaaacccctttttttttttttatatancncnagaggggcccattttggggggggggagccccggggggggggggnnnnnnnaaaaaaaaaaaccccccccggggggggggaggaatttggggggggggggggtggtgtccctcccccccggagagagggggggggggtgttttttttttttttttnnaaaaaaaaggagaggggggggggggggggttttttttttttttttgttgggggg

SEQ ID NO: 16671 - DNA, 774 bp, Xenorhabdus bovienii
  unsure (1)..(774): unsure at all n locations
gctctgctgcctgcgtcctcttactatatatcacgtcggctacatccgtgtcatataagatcttgttcttgctaaatcttgattgtctagccgtttcggcgaaaggtttactttgggttttccccccctttggccttttttaaaaaaacccggggcccttttttttttttaaaaaaaattccccccgtaaaacacggcgttttttaaaaggtttctttttttttccggggggggaaaaatttaaacccccccccccaagaaggggggggnnnnnccccatttttttttttttttataaagaganngggagagaaaaaaaaaaaaaaacccttttttttttttttttttttttgggggcgcccccccccccccccccacacgaggggggtggttgtgtgaaaagaaaaaaaaaaaaaaaaacaaaaaaaannaatntggcggggcgcgcaccacaccacaaaaaaaaaaagggagggggttgggcnnnnnnantttcttttttttctctccggttttttaatgtgggggagaaaaaaaaaggagggggggggggggggggggggggcggggggggaggaaaaaaaaaaannaaaaaaanccgccgcgggggggggggggcgggccccccccccnnntttttttnnnncttttttgtttttttaaaataaaaaatcaccacccacccccttttttttttttttttttttnttttnnggnannnngggggggcgggcgcgccccccccccccccccccaccccaaacccacacaaat

SEQ ID NO: 16672 - DNA, 894 bp, Xenorhabdus bovienii
  unsure (1)..(894): unsure at all n locations
nnngggggnnnnnnnnnnnnnnnnnaaattttcgannccacaccaaccgggctgcgcaactgtgagcggtgcgtcccacccggagggcnataaaacactccnagattttcnncnnntttaaattacaccaatatncgngacccggtnnaccccggggnancctnctnangatnnctgcccttgctttncagctcgnacaatnannccgttgtnctggtntggaancggcncatntggngnccaggggnaagattaaggcgaacgaatggctgnanatncaaaaaatactatccaatattttttcaacagcccactcttcacatgggtaaccggaaaggggctttttggggggccttaaaaccaatccgggggggacccaaaaccaaccgggggggaaaaaaaaaaaacacaccgccgccgtttgggccccccgggaaaaccccaaaaaaaccccccggggtttacccccaaaaaacaccccctttttaacccccccgggtttttttttcttcgcggcnccaaagagaaaaagagtttttttttccccagaaaaaaacccccccagggggggcacccaggagttttttttaaaaaaaaaaaacacccccccccaacanaaacccccccctttttttgggtttttttgggggggggggagaaaaaaaataatttctctccccgcggggggagagaaaaaaaaaaaagaaggggggggggggnggtttaggtnnccccccncccccccaanaaaaaaaaagaggaggtggttttttttttttttctaaaacaaaaaaaagaggaggagnnnnnnnnttttttttatnnnttgtgggggggnttttttttttgttgtgggggggggggggggggaaaaaaaaaataaaaaaaaataat

SEQ ID NO: 16673 - DNA, 700 bp, Xenorhabdus bovienii
  unsure (1)..(700): unsure at all n locations
tgtacgattcggctcgtacccgngatcttaggnctaatggtcttttcctgttcagcatgcttatgaaggttgacttgccggttcaggtttgggccccccgcttaaataaaacaggattttgccccgggggggggggtttaaaaaaccctttttcccaaaagggggccccctttggaaaaaagattttttttttttaacatttttttgggaaaaaaagggggttttaaaaaaaagggggtttttccccccaaaaaagggggggttaaaaaatttttttttggaggggggggggggggggtttttttttttttttttgggggggggggggggggggggcgccctttttttttttttgggcgcgccgggcgggggttttttataaaaaaaaaaagggggggggggggggggggaaaaaaaaaaaaaaaaaacccccccccccccccccccccctcttcccaaaaaaaaaaaaaaaaagaggggggnnanncaccccccccccccccccccccccccccctttttttttttttnannnnnnaactttacaaaaaggggggggggggggggggggggttttttttttttttttttnaaaaaaaaaaaaaaaccnnnnnggggaaacccccccccccgggnnggccnnnnnnnnaaagggaaaaaaaaaaacaccctccacaccttttttttttttttgttgtgtt

SEQ ID NO: 16674 - DNA, 1022 bp, Xenorhabdus bovienii
  unsure (1)..(1022): unsure at all n locations
atgcttacgaaatcgaccttcgtacccggngnacctctaaagtcgcagctttcatttntatagaatagacagtttgagtaaatgaaattattaaaaggccgataaaaccaggagggccctaaagggttttttaaagggaaaagaaaatttttatttctttgggggcgggaaaaaacccaaaccccccaaaattttttttttaaaaagaggaaaagccccagccccttttttttaaaaattaaaaaagttttttttttccacacaaataatagggggggttttccccccccaaaaaaaaaaacccccacaaaaaaaaaaaccctctttctttttcccgggggggagggnnnnaaaaaaaaaaaaaaaaaaaaattttttttttttttttttttttttttaaagaaaaaaaaaaaaaaaaaaaaaaaaaaaaaaaaaaaagagaagacctcttcttttttttttttctttgaaaaaagaaaaaaaaaaaaaaaaaaaaaaaaaaagaaaagatatcccactccccctctctctcctctcccccgcgcccgcgcgaggtggaaaaaaaannaaaaaaaaaaaaaaaacaccccccgaaaaagggggggagggggggggggggggggggggcacagagataaaaaaaaaaaaaaataaaaaaacaacaaacagggagggggcggggggggggccccaaaaaaaaaagagaaaagaaaatttaaatattttttttttttttttttgtgtgggggnggncccccccccccccccccccccccccccccccaacccccgaaaaaaagaaaaaaaaaatatttttttttttttttttaatatttcttctccccccccgcggggggggggggggggggggggggggggggngggncccccccccnttccncccnccctntttttttttttttcttttttttttnnnnnnnnnnnaggnnnnaggggggaacaccccccccccgccctcctcttctctttttttttttcttattaattataaaaaaaaaaaa

SEQ ID NO: 16675 - DNA, 1185 bp, Xenorhabdus bovienii
  unsure (1)..(1185): unsure at all n locations
nnnnnnnnnnnnnnnnnnnnnnnnnnnnnnnnnnnnnnnnnnnnnnnnnnnnnnnnnnnnnnnntttttatttggcntncccgggggtcctagggtgnnnnntttatgttnggggtgnntangggggggggtcggggggnnnnggttgntntggtnngtgnnggagnnntnnnttnnnnnnnnnnnntnnnnnnnngnntgnnnnnnnncngggggggtgttttttttagcacgcaaaaaaaattttttgccgcgggggaaaggcctttttttgcgggggggggataaaaaacacccccccgggggggngggggggggggggtatcccttctcttaggaagttccctgtgtngcccgcgaaacaacccgggggttcctttttccgggggtgtggggggggggggggancnaccccagagaaaaagggggtttttctttttttttttaaaaagcgggccccttttttggggggggnagataaaaaaaaaaaccccnccncacncnaaggngggtgtgtgtttttctctcttttatttttccgccgggggggagaaagtataatctctccccggggnngggcccccccccgcgagaaaggggcccccccccgagggagaagaaaaaaacatacccacccggccgggcgcgcgaaaaaaaaaaaaagggggnccccacacaaacaactttttgtggggggggggaaataaatatttcttttctttttcttctcttcttttgtggaaaaaaagcaggggggggggggggggttcacaaaaaagaaggagggggggggtgggttgtggtgggttgccccccccaaccaaacaagggaaggnggggggggnccccccccccccccccgcggtgggtggggagttggggcccccccccccccccccccctttttttttttttttatgtgtttttttngggggtgggggggggggggngnnttttttttttttttaaataaaaaaaacaaaaacaacaacaccctctccccccccttctttttttttttttttnttttttttnnnnnnnnnnnnnnncnnnaaaaaaaaaagagaaaaaaaaaaaaaacacctccgccacatttctaataatnnnttagttgagaagaaggggaggggnggngncccccccnccccnnccnnaaattaataactttacaaaacaaaacaacaa

SEQ ID NO: 16676 - DNA, 688 bp, Xenorhabdus bovienii
  unsure (1)..(688): unsure at all n locations
tgattcgaattcggctcggacccgggatctcagagcggattatctatgcnntacacaggtaanttatttgaattttttactgtggntccantccaagacataaaaatgggttcacctttaaaaacaaaattttccaaaaatacccccccatatttacaaaacgggtttttaatttccgggcccaaaaaaaaaaaaaacacggcggggggaaaaaaaactttttagagggaaaaaaaaaacccccttaataccaaaaaaaaaaattcccccccggggggttttttttgcccccccccccacgtggggggggggaaaaaaaaaacctctttgggggggggggggaaatttttggggggggggggggttttttttttttttttttttggggggggggggtgttttttttataaaaaaaaaacaccccccgcggggggaaacccccctccctccctggggaggaaaggatataattttttttttttttccccccccggcgggggggggggggggggggggggttccttaaaccaacacacaccgggggggggggggggggggggcccctcccctccccgggggaaggagagggggaagagaaaattttctcctttttttttttttttttngggtggaacagcggcccccccccccccccctttgatttttggggggggggataccaaataaa

SEQ ID NO: 16677 - DNA, 863 bp, Xenorhabdus bovienii
  unsure (1)..(863): unsure at all n locations
acttttcaatcagctcgtacccgggatccttagatcttnacaaaaaactcgtacttnanctgtanntattctnnncctnccgtactncatnaaanttccntatggggcgatttatttactgggattttatattaccatagactataggaaatcggcatatncattaacgaggagaatcattggcggggggggatacttanatnataanctnatttgntcatgatgacattggacaannnttacgagggaganccaanaaaaacannnncccnaaagttttttttnnccnncccccggttgatttcttttgncanntatttaccccggaaaccttccccggtttntccaccccccgggggggnnnttaacccttnccttnaganggatncctcgccccccaannaaatttaancttgnaacattttttcctttccttttttccccatttttttcccctggttttatataaaaccgcctttttccccccccaaaaatctttttttttttaaaaaaaattttccctctttttttgcccccggctttctttgggcccccttttttaaaacaccccgccggtttttttaaaaaaaaatatttgtgtttttaaaaaaaaaaagaaaaataactctttttacacaacacacccggggnaaaaaaaaaatttttttttttnngggggggaaaaaaccccccccaaaaaaaaatttttttcccccccggngnaaccccccccccaaggggaaaacccccacgcggggtcttttttttttttctccacccaaaaaataatatttttcttttttttctttnnnnaaaaccacccccacagtggtnactcccctctttcttctacttttctnnca

SEQ ID NO: 16678 - DNA, 801 bp, Xenorhabdus bovienii
  unsure (1)..(801): unsure at all n locations
cagcttgatgcctgcaggtcagccaaatggcaagtcaacttttattgtctgtgaacagnaaatgggnnntnnaaaatttttttttttnntttnnnnttttggggggggnnccccccaaaaaaaattttttttttaaaaaacnacaaaaaacaaaaaaaaattttttttaaaaaaaaaaatttttttttctcttttccccctctctccggncttttttttattttccccctttttaatttaaagccaagntaaaaaaccctttgaaaanaaataaaaaaaagtttccctaaaatccttgaattttaaaattaaatgtaaaatttttaagaattttacccattaaaatttccccaaaaaagggaggatttaaaaaaaacccttaaaaaaaaaaagggcccggcccttccttgttaaaaaaacccctaaaaaccttaaaaaaaaaaaaattttgccccgctttttaaaaaaaaaaagggcccaaaaaaaaaaaaaaaatttgggtttttaaaaaaatttccccacccccccaattttaaaaaaaaataaaaatttttaaaacccccccctgaaatctccccaaaaaaacccggaaaaaaaccccttttaaaaaaaccccccgggggaagaaaaaaaaaaggggtttttttttgaaaaggaaaaaacccccccccctttttatacacccccccccccttttgaaaaaccccccccccccccccaaaaaaaaaaaaagaagggttttttttttttttttttccacacccaaaaaaaaatcttttggtggaaaaaaaaaaaaaattt

SEQ ID NO: 16679 - DNA, 671 bp, Xenorhabdus bovienii
  unsure (1)..(671): unsure at all n locations
gatctgtgatgccgcagtcctattgacgaagctcagagaatnacatatgcaggaacatgcccgtgataataaatgctgtgaaaatgccgagcatacatccaaaggcaaatgcacccagggttttaaaaagcgaaaaggggcccctttcgaaaaaaactccccaatttggggggcccaaaaaaaatgtggggcccctaatttaaccccaaacattgggggggggggttaaaaaaataaattttnaaaaaattttccgccggaaaattttttttgggggggggggctcccccccccaaaaaaaaggggggggggggggccgaaaaaaaaaaaagagggggggggggggaaaaacacccccccccnnnnnttttttgtttttggnaaaaaaaaaaaaaaaaaaaaaaagntttttttttttttttgtcccgggggcgcggcggccggaattttttattagggggagagggggagggagggaggggggggccttttttttgggggggggggggggggggggnnnnnaaaaaaaannaccacaaacaccccntnttttttttttttttttttttccggtgcggcggggnaaaaaaaaaaattncttttgtgttgtannnnnnnnnccccccccccccnnccccgggattatnnatttttttgggaggggggggaga

SEQ ID NO: 16680 - DNA, 1256 bp, Xenorhabdus bovienii
  unsure (1)..(1256): unsure at all n locations
nnnnnnnnnnnnnnnnnnnnnnnnnnnnnnnnnnnnnnnnnnnnnnnnnttgaaaacaccaacccccagccgccaccagtaacaaagcaaaaccaccaggcccaagaaaggaaccatcaaccacaaaaacaccggacagcgcagagaaacgcaccccttcaccatgcccctgccaaggggtcccaaatntntggccctccccctgnaaacctggtaaanccctgnaaaccaaaagcgccaaatccctcccggggngtntntcccggggcgccaactcccattggggnggggatntcccggccccccaacccccccggaaaaccgggaaatntcaaaaaaatggccccgccccnttttccaagcccggaaaattttccacaagggaaaaaactcccgcggtcacatgtggaaaaaaaaaaaaccccctttttataaattgggcaaaaagggggaaaaaaaaaaaaaggggccgagaaaaagcccgcgccccaaaaagagaaaatatttccaacacaaaaaggagngcgcccttttttgggcgccccccccccccccgggaaaaaattttaaaaaaaacaaaaaaaaaaaaaaagagggcgccccccgccgccccaaaaggccaaaaagaagagaaaaaaaaaaaaaaattttttgtggaaagaaaacaaaaagagaaccccccccctctttntttttctctccacaccaaaaaaaaaaaaaaggggcggggggcaaaaaaaaccaaaaagggggggggggaaaaaaaaaaaaaaaaaaaaagaaaagagggggggcgggggccccccaaaaaaaaaaaaatatatttttatatacccccgccccccgccccccaaaaaacaaaaaaaaaaccctccccaaaaaaaaaaaaaaggagggggggggcggggggccaaaacaaaagggcgagaaaaaaaaaaaaaaaaaaaaaaaccaccccccccccgcctaattaaaaagaagaagcgacaccacaacccaccaccaccccccccctgtcgtctccgcggcggagaaaaaaaaaaacaaaacaaaaacggcgcggcgcttgacgtcaaaacaaaaaaaaccacacccgcccgcccccccacccccccctcccgcgccggcgggagagcgcggaaaaaacaaaaaaaaaaccacccccccccccagtaacacaaaaaaaaaaaaagaagagggcgggcaccccgccccccaccccccccgcgcgtcctggaggagcaaaaaaacaaaaa

SEQ ID NO: 16681 - DNA, 932 bp, Xenorhabdus bovienii
  unsure (1)..(932): unsure at all n locations
gaggtangaaagggggnnngtacgttttttnnctagactcacggatatngccngggaaacctcccggcgcgggnnnntnnnntntccctcttcccccggagggggggggggnnnnnnttttaaaatacccccctcttnnnnnctttttngggggaatggggggaatattnnncctcttttttttncccnaacaatattaaaaaaaaaaaacccttccccctttaatnnntttaaggggggtttttaagccccaaaaagaggggggctttgaaataaaaaccccgggagggggggttttttttaaacttttttttttttatccccccgggggncnccccccccgggcgggggnnaccccccgagagggggggaaataaaaagggcacccttttataatnaaaaaattttcccccccatttatttttttggggggggcccctcttcttgtgggggagaggggccccctctctttttntttgtttttgggaaaaaaaaaaccccccctttctggggggggggnaataaaagaggaggggatttaataaaagggggngnaaaaaaatataatccctctttgtgggggggnggngaaaaaaccccccccccccctcctttttttgtgggggggggnacaaaaacccccccccccccggcggcggcgggggggttattnttatatttttttgagttggggggggcgcnacccccccccactatttttttttttgctatattattttatttctttttnttttttttctcgccncaaaaaaaaaaaaaaagaaagnnagggttgtggggggggtggggtaagaaaaagaaaaaaacccccccccccnnagaagaaaagaagaaggagagggggnnnnnnnaaataataatataagagggcggtggggnntttttttttatttatgggggggggagcgcca

SEQ ID NO: 16682 - DNA, 1017 bp, Xenorhabdus bovienii
  unsure (1)..(1017): unsure at all n locations
ggggggcaaagggggnnnnnnnnnnannnnnaaacaaacctggnnnnnnnnnnnaaaacccgggggggnnnntttttntttnnattnggggggggggnnnagggggggggggnnnnnnnnnnnnnnnnnnattnttttattttttntnngngngnggnggnnggnnnnngnaaagnaggnnnannnnannnnnnngnnnagattttttgttggtttttgnnnnnnnagnnnnaaannnnnnnnnggggggggngggagnnnannnnnnnnnnnnnnnnnannnaggggggggggggggggggggggttttttcctccccccccccccccccttttttttttccccccgggggttaaacttggaatgaggggaanantcgcnnggaaacccncgcnggataatacccggggnggnnntaaacccctnncccnnggaaggaatncccgnnccctnnaaaaaagggggaanaggnnaaaaaaaagttctgtctcgggtggnaaaaaaccgggncccaccccctttctcttttgggtccgggnnaaatgggtnccctttttggcggccaaacaaggccctggaacccccaattncaaaaatcccccggggcccaaaaaaccgggtccccgggaagcccccggttngggaacggtttttttggaaaaacccaaccaaaaaggaaccgggggccccccccggtttgggaccgttggcggggggaaacccccggggcaaaaaacaggggggtaaaaaaaaaagaaaacccctataaaccgggccccggggaaataaaaaaaaggggcggcggaaaacccccccggggggggggcgccggcgggaaaaaaaaaaaggggccggcgccccccccccaaaaaaaagaaaaaagggggggccccccccggggggggggggagaaanaaccccccccaccaccccctcttgggggggnagagaaangggggaaaaaaaaaaagccccccccccccgcgggggggggagaaaaaaagcgaggggggggac

SEQ ID NO: 16683 - DNA, 1022 bp, Xenorhabdus bovienii
  unsure (1)..(1022): unsure at all n locations
tgccnnnnnnnnnnnnnnnnnnnnnnnnnnnnnnnnnnnnnnnntaactctccgagggaaaggagcccgtgcaatgctacccccagacggaagccggtctggaggcaatccaaactgacatagccatgctggataagacgagcgtnccagncctnacatgtnataacatatggccgccccctttcctgggggggggaaccccaaattttaaaaacccggggggaaaggaaaccacacaaagagccccccccacccctttgtggggaaaaaacccccccggagaaattggggggccccccccccccccccccgcggagnaaaaaagaccccaggggggggctttcccacccggggggaaaaaaaaaccggttgcccccccaagaggggggggtgtaaaaaaaacaccgcgggggggcggggaaaaaaccagagaggggcccgccagaaaccccccacacatttttttttcccccccggtttgtctgccccccccttttataaaaaagccggggggggggggtttttttttttttgggggcccccccccctttgggtgcaccaccacgaagaggggcccccctctctttttggtgggggcccccccccctttaataaaaaaggaggggagaaaaaaaaaaagagggggggggttttattttttttnaaacactctcttaaaagaccccccccccgaattttttccccccccacaaaacaaaaaacctcccttcttttttttttnnaannnnncccccccccccctccttttttttttttatagagggggggggggcccccccccccgcgnaggnnaaaaatnacccccccccaccccgcgcggcgggggggaaaaaaaaaaaaaaacaaaatcccttctctctnctcctncttntaaaaaaaaaaaaaaaaccccacccgcgcccggggggggggggaaagaaaacaaaaaacaccacccccccctcctttctctttttnntttnnnnanaaaaaannagggaagaagaggagacccccccaca

SEQ ID NO: 16684 - DNA, 827 bp, Xenorhabdus bovienii
  unsure (1)..(827): unsure at all n locations
gtgctttcaattcagctcgtacccgggatcctctgagtcctcagtcctcgncgagtcggatttaccgcccgtcgttagctaacgtttattggcgtttcgctggagaaccgaaccctgatttttccctgggggggcgccggaaatctgggtttcccccccggaaaaaaacccgggggtttgggggcccccggggggttttttccccccaaaaaacaccggggggggggggtggggcaaaaacccgcgggcgcggagtgtagttttttttgttttaaagggggggccccacccccccccttttttttggggggagagtttttttttggggccgccccccccccccccccccccccccccggggggggggagggggagcaccattttttttttttttttgggggggcgcgccctccttgtttatttttttttgtgttttttgcgagataaaaaaaaccccctcttttttttttttttttttttccccccccccccggggggggggggggggggggggggggatatattttgttttttttttttttttttttttattagaacaccaaaaacaaaagaggggcggggggccgtttggtatattataaaaaaaaaaaaaaaaaaggcgcggcccccccccccccccttttttctttttttttttttttttttggttgggggggggctcccccctaaaaaacaggaggggagaggggagggggggggtggggcgttctctttttttttttttttttaaacaaaaaagaagagagggggggggggggggtttttttttttttttttttctctcccccacccacccacacagggag

SEQ ID NO: 16685 - DNA, 1047 bp, Xenorhabdus bovienii
  unsure (1)..(1047): unsure at all n locations
ggcatacttgcatgcctgcaggtagcatccagttagtaaatttgncggtttggnncaggnaattttttnggggnnnnttaanccccaaaatttaannncctctttttgggggggggggnttttttttttttttnttnttatatatatatatangntatatatatataatagngngaatatatatatatattttgtttnnnnnggggcgccccgcgccccccccctccgccgcgcggngggngnnnnccttttgtggggnnnaaaaaaaaccctataatttnnncccccgaggncccccccaacactttgggnnnnaaaaaaacggnnnaaaccgggtttnncccaaaganccccgggggccccncccggggncccttttttcccgcggcccctttttttttntttccccccaaaactttttaaaacccccccacaaaccccccccaagagnngaagaaattttnnattattttttccccccggggggggggtttttttagagagggggaggagggtataatataaaccccccagggngggggttnttttctcccgggggggggggcccccaaaaggcccccggggtttttttttaaacacccgcggggggggaaaaaaaaaaaagggagttttttcccacaaaaaagaaataataaaacccccccccccccccnctttnttttntttttttnttttttttctcccccccacccacacacaaatattctttttttttntttccccgcggggggaacaacccccccacaaaaaanaaaaaaatttatattttttttctcctccaaaaagaggggccccccccccccccggcgggggggggggnccgcgcccccccacaaaataatatttttttttttttttttttttttgggggggcggcgcggtgtgtttttttttttnnnaaanaaaaaaaaaaacaccacccccccacacaaaaaaaaatatatttctttttntttttttttttataaaaaaaaaaaaaaaaaaataatataagtgggggggggggcggcccccccccctcctcca

SEQ ID NO: 16686 - DNA, 704 bp, Xenorhabdus bovienii
  unsure (1)..(704): unsure at all n locations
tgannnnnnnnnnnnnnnnnnnnnnnnnnnnnnnnnnnnnnactgctgtcaccttgatcgcgaggntgacgagtcttgaagattgagattctccagatactcagtaatcgatatgaatatcgacgcgggtcgaagccttgcaantggcatatcccgctgtccgccatgggtgaaaaaatccttcttagccccaccttgattgggacgggcctggagtttaaaggggggttacaattggacccccaatggagggggggtgcccaacccggaaccccctttttaaaagggggcttttatgggcaaccgggtttttttccggggataaccccccccgcaaaatatttttgggcgcccgcaatttttcaaaaatggggaatttttttaaaaaaggggccccaatttttttccccccccaaaaaattttgggggggttttttaaaaaaaaattgggggggggccccgtttttaaaaagggagccccccggggggggccccctcttttttttttttttctcccaataaaaaaaaaaaaaaacccccgggttttttttttccaacaaaaaaaaaaattttttttttttttttttttaaaaaaaaacacggggggggcctcttttnaaaaagaaaaaaacctcccccaaaaaggaaaatataaaaattttttttttttttggggggggggggaggaaaaaaatataccgggg

SEQ ID NO: 16687 - DNA, 813 bp, Xenorhabdus bovienii
  unsure (1)..(813): unsure at all n locations
gctgggggggagcaccacgcctctgccggatgngaagggagtagtcccgggccgcggttggggttttttaccgccaaaaaaaaaggggggatatccgggggacccccccgggggggggaaaacccccccctccaaaaaaaaaccggggggatttttttttttttccagggcagaggttttttttttgggggggggggggggggaaaaaaaaaaacccccccaaaaagagagggggggggggaaaaaaaataatatttttttttttaagaaagcgtgttttttttttattacacaaaaaaaaaaagagggggggggggggccgccccccgcggagaagagaaatttttttttttttttttcgggggggggggggggggggggaaggaaaaaagaaaaggagggatggggggggngncgcaggcccccccccccccccctcttttttttttgttttatttttctccccccacccccaccaaccaanaaaaanaaannaattatttttttttattttttattngtggggggggggggngggggtggnttatataattttcttttttttcttcttcccccccccccccncacaaaaaaaaagaaaaaaaaaannagngggagggggggggggggggnggggtntatttctttcccccccccaccccccccccccccccccaccncncnaagacaannaannaagaaaagaaagagggagaaggaggagagagagggagagannnaanaaaaaaaaaaaaaaaaaacaaaaaaaannnaaaattatnntntctcctcctctttcttctcattcttctc

SEQ ID NO: 16688 - DNA, 871 bp, Xenorhabdus bovienii
  unsure (1)..(871): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttggtggggggtggcccccccccccacaaaaattttgttgttgttcccttttaaaaaaaaaaatttttttggcgggggggggttgtttttttttatattgtaaggagaantattattttaatccccaacctttctttctctcccccncnccctggggggggtgttctcccaaaaaagaaaaattttttttttttttttccccttcggggggggggcttctccctcctttttttttcttttttaggggggcgggtttttttttttttttctcccccctccccccacnagnaaaaaaaaaaaaaaaaaggnnnnncccncttttcctccgcggtcgttttttttcttttcttttaaaatataaaaanaaagtntatntagantgtgtgtgtggggggtgtgtcg

SEQ ID NO: 16689 - DNA, 510 bp, Xenorhabdus bovienii
  unsure (1)..(510): unsure at all n locations
nnnnnnnnnnnnnnnnnnnaaaaacgcgcggggcagnannnnnggnnnnnnnnaaaaatacgacggaccatcatcgggcgtagcaacggaccgcaaagagcagcaaacaatggcccttgaaggaaaaaggcccccccaacccaagaaacccccccttttaagggggccaaaagggggaaaaccccccgggggggactcccccccggaggaaaaaccctggggggccccccccccaaaaaaaaaaaggggggggaaaaaaaaaaaaggggggccccccaaaaaaaaaaaagggttaaaaaaaccccccccccaaaaaaaaaaaaccccccccccccccctaaaaaaaaaaaaaaaaaatattttttgggggggggggggggtaagggggggtttttcccccccccgccnnnccnnnnnnnnnnnnnnnnaanggagggagggagggaaaaaaaaaaaataaatanngnntnngnggggggggcgggcgccgccttcctttgtgccccggga

SEQ ID NO: 16690 - DNA, 1001 bp, Xenorhabdus bovienii
  unsure (1)..(1001): unsure at all n locations
agatacgatcgagtcggaccgggatctctagagctgacgttgagcacacaatggcgctggcggtcgtcaaatcaccgattgggaagggaataagcctcatgcaccgggccccccacttaagggctgggggaaaaaacccgaaaggaaacgcggggggaaaaagtttgggaatccccccccaaaaaaagggggaaatttttcggaaaaaaaaaaagggcgcccgcccttttttttttttcttcccccccaaaaaagggaaaaaaaaggggggaaaaaaatttttttttttgggggtggggagagcggggaaaaaaagggggggaaaaaaaaaaaggggggggcggcgccaaaaaaaaaaagaagggtggggggggggggttttttttaatacccccccccaacttcggggggggggggcccccccccttgtgtttgggggggcgaagaaaaaaataaaaaaataaataaaaggggagggggggggggnaaacaaacccatataataaaaaaaagaaatgggcgcgcccccccccccccccccccccccgggggggagaaaaaaaaaaaaaagaagaaaagggggggggtgggtggtgttttttttttttctctttccaaacaaaaaaaaaaaaaaaataaatttgttttgggggtgggggtgggaagagggggggnaaaaannnaaaaaaaaaannnnnnnntttatattttttctcttttgggtggggggagggtgggaagagaagattatacactccctcttctctcccccggggagagaagaaagaagaaaaataaaaaataaattttctctctccccccccccgcgcgcccgccggagggggganaatgnaccatttctcttcctccccccnacaataaaaaagaaaaaaaaaaaaaattttattttttttttttgttgtttggcgccgggcggcggcgccgtcgtgtgttttttgtnnaaacaaaaaaaacaaacaaccaccatctctctgttttta

SEQ ID NO: 16691 - DNA, 878 bp, Xenorhabdus bovienii
  unsure (1)..(878): unsure at all n locations
atgtacatcgagctcggaccgggatctctagtgctatctacgagtatcgcagcacatcaccagcaagattcgctcttttgatgggggactaaccgtttccaatcggggatagaaccggaaaaaatttgtcccggttttttggccggggggttcctttgttttgaaaaattcctttgggggccccctgggccccgggggggtttccccttacaaaattttttttttgggggggacccccttttttcccctcttaggtgcccccccccccccccccccgttttttttttttttaaaaaacaaacgggtgtttnnnccccccccccctcttttgaganttaaagggggggggaaataaaagnnnccntnggaaaagtcttcttttctcttccaaaagggggggccccccaaaaacaacatcccctctcttttttttgtctttcccccccccccacccccaccaaaggggggtgtttttttctttccccccccccccccggggggggggggggggtataaaataaaaaaaaatccctcctcccccgcccccccccccagaaaaaaaaaaaaaaaaaaaaaaaaatttatttttttttttcttccccctcccccccacaaaaaaaataaaaaaaccccgcgcccgccgcgggagatcccccccccccccccctccccccccgggaaaaacccccccccccccccccccccccccgcccgtgtttttttttattaaaaaaaacaacacccccccccaccctccctccccccccccccccccccccccccncnaaaaaaaacacaacgggggggcgccgcccgcaaaaaaaaaaaaaaaaaaaaacattataaatttattcctctcccctcccgccccaagaaaa

SEQ ID NO: 16692 - DNA, 758 bp, Xenorhabdus bovienii
  unsure (1)..(758): unsure at all n locations
atgtttannnnnnnnnnnnnnnnnnnnnnnnngnatccctctaaaggtcttattacccagcgggtaagatggccagggcccgtttacaaatccgggccaaaaggggggaaccccccaggaacccctttttaaaaattggaactctttcgggggaacggcggggagaataaaaattctcaaaaaggagcggtttggggggatttttttgtttttaaacccccctttgtggggggagaaaaaaaaattctttttcaacccatctccgccggaaaaaaaagagattattattttgtgaggaacaaaccccgcgcgggaaaaaaaaaaatttctaccccccccctttttttttgtggtggggggggggaaaanaaaataaagggcggccccccccccccccccccccctatatataatataaaagggccgccctctttctataaaaagaaaggggggcgggcgcgccccacgccacgcagacgaagagagaacggggggggggcggcccgcgcgggcggcggcgcggggcggggggcgtggtgggtccgggaggcggagcagggaagagagaagagagaaaacaccgnctcctcttcttcccccttcggccgccccgcaccacctaaaaacgaagtagagggaggggatggggggcgaggaggaaagcggcacacccaccactctattttcttattttctccctcccncnncgcgcggcgggggggngggggggggcgaggaagaaacaactccaccgcacc

SEQ ID NO: 16693 - DNA, 1289 bp, Xenorhabdus bovienii
  unsure (1)..(1289): unsure at all n locations
cccgccccgggggggggngnnnnnnnnngnnnnnngcnnnnngnncnccccgccgcccngcaggtttacccaattccgaaccccgcaccccggggaaccccctaaaatcccgctagacctacctcattccgcgagtacgctgctctcattacaaagcccacgatgaggatccactgaccaaacactccggtgggcacacttgcataccaaccgaagacccccctatgtaccagtatattttcatacacgagacgncgcccccgtttcaagagaattttttatttataccacacagcggaaaataaaaanaccgcggcggggagaaatattttgggcgggggcctcctcacctcacacccccgcgggggggnggggggggtataaaacaacacccccccccctcccttcagaaagaagaagaaaacccctccctccgcgcgcactaaaaatatagggggggggggccccctcttttttgttttgttttgcccgcccaaaaaaaaaaaaaaatattttaatatatgggggcgggaggcgcccccccccccccaaaaataaaccccctttttttttttgtgaaggggggggaccccccaaacaaaaaaaacccggcggaaaaaataaaaaaaaaaaaggngccccccccccacccctatatttggtgtaaaaaaaaggggggggggggtgttttttttccccccccccccccccccaacacaatataaaagagggcgcgggcgcggcgggtaaaaaaacaacccccccccccccccccccctcctttttttaataaaaagagagaggttctttattaaaaaaaaaaaaaatatcttttctttggggggagggggagaaaaaaaacaccacacaccctccctctctccttctcttgggggggggnggtgttttnnnnnnnnnnncaccacacaaaaaaaaaaaaaataatgtaannnacaagnagagggcgcgcacgcccaccttctttatatataaccagccgncggngggaatattttntttntggngngggggggngaggnnnaaaaaacaaaaaaaaacaccacccaccccnccaccaaaagaaaagaagnaaanatgttatatttcnttttatncaccccgnataatgaagagaaagagaaatatagatnnttnaatactaattatctttttcttctctttcnnnccctcnccccaccaccnncgcgacccccccacgcgcccgcgcgccggnacccaacatnaaaaaaataaacaanacaccaccaacaccatcaatatacttttta

SEQ ID NO: 16694 - DNA, 937 bp, Xenorhabdus bovienii
  unsure (1)..(937): unsure at all n locations
gggggtnnngnntaaggaggggnnnnnnnnnnaccctnnnnncccnnnnnccnnnnnnnanncnnaggatttttttannnnntttttttttttttttttntttttttnttnnnnnnnannnnnnnnnnnnnnnnnnnnnnnnnnnnnnnnnngggggggggggnnnccnnnnnncccccctccttttttgttttttttttttaaaaaacccccccccccctggggggggggnnnncccccccctccgggggggagaaaannccccccccccccggggnnnacggggantnctttntnnccgaatnnnactaggggnnnggatttaatcgagagttnttgggggnccccccaaannaaanccgggtnntnnttttnntaaatttncccgaatcccnagaanntnaaaattncccctctttnnttnttttttnaaaacccccctnnnaaaaaanncccccccccggnnaacccaaaggggnnaggagggggtttnggggtttgggggnaaaaaaccccggggggcccccccccaaaaaaattttccccccctccccccaaaatttttggggggaaaaaggaagccccccccccgggggggaaaataattttcccccctccacaaaaaaagaggggccccccccggggggnnaaaaatttatttccccccaaaaaaacccccccacccccccgggggggggggcgcggggttnttntaaaaaaataggggggggggaaaaaaaaaaacccccccccccccccgggaaaaaaaaaaacaccccccccgggggggggtccccccccccgntaaaaaaaataaaacaacccccccaccacaaaaaaaaaaaaaaaaaccgtgccgcctctgtcgctaaaaaaaataataaatattttccccccccccccccgaagagaggggggggggccccacacccccccc

SEQ ID NO: 16695 - DNA, 919 bp, Xenorhabdus bovienii
  unsure (1)..(919): unsure at all n locations
tgtnnnnnnnnnnnnnnnnnnnnnnnnnnnnnnnnnnnnnnnncggtataagtgagtgccactctccctggcnacgtnaacctnccatttggccccaaaccccccgggaaaaaattgggcccctttttttaaaaaaaggccttttttggggggggtttttcccccccccgttttgccccccccttaaaaaaaaaaaaaaaaaaccccccccggcggggggtattacataccggggggggggtctcctcccaccggggggggggggggggggccccccccccccgggggttaaaaaaatcccccccccccccacaaaaaagccccccctttttggggggaaaaccgccccccccccctcgctgggggggggggggttttttttcccggcagaggaaaccctttccttgaaaagagatatttttgggggggggggggggcgcgccccccttttctgggggggggggggggggagaaaaaaaaaanncggcggcgggcggggcgccttttttttttttttttgtgttttaaaaaaaaaccccccccccccccccccccccccccccccggnntnnntnnttttttttttttgtttnnnnngnttgaggaagaaaaagagaaagaaaaatttttttcttttgtttttttttatacncncacaacaacaaaccacccccannaccccannnnnnnnnntntttttttttttttttttttgtgtntnnnaanaaaaaggaaaaaaaaaaaaccacccccccccccccccgnggcttntgtttttttgtgggtgggggggggggnanngnaacactaaaactattnnnntctcttcncatccccgccccctctccgcgtccccgtctgggggttgggttcggttgtctttgncctnnccntnnnngngcaaccgactccccaccag

SEQ ID NO: 16696 - DNA, 1188 bp, Xenorhabdus bovienii
  unsure (1)..(1188): unsure at all n locations
nnnnnnnnnnnnnnnnnnnnnnnnnnnnnnnnnnnnnnnnnnnnnnnnnnnnnnnnnnnnggggagatcatccatctcggtccggggaccttgtgtggttttcaggtctggtaggtccctaggtctgggngattttgctgtcccnnnnnnnnnggggnnnnnngggggttttccaaattttggggttttgggtccccccccggggggaaccccccccgggggttgtcctgcaaccccctttttttttcttccccgcgggggggggaaaaatttggtggggggtatttttccgccgccccccccccccccccccacaaaaaaaaaaanttttttttgggggggggggggnaaagggggggggggggaaaaagaaaaaccccccggcggggggggggggggggggnnnntttnnntttttttataaaaaaaaaagaaaggnnnnngggggnaaaagaggaaaaaaaannnnncnttnttttttnncttcggggngggggngcggggggggtgnnnnnagaaaaaaaaaatccnnccccccctccccccctcttttctttttttcttntaaataagaaaagagagggggggggggtggaaanttttttttttttttttttttttttttcccttttttcctcccccccccaccccccaanncaatttttttttttttgtttttggtgggggggggggggggggngggggggggggggggggngcanagaaaaaccccccccccccccttttttcatttttnnnnnnnnnnnggnntntttntttttttttttcttttntnnnnnnccnnccccccccnnccccccanaacnncnnnnnnncnaaaaaaaaaaaaaaaaaaaaaaaaaaanannnnnnnnnnnncnnnnccnnncnnnncnnnnnnnnggggggggtggtggggtgttggtgggtnngttgtnnntntnnnnnnntttnnnnntctttttttttttctccctnttttntntttcttttcnntnnnnnnttttccccccccnncnnncccccccccccgcgnnccnncccnccnnnncccncaancanccaaacccaattattcaccccccccnnccnnnncccnnccnannnnnnnnnnnnnnnnnnnnnnnnnnnnnnnnncncnnnngcnggccgcgggggcggcgcncncttgttttgtgtttctttttt

SEQ ID NO: 16697 - DNA, 1084 bp, Xenorhabdus bovienii
  unsure (1)..(1084): unsure at all n locations
atgcttttacgagattncgagncttcggctactccggnngnatccctctagnagtcctttnatcaccccaccttttgataattatgggcacaggtttctcccaaccgggttttgggactattcncccaatttcccttttatttggcccccaaatggttttggcgcccccgcgtttttttaaaagggtgggaaaaaacatacccctctttttggaaaatatttttagaaaaatttgtcccccccaaaaatggggggggtttttttttttatttgggcgcaaaattttctcccgggggggacaaaaaaaactggggggggggggggggttttttttttcccaaaaaggtgttttttttttcccgccccgggaaaataaaaaagagggggttttttaaaaggggcgccccccccccaaatatttttttttttttttttggcgggggggggggcgccctcttttttttttttggggggggggcgccccccccccctttatatatgagggggggggggtgtttttctttttcttttttttgggaaagaaacgaaaaaccctctttttttgggggaagggaagtttttttttttttttttttttttgagaagggaacccccacccaaaaatttttttttttttttttaaataaaaaaaaaaaaaaaaaaaataaagaggagggggggggggcgcccccccccccccaaaaaaaaaaaaaaaaaaaaaaaaaggggggggggttttttttccttattaaaaaaaaaaaaaaaaaaaaaaaggggggggggggggcggggggtttataaaatcttcttttttgttggggggggggggttttntttctctcccccttataggaaaaaaaaaagagagaaaaaaggnnnnccacccccgccgcccaccgggaccttttttattcccccccaaagaaaaaattttttgcccccccccctctttttttgttggaatatacccagagggtttggtgttttttcggggggagattctctttttcaacaaaaatggtttttcttccacctccctgcggcggtggggcggggaggggtttgtttttttttctcctttttt

SEQ ID NO: 16698 - DNA, 1014 bp, Xenorhabdus bovienii
  unsure (1)..(1014): unsure at all n locations
nnnnnnnnnnnnnnnnnnnnnnnnnnnnnnnnnnnnnnnnnnnccgtacagccgagggcccgtccacggcactccctcagcccatgccgccccatacacgacctcaccccctacactgcccctctcatctggagctcacttcgctggtgcgatccgcgggtcgcggnggacctcttaagcacagaataaattcctcaaacggactcgatactgacctaccggacccctctcactccgacgagataacagcccctctcgncgcccctcccctaaacctgtcagtacctccctaccactnagggannnnnngggggcccaaaaacccttgtcccaggtgccccccgtggcccaagggggtttccccgcgccggccccaaaggggggggccccaattttcccggnaaaaaaaaagttttggtgcgcgggnaaaacccgagagggncaaaacccccacatattttttttttttggggccccggggggggggggggaaaaaaattaaagagaagggggntgtggggganaaaaccccttttttttttnttggggggggggtttttcccgggggggggggccccaaaccccccaaaaaaaaaaatatttttttttccccccaaccccccttttttttttttttccccccgcggggttttccccccaccccccccttttttgtggggggccccccccccaaaggggngttttttaaaaagaggaaaaaaaagggcgcccccccgcggnaaaaaaaaaaccnccccccacaatttgggggggggaaataaaattttttttttccccccccggcgaaaaaaatataaataattttcccncaccaaaaaaaaaaaaaaaaaaatttctcttctctccccccaaaaattatttttctcccccccccccgggnggnggggnnccncgcgcgcgggggggggcgcccccccccccacacaaaaaaaaaattanttttcccccctnttncccccccccctntttttttttttttttgtttttgagggg

SEQ ID NO: 16699 - DNA, 1107 bp, Xenorhabdus bovienii
  unsure (1)..(1107): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcctgcttgctcgcggagggccgaatttggtttctctgcgttatagctaaagctgccatctggaccagtgacgaaaggatgggcaaacttgccatgcctgacagggtcgntgtaatcgngntactttcgtcagnntaaaggggttgctggnccatcaacgncctcgaaagtatatggatggcgcncccttgccaccttgaaaacccntggaaacattaccaaaaatccaaccttggcttggggttggccacccggtgggntttccacccctggccctttccaccccttttcaacccaacccccaaaggggggaaatgggcggaatccacccggggtgtatttccgaaacggccccctggggttgtggggaaaaattttttttaaaaggggggaaaccaggggggggntttttttttggggggaaaattttttttccctttcaaaaaaacacaaaaggggggggccccatatttgggggccccccccaagtgggggggggcacaatatttttttttggggcgcgcccccaacacaaaaaggagggggcgcggcggggtgtttttttcttgttggggagagagagaggggagaaacactctctttttttgttttttccccacacaacgggcgggggnctcgcccaatatggggggaagaacacacctcttggtggggggggggagaaacccacaccccgcgggggtttttggtttgtttttttttgaataaaaacccccgcgcgataaaaaaaaaaaaaaaaaaaaccccccccctttttgttgggggggggcgcggccacaaataataagggggggggccccccctttgttggggcgcccccccctgggggaggaaaaacacccccccttctgtggaaaaaaaaaaaggggggggtgttttttaaaaaaaccaaaaagggggggtttttttttcatcttttgggggggggaggcttttttggtgtgggggggagaccccccccccccccccccccttttttttttttttttggggg

SEQ ID NO: 16700 - DNA, 881 bp, Xenorhabdus bovienii
  unsure (1)..(881): unsure at all n locations
atgcccatcgagattcnnnnnnnnnnnnnnnnnnnnnnnnnnnnnnnttnctgctncctgcttngggcataagggcaaggctggttacgtacaaaaagggggccgaacggttcaatgtcccgggagtcaatcccccttttttggtttaacccggggggcaaaaaatttataccggtttcccccgccggggaaaaaagggggggggaaaattcccctcacaaacgggggggttgggggggggaaaaaataaagggggggggttccccccccaggggagagccccccggaataaaaaacaaccggggggaaaacccccccccctctttttttttcacccccccccccccacaatttttgtgggtttttcttccccacaaaaaatatatatttttttttnttttngccccgccccgctctgctttttttttttttttatttataataaaaacccccccccccccccccctccctttttttatttaattggggggggggggggggggtgtttttttttttttttttgggtgggggggggggggagagagaaaacccccccccccccccaccacaaaacacaaaaaagagaaaaaaaatatatctccccccccccctccccccccggccgccggcggcgcggtatatatttataataataaaaagaagagagggggggggggggggggnnngaaacccccccccccccccccccccctatcctctctgggagaggagagagggggcggggcgcggccgccccccccccccccccccgcgcggggggggtgggggggggggcggggggcacccccccacacaccccaaccacaccctcttctcggtgggggtgggggagagacaacccgcgcgccagctcctgtgta

SEQ ID NO: 16701 - DNA, 980 bp, Xenorhabdus bovienii
  unsure (1)..(980): unsure at all n locations
ncagcttgtggctcccggctggtgtaattggggaggcccaaccacaaataataagtggggggggtgccggcccccaatttttttttgttttttgggggggggaaaaaaaaaattttgtgggggggggcgcccccccccccccctcaanaaatttttttttaaaaaaaaaaaaaggggggggggccccgcccccccccccccctctttgttttttttttatttggaaaaaaaaaacccacccccccacaaaccaaaggtttgggtgggggtggtgtggtttttttattcaccaacacacatttttatttctttctcntcccnanncccgccctcccgcgcgcggggggggttgttattgtagtatataaaaatcccannnnagggttntatctctccccctccggcggccgggcgcnnnacacaaaanacaaacacacaaacacaatcatctatttttntttttttcnttttttttntttattttataatagaagagagaaaaccacgccaagaaannggtggtgggncgcctttttccgcttctctcctccccttttgtgtggcggcgaggagntatttaacaaaaaaaaaaaaaaaaaaaanaaannaaaaaaaaaaacccacccccccctccccgcccgccgccgcgcgcggggggggtggggggggagggagggtatgattatatattaaatattggtgggggggggcgggcgggcgcgcgcgcgggggcgacacaaaccaaaaccccccccccccccccccctcccncncccannccncncctttttttttgtgtcgttttctcccttccctcccccctccccctaataacaatttnctantaaaaaacnacaanaaaaacccactcacacttccacactcttcttcctgcccttcccgcgcctggcgcgcgctcccctgcgtcggccctgccgttgtcaggggcacaaccgggacgacagcgtgcagagaggagg

SEQ ID NO: 16702 - DNA, 1056 bp, Xenorhabdus bovienii
  unsure (1)..(1056): unsure at all n locations
cccccccccgccgccnccgcgccgccccggcgcgncnnccgccgggagcttgatcctgagtcgatttattcggtattctgccaatatggccgcattggtaggtgtatgccggggggnaggnnccnaaagggagggaggggnnnnanaannnnnnggnnnngnnnnnnnnnnnnnnnnnnnncccaaattggactggcatggcaggntctcaatggaaggggggctttngggtgccccatgcttgcggcggncgggaatttggttccctggccccttttcgggaaggggggggggtattttggggcaaattcccttgttgggcccaaattttcaaagggaaattgggggggggaaaaaaaaaaaaaagtgggggggccccccccaaaaaaaaggaaggagaagtggtggtgttttttccccccctttgttgggggggggggggggttttttttttttaaaaaaaacaacctttttgggggggggggttatatttacggggggggcccccccccccccgaggggggggggggggggggtataaaaaaaaaacttcccccgggggggtgttttccccccccccacaaaaaaaaaaaggaacgcccccctcttttttttttgnttgggggggggggggggggggagaaaggattaaaaacacccccnnccccccccccaacacgccaaattaattttttttttttttgggggggggggggggggggggttttttttttttttttttgtggagggggggggggggttttttttaatagagggaggggggggtttttttttttttttttttttaaaagaaaaaaaaaaaaaggcccccggggggggggtggggggggttttttttttgaaaaaaaaaaaaaaaaaaaaaagtgtgtttgttttttttttttgggggggggggggggnngnnnccccctccctcccccccaacaaaaaaaaaaagagaggaggggggggggntnttntttnntttttcttcttttttnnaaaaaaaaaataggggggcaccccccccgcggggggggggggggtttgtatatt

SEQ ID NO: 16703 - DNA, 862 bp, Xenorhabdus bovienii
  unsure (1)..(862): unsure at all n locations
tgtnnnnnnnnnnnnnnnnnnnnnnnnnnnnnnnnnnnnnnnnccaagccaacgttcagcacatcgggnnnnnnnnnggggnnnnnncccctctttnnnnnnnnnttttttaannntttttttttnnnnnnnnnnnnttttatttatnnnnnnttttttttnnnnnnnnnnnnnnnnnnnnnnnnnnncccccggggggggggggggnnnnnnnnccnnnnnncccgcctttaaaaaaaatgtgggggtggnanactnccaccccgnccnaaaaaaaatnaaggggcgggtcctttggcccaaaaaaatacgggggggggaatccatttgggcgcggggtggggccgcctattagggatatgggcgcaaacaaaaactggtttcaagggtatgaagggaatgccaggccaaaagaacccccctttaccccccgaagtaccaccgggcccaaaaaaacttcaagggatttaaagggggggcggatttttacccccctatgtcccgggggcttttccaaaaatttttaaccgcgggggtttttaaaaggggggcccttttccccggaaaaaagttgggggaaaaaaaaaaaccttttttacccccgtggtttttataaaaagagagcgccccccccaaaaaaaaaacaaaaaaaaaggccccctcataaaaaaccgcgcgcggtgcggagaaaaaaaaaggggggggggcgggnaaaaacgccacaaaaaaaaaataggaagcggggggggggggggggggggtttttcctccccccccgcgggggagaaaaaccccccgcggggcggggggggggggggagaagaaaataaatatttnccccccagaaagagaaaagaaaaaa

SEQ ID NO: 16704 - DNA, 1032 bp, Xenorhabdus bovienii
  unsure (1)..(1032): unsure at all n locations
nggaaaaggnnnnnnnnnnnnnntttctttnnnnngcactcatcaaatgcggacccccgccctccgggacccccngaagcccctctccgccacaaaccgccaccccccccccccccgcctgcccccccccccccccagaaccaaagaagacaccccacctccccccgcccaagacgaaagttccccccctcncncctcttcaaaattgatcnnnccgcggccnccnnnccccgcccnnnncgaaattaccctcttttttnggnnnnnnannaataaaaaaaaccccctcaaaaaacaacggaataataaaaaggggaaaaaaaaaacccccccccctgttcacccccccacccccccagggggggggaaaaaaaaaccccccccccccaaaaaaaaaaaaaaaacccccccccccgccccttaaaaaaaaaaacaaccacacccccccccgcccccccccccaaaaaaataataaaacaccccccaccccccccaaaaaccttttttccccccccccccccacccccctcttaaaaaaaaaaaaaaaaaaaaaagaggnnccccaaacaaaaaaaaaaaaaacncaaaagaaaaaaaaaaacaacacacccccaccnnnttnnnncccacttttttttttaataataatacaacaaacaccccccccgcccccccacaaaaaaaaaaaaaaaaaaaaaaaaaacacctgcgggggcgctgtccccccacccccccccccccccaccccattattttttttttaccccccccccccccccccccccccccccacccccgccccgccctcccccccgngcaaacnnnaaaaaaaaaaaaaaaaaaatanancccacccccccccccccccccccaccaaaaaggacaaaaagggtatggttttaataaaatttttttnnnnnnnaggnangagngaaaaaaaaaaaaaaaaaaaaaaaaggcggaanatcccacaccctctaccaccccccccccctcctcctcgccccctnaaaaaaaaaaaaaaaaaaaaac

SEQ ID NO: 16705 - DNA, 1012 bp, Xenorhabdus bovienii
  unsure (1)..(1012): unsure at all n locations
nnnnnaaaggggggnnnnngnngnggctttgnnnnctaactttacgacattcngactcggtacccgggggattcctctagaggcccgnaagccaatgtgctgacgtccctagcatgcagtggcgatgagaactgactatctcggcacacgcgtactatatcgcatgcgcacgtacactccatgaggcggctagatacgcagatacactacgagagcttatatgggcattagaacgcgcgggaacgacggctcgcgcttggggaattttttttaaccagtaattaccgggatcctccgggtcacccccgggggggatacctcctctaaaaaaacccttgggtttgttcacaagagatgtttgttggggggaaaaaaaaaggcgggcgaaaaaaacaaaacctcgcccaccaaatattttttttttttatttttgggaaaaaaaagtggtgggggggagaaggggggttttatatacccggcccccccaaaaaaaattttttttttcccccccccgggaaaaaaaaatttttttttaaaaaaaaaaaaaaaaagggggggggggggggaaaaaaaaaaaaaaaaaaaaaaaaaaaaaaaccgcccccccccccccccccccccccccacacacacaaaaaaggggggtggggggggggggggggggggagaaaaaaaaaaaactacccctttctttttttttttnttttttttcncaaaaaacaccacccccccccnnnngncccccaaaagcgggaggagaggagagggggggggaaaaacnnggnnnnnnnnnncncgcccccccccccccnacaccaaatataatatttttttttttgtggtgggggtgttgggggggggggggggggaaannnnnnnnnnanaaaaanaaaaataacanccccccccccccccccccgcctctttttttttttttttttntnttnnnnctttctttttctttgttntnnngnnggtggggaggaggagaaacacccaccccccccccccc

SEQ ID NO: 16706 - DNA, 1080 bp, Xenorhabdus bovienii
  unsure (1)..(1080): unsure at all n locations
nnnnnnnnnnnnnnnnnnnnnnnnnnnnnnnnnnnnnnnnnnnnnnnnnnnnnnnnnnnnnnnnnccttnnngggggnnnnngnngnnngggggggggnnnnngccggggggggnnnnnnnnnnnnnnnnnnnnnnnnnnnnnnnnnnngggccctaggactttgnnctagccnctggncgagntnncannncactttnntatttncnatnatnnancatnctnactnannacttncgnnaatnnattttntgggtttaattacttaaaaancactaaataaatttaaactggagttacccaacaaccaaaaaccaggtttaggcattttncccaatttggngnccgggcaatcggaaaaactaaaaaaggaaggggtttttaaggggaatttaaattttttttttaatccccctggctttaaaaaaaaacccctttttttttatttttcaaaccccttatgcgcttttttgggggtttaaacaacaattggaaaacggggggctcttttaaaaaaaataaaaccccccttttgggggggttttttccccaaggaaaacaaccccgggggggggggggacacccccccccttttttttttccccccgaggggggtttttttcgggggggggggagggccacccccccctcttggggttataaaaaaaaacacaaaaaaaaattttttggtgggnnnncccccccccccctactttttttttttttccccaaaaaaaaaaaagagggggggggcgcccccccccccccctatattgggggggggttttttaataaaaagaaaagaagaaaggcccccccccccccccctctattataaaaaaaaanaatatattnnccccaaaaaaaaantaatnnttttttttntnnnntttnttccccctcttttttcttttttttttttttggggtggagaagaaaaaaaaaaaaaaaaaaaatatatatttttttttctttccgcgggggggggaaggagaaagagaaaaaantttttttattttttttttttttatttaaataaaaaaaanannnnaaaanacnnncccgccagcgccgggggcga

SEQ ID NO: 16707 - DNA, 657 bp, Xenorhabdus bovienii
  unsure (1)..(657): unsure at all n locations
aggcggcatgtacgtcttaaaaaagggcctanaggggaatcagaccggttctcggggnacctctangatcggcccgacgcccacatagccggcgagcggatcgtccggacgccaaaggggccggcaaaactcgcccagggtgccgcccgccgcctaaaaaccccaaaaaaaggggggcaaaaaacccgtttcccttggcccttccccaaaaccctaaaaaacgggggggggggaaacccacccccaattttcccgaaaaacccccccgcgctaaaaaatcccttttttccccccccccccccgggggaagccgggaaacccccaggggggtttaaaaaaaccccccaaaaaacggtttttaaaacaccaattttcccccccccagaagaccgttttgtaaaacaccccgccgggggggggaaaaaaaaaaagactcggggggggggggggacccccccccccttctttctccgggggggggggggggaaaaaaaaaaagaaggaagggggggcggcccccccccccccccccccttttattttgnaatcttataagaaccaacccccccccccccccncgtctgatttaaaacctctcctcttcgctgccgccccgcccgggcggcgaaaagaaaaaaaatatagttttcctttccc

SEQ ID NO: 16708 - DNA, 404 bp, Xenorhabdus bovienii
  unsure (1)..(404): unsure at all n locations
nggggnnnggcttggcgggagggctaggggggccggggaaaagttaggctcgcgcgcgctaagtcatgcggccgaaacccagtgggcaaacgggggggcccctttccgaccacccccttaaaaagtttattccccccccaaaaaacccccaaaaaaaaagggtttgggggggggcccccccggggggtttttggtgaaaaagggccccccccggggggaaggaaaannnnnacccacaaacacccgttttggaggaggccccccccccccnncngggggggggggggggaaaaaaaaaaaaacccccccccccgggttttttttaacccaaaaagccccccgcgtcgttttttnngnnnncaaaaaaaaaaannnnnnnngcgggggccccccccctaccaaaa

SEQ ID NO: 16709 - DNA, 1106 bp, Xenorhabdus bovienii
  unsure (1)..(1106): unsure at all n locations
nnnnnnnnnnnnnnnnnnnnnnnnnnnnnnnnnnnnnnnnnggtgatgcgctgcagggccttaagtttgtttttgtttggtggggattgtgaaattatgtgttnnanataannnnnnnagaaatgctgcctgcaggtcggcttctgattttatgtccccttgagtgctgaagttacgctgtttattccagagttgggaaaaggttttcctggaatttaggcaaacaagggaaaactttattaaacgaaaaggttgggattgggctccgcgccttttaaaaaaatctctgtgaagagaaagaggggaaatttacacccccttttgggtttgtgtgtggggagaaagggttttttcaccgctcttttttttggggggaaaaaaaaaatattgtgggtttttttggccccccaataaaaccgggtggaaaagggggggggtttttttttttgtggggggggggttttttttttttttttcagaaaaatattttttttgtggggggcccccaaaaaaaaactttttaaaaaaaagggggggttttctccccccccccaattttttttttttttttttttaaaaaaaacaaaaaaaaaaaaaatattttctgcccccggggggggggaggggtttttttttttttggggggggcggggaaaaaaaaaaaaaaaacacccccccccccctgctcttttttttttttaaaaaaaaaacaaccgctcttttgtttgtgttggganngnnnannagaaaaaaaaaaaaaaaagaacaacttctgtgttttttttttttatagaaggggggggggggaaaccacaaaaaagaggagggagttttttttttttttcttttttttggtggggtggggngggaggggnnnggggacccccccccccccccccnccctctttttttttttttttttgggtgggggaaagagaaaaaaaaaagagaaaataaaaaanataaaattccccccctccctaccaaaaaaaaaataaancgcccgacgggcggggggggcgcgccttgttcttttttttnattccacaaaaaaaaaaaaaaattatnttaaccncgtgcgcggggggggggtgttgcctcttttt

SEQ ID NO: 16710 - DNA, 754 bp, Xenorhabdus bovienii
  unsure (1)..(754): unsure at all n locations
ngcatgcttgctngcctgcaggtcgctgtgcttggtcatgtacggcaaaagcggttctccagcataagcgnacactcgtgcacagggctatcccatttcancaattaaggggagtatgctattccgcggcccgggggggaatattttacccccctctcccccccggggggtccccgaattttttccccccccagaggggggggctttatttatttggggtcccccggtaaacccctggcccgccccctttgggggatttttaagggggaaaattatttctgggggggggggggggttttgggggagaacccccccataaaaaaaaccacccccggtggggaaataatggggggggggttttcccccccccaagggggggggggctttttataaaaaaccaaaaaaaaaaacccccgccccgggggggggcccctctcttttggggggccccccgcggcgcggggagattttttttttaaaaaaaggagatatttttttttcccccccccccccccaaaaaggagggaggggggtgtgttttcctcttcccccggggggggggggggcacccaggnnaanaaaaaaaaaaaaaanaaanaatttttttttttttttggcccccgccccccccggggggggggganaaaaaaaaaaatataataataatanacaccccaccccccgcctttggggggggcgggtggnnaggnngagaggggntgggggggttctcctttccctccttaccaacaaa

SEQ ID NO: 16711 - DNA, 963 bp, Xenorhabdus bovienii
  unsure (1)..(963): unsure at all n locations
tgctacgaattaagaccggacccgngatcctctaagcgacagtatatactcgatacacttttttctcgattacctgtgcgtagcaacgatgaatggcgnggctggttttttgttttttgggggattcattttgggttttctggagaaatataaaacacacaagggggggggaaaataggggaagggatggtctttataaaaaagggagaaaaaaaaaatattttttcgttcgggagagggggggttcttttataaacaaatattgtttctccccggggggggggggggggggccaacatttttttttttatttaaaagagggggggggggcccccaaaaaaaaaaaaaaaaaaaannnggggcgcccccttcggggggggggcccccccccccccccccctcctcccgagaaaaaaaaatataattacacccccccccaacacacaacccccccgcgcggggggggggggtgtttttttttttcccccccccccacacaaatttctccttttattagaggggggagaaaaaaaaaaaaaataaaagaantnctttttataacaacaccccctcctcccctcactccccctcccgcccccgcccgcgcgggggggggggggggggggggggggggggggggggggggaatatanntnncctttcttttctcttttatntnncaacccgccccccccccccccatataggcggtgtattttatattcccccctcccccccttttttttctcccgagagagggaaaagagggggngnngggaaggtgtgtgtgtttttttttacaaaacaaaaaaaacaacccccccgggggaaaacaaaaaaaaaaaaaaagaggagcccctttcttctcttttttttttttttttattatatttggggnntangaggggaggagagagaagaaaaacacccccccctctttttttttttttgggggataagaga

SEQ ID NO: 16712 - DNA, 969 bp, Xenorhabdus bovienii
  unsure (1)..(969): unsure at all n locations
naagnnnnnnnnnnnnnnnnnnnnnnnnnnncccctcttgcctncctatactcacctctnaattagaataaggnnnnnannncannanattnnactaaatncnnaatacttataaataaaacttttatatcttaanncttaaaggaatggcaganagtttctttatttanctnnnatcaaacccnnantnatcctnnncctnnccccaacttcccaatccnnnncattntcttttcttatnnccttnaacttcccnaancaatnnnnccaaccttnncctannnannnccnnnnnnaaaannngtgatttnntttttttttnnnnnnnnnnnnncgggggccccactttaaaataaatctttttttggggaaccccttttaaaaaccccccttttctggggccccccaaaaaattttttnnccccccgcgccttttnnnnaaaaaaaaaatttttttttttttttttttttggggngggcccccctttatattttttggggnncccccccgnnnngaaatatattatnnnnccccccaaaacacccccccccccaaaaaatttttggggttttttnttttttaaaaccctttcttnggggggggttttttttgggtttttttnccccccccaaaaaatatattttttttncccctctttttttngggggggnggggngggnnnnaaaaaaaaacacacaaaccccccacaaaaaaggnggccccccctttcttgtttttttttttgggggggnnnaaaaaacaccacaccccaaaaaaagnnnnnntttnnttttttttttttttttnnacctccaccccccccttttttttttttgtgtttttggggcgcccccccccaaaagaaatatttttttttcccccccggccgggggccccccccgggggccccccccccccccccaaagaaaaaagnnnacaaaaaacccctctctttttttttttctttc

SEQ ID NO: 16713 - DNA, 871 bp, Xenorhabdus bovienii
  unsure (1)..(871): unsure at all n locations
nnnaaaagggggnnaaaaaaanagaaacatgcgatgcaggaacataggaaagaggagagagacagggggggaaaaaaaaagacgaccaggaaaggaaatttttatagaaaaaaaaaagggctagatgcagctgcagtccaacaggttggaggtcgggaacgaaaaccccaaaaaaccgaaaaaacctggaaaaaaagaaaaagaatgttaaaaactttaaaaaaaaaaattttttcccccccacaaaaaaaagggggggaaaaggggttaaaaaaaaaaaaaaaaaaaacaggggtggggggaaaaaaaaaaaaaaaaaaaaaaaatatttttttgtggggggggggggaaaaaaaaaaaaacaaagcggggggggggggggaaagaaaaaaaaaaaaaaaaaaaaaattttctctccaccaaaaaaaaaaaaaaaaaaaaagggggggggggggggtttttgttctcccacccccccctccccccaacacccacaccttctaatttttttttttttcccggccccgcccccaccccaaaaaaaaaaaaaaaaaaaaaagaagaacccagggggngaagaaacaccccccccccaaaaacagataatattatgtcttgggggggggggntgtgtgccccnccccccnnggttnnggtgttgtttgncnnnnttccctttatattataacaaaataaaaaaaaaaaaaaaannnanaaaggggggggggtgggggggnggggggggtggggggtgcgcccccacccacacccacgccgggacaaggaaaaaaaacaaaaaaaaancgaaannaagaangnggggggtgngggaaaggttgttcttgnttcgcaatacagaaaaaaaaaaaaa

SEQ ID NO: 16714 - DNA, 1094 bp, Xenorhabdus bovienii
  unsure (1)..(1094): unsure at all n locations
ngggagaaccggnnnnnnnnnnnnnnnnnnnnnnnnnnnnnnnnnnnnnnnnnnnnnnnnnnncncnncnnnnnnnnnnnnnnnnnnnngggnggggggggggggggggggggggttttccgggaagggnggnggggncgnnngntttnccnngngggcgggnnggngnnngggngcgnnnccggccgcccngnncccnccggcggcgcgnggcggcgggcgngcccccggcccgncnccnggcggngccgcggcggggnggcgccgcccgcccggcccnnnngccngcgcggggccggggcgnggncgcgggggggccggggcnncngctcgcncggcgggcccgncggggccccnnnccgcccgggggcgcgnnnnnccccnngggccncgcnnnnnngngnnnnnnnngnaagaannnnnnnngggggcccaagaactttgncaaggccccttggncagggnntcaaggaacccctntntgnaaaaataaanttggcanaaaaatttaaggggaaaagaattggcccgaaacccccaaagggggtttaccgggggcaaaaaaaaagggggggtaattggaaaaacccccaaggggggggaaaaaaaaaaaaattttccnaaaattttaaaaattttaaaaggggggtttttttttccgcggaacccccccaagggggggcgcgccggggttttttttaaaaaaaaatgttttttaaaaaaaaaaaaaaaaatttggggggcgcgggaaaaaaaagaggggggggcccccccccnnaaatatttttttataaaaacaaaaaatttttttttttttccccccccccgcgggaggaaaaaaaactcctgtggggggggggggcacaccaaaaaaatttttttgggggccccccgggggggggaaaaaaaaaattatttgtggggggnggggggaacagttttttttaaaaaaaaaaaaaaaaaaaaaaaacaccccctcttgaggaggggggggggtggccaccccccaaaaaaaaaaaaaaaaaaaaagggggggggggggggggnncccccccccccccccatctnttttttttttttttttggagagaaaa

SEQ ID NO: 16715 - DNA, 1109 bp, Xenorhabdus bovienii
  unsure (1)..(1109): unsure at all n locations
gggctcggcggggggcngtnaaggggggnnnnnnnnnnctttctttttcctccnnncccttnaccnnnnnttttttttttttnnnnnnntttnttttttttttttttttttnnnnnnatnnnnnntntnnnntttnnntnnnnttnnnnnnnnncgggggggggggggngncccccccccccccccctttttttttatattanaaaaactttcctttttgggggggaaaaacccccctttttagaaaaaaannnnccccccctttggnncccgagattnnccgaacccaanccctannccaaaccccnaaaaaacctttggggnccccccctttttnaaaaaaaaaaaattaaagggnccccccccgcgggggnnccccctttattttgtgggnnccccttttgggnnnntatataaattataanncccacaaccgcgggggnggggcccctctcttttggggccccnccttatatttgggggggnnnaaaaaaaacccccccaacaaaaaaagaaaaaaacaccctcttttggggccccctctttttttttccccccacaaaaaaccccccccccccaaatattataatattttgtggngcccccccncgggggngnnccccccccacaaaaaaccccccccaaaaaaagagaggggggccccccccacaaaaaaaatattttttnnttnttttttttgggggngttttggggggggagaaaaacaaacccctttcttgtggngggtgttttttaaaaaaaaaaaaaaaaaaaaaaaaaaacacccgcgcccccccccccccaaaaatatttnttctctcccccccccccgcgacagggtgttttttatatatatttnntattcccccccccccccccacctccttcctctggtttgggggggggccctctttctttttttttttccccccccnnnanaaanangaagagaaagagagggcgcccccccccctccacaatnattattnttnttnnttntnnnnnnnnnnnnncccccccccccccccccncnccccattatattatatattattttatnnaanaaaaanannnnnnnaaattttttttattttnntgttgggggggga

SEQ ID NO: 16716 - DNA, 936 bp, Xenorhabdus bovienii
  unsure (1)..(936): unsure at all n locations
nnnnnnnnnnnnnnnnnnnnnnnnnnnnnnnnnnnnnnnnnngggattcatagtggcgggacctttccttattnnnnnnnnnnnaagtaatcagtggaccgggactctatcctcatggtatacttgcggatagagctgcgcccgatccatacgcctgaattggtactccttgaaagcctgaaaggggtttgattttccccccggtactttaccgggggaaatttcaaaaaggggggtaaggggggggtttccaaattttggaaaagggttttcccagggggggggttccccaaaatatttttgggggaacaaaaaaaaagggtttcaaaaaattttttttggggtgggggcggggggggggaaaaaaacaacccccccgcccccgcccctgttttttttttttggggggggaggcggcggcgcctccctttcttcctcaaaaaaaaaaaaaaaattatttttttttttttttttgagagaaaaaaaaacaaaaaagttggttttttttttcaccccggggggggggggggggggggtttggtgtatttttctttaaaaaaaaaaaaaaaaataattttgttttgtgtggggggcccgccaccacaaaaaaaaaaaaaaaaaaaaaaaagaaaaggtgttggtctcttttaaaaaaaaaaagagagcggggggcgggggggcgggggaaaaagaaaaaaaaaaaaaaaaaaaattttccttcccttttttctcctctcgcgggccggggggggggggggggcgctctttttttttttttcttccccccccaacctcttttttttttttttccccgggggggagagagggggggagagaaaaaataaaaatttttttttttttttttttnnnnnnnccgccccccggcgggggggggggggnnnngtggagcaaaaaaaaaaaaataaaatttcttct

SEQ ID NO: 16717 - DNA, 1301 bp, Xenorhabdus bovienii
  unsure (1)..(1301): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccngggcggcncggcnccccccccccgccccccccccccgtgggggggggcccncnnnnnnggggcnccccccccccccccccccccccccccccggggggtcgccgccttttttttttttttttnnnnnnngggggngnnnggcccccccctttccccgttgngnttccccggnnnnnngccccngnggggggnnnncccttgtgggcgccgcgnncgttgttctttttttccttnnnnggggnnggggnnggggggggggtcccttggggggtggncccccctcccgggggcccgnnccccgcccggnnggnngggggccccccccccnccnccnnnnnngngggggggggcgcccccccccccccttttttttttggggggggcccgccccctcccccccgggtttnnnnnnnnttgttttttttttttttttttcccccccccccccccccgcgcgcggggggnnnnnnnnggggnnncncgggggtgtggtttttttccccccccccccccgcccccgcgggcgggcgggggggggggggggtgggncccccccccccccccccccccccgccccccggggggggtgtgtggtttttttttttttttttcctttgggggggggngggcggcccccgcggggcgcgggcgggcgcgggggggggcggnnngngggnnnnnnnnnnnttnttttttntttnntttnnnnnnnnnnnnnnnnnnntttttccccccccccccccccncccccnnccccncnnnnnnnnnnnnnnnnnnnnggnggnnnngggggggggggggnggnnggggnnnngntntntnttnttgtgcctctcc

SEQ ID NO: 16718 - DNA, 914 bp, Xenorhabdus bovienii
  unsure (1)..(914): unsure at all n locations
nattccccaggttagnnaagggaanagcggngcctcccggggggcccctctctttgtgggggacactaattttcctccgggggggaaaccgggggggggggccccccccccccccctcaaaattttttttttggtggggggttgccccccccctctttcctctnccccccntccccccttttttttttttttttttttttgttgtggacgcccccccacaaaaaaaaactttttaataattatatttnntntttttttttggggggggggggggggggggagganaaaaaccttttttcttttttcccctgttgttgggtggggggcccgtgatgtgatgagaggaaggccccccccccccccagggggggggggggtgggggggggccgttgggggggggggggggggccccccgggggggggggggcggggggggccgggtgggttgggggggggaacaccataaaagaagacaaaaacaccccccctttttcttctctctgggcccctcccttctttggcggggccgccccgcccctggggggggaacagaaaaaaggggggcccccccccccggcgcgggtggtttgttttttctttnnnngctggctggccccctccccccggngnccccccgccccccncaccnnctgnaagtctgtcgcctctcaaaacaccacccnnncaaccccccccgcgcccacaccccttctctctttttcttttcccttcacacacgcttttagtgggggtgtgcgctctcnggccccccctccnnnntctaaaactccctttttttcttcctctcatctncctctccccctnnnccacccgcaacccaccatcaccaaaatgaccccttctttccttctcgtggtgtttttngcacatccaagacaataaaaaaacaaag

SEQ ID NO: 16719 - DNA, 814 bp, Xenorhabdus bovienii
  unsure (1)..(814): unsure at all n locations
nnnnnnnnnnnnnnnnnnnnnnnnnnnnnnnnnnnnnnnnnnnnnnnnnnnnnnnnggctgccggaactaaactttaagcattcctttttaggttttatggttacattgggtattggagacgcttttttgtgcgagcttaatgatcataatggttgcatacgacatgtattgcatatgacttgcgctaagagcggacgtaccttacgtggtagtgtgttgagtatgtgtatttattctgtgaacctcgaagatctatatttgtcgaatgcgattttaaataggagtattgagagttgtggcgctagtctaggtcgcattcttctggtattttttgcttttccnncccngggnnnnnnggaaatacaaatccgnaactcgggttacccnggaanatccctcctagtagtccggatntccacctcgggcgtatgantnnnnttttaggcccctccgcgttaattncaaatcctgggaaatantccaaaacccggttgtntgtgagccgaggagnccaccngtggnccctggcccttggaaatgtggggaaggcccctgggccccaaaaaaaggcnccgggttccacaaataaattaatttttaaaaaattgttgcccggaaaaacacctttttgggggttttatnnnaaaanaaacccnccgggggccccccccaaaataaaanaattttttttttggggggggggggagaaataaaaaaaaggggggggcgggnaaaagggggggggaaaacacatttttttggggcttttttttttttgggggggggggtcttctctaaaaaccanccccaccc

SEQ ID NO: 16720 - DNA, 1056 bp, Xenorhabdus bovienii
  unsure (1)..(1056): unsure at all n locations
ggttttatttggnnnaggcaaatctttcgtgnctgnncctgccagcttcgtnctgnctncttcctnctggccctcttncagcggctttccggtaaaccacctttggcctgcttcttttattggccacaaaaaattcaagggccaccctttggcccgcggtttttttcaattgggacccggggccgcccccttccaaggttgggggccacgccgggaaaaccccacaaagattcccccggtatttttaacccccccccaaaaatctgcggggggttttttttttggggccgccccccttacacccatttataaaaagaaggggggtggttttttttttttgtgtggtaaaataaaaaaaaaccacctttttttgtgggggggggggggaaaacaccccccgccgcgggggggggggaggtattttatttttttttttttttttttgggggcgccggccccgccccttaaaaaaaaaacaattttttttttttctccccgcgccgcgctttttttttttttagaggaggagggggggggggggggggcgacaacaataaaaaatattatattttattttgttcctctccctcccccccgcgcgaagaaaaaaaaacaccccctcttctttttaaagggaagagagaagaaaaaccacccccggcgggggggggggttttgttttttttttttttatttaaaaaaaaaaaaatattgggggggggggagaccaaaaaaaaaaagacctcccccccccccaacaaaaaaaaaaaacccccccccccccccccccccccttttttttttgggggggagaggaacacccccccccccccccccccccttttttttttttttttaaaaacgccccccgccgcgccccccccctccttnttnnnnnnnnnnnnnaatataaaaaaaaaaaaaataaaaaaaaaaaaaagtttatgtggggggggtgggggacccccaaaaaaaaaaaaaaaaaaaaaaaataatattttccccccccccccaaaaaaagaggccggaggggggggggggggggggggtgccccc

SEQ ID NO: 16721 - DNA, 769 bp, Xenorhabdus bovienii
  unsure (1)..(769): unsure at all n locations
tgnnnnnnnnnnnnnnnnnnnnnnnnnnnnnnnnnnnnncatcacccagcccgtctgggggaacaaacngactgttgcaaaaaaccaccaacggggtttgcccattgtggcggcggcacgggattttttatccgggactggaactggtcttggccagttttgggcgctcacggggggtaaaagggaatttggggggaaattttaaaaagccccttcggggggtttttaaagaacatcccgggaaaaaagggcggaagggacccactcccccttgggggggcccttggtcccggggggnaaaaggggggnnatttttttttccccccaaaaaaatgaggtcccccttcctccccttttgatcccccggggggagggatttttttttcaggggggagcccggcgcccttttttaaaaagggggtttcctccccccccgggggcgagagggtttttttctaggggggaaaaaaaaaaaaatttttggggaggggagcgccccttcttttggaaaaaaaaaaaagggggggggggactcttcccctcggggggggttttccccccccacggggtttttttaaaaaaaaaaaaaaaanagggggggggggcnnncccccccgcgttgttatatttnaccccccacccnccngcnngngntgnggggggnggnngggggggtactnttttccacgcggggggaggagaaaaaaanaagaaantttttttttncgggggggcccccccccccntttgttttttttttaaaaaaaaa

SEQ ID NO: 16722 - DNA, 890 bp, Xenorhabdus bovienii
  unsure (1)..(890): unsure at all n locations
ngacttctgtgatgcctgcaggtctgtatgcgcgagcatgacggggcgcgggtgagtttctgacgttggcggcgtccagccgacataagacagaaagaggggaaaaatgaatgttggcaggcgtccagactgacataaatgaatttttccctttgttgttttcgcagccctagcgaagaaaataaccatgccgacaggcataaagatagctatataatataggtgattaaataagttgttaagtaaaaaagggttcttatatagctattgggtgaccgtgcaaaacattaagttcagtagatannnnnnnnnnnnnnnnnnnnnnnnnnnnnnnnnnnnnnnnnnnnnnnnnnnnnnagacggtgctaaaaaaaccaatgttctttagctaacgtcaaaaaacaaaaaagccccaaaaaggggctgttatctgatataggttatctggtgcactcaaagcaaaccatttttctttttgtggtaataccagcggcgactaattcctagtgattcccacggcttgagcgttctctctgagcttgggatcgcgccacgctttgatttacgtcctctggcggcctggatctctggcgtatgcgtgtctgcaacatactgcgcgaacgccttttcgctcatacgctggtgtgtccacttggcaatactgcgcccgatacaggcgcattccggcagcgatagcgggttggtcagctgaacgttgtacatttccacacgctgaatgacggccagttgccactgggcaaaaacgggatacccctgccgaatcgccctggtagcccatttaccgcgttttttcgaataactgccaggttacgccccacccccggagtaaaaatcggtttacgcgggcttcttgggaactttcaaataga

SEQ ID NO: 16723 - DNA, 1379 bp, Xenorhabdus bovienii
  unsure (1)..(1379): unsure at all n locations
gggaaaaaaagggggcnnncccccnncncntgttttttnnnnnngggctcactgggggcnnnnggccgcnngnnggnnnnnnnannnnngnnnnnggggggnnggggnnnnnnnnncnnnnncngaggaggggnnnnggggnnnnnnaaggaaaaaaaaaagaaantttttaaaaaaaaaaaaaaaaaaaacccccgcttgnggaatgttntgggngnnnttggagnnntattgtgacagggagaaggttttttcttgggggggggggggggggagaaaaaaaaacntnnnaaaaagaaaaaccacaaaaaaaaaaaaaaacccccttattnggggggggggggggggggggggcaaaaaaaaagaaaaaagacccagaaggagggggggggggcaaaaaaaaaaagaagggggggggggnctttttttttttttaaaaaaaaaacaaaaaaaaaaaaagaaggggggtgggggggggggggggggagggcccnccccccccaaaaaaaaaaaaaaaaaaaaaaaaaaaaaaaattttttttctctcccccccggggggcggagaaaaaaaaaaaaaaaaaaaaaaaaatttttttttttttatttttttaatnnnnnccccccccccccccccccccccccccccccccaatcctccctaaaattnttaaaaaaaaaaaannaaaaaaaagnaaaannnnnnnnnnnncccncncccgggcggcgggggcgcgcgggggcggggccggngncgcnggngnnnnnnnnnnnnnnntnntnncnntggttttataaaaaaatnaaaaaaaaaaaaanaacncaaaacaacccagcnccctccnnccgncggggggggggggggggggcgggggggggggggcgctggnngnntcntttntnntntttnttnnnnnttnnttnnnncnnnnnnnnnnnnnnnnnnnncccnncnnncnnnnnnngggggcnngncncaaaaaaaaaaaaaaaaaaaacaaaaaannaaaaaaannnnnaannnnngnngnnnnnntnnnncnngngngnnngnggngggggggggggggggggnggcggccgcncccccncccccccccccccccccccccccccccctnncccggctcctccnttnnntccttcccgccgggtccccnnnccggggggnggggggggggnggggggggggggggngggggnnnnncgccnnnannnnncaaaaannnnnggngcgcgnggncgcgnncgncggtggggccgtcccgggcggccntccacncgtggggnnngaggggngcgtcggggggcgggcaggagggggagggtggcgngcgcgggnctggnccggcgggaaagaaagaaaaagaaaaaaaaaaaaa

SEQ ID NO: 16724 - DNA, 1377 bp, Xenorhabdus bovienii
  unsure (1)..(1377): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaaancnctnnaaganccgnccccctctccgcggaaaagcatttactaatccccggggccnccccnnnnnnaaaacanncagggccccaggggcacccccaccacnncccacnnggaaaaaccnncagaggggggggcnccccntncnnncnnnnnnnggggnnnnnnnnnnnnngggccccaaaaaaccctttttggcccattttnnccnctttgnncaaagngnnntncnaaaanccnttttcntttcctttaaaaacaaattttgnnntaaaaaaaaaaaaaagttttttcccgcaaaacggcgggnaaacaaaaaaaaaaaaggngttggccgctttttnaaaaaaaaaaaaaaaaaaattttttaggggccctttttttgnggagaccncaaaattttttaaaaaaaaaaagaaaaaaagggggtttaaaaggccccctttttaaaaaacgggggcaaaattttttgaaatttccggggggggccccttttttttttttggaaaaaaaacggggggaaaaaaaaaaataaaaccttttttttaataaagccttttttaaaattttaaaaaatttttttttttttttaaaaaaaaatttcccaaaaaaaagggggggggggaaaaaaaattttttgggaaaaaaatttttttgaaaaaaaaaaaaaaaaaaaaaccgtttttttggggtttttttttttaacaccggggggaaaaaaaaaaaaaaaaaaaaaaaaaactttttttttttttcaaaaaaaaaaaacagggggggggaaaaaaaaattttttcctcccccccgcggggtttttttataaaaaaaacctcttttgcaaaaaaaaaaaaaaaaggggggntaaaaaaaggggggttttatttttttctctacaaaaaaaataaatatttttttttttttcgcccctttttttttttttttttttttccnccncccctctttttttttttttcacaaaaaaatnggggggggggtgttttttttttttttttttaaaaaaaaaaaaaaaaaaatattttttttttttttttttaataaaaaaaaaaaaaaaaaaacccccccccccnccttttattttttttttngngggggggggccctccaccccacaaaaaaaanannatttttgttttgggtgtgncccccccccaccccccacacnncaaaaaaaaaaaaaaaaacacaccacccc

SEQ ID NO: 16725 - DNA, 920 bp, Xenorhabdus bovienii
  unsure (1)..(920): unsure at all n locations
ncaaaagggggnnnnnngtttnnnngcttcgggnngccccccccccggcnncggcccccccggncgggggggccccgcccagagcnngaanaggaaaagatttaaaaaaaaaggcttgaggggnctanacccgcagttcagccaaaaaagacgacttgcagccgaaaggaattcttggcagttaaaggcccccaatgggtacccccaaaaccgggacgaattaaaaaaccccaaggcctccccaaaggaaaacccccccccgaggttaaaaaaaaaaaaaaagggggggttcaaaaaaccacaaaaaaaattgggggggaaaaaaaataggggggggggggggtttatataaaaaaggggggggagaaaacaccccccccacaaaaaaaaaaagcgcgcgcccaacccctgaagagaaaaaaggggggggaaaaaaaaaaaaaaggaaggggggggggggggagaaaaaaaaattttttttttctctctcccccaaaaaaaaaaaaaaaaaaaaacccccccccccccctggtggtggaagaggggggggggggggttaaaaacaccccccccccccttcttttttttccccccccccccccccccttttataaataaaaaaaaaaaaaaaaaaaaaaaaaaaaaaaacaacacccccccggggggggggggggggggggggggcggccccccccaaaaaaaaaaaaaaaaaaaaaaaaaaaaaaatnccnnnnnnggcgggggcggcggcccccccccccccccccccccggggncngaaataacaaaaaaaaaattttttcttctctctccccggtcggggggggcggcggggggggggggggggggggggnggggggngnaaaaaaaaaaaaaaataaaaacgccccccttcttataacaactaaaaaaaaaaaaaa

SEQ ID NO: 16726 - DNA, 772 bp, Xenorhabdus bovienii
  unsure (1)..(772): unsure at all n locations
atgattcgaattcagctggacccgggaatctttagtatgactggctgacgtgagtttgcagatcaacctaggatgctgaaaacaatcgtcgcttgaggctcgncaaatactgaatacgtagaggccttccccagggtgggtaaacccccgggaaatttttggggccttacccggggaaaaaaaaattttgggggaaaacccacctttttggaaatttctttcccccaatgaaaaaaaacccccccgcttttatccacaaaatatatttttttcccccccccccccttaaaaaaaaaaaaatttttcgccaagagaaaaaaaactctttttttttttgtttgtgtgggggggggggaatttttttttttttttttttgggggggggggggggcgggggggggggggaattatttttttttccttcctccccaacccaacaaaaaaaaaaaaaaaggggggggggggggcgcccccccccccccccccacgcgctgtggtggtgggggtggggggggnnntttnnnnnnnnnnnnnnnnnnnnnnnttttttttttttttctttttcttctnggggggggggaggggaggagggtgtcgcttcctctcccccccccccccccccnnnggggggtgtnttttttttttatatttttttttgggggggggggggnttgttttttttttttncnnnnnnnnnnnnnnggggggggggggggggggggggngagaaaaaaaaaaaaaaaaaaaaaaatttaatctttttttcttttta

SEQ ID NO: 16727 - DNA, 708 bp, Xenorhabdus bovienii
  unsure (1)..(708): unsure at all n locations
ngcccagacttgnctagncctgncagtncgcgtncaaccacaccctnctgtagactgttngaaagcgaggccgtagccgcccgnatatttcacaancgtatggtttggccgctggagnacgtaagatncggcctcaatctcgcgtggatgaattcccaaagattcgcactccatcgtgcatgcgtcccaggccaaaaaacccttgaaaggtaacttttcaggaaaaaattaaacctttccttggcaaaaaccttaggccaccccgtttttttttggcagggggggcgtttttgcctttggccttgggtttcccatgacggggggcgtttaccaatatctttggtttttggggggccaattttttttatattttccccccgcaaaaaaaactttttaccccagaggttttcccttgggggagaaatattattttggggggggggggaggacctttttttggggggggggggggggttttttctcctgttttttaaacacccccttttttaagagaggaggttttctttttttggggggggggggggggcgcgccccaaaaaaaaaaaattatttttttttttttaaggagacctctttttttttttcttgtgggggggggggttttttttaaaacnaaaaatataaaatacacccccccccccccccaaaaaaaaataatgtgtggggggagagagaaaaagaaaaaat

SEQ ID NO: 16728 - DNA, 560 bp, Xenorhabdus bovienii
  unsure (1)..(560): unsure at all n locations
tgccnnnnnnnnnnnnnnnnnnnnnnnnnnnnnnnaggtcggctaatggaaaaatatccccacgagtccccacattcgacagatacgcaaatcagagcactttctttcctttaccaagctttgtccgaccccttggtgggggtggcaaaaggccgtttgggaaaaaaaaacctttttggtttgggaaaaaatcgaaaaaaattgttggggaaatttctctccgccggggaaaaaaaaatttccccccccctttttaaaaaaaaccccttttttttacggggggggtttttaaaaaaccttggggaaaaaaacccccaaaaattttttttttaaaaaaaaagggggggggggtgttttttttaaaatatggggggggggttaaaccccccccccccccgggctggggggggggggggccccccccaaaatcaatataattccctcccggcggggggggggggggggggttggtggggaagaaaaaaaaaaaaaaaaaaaaaaatttttttttttttttttnnncccccccccccccgcgggggggggggggcgggacccca

SEQ ID NO: 16729 - DNA, 925 bp, Xenorhabdus bovienii
  unsure (1)..(925): unsure at all n locations
actttctttggtnntntncatagacccnngntattttccgnngnatcctnctagnagtcccttttagtncgnnatcattgnncgntggagttacagccttcagcccccaagcaagtttttgggcgggcattactttgtgttacaatgaagggaaaattcccgtcccttttttgtcccccgttcccccaaaaaaaaaccccccggggggtttttataaaaaactcttatttttttcacacacttataaaaaccccccctttgtttttttttgtggaaaatttttttaccccccccccctaatttttttttttaaattttttttgggggaggaaagagaaagattttcttttccctttttgtttctctcaccaccctattttttattttcccccccccgcgaaaaaaaaaaaaaagggggggggtgttttttttttttttttttataattaaaaaacaaccacccccccccccccccgggcgggggagataatttatttatattattttggggggggggcgcgccccccccccccccccccctcttgttttttgttaaataagaaaaaaaaaaacaaaaaaaacaagaaaaaggggggttttttttttttttttttttttatttttccccccccccaccccccccccccccccccggccgggggggggggttggggnnntttttatattcaccccctctcaaccccnntcctttttttttttggtgggggggggnnnaaaataaaaaaaaaaaaaaaacaaaaacccccccccccccccnngngcccaaaaaaggggggggaggggggggaggggggggggtttttttttttttnnntttttttttttttttttatattggccccaccccccccncccccccctctctctcttcttttctnnnnnnnnnnnnnnnnnnnnnnnnnnn

SEQ ID NO: 16730 - DNA, 881 bp, Xenorhabdus bovienii
  unsure (1)..(881): unsure at all n locations
nnaaaggggggnnnntttttnncattttggnnnaccnaggcnnacggcggaggcccgagggaaaaaaaatcgtgtaaannngatactagtatacaagccngnttccggggatctttaggacccgacttcggaaggaccaacccacaattccctttgggtttcctaaaagcattttgaattttaagggaaaaacccgaaatggaaaaagtttaaaaaaaacccgtgtttttttaagggaaaaaacaaaaaaaaaaaagccccctttttgttttttaatcgggggggggggaaaaaaaaaaaaaaaaaaaaagaggggcctttctttttggggggggggggaaaaaaaaagggggggggggggggggggaaccccccccaaaatttttttttccccccccccccccggggggtttttttttnggaggagggggggggggggggggggttggttcctttnnaaaaaaaaaaaaaaataaaattcctcccccccccccccccccccccgggggccggggggggggggggggggaagaaagaaaaaaaaaaaaaaaaaaagaaagagagcgnnnnncccnngggntttttncccaaaattatatatattaaaagaggaagggaggggggggggggtttttttttttttttttcttttttttggggtgcggggggggggagggagggggggggggggaaagattttttttttnnnnnnnnncnnnnnnttttnttnntttttggnnnnnnnnnnnnnnnnnnnnnannnnnnnngngggggggggggggggnngaggnannngagaaaaaaaaaaaannannaanannnaaaaatacaaacaccccccccccngccnnngnaaaanggaaaaganaaaaaagaaaaa

SEQ ID NO: 16731 - DNA, 821 bp, Xenorhabdus bovienii
  unsure (1)..(821): unsure at all n locations
gaaaagggnngaaagtaggnggtagttttgnnagtgctgcgatatcagacctnacggggntnnnnnnnnntcccccttccccnnccccggggggggggggggggggggggggggggggggnnnnnnnnnntttttttttaaaaaaaaaaaaggccccccggtccccccctccttgggggngggcccccctttttttnnggggggggggggggagataaaaaaaaaggggggggggggggaaaaaaaaaattattnnnnnnnnnnnnnnnnnnncccncccccccccccccccttttttaaataaaaaaaattttnngggggggggggggggnnnnnncnncncctccccnttcaaagagaaggagagcagataaaacatcaaacccccccccccatcagagagcagagagagagaaggagtaataanatctcatctgctggagcggaggcagaggnaggccggaggnnagggggggtctgttcctttttttcttcgcggggggagcggaggccccccnncnccccccccccctcttttaaaaaaaaatacatcttttccttccncngcccccncaggggaaggggaagggtctacccggggtgggcccggggggcggctggaggagaattatttntccttnttctctttncccncccccccccccccgcgggggggggggggtggggggggggggatggggggggtantgaaatttatntattttgtgcttnnnactgcggcggtggggatatttatattcccttntccccccccccccccctacgggggggggggnngggggggggggtttttattattt

SEQ ID NO: 16732 - DNA, 1263 bp, Xenorhabdus bovienii
  unsure (1)..(1263): unsure at all n locations
cattggttaataacccgaaaatattccggaggnctctncgngntanaccccccggngngggnatatccccttnctatngaaagattcctttacggataaataacaaccgaaaagannttttttggcaaaatcccgcctcttttccgcacaatttttcaccacnaaggatatagccccctagaagaacaatttattaaacaacaccatatgtcgcccggcggggagaggagtatatacaaaaaaaaaaggtgggttnntttttataaaagccccctctcgcgggcctctttttctttttataaaaaggggcgccctctgtgggtttttttttttaccaaaaaaaaatcttctttaccaacaggagaaagtggtttttgttttgttgggccacaacaaaaaaaataaaaaaaagacgctctgggggggggggagagattttattaaaaaaaacaacccccccccggcggcggaggggggggaaaaaaaaaatttttttttttttcttcccccaacaggggggtgtgaaaaaaaaaaaaaaaaaaatgcacccacccccccgcttttttatattaaaaaaaaaaaaaaaaaaggggggggggggggggggggaaagaggaaataaaaaaaaaaacaacccccctcctcttcctttcctccccccaaacaacaatttttttttttttttttttttcccccccccccccacaccacaaaaaaaaatattgttttttttttctctcccgcccgcccccccacaaaaaaaaaaaaaaaaaaaaaaaaaaaaatttttttttggtttcctctttcttcctccccccccccgccgcggggggaggagagatttttttttttttttttttttttttttttttttttttttttttttttttnngggggggggggagagaaaaaaaaaaaaaaaaaaaaaaaaaaaaaatgagggggtgggggggggggggggggggggggggggggggnnaaaannnnncccccccccccccccccccccccccccccacacacccccacccaccctttnnnnnnnnnnnnnnnnnnnnntnttggtnttttttatnaaaaaaaaaaaaaaaaaaaacaacacagcgaggggggggggggggggggggggggggggnnnnnnnnnnnnnnnnnnnnnnaanaaaaaaaaaaaaaaaaaaaaaaggaaaagaaaaaaaagaaaaanaaaanaantncctcttttttttnntttnnnnnnnnncccgcgccgcgctcttcttttaa

SEQ ID NO: 16733 - DNA, 1276 bp, Xenorhabdus bovienii
  unsure (1)..(1276): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnntnttntnnnnnnnnnnnnnnnnnnnntnnnntatcttgccctccgtacccccggggacccctcctcttctctcctcttccccccgcttcctacgaccactggagcctgttcttgtcttcctcttctgcacgtcgcggcctannatttttgtatccatctaactcttacagtcccccccncccnnccccnngnttttnccctcccccccncnnctacncnatatttacccnncccnncnnttnnttntctnntgtttnnnnnnnnnnnnccccccncccgnnccacaaacgcttccctcccctgggactccnnnnncccnnncccctnnnnnnttttgttttcctnnnnnnnnnnnnnnnnnnnnnnnnnnnnnnnnnnnnnnnnnnaaggggnnnngggttntttttcgcnaaaatttttccgagaggccccttccgngggnttaaaaccgggggnngggggggggaatttncccccctttcccttaaaggataaggtggtccccagaggaaatatccccaaaccccttnttttttntntccccctttttgggggcccatatttcccattttcccaaaaaaccggggggcttttttttctccccaattttccgggggctttnntttcttccccccccccccccccccaaaataaggaagcgggggggggggggtgcccccccccctataaaataaccccccttgtgggggggaaaaaaaaaccccctttttttttcttccccccccgcgccggaaaaaaaaaaaccccgcgcgcgggtttttttttttatttttnttataaaaaaaatattttttttgggggggggggggggggtgtttttctctccctttatattaaataaaaaatatttttttgtgtgtgggaagagaaaaaaaaaaaaaaaacaaaaccctcccttcccctcccccggggggcggggggggggggctctcctccttctcttttataaattaattggtggcgccgccccccccgccccncccctctttttttttgttatttaaataaaaaaaaacccccccccgcccccccgnnnnnnnnnncttttgggtttttttcccccccccccccccccccccgcccggcggcgggggagaaaaaaaaaaaaaaaaaatataatanngnnnnnnnnnnnntccccccgccccccccccccccgcgcccgaaaaaag

SEQ ID NO: 16734 - DNA, 1057 bp, Xenorhabdus bovienii
  unsure (1)..(1057): unsure at all n locations
nnnnnnnnnnnnnnnnnnnnnnnnnnnnnnnnnnnnnnnnnnnaacgagngggtgggacggggccccctagaggccntagccacgggncgcgcgcgggaaggttangggagctgactggcggggtaagatgggtncgcccggggnggggggagcgtttggggagctgcngctagggtggatagtgtangggaggaccactgtgggnnanaggggagggnnnnnnnggggggnnnnngatatacnaattccaaattcggtaaccgggggaatcctctatttccaaaaaacgaaataacggccttctgttttttcgccctttaaaaaaaaaccccttggaaaaatataaaaaaaaacccggaaaaaaatttttaaaaaaaaaaaaaaaccccgttttggtgggggtttttttttttttttaaaaaaggggggaaaaatttctttccccaaatttttttttaaaaaaaaaaaaaaaaagagggtgttttttttttttataaaaaaaacaaaacaatttttttttttttttttctctcccctnngnggcccccccccgcggggggggggggataaagaatattattatgttattattttttcttttnctccccctcccccccccttttttttttgtttttgttttttttgtggggggggggggggggggagaaaaaaaaaaaaaaaaaaaaaaaggaggcgggggggtgtttttaggnntttttatttattttttttattttttttntncgcaccccgggggggggggggggggggagggggtggggtaaaatgaaaaaaaaaaaaaaatnanannannannggcnnnnnnncnncccccccccccccgncgcggccggcggcgggngnngangaaaaagaaaaaaannaagagnagaagaagaaaagangnagaagnaaaaagnantaatnatatnttntcttttccccnnnnctggtttctgcttcttttcctcncttatataaaaaannaataanntanttntgntnncnnnncnngggtggggggggcggnggctggcctcctcttccctcttccac

SEQ ID NO: 16735 - DNA, 867 bp, Xenorhabdus bovienii
  unsure (1)..(867): unsure at all n locations
naaagggcgcnnngnnngtnttnnnngggctttctggatgccggagggctcgcggagatggccctgcccggagaggaacgggntatgagataaaatggtctttttaaaaaaaaggggcccgttacgtgggnnagggnccaagggccagggcttctcaaaaaaaggagggggggggaaaaaaaaataaaaaccccccgggaaaaaaaaaggggttaaaaaaaccccccatattccaacaaaaaaggggggggggggcgcgcccaaaaaactaccaaaggggggggggggggggggagnnaaaaaaaaaaantcctaaaccgcgcctccggccggggcggggcgggggnggggcggggnnnnnnnnncccnnnnccccccccccaaattnattaaaaaaaaaaaaaacaaaccnnaaaaacccaaaaaccccacgnaaaaagaaagaagggaggggggtgggggcgcccccccaaaaaaaaaaaaaaaaaaaaaaaaaggggggggggggggggttttttttccctcacaaccaaaaaaaaacaaaagggggggggggggggggggcccccccccccctcttttttttttttttttttaaaaaaaaaaaaaaaaaaaaaaaaaaaaaaaaacacncgagaggggggggggggcggggnnnnnggnngtatttgtgtgtttttcttttcttttcccncnnncccccccccccgcnncnncccnccccnccccccccgccccccancagcgacngggagagagggaggagaaagaaaaaaacccaaagccnccacaaacnnacaacacaacaacnccaccactctcttttcctctttccctccccatccggcgcccggggggcgggggggg

SEQ ID NO: 16736 - DNA, 1027 bp, Xenorhabdus bovienii
  unsure (1)..(1027): unsure at all n locations
gggagaggccccgcccngcgcttccggtatattttnnnnngnggaactgacgnatatncgagagtcggggttttccccggngggaacccctnctgaaggatccccacgggnagagccccctggcagaagagacatgtaacggtaaaatttttgggcccggaaaaaatttccggacttaccccgggtggggccagggaaataaagggggggggggaaaaaaaacaccctttttgggaaaaaagaccccccccacaacgccccccccatagagggggggaacaccccttttttaataattggtgggtcctccacccccccataaaaaaggcggcccccccccccgggggggggggtttggggccccccccaaaaaagggggggcgcggggggataaaaaaaaacaacccccccccccccaaaaaaaaaacccccccccctctctatattattaaagggggggggggggtaacccacacaaaaaaaaaaaaagagggggggggggtgttcttttttaataataaataccaccggcgcgcggggggggggggggggggggtgtgtttttttcctcccgggagaggggggacacaaacaaaagagaaatctattttttattttgcggcgggggggggggggggaggagataaatatatattttttttttttttgggggggggggggggggggggggcgcgccgcctttcctcttctaaacttctaaaaaaaaaaaagagaaggaggggcggggnnnnnaaaaagaaattttttttttttttttttttttncctctcttctccccccccccccccccccccccccccgggggggggggggggggggggggggggggggggnttttttttttttttttttttttttttttgtttgtttttgttggggggggggggggggggggggggggggggggaaaaggaaaaaaaaaaaaaaaaaaaaaaaaaaaaaaaaaaaaaatataaatttttttnntttttttttttttttttcctgctcttcctcggggggcggc

SEQ ID NO: 16737 - DNA, 977 bp, Xenorhabdus bovienii
  unsure (1)..(977): unsure at all n locations
nnnnnnggggggnnnnnnnnccccccnnnnccgcctttggggnngnnccccggctccgggcccnggccgggccnccaccannnngnnttnnnnnaaagccttgacttgctgcctgccgagtcagcacctgaaatgctgaaactgtgcccccattcagtaaaagccgccggaaattaagggccaagggccccccaaaatggaaaatgggaagggacccccaaaaaggggtttttcccaaacaaaatggggcctttttttctgggggcgcgccaaaaaggggaaacacaaaaactgctttttttttccccaaaaaaaaggggggggtttttttttttttttttttggggggggggtttttttcaaaaaggggggggggtggttttttttttttaaaaaaaccttttttttttttttttaaaaaaaaaaaaaacatttttttttttttgggggggggggaaaaaaaaaaaaaaaaaaacccccccccccccccccccgccttatttatttttttttgtttgggggtggggggggggggggaaaaaaaaaaaaaaaaaaaaaaaaaaattggtagagggggggggggcggggggggggggcggccacccccctccttaaaaaaaaaaaaaaaagagaaaaaanccccacaccccctcccctccccccccctcctcccctctccgcggtgggggggggggggggggggggggggggcganncccannnacaaccaccccaccaccccctctatcttnttttttactttttttgggnggggggggggggggggnnnnnnnnnnnnnnnnnnnnnnnnnnnnnnnnnnnnnnnnnnngnnnnnnnnnaanatannnnaccacccacaccctctctttctcctcnctcccnntnntggngccgcgngagggggggggggggggggncggnnnnnnntatnattataannaaannaaaaaaaaagnctaatatctttttgttatta

SEQ ID NO: 16738 - DNA, 988 bp, Xenorhabdus bovienii
  unsure (1)..(988): unsure at all n locations
nnnnnnnnnnnnnnnnnnnnnnnnnnnnnnnnnnnnnnnnnnnnnnnnnnnnnnnnnnnnnnnnnnnnnnnnnnnnaattatcaattcgatccggtacccgggaatcctctaaaccatggtagctgtccatgncaatccttcgcatactccacatcaacctaaaacatcaccttactaataaccacaccatcatccataaacatatttctaactctaacatactcaaaanannnnnnnnnnnnnnnaaattataccaattccaaactccgtaaccccggggaaccccctaaaaaacccctttttttccggttttcccaacccccaaaaacccccaatttaaagaaaattttttttcacaaactgggaaaaaaaattttaaaaaaaaaaaaaaaaattttttttttttttaaaaaaaaaaaaaaaaaaaaatttttttttttctctccccccccccaccaaatttttttttttttcccccccccccccccccccccccccttttataaacccccccccccccgggggggggaggaaaaataaaaaaaattttttttttcccccccccccccccccccccctcttttttttttattaaaaaaccccccccccccccctttttttttttttttaaaaaaaaaaaaaaaaaaaaaatattttttttttttttttnnnaaaccccccccccccccccccccccccccttctttttttattatttctccccccccccccccccccccccccccccaaaaccaaaaaaaaagagagaggggggggggtttttttttttttttttttttttttttttttatttaaaaanaaaaaaaaaaaaaaaaaggaaaaaattttatttttaattancattaacaaaaaaacacacacatcganngtttnnnnntttttttttttttttttttgngggtgtttggtttgnggggtgtttngngcgcgccggccccccccccccgccacacacaacaaaaaaaa

SEQ ID NO: 16739 - DNA, 1089 bp, Xenorhabdus bovienii
  unsure (1)..(1089): unsure at all n locations
nggggnngggggnnnnnnnnccccgggcccccccccccgggcgggcccccccccncccccccggccccccccccaggccccgccccgcggtccgcacggcggccccccgccccccgaaccccccctcgcgcccccccgcgcctcccggcccccacntcccttctttcggagggaaaaacccttttnnntttttttaaaaananngcccacccgcgcgnnnnnnnnnnnnntttattaataattttataaaagnnnnnnccgccgcccccccgggggggggggngnanaaaaaaatcccccccccccccnnnnnnnnccccccccccccgngggggnttttttttttttntttngggcccctccttcgtggnngnngnnggntnaccccctnnnctnnngannngatatatnncccctnccnnacccccccccccgagnagattgccccctnttnnntanntanttnccccccgnnngtannacccnncccctnntnntanatattntnaattttanacccccccaccgccatnccangnnngnatngttggaccctncccccngcccagcccgaggttttttcccattaanttntccccagcccaccctntnaccgnngcctatcccccnanttctccgncccatccccattgccctccctntcccccgccccggcccccctgtggaagagccctgggntnaaccccccaaangnatttatcccccngttatnaggnaganattcccccataaggccccgcccccataccccccccacccctanccccgcggttnttntcccccaatcgccgccccctatatacggggggtttttaaaaaccccccgggcccttaaaacccccccccaaggccgcgggagagcccccccctcccccccccccttttaaaaaaaaaaaaattnttccccccacccccccaaaaaccccccccgcggggggggggcccccccccaccccctttttttttttggggggcgcccccccttccctcccccttattatccccccccccccggggggccccccccccccccccggagaaaacacaaccccccccccccccctcttt

SEQ ID NO: 16740 - DNA, 949 bp, Xenorhabdus bovienii
  unsure (1)..(949): unsure at all n locations
ttttttnnnnnnnnnnnnnnnnnnnnnnnnnnnnnnnnnnngatgcgggaaatctctactccggatatttcatggcggttggtggagcgcagatggcgtggagtgattagaagtaggttattcngctcggcgatttgcggttcatagtgtcatgtttactgatcgtgactgtatactttgcctctccttcgagctctccctctgttaatggtgtctccaaagctttttcttttttttttttntncttggtgcgcgtggggggggggttttttctcccctttcaccgcgcaggagggtgaccnccccgcttttttttttttcccaccccacccacccttataaattttnataggncgccgnnnnataattatnngccgnnggnaaacctctttncgggnntttttttccccccccgggggnggnggnnntttaacccccttccnctttgggaaaagaattcncccccccgggnttttttnncccttgggannccgggngnnctttttnncctttttttttnaaaggngggcgggnattatgggnattttnnacccccccccggagaggnncaaaaagaaaatttttccaaaatgagacccccccttatttttgtgggcccggggaaaaaaaaaaacccgccccccctattttttccggggggcccttttttattttttcccccccggggtttgggggatttttccccttttttcccccaaaaaggggggcccctttttttctcccggggngtttttttttttgtgtcccccccgcccttttttggggggttttggggggtttttcccccccccccgggcgggttttttttttttttttccccccccccccccccctcttttttttttntttgttttcaccccccccccccacaaagggggtttgtcccnccccaaaaaaaaagagggtttttttttttctctttttggga

SEQ ID NO: 16741 - DNA, 954 bp, Xenorhabdus bovienii
  unsure (1)..(954): unsure at all n locations
gtaaattgggggnaagcccccggtttgtnngngngnannngnncncngctgntttgngngggtgagaacgcgggggcgnnnggnggatnactttccnngcctnngnggggcggggaangccccnnggntcttgaagaggnnanaagaaannnaaaaaaaaaaaatgtcctgtcnnnnnnnnanaaaaaaccgcccatccngaaagcttgggcctcaaaaaaaaaaaagcnnnaaaaatttcctttgggtttttttaaaaggaaaaaaaaaaaaaaaaaacccccaaaaaatttnccctaaaaaaggggaaaaaaaaagaaaaaaaagggggggaaaaaaaaaaaaaagggcctaaaaaaaaaaaattctttttggcccaagaaaaaaaaaaaaaaaaaaaaaaaaatgggggggaaaaaaaaaaaaaatctgcgggggggggttttttttaaaaaaaaaaaaaaaaaaaaattttttttttgggggggggggggggaaaatttaaaaaaaaaaaaaaaaaggggccgcggccaaaaaaaaaaaaaaaaaaagggaaggggggggggggggggtggggtaaaaggggaaaaaaaaaaaaaaaaaaaaaaatatatnnnttttttnaaaaaaaaaaaaaaaaaccccaaaanngggggggggggggggggggggggntaacctttctttttttaaaaaaaaaaaaaaanaaaaagggggaagggggnggnggggggaaaaaaaaaaaaaaaaaaataaaaatttnnntnnnnnnnnnntncccncncncnnncccnncnccccncgccnnccgggggggggggngaaaancggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16742 - DNA, 1320 bp, Xenorhabdus bovienii
  unsure (1)..(1320): unsure at all n locations
nnnnnnnnnnnnnnnnnnnnnnnnnnnnnnnnnnnnnnnnaaaanttggcgggtccattcggcgttaacgtggtggttgggtattaaactttggaggttagttgtttaggaagggagacacaggtccggacggccgaggcgcggccgcaacccatcccggacgcctcctttggggcgggaccagctaccccccacagccggggaggcgggcagcagggggcggaaacactttttaaaaaggtgacacccctttgggccagaggggggtttgcccccccctttaaattaaaaaaaagggtggaaactttttttttttttaattttggggcctgaaaaaccgggggggaaaaaaaaaagaaaaaaggccctttgggggggaaaaaaaaaaaaaaaggcccccccgaggggaaaaaaattttattgggcgagacaaaaaaaaatttttttgtgggggaggggggaggtttttttttttctaaggggggggggggggggggggggggaaaaaaaaataaataaaaaacaaccccccccccccacaaccaatattgtgggtgtgggtgaaanaacgaagaaaattttttttcagaggggggggggggttnnttccttctggtttgcaagagggattttattttttggggggaaagggagntaattcttccaagagagcggggggtgggcgcgagagatataatatattttctgcggngnnnnncagacccccccaaaaattggtgggggggggggggggagagacaccacccccccctnttggtggggggggggagaacaaacactctttttcttttttcttttttgtggggggggaggaaggaaaaaaaaaaanacaaggggcgcggcgccccgccgcctgataaacaaaaacaaataagaggggtgtgtttttttttttcgggcgcgggggcggcgcagaaaagaaaaaaaaaacaacagacggcgggggagagggggaaaatatatttttttttttntctgtggtgcgggggagcggggcgccgcctctttatttatattttttcttctctgcgcctcgcgcgttcgctctcgccgtggngagacnnacaacaaaaaattactcttttttttcttttttgtggttgcggcgggtgggcgctcactcttctctatcttttctctcgggtgtggcggggcggggtagttgttatatattatatcatcccacctcttccctctcctttcttttattataaacaagaacgcggacggcgcggagggaagaaggagatgcatggttgtttaccatcgccaccaactcaacacagttgtgtgatggtn

SEQ ID NO: 16743 - DNA, 794 bp, Xenorhabdus bovienii
  unsure (1)..(794): unsure at all n locations
tgattcgaattcagctcgtacccgggatcctctgagtccgaaggtagaacccgccgacattttcagaatcttcgtgactgtgctgggggaaaaacctgcccctgataaaaaacctgaggggatccccctggctttcgggaaggccaaaaatggggtttttttccccggagaacccgcgaaaaattttttgggggtgttttggggaaaacaccttttcttttttttggggggggggttttttttggggaaaaccccgaggggggggtaataccccccccctcccccccccttttaagagagggggagagaaannccccaaaaaaaaaacccgggggggttttaattaaaaggggggggtttttttttccgccaaaacaaaaaaaagagaggaacccccttttctttttttttttttttnnnaaaaaaaaaaaagcgcccccccccacaaaaaaaagagaaagaggcggggnngnggggtttttataaaaaataaaaggggggggggggtttttttttttttttttgggggggggggagagacccccctccccccccccccccggggagagaattttttggggggggggggggggggggggggattatttttttattttttgtttggccgggcgcgcccccgcacactctttaacaaaaaggaggggggggggggggtttttgtttgtttttttttttctccccccccccccccaaaaacaaaacanacacaaccnaaaccncctcttctgtgttttnacacacaaacaacaaaacgcgcgggcgggggggggggg

SEQ ID NO: 16744 - DNA, 1120 bp, Xenorhabdus bovienii
  unsure (1)..(1120): unsure at all n locations
nnnnnnnnnnnnnnnnnnnnnnnnnnnnnnnnnnnnncaccttccccacccaccggcccccgcgccccgcgggggcctccacgaccgcccgcaccgcagcccgcgggcccccccaggctccccgcggagggcccagccgcggcctgccggaccccgcggccccgcgcggtcgccaccccccccctgggggttttatcccggaaaaaaaaggggggggattcccccgggggccccccccgccccggggggggggggaccccccccccccccccggggggggggggcctctttttttaaaaaaaacccccccccccataccccccccccggggggggcccccccccccccccccccttttttttttcccccccccccccccgggggggggggagagagaaaatatcaccaaanaccccccccccncccccccccctttacaattntttatnntntnnttttgggggggggggggggcggggcccgggcgcccccccccccccccncccccccccnnccnnnntctttttaataaaaaaaaaaaaaaaaaaaccanaaccnggcgngccccacccccgcccccgngnggnnnnnnnnnnnnnnnnnnnnnnnnnnncnnncncnnccccccccccccccccccccnacnnanannnnnnnnnannnnannnnnaannggnnnnnnnnannnannaaaaaannnnananannnnnntctttctttttttttnnttttttnttnnnnnnannnaaaaaaanaaaannaaanaaaaaaaannaccnnaannaanannnananaccnnnnanacacccccccccccccccccccccccccaccttncnnttnnnnnnnnnnnnnnnnnnnnnnnnnnnnnnnnnnnnnnnnnnnnnnnanannnnaaaaannaaanaaaaaaaaannnnaaaaanannnnnaattnaaaaacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16745 - DNA, 509 bp, Xenorhabdus bovienii
caatcttttaccagacttaggcatgagctcaatattcttgattctagaaatttcttttgctagcttgcacacatagctcatttaaatacctttgatcatatctcttttgtatgctatgactaatgtgttttcaagtcgatttcaaaccaagtcataggaatgttgaaagggaattggagtcttcggcgaagacaaaggcttccactccgtaactcatgcttcgccatcactccgagcaactctctattccttggggagaaatgagcatcaaagaaaaggacttcatccttggaggagagagtaaaagctcaaaagcaaaaggaccggatttcgtctttggtataatcttaactcatttacttttgaccaaaggggaagaaattactaaggagggctctaatgattccgtttttggcgattcatgccaaaaagggggagaaatgagcccaaagcaaaaggaccgcaccaccaccaccaaattcaaaaacttagtgctttccaaaagtctt

SEQ ID NO: 16746 - DNA, 923 bp, Xenorhabdus bovienii
  unsure (1)..(923): unsure at all n locations
ttccccaaaacaaaataaatataaaaagggggggggaggggggggggggcccaacaaaaaaaaaaaaaagggcgggggggggggggccctttnggttgttttgtgtgggnnnnnccccccccccgcccggagaaggaagaaagagggggtgtttttttttttattaaaaaaaaaaaaaacccccccgccgccggccgggagaaataatttttttttttgttgttgtggagaaaaaaagaaaaaaaccccccccccccccccttccttttctaagagaagagaaagaaaaaaaatttaatttttttttttttttcccccccggcgggggaaggaatatttattatttttttccccccccgccggggggggaggaaaaaaaataaaattataaaaaaagggggagggaaaagaggggggggtgtttttttttttttttttttttttgtggggggggggggggggagagagaaaaaaaaaaaaaaaaaaaaaaaaaaaaagaccctcttctttggggggggggggggggtttattataataanancctctntggggggggggggggagagacccccccccctttttttattttttccgcccaggtgtgttttttccacaaaggagagggggtgttttctcttccctcccggggggggaatttttttggggaggggggggaggtgggaaaaaaaatatgggccaaaatagggcgggggtgggtgtaagggggtttttttttaaaaaaggttttgggagggacggcccccctttggatttccagggagacaagggggttaacattcagggcagggcttttttttcggaggccaccctcttttaattttgattnccaaaanatctcgnttgnaataggcgattcgnagncggggntgtaactggtggtgctncanctatgggtgtctag

SEQ ID NO: 16747 - DNA, 1061 bp, Xenorhabdus bovienii
tttgtggagaatcttacattcggctcgggagccggggatcctctatccccagaagggggaactataaggcgatttacccataaaggaggacggggtgcaggtgctgattgaatatttggtgaagcaggattgacatagtgtatgaaatattatgtgtgatatcatactaaggttacagtttaatatcgtgacgtcggtaactatgattctattaatcttttacttgtttttgtattggtttattaaatgaggtgtcgttatacccatattaaagcgataacgaaaccccccactgcccgatcgcgctgatctgcatgccaattggacgcattgtgtgcatttcattactcttactcttcctccccttccccttatctcctctttaataccctactccaacgaatcatcctctagctttgcgctcccattttactttcgatcataactatacgccaacgtacttttgcctcccccaccgtcgcaatcatcgatactattcccgtcgacgcctacacttcctttatccttgcaattgcatatcattacatgaattatttcttacgttcatcgcatatgtacctatatactaactttccacacttcttccacactcctctcttcctgtctcctcaacccccctatgaactcactacttggctccacacaccctctactcactaacacttttaaacacactcaagatattttaagaataatgaatagccatacatatacttactccaatatctcaaaacttactacttttccatactccccttattaacttctcacttttcctttcctcatacccatcacccctatatatacccacacccccactttccccatcccctttccctaccctcctccaccgtcctctctctctactacactccctcatattacctacatttataacatgttatttataatcattaacattcccaccaacttcatcgcttctattatctactctcttcctttaattgccccacatactcacctcatctccacttcacctcaccctaatcacctcctacaacaacctctccacccccacc

SEQ ID NO: 16748 - DNA, 1049 bp, Xenorhabdus bovienii
  unsure (1)..(1049): unsure at all n locations
ttttttttaaatatacaattcagagctcggaacccggggaatcctctatcgcgaatccagtccgtccttaagctggatgtctgcggctcagtgcgagaggcgggctaaggcatctcagcggtgggccatgatggcacccagactttacagtctgtgcgtgctcactaatgtggaggcgcagtgagaccagcagagtgaaagatcttcttacagatctgtgcaatgccatttgcggtgatgacagagaggccgtatatatcatgtgacatcagcagccgaattatagccatcctgcttgggtgtgcgcatatagcctgccttagactatgcacctgaggcagaagagacaccgctcacttgtgggcactgcgctgcccccagatgccataggaagaagagaactgcgcccctggttgtcgatgatgcgctatgcagcatcagaggagcggtagcgggtcccccacccagctccttccgtaatgctaggaagttgatccaatgtcctagacgtagtcagcaacagcatatttgtctcgcctgcctggtgtcccgccttgacagaaactcactcctgagaagatctcaataaggtgattagattcctgcaaacccttgctagttttattgcagtccacctatctcctgctccgcacataatcttggttaaaggccgtgaatttcctacctccagcaacgcccgcgtctttcttgacttgaagattccagctccgattcaatatcttcggctgttagcttccgtatcccccctgcccgcgtggcccgacagaatgccctagggtcaggcacttcgggagagttattcttgaatcagaaggcggagaccatacacccttctttctaggagagagccggtaatccaccatttggaccttcgtagaggttctttttgtggtgttagggcctcttacgccaaagtatctacaaatggcaactcttggggaaatacctacctatggncgtaaacaaccacatcccgagatgtgcccctgacgcattgataaagaaaacgattcatcgcccgcggacca

SEQ ID NO: 16749 - DNA, 166 bp, Xenorhabdus bovienii
atatacctttggtcatctctttcatttgctatgactgatgtgttcttcaagtgcattttaagtcatagattgaaagggaaatggagtcttcggcgaagacaaggcttccactccactccatcatattattcatccttcatcgtcactccacatcgctctccaaaat

SEQ ID NO: 16750 - DNA, 992 bp, Xenorhabdus bovienii
tgatcgattcgagctcggaccggggacctctataccttaattgtatatgttcgatatatatttgcaaattcatcatcattcatttaaatataaacataaaaatcaagtgctaaaacgaatctattttaggacagaaggagtattatttataaatattaataattacttgtatatatttggtcaatattaaaaatattccacttctcaaaagtcgaaataacactctttgtgcgactgggatagtatacacttccaaattcaattttaatacacattaaaaaaaatccacgcatggcaggccccaaaagatgggaaaccttgttcgccactcgcccactcgccaggagcagcagtgtctgtggctaggtagttatgcgggatcttattccgtgttcatttactctctgtctgtctatcaaggctgagatgatatcagagctagattactcacgtatacactagatttaaagtggtcatatgagcacggagcacagaatatgtttacagttatgcgtgcctatcactatcagtctatccaaaagacacacgacttccgtgaacgtcaactgaaaaacacgtcgctgcaggcgaatatgggattatggactgttgtgaattgggatatatattggcactccagctagcattacaaaagtgcccaggcatttccattttctcaaatggaaatccattttaaaaatgcaaaacactgtccacgtatgtttggattgctacctttgaccttcaaaccaaaaaaaactacatgtttggatgggttccaaatattggattggtaaagtcacgtgcctagctttctagttattttggcatgccaaagttggctaattcttggtcagccaaaatagacgccaaagttaggccggcccatgcattggcacaggcaatttgggcactatcaaacgcacccttggcgtcgaagaaagatgcatcacacaaaatcgagtaaagtggacctgcaggcagcaagctgc

SEQ ID NO: 16751 - DNA, 62 bp, Xenorhabdus bovienii
ctggatctgcgcgatctggccggagatctcgtgcgtcgccctggcggtctgctcggccagcg

SEQ ID NO: 16752 - DNA, 1310 bp, Xenorhabdus bovienii
  unsure (1)..(1310): unsure at all n locations
gggttattttggggggaacattacgggaatcggaattccgggactcgggggatcctcctaaggtccctgcaggcctctctgagcgcatatgccgagatggggcatgatgacagaggagggtaaatgatgcgtcgtactaagcagctaggatggttgacgcgcagagcatcagccagatgctagagggccagctgttagctaagcatgagaaagccagagaccgagacaacaagcggtatagagataaaactcgccctcgagcagcgtacttccatagaacaatagagatggttaatgcatgccatgatgctcagtgagtnacgccagatgtcaccacatgaagcaatacccaatcagctatatgctgtaatagccaccatcgatagtcgcagcgctcctagctgagtatttcaggaggtgaatatgaagccagtacatattattagttagctgaataggagtagactagtaggtgctatacggattcagggcattagattctgggcttgctcctagagtcagtatccctgctcagcaggaggttttatacataggcctatactgtatgtatagcccatatactgcactccctgcgtacaaggtaatccctcttggaagtatgtctatgcctcactcatgctggctgactttttcataccaactactcgcgctctctccgttcaggctcaagagttagcagctgcacggtagcataattcgatgtcctcccttcctgttcgtcatttatcgtagtcctactgaactcccttgagcatgcctaattctctccacacctgagcactattttacacctggacgagtggcagctttcaacaaagtctcatcggaatcattatattggattgggtagtccttcgagcactccanagcacatgttatagaacactaatataggtctgagatcttacattattctactattaagctacttatatcgtattaccgaatcacaagtgtnaatgtgncgtatgactgnctcagcgggacttgtgtctatgaggtctcctaacttgctcgtgtagtctcgcctacgtgtctgntcgtgcctctgtcatgcggtcgcgcagtgtgtgcttccaactcgccgcggcgcgtctatcggcccgtgtagatttatctatacgaacatcctgtcnatacttcgtctggagatgtgatgctactataactcagcgttctcactctcatttcnttgactctccctgtacgttcttctgcgttgctcttcttcctacgtcgcgaccctacccttatacatactcggtccctgtatatacatctgtctacct

SEQ ID NO: 16753 - DNA, 1077 bp, Xenorhabdus bovienii
gcagcttgatgcctgcaggtcccctaaggcccggatgtgtccgcagtgcaatagaacaaagtgtccacacaaatggtcagacttcgggcccttctagaggatcgcggacggtccgcccccgaggcccggacagtccgcgcgaccatgacttcgcaattttcaaacatgcttttgaaagaacttttaactcacgaaatgtgaagcgctgttagtcctcatgcaaatgcaactacttgatgctctatgaggcactaagttttacacagatctaagccattgactcctcttaatagtacggctatctagcctactaatccggtcaggtatcttctctaaacacctcaagaccagcaaaaaagacacctctattatacctttcccttcatctgatccacaaccaatgcgtatgattcttcaacatttcctgttctatgtggtccaaccctgcattcttatttctccaagaatcgttagtccacaagcagttgtcattaattaccaaaacattaccaaaggggcctagatgattcacagtttgggcctcggcggccgcagaaaacacacactacaagataatccgatcctgcaggctcggatcttgatagttgaagggagcagcagcaccctcggcgtcgactacaccttcggcgaggtccgacctagcctcggacgacgacgcggtccgaggatctccactctgaaggacgacatcatcatcacgcccgggccatcgccgccagggtgttctccaagaatccggctcgagcaggcagctcggctggtcaccctgaggcctcggccagctgtcccccgaagacatcagccccggcccaaggcctcggcagatcaactccggcgtcggccccgctaacggacgacccgggcaggctccgggcgaccaagtcttcttttccaggcactctggcctctgtcgggctgaacccggtacccctggtttcggttcattgaaaagcggccgaggggtttcctttaattaaccaagagagcctcaaatacagttccaccgaacccggggacttccaaccccccgggatatggatacctccctgctcccca

SEQ ID NO: 16754 - DNA, 1001 bp, Xenorhabdus bovienii
atattatctttcgtttatcagtcacatcgaaacatgtgcttatgatgctttcagcaacattacgctcttggtgcatcaagtctatgttgtgcggcatgatcaaggcttttgcatacggaagatcccatattgatgaaatatgggtccagttgtggtcctccccgtagccttgaaacctatcattttctccttgcttcagacaagcatgccatgccattatctgcggtgcagtttgcctctttggtggcccatttctgattttggctccacttctgaatgcagtaagcgaattcctgaaatcatgcttgaatggagtccaacgtcgatgagcatcaaagaatgacactttcccaccatgcttcaatctgaatgcatccgtatcattcatacatatgggacagcacaaccgaccatgaacacaccatccagaccaatctccatacgccagcagatcatgcactgaccacaaataagcagcgcgcatggtaaactccttttcagtatggctgtcataagccttcacacctctccacaattgtttcagctcttcaattaaagggcgaacaaacatattcagctttggccctggatgctcggggcctgggatgactagtgcaaggaacatgaactcttctttattgaccaactcaggaggaagattatatggcacaatgaagacaggccaacacgagtaagggcttgcactggtattgaaaggtgtgaatccgtccgtcgatagaccaagccgtacactcctagggtcgttgcaaattcgggatcaaactcgtcaattgccttccacgcatcaccgtccgacggatggaccattatgtctggatcagtgacgagacgtacaccattctttggcatgtcatatgcagagctatttccttgtttgaggaacaccctgaaagccaagaatgatgggccaaccgaccaagttgcttaactgccacctcgtaactaccatttcccctcatcatttgtcactccaaaattca

SEQ ID NO: 16755 - DNA, 491 bp, Xenorhabdus bovienii
  unsure (1)..(491): unsure at all n locations
aataaatatataatatattttcatcccccccccccgcgggggggggggggaaaaaaaaaaaaaagagggggggggggtgtgggggggggggggggnnaaaaaaaaaaaacccacccctttggggggggggggaggggagaaaaaaaattttttttttttttttggggggggggggggggggggggggggggggcggggctcttatttataataatatttttttttttgtttgtgggggggggggggggggggggggagagaaaacaaaaacaaaaacacaaaacaactattatattttgtttttttttggggtgggggggggggggaggggggaggggaaagtaaaacacttttttctttttctttggtgggggggggggggggggggggggggtggtgtttttttttttttcttttctcccccccccccccccccccgccggnggggttgggggattaaaataaaagaaaaagagaagagagagtgggta

SEQ ID NO: 16756 - DNA, 396 bp, Xenorhabdus bovienii
  unsure (1)..(396): unsure at all n locations
cccccccaaaaaaattttttttttttttttttttgcgccccaggggcgcccccccctttttgggggggggggttttttttttaaaaaacccccccgcgcggcccccccggggggggttttttttccccccccccccgccccgggtggggggttttttttttatatccccaaaaatacaccccggggtgttgttccgcgggagggttatagggttaaaaaattgccctttattggattcccnnccggttaaaaaaaaggncccgggnnccnctnaggnagggtannccnncggggatnnnncnggacctcntcgnttataacgncntagtcntnccnnnnnccaaaatagaacctgggagccgggggcggtggcctctgggcaaacgcgccactccc

SEQ ID NO: 16757 - DNA, 773 bp, Xenorhabdus bovienii
  unsure (1)..(773): unsure at all n locations
cgcggagagcgcaccggcacgcccaaagcggcacgcggccgcccagacacggcggggggggaacccgcacgncacccgacaccccaccgagggaccaggggacgacccacgaccggacgaacggaggggccgccgggacgcgacgcgggagggcgcggacaacgngggccggncggggccagcacaaccgacngcgccacggcccggaaagggcccgggggcgggcggcgccgccgcccggcanggaaggagaaccgggccggggcggcgggcgcagcgcggggagccgngcgccgcgggngcccgcgcccggcgcgcgcggccgcccgccncccggccccgggcgcggacgcgggcccggccggcggcccccggaggcgggggcggcggggcgccccggcaagcgcccggacgcccccccagggggcngcccggggggccggggcgggccgggcccgggcacgggggccggcggcccccccgcccgcggacaccgccggncgcgggcgggaccccgcgccgccccgccggcggcgccagccgcggaggccaaggcgcggggcggcgcgcgcgccggcgggccgccccggggggggccgcgccggcgccggggcccggcccggggcggcggccggcgccagggcgcgcccccccggccccgcggggcggnggcgggggggccgcgccccgggcgggcggcggcggaagcggccgcaccgcgcgggcgccgncggcggcgcggccacgcccaacagcaaagacaacacaaaaaa

SEQ ID NO: 16758 - DNA, 692 bp, Xenorhabdus bovienii
  unsure (1)..(692): unsure at all n locations
cccgccccccccctctttttgttctccccccccccccccccccccccccaaaaaaaaaaaaaaattattgtgggggtgggggggggggannnnnnnnnnnnnnanaaanaaaaaaaaaacccccccccccccccccccccacaaaaaaancctaaaattttttttttttttttttcccccccccccccccccccnccccccggggnagaaaagaaggnnagnngggnnnnnnnngnggggggggggggggggggtttttattntttaaattgaaaccccaacccccccccnccccccccccccccccccccgcccccggggcgcgggaaaaaggnnnaaaaaaaaaaaaaannanaaaaaaaatattattttttcttcccccccccccccctcccccccaccaaaaacccaaaaaaaccgngcgnatagtttagagntgattagaaaatattttnnnntnnaaannnnaannaaaaaccaaaccccccccaccccccccctgcgcccncctntttataaaaaaaaggggaaatatntaataggntaaaatttanntaaaaataataaatataaatttaagtataaaaaaaccacccctcaaacnatctactagtatgaaagaccaccccgcgntctcaccacaccaagaccccgacgcaccaaacaccacaccaagtcaccaattttcttat

SEQ ID NO: 16759 - DNA, 784 bp, Xenorhabdus bovienii
  unsure (1)..(784): unsure at all n locations
gcttttctggctgcctgcggtcctttcctatctcgattcggcggtactcagattggaatttgcccgctagcaaatcgactttttgggccttttccggctttccctagggggcgttttttgggatccaaatttttaaattcccgggacaaaagggacccgcggcggttttggggctctcccaaaaacccaaaggggttttgcccccgtttttttttttaggggggcggaaaaaaggggggggggggggccccccacctggggggggggaaccacccccccccgggagaaatttttttttttttggccggccgcccccccccccccaaaaaaaatggggggggggggggggggggggaaaaaaaaacccccaccccccgcggggggggggggnggggtggtttttttttttttgttcncccccccccccccccccccccccccccccccgggnggggggnggggggggtggnnnnnccncnnnnntnnccccccccccacccccaaaataaattatatattaataaaaaatnnnccccccggggggggggggnggggngngggnnnaaaaaaaaacacaccccccncccaacaaaaaaaaaaaaaaaaaacaaccaaaactttttttctttttgttgtgaggggggggggnngggggccacacacaccccccaaaaatagaaaaggggnaacaaaacccggcgggcgcgaaaaaacaaaaaaactatcgaaagagaaaaataaaattaaacccccccnnnngggggccgcaccccccccccccctc

SEQ ID NO: 16760 - DNA, 724 bp, Xenorhabdus bovienii
cgtgtgaagggctggatccggcagtaagtatcgtctgcactgctatgccctgatgctctcatttgcagcgcgtacatacactactgctcggataagtatccccatccggtcatgagtcatacgaacgggagggaccttggccaacacccgggcaaagaaaaaaagggtttttttggggccccctaacccccttttcacgcggggaaaccaaccccccgcgcccctctttatttcagaaaaaaaaaccctccgccggggaaaaccataagagagggggggggtgggggcgcgggggtacccctatagaagaaaattttttttttggggcgcccctctccccccccctttggggagcaaaaaaagaggggtttttttttgggggggggccgggggggaaaaaaagggggtttttttttccccccccccccttaaaaaaaaaaaaattgggggggggaaaaaaccaaattttttttttgggggggggggggggctgtaaaaaaaaaaaccgccggggaggggggccttccccccccccccggggggggggggggagggagatacttttcgggggggggggggggttttatttttaaccaccctattttttttttctcccaaaaaaaagaggggggaaaaataatttggggggggggggtttttttataaaaaaggctgttttttttttaataaaacaccacccctcgctaaaaaaaacaaaaaaaat

SEQ ID NO: 16761 - DNA, 863 bp, Xenorhabdus bovienii
tgatttggataatgcctctgccaaagaaagagcagggaaatcacctaggtttatgaacttttcttttccattcttaaagtaacgatagacaaagacctttcttcccgatggatatgttttaactcctaaccttccagttcctcgtgttgctgctgcttgccatgtataataggctgagtttttgggtttcaagcctcggattttactgtcagtcaataaagtactagccattgatatatccctcataacaggtcaagtagcgggtcaagttatgatgaaatgatatgcaactacatgaaactgttcaagctataaaatccgttttaaatcaaaataatgaaaccaagtgaaattgtaagaaatagagtgaaatcaaaggtttttgcccttctaagccgtaggtcacaggttcgaatcctgtagggcgtaccataaaatcaatcagttacgataagaaatgaaaaacccgctataacaacgggtcaggtaacgggtcaagttatcgctacttcttctctctcacccaagcctcatagacctcttcaggccatcctagaaatgttccaccagcagtcttatctggtttaggaaactcatttctttttgcgtacattctccaaagggttgttttgctttttcctgtgagtcgttgcatctcttcacgcttaatgtatcttatcgccatgacttgcctccctctctgatagccatttctcaaaactcccttgcttgtgctcgggctatctgtagtaccagcagggcgtatctcttggttgttttgattactgatatgcattgctcaggggttttggtttgtgcccaaattaagatggaagaagaattttttctggctccatttgacc

SEQ ID NO: 16762 - DNA, 797 bp, Xenorhabdus bovienii
cctacggacagtggtttttttgacttcgaaggtgctattccttcgaattccaggaacgctggatggtgacgggaatgcaaccctattaaaatgcgttactgaaaatattggggcaatgctatgagtctttttatttctgaattgagttctgaatgtcggctctaacaattttttacagaaattatcaacgcttatagtctgtaaccgtcattccgcacctaattaatgaattacttatcgtgacaaaaatcacaattctagttattgggttacttagcaactttagtggatacatagttattatattaggttgaattattcccaatttacattaagaaagcaacgtattctcatcatagatgcaagtgttgttggcggatccaactttcaagtgcaacatcacctatgcagcctgcagtaattctttatcgaagactgccatatctgccacagaaagtctaaaaacagcaaaatactggcaactatcgcgatcatgtagccatcttcgacgaagtaaatttccaaaataggtcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatca

SEQ ID NO: 16763 - DNA, 677 bp, Xenorhabdus bovienii
tgtcgatcgctgaccggtcttaatcggacagtgcccaacagcatggtccggctgcaaaacgccttggcgaaaatttggttggcggcccctaaggggcccttcaaattttttttttttaggccccttaaaaggggggggggggggcccttggaccccttttggggggggggtttcccccacaaaggggcccttagggggggtgggcccccccccggaaaaaaaggggggggctttttaccgccccccccccacgggggggggggggtgtttttcacccccccttttttaaaaaacccttttttttttttttttaaaaaaaattttttttttttttttttccaaaaaaaagggagggggcccccacacaaatatttttggggccccccccccccccccaaaaaagggccgcccaaaaaaaattttttttaaaaaaaagaatttttctttttttttatttccccccttttttaaagggggggggggggggttttttttgcccggggggggaaaattttaaaaaaccagcgccccccaagttggtgggggaaaaccgagggccatttggggttttccttgtacaggccacctccaacgaaagatggcaaatgtgcaacacaaagccaactcctgtcgtattgcgaccagaagatccgggacgaagcccgaattcgaacaat

SEQ ID NO: 16764 - DNA, 1126 bp, Xenorhabdus bovienii
  unsure (1)..(1126): unsure at all n locations
tggctgcgttttggggggccgggctcttgtggggtgttttttaaaaaaatttagtttttggcggatttttgccgggatttcggggttttcccccggggggggtacccctttgagggggtcccttctcaaaatatttgtgggaagggcgtttttgggggggtttttaaaaccgggggaaaaaaaccccccccccccttttttttttttttgggggtggttcgccccccagaggaataaaaaaaaaaaccccctggtggggggggttggtggggggggggggtatccccccccaacaaaaaagagggcgccccttttgngggggggggcgccttctcttttgtttttttctcccccacaccacccccccacgggtgttttaaaaccaccctccccagggaaaaatagttttttttttcacacacactatcttttatgggagacctctctccccccagggttttttttttttttgtgtataaaacacgcggagttttaatttggggtgtgccccccggagagggaaaaacgcgcccccaattcccaaaattcttccccagagttcccgcgaggttattggtgcggagggttttaacaaaataaacccccggtctttatttttaatatggaccatcgggaggggaaagttttaaaattcttcttggaattaaggtgcccataaaaaccccccgcctgtatcggtcgatgactccaaatgttgactcggatcgggngcnaagtctaaaaagcggggttatacaganaatagcactgaggctgttcaaagaatgtcntctgatgggccnttatctgactgcnaactagtanccaagaatactgggaggcatagtactcaatgctggacnagtcggatgaccgagcaggtaatntagctgnccagcnaagactgcgccgtcagactacctctgcccgtagatagtagcgagtacgctagaaagatagcgtaacaggtctgatgctcttgacagtctggtcactataatgtgcgaaggctaagatctgtccagtcgacgaacaagactctgctggatacagtgcggcgcgtctgggacccgactcataggtaagctcngtgtcgatgacatggaaagagcaaggtgagcaacat

SEQ ID NO: 16765 - DNA, 1393 bp, Xenorhabdus bovienii
  unsure (1)..(1393): unsure at all n locations
tgggagggggtaagaggcgaatcgagccggggcgcgggggaccccaataccccacccgcccggnnnnccnnnncctttttcccaaaaaggagagaaggaaanggcagcccacagaggaaangaaagcaggcacaagaaaaggagagacgnacagcggaacagacagggagaaagaaaagacaggaagagaaaaagcaagacggaggagaagaaggacgagagggaaaaaaaagacgaggaaggaaaagagacagggcaacaacaagaccaacccaacaggcacccagacacgcgacacnccgggaagagcaacaacagaagccccgnggagaagaccgcagggacacaagaaaaagaaaacacacaaaacgagcggacaaagcgcaaaacagaacagcaaaacgagcaacagccaaacaacgcaaaaaagaacaccacccaagcaaacagaaaaaagacagggggaaaacccacaggcacagaaaccaacagcgccacccacccacccgcgcacacccggcccgccgcaaacaccacacaggagcgagaacacaccaaacacccccacaggcacaagcgccaacaagcaccacccgcaaaccggcccacccggccccaaccacaagcacacaaccaccgccaagagcagcccacagccgaccaaagcggggcaaccccacaacgcgccacgcacccccgccgaacaacaccaacaacaccagccccaacggacgccaccacgaaaaacagcaccccgcacacaaagcgaacggcaaacggacaaacgcggaacagagcgcgaaaccccgcgaaaccaaccgcccaccgaccgcccccaccaacccgcacacacccgccaaacacggcggagaacaccgccacacaacccgcacacacaacacgaacaacgccgcgcgcacnaagcagccaacagcaacccgggcacaaaacaacagccgcgaccacaccacagaaacagcgccancgcaaaacaaagcgcaacaaacgccgaacaagacccagcggaacaaaacgcgccgaacaagaaagacgagnancacgcgacancgacgccnggaaccnaacaccgcacagacaacaccccacacacgcgcagacgccaccgcgccccaccgccgcacagaccccacagaaaggcaaaacaaccacgagagaagacaacaagagaaaacgcacgaagaagacgagccaaaaagggcggcccggacacagcgcgacgaacagacagccgccgcaacacaccagccccgccacccaagacacgcgcacaacaacaactaccgcaagcaacaaaccggaaccgaagctcagcaacgacctacgcgcagaccacagcaaggtggagaaggcacgagtaaaagcagacaacccg

SEQ ID NO: 16766 - DNA, 361 bp, Xenorhabdus bovienii
aggggtggggggggtgggggggattgaaaaaaccccttttttttttttttttaaaagaggggggggggaaaaaaaaaaccccccccccccccccccccttggaggggggggggagggggggggtgttttttttttcctgcgggggggagagagagaaattttttttttgggggggggggggggggggggatataaaaaaaaaaaaaaaaaaaaatttttgggcccacaaaaaaacccccccccttatatttttttttttttaattttgaggggagaaagaccccccaaatttttttttttccccccccgccccccccccgggggggttttttttttttttttttcttccccccccccaccg

SEQ ID NO: 16767 - DNA, 1131 bp, Xenorhabdus bovienii
  unsure (1)..(1131): unsure at all n locations
aaacagaatgtcagtcaatggcctatttttagaggtttcactgggtaattcgtggatcaaatcggtcgtaaagccagtctggacgtgctctggacgttggccgcccggcggcgtcacttggtaatcccttttcttcaacacaagggaccaccattagaacatcatcctaaacctgatcacgcctttatgcagtcgctttacccgaaaatcggattgcaactcaaacaacatagcttgaactcagaaaatactcaggcaggttgtgccaaatgcggcgcttgttcttcgctgaaagcatatgaataaggagaatatgatatggaactttctcgttatgcttgtctgtttgggctaaatgaagagctgaaacaatttattagcgatgacattgccatcaaaatggtgtcggaagattgggaacgccgccaatattatcgtttgcgtgaagtgacctttcgcgatgaacagaaaatcttaaaagaagatcgtgacgagtaccatgttaaagcattaggtattgttgccattgagaaaatggcgggtgagcatgaccgtgtgattggcgcagtactgatttttcccgatggcgaacacacgtggtatggcgggcgtttatgtgtagagcctctataccgacgtcaccataccattggtaaagcgttaatcaatgcaacggtatcgaccgccaagaacttgggatgctgtacttttttaacccaccgggccaagtcaaaatgaacactacttcccaagaattgtgttgaataagtttatggaagatgaccgttcgccacattccacattttgtaattcatgcacagatttgaaactattcctttcaggttattcggatccaaacctatattcagatggatacccatcatcgaacctcattaattacctccaatattgagaaacatcaacccccccctanccatacagcttttgtattcatcatttaaaccattccaattcggcccttccatccctccatgattcttacataggtcacctttattcctcacctcgcatcaccccgcacaacctccaacatatggacctttacaccaccccctctaacactatccagccattctgccgcccttcccctntctttcgcctgtcagcagg

SEQ ID NO: 16768 - DNA, 51 bp, Xenorhabdus bovienii
ctgccggtggcgtggaagaccgcgttggcgatcgccgccgcggtgccgacg

SEQ ID NO: 16769 - DNA, 179 bp, Xenorhabdus bovienii
agcctggtcctcttcctaaaaaacgtcgctggagtgttttaaaattatttcccccccacctgtttttttttgggggcccccctttttttttttcccccctttgggggggaaaaaaaaaaaaaaatattttttggggcggccccttttttttttaaataaaaaaaagggggggccccccc

SEQ ID NO: 16770 - DNA, 370 bp, Xenorhabdus bovienii
ggggaaaggggttttttttccccccccccccccctcttttttttttttggggggggggggggggggggccccccacacccccccccccctccggccggttttttttgttttttaaaaaaaatataaaaattttctccccccccccccccccgggggggggggtggccccccccctcttttttttttttttttttggccaaacaaaaaaaggaggggtgtctcccccccccccccccccccccctcaaaaaaacaaacatattttccccccctttcccccccccggggggcgggggggcggggggtttttttaaaaaaaaaaaaaaaaaaaggaggggggggggtgggtatacactcccccccccccccaa

SEQ ID NO: 16771 - DNA, 943 bp, Xenorhabdus bovienii
  unsure (1)..(943): unsure at all n locations
ggggtttggttgtgtggttgtaaaaaaaaaaaaaaaaaaattctaaaaaaaaatactctcccctgtgggcgggcccccccccccccccaccccccccccggtgtgtgtggggtgtgccccaacccacccaacaaaagaagccctctttttttttttttttattctctcccccccccccccccccccccaaaaatttttttttggggggggggggggggggggggcgggtaaaaaaaaaaaaaaaaaaaaaggaggcgcgccccccccgcccccccctcgtggtgtgtgtggtagaaaaaaaacaaaataaaacacaacatccttggtgtttctaaaaagaaagaggggaggaagggttgttctttcgtcccccccccccccccccgccccccgcggagagagaaaaagaaaaaaaaaaaaaatttttttttnccccccccccccccccccgcccgccccgcccctattattttataataaataaaaagaagagaggggtgttttttttatataataaaaataatcccccccccccccccgcgccgagaaaaaagaaaaacccccccccccccccccccccgccccccggggtgggttgttgtttttcctcccccccccccaaaaaacaaacccccccccccccgcgaggagaaaaaaaaaccccccccccttttgtgggcccaccaataaagaaattccccccccccccccctttgttggggggaaaaaaaaacggccggccggcccccaaaaccccaggggggttcacaacccccccccccgtttttcccaatgagcaattccaaaattttaaaccccttttgcccccnccgctttggaagcgtcccgttaatcgaattcagccatcacgcacagctgtagctagctacaatcgcctcatactacgctacgagtcatccattctcaaccgcagcacaaagtc

SEQ ID NO: 16772 - DNA, 788 bp, Xenorhabdus bovienii
  unsure (1)..(788): unsure at all n locations
caacccgcgaagcagaaaacactagcgggaaaagccgacagcgcaaggggccggagccacgagagncaacaacacgggcagagngagcgacaagccagggngacgggggcagccggcncaagggcggancaggcaggggagacganggngaagcaggccggaggaacaccaggactgcgaacccagggggagacgccaccacaacaagagagaaagcagaaaagaaaagaaagcccaggaggcgcgccgaacaagcaacgggcggaccccacaaaacagaggaaaaacagggcgaaacacggcacgaagcaaacccaaaaaaacacccaggcacgggcacgagacgcagcagagngagagaagcgcgcagaagaacggcgccgacaaaaggacagaccggagaanaggcaacaccggcacagaggcagngacgccaccaggaaacagaacgcacggcaagccgcaagagggaaaccgaggaagcgaacgaagccaaggagacccgccagnacaacgcaggagggaccgaangagcggacaggccaacgaaggcaannagggaaggaaagnggggcaggcggaaaaagggaacagccaaaaaggaaagcagggggacgaagacccngagaagcaggaacacaggaaaaaacccggcnacacccgggaggccggaccccgcccgngcccaaagggggaangcaaaccaggggcggggaagggacacaggcggccgggcacaccnagccgagaccgcgcgaaccccgggcccggaagggccccacaaaaac

SEQ ID NO: 16773 - DNA, 720 bp, Xenorhabdus bovienii
  unsure (1)..(720): unsure at all n locations
gatcctcagagtccgtttgcgagtagcggccctgcacgacgagaaagatgataagattgaaaatagcgtccaacgtttataccttccggggaaaccccaaaaattttggaagactttcccaccgggggaaaaaaccctggggggggggccccccaaagggggaaaaaccccctttaaaaaacccccggtttttgggggaaaaaaaaaaaactattttcccgggggggggggggcccaaaaaaaaagggcttttttttttttttttttttttttcccccccgggggaaaaatttttttttccggcccccccaaaaaaaaaaaattttttgggggggccccaaaaaaaaaaaaattttctctttttataaaacccgcccngccttttttttttagaaaaaaaaaaaaatcccccccccccccccccttttttttttttctttttttgaaaaagaaaaccccccctttttaaaaaaccaaacacccccccggccctttttacggggggggcctgacaaaaagagggggggagaagcgcggcttccttgtataaaaaacaccctttcaatacacgccccgccctgaaaatgaaggagagaaactttaatattttgctgcgagctacaagaaattgtgcaattccttggagataccccggtgggtcttgggttcatggnanaaattaagttgaactagaacaaagaaaacacactttccctctta

SEQ ID NO: 16774 - DNA, 175 bp, Xenorhabdus bovienii
attccattccattccattccattccattccattccattccattccgttccattccattacattcggattgattctattcaactccctaactctccattacattccattccattcgggttgttccattccattccattccattccactccattccattgcactcgggttgattcca

SEQ ID NO: 16775 - DNA, 956 bp, Xenorhabdus bovienii
tgcttaaggaaccgccattagaaataactcactcggtggataaccgaatccgtctgtaaaaatatatcgtccccgcaggctttgagcctttttctactagtggcggctagccaaatttggctagaaagggagccaatttgaagagccagatagcttggcaagttggatggttaatctgttggagagttattttgtattgagtaatcaaaatttagcttgctgagccatttgactaatctcttggagatgctcttagcaaggcttgggcaagagactcctatataatcactagctaattgatcagcccttctttcttgcaccgtcattccagctcaatgcgcatgtgcagcgtagtgcatttaattttcagctaggtctaggtcccttggtggctccccttcgcacagcagagagatgtgtgcgttgttggttcgccggcgaaaactttggccgcgcatattattggatgcatcgatgacatgcacgttcgtgcagtgctaaccatcggtcgtcaatgcaagtgcagcgagtctagattaaggacgctgtgcatgattaacgttatttcccgatcactttatatacattgactacgtatatattagcatgtgttaaattaattagctgcgttgcgttcatacttcatacacagatgtcaatgttggaacacttggtactgtcctgttgtttattcccataccgcacacatatccctctctgaagtttccattatatggtgactgaggcattgtcgacagtcctactctcggtaaatatcatcaataccgagagtaggactttgacgagtgcgggactcggcaaagactgctttgtcgagtgcccgataaaaagcactcggcaaagcgccaatcactcggtaaagagtctgattccggtagtgccccaaatacagagcttttacattgatatagcaggatgatcgacctcaggcatca

SEQ ID NO: 16776 - DNA, 1316 bp, Xenorhabdus bovienii
tttacaaacgttggtcaggggggcgccccgacaaccggccaacacttcacacgggcagattttaatctgtccgtgggaggggttctctgactcgtcaccggatcaattccgtttcgttccagatagagggccagtgatagtaagagtctctaactagtcaatttggaggttcttccattagaccaggcacaggctctctatgtttcaaatagagcactttggctaaactagggataggtgtgtgttgtatggggtttaaaagaaaaaacaatgaacaagcaagagaaaagttgcctgaatattgcaaaattcattcggggacagacgctgttattgctggaaaaaatcaatgaactggatttggatgatgaagcggaggcgtgtgagaagttgcatgatgatgccgaggctctctatcatcaattagtgtcgagatacggtgaggaatgagcatgaaaagacataaattaacagattccgaagaaaaaaggctagccgaggcctttcgggagtatgccatcgggtcgcgagccagggcatcgaccagaccgctgatggcagtaaccagataggcggttacgcgagccggatcgatcccgactacggcctgagcagtcaggtggaaaccggcgcccagatcatccaccgacagggtgagcggatagttgctctgttcctcaacggcgaccacgcgtataccggtccaaatcgtgttaaccgcgtctgcctcgctggtttggctatgacggtaattaagcagggcactgaacagtggcatcgactgcggcacgccactacagcgttgtgccagcgccaacggtgcctgctcgtgctccagcagcgtcatcaaatcgcggtagaaggcctgcaccacttactgtacactgcagacgatgagagcgacttgagctgcgcaggaatagctacacaatccgagaaaaatattacttcacgatccgatgactgaactagcgtatcaatggtaaattgtgacgctgcgggcacggcaatagaaagtaattccaccaaaatagaaagcactagaacgccggaaagaatacgcttcaaacccctaactccgcagaaaaggtcagatacagatacattcatttccatcggttttttgtcgaatgtctccgcaggccaagcttccactatgacgccagtaaatttgtctggacattcacgcaatgagatactgcgacgaccaatgccaggatcatggataacggcactacgatgtgacactttgactaaaactacaaagtgattgaatgaccagtgaagaataccgggcggctgagcgaacgtagatc

SEQ ID NO: 16777 - DNA, 1121 bp, Xenorhabdus bovienii
  unsure (1)..(1121): unsure at all n locations
tagatgcgctgcaaccaaaattcagtacaacatccaaaattccccaaccctaaacacccactacgccacctgcgaaggccctgacgctgcgggagcctccgccgttggctccgccgccacttccgccattgtttccatcgcctccgctgcgggatcttcaatgctcggcgcagctgctgcgggggcatcaggggcgccttcggccacctttgggggcaggtcttcgccggccgcagcagatgtgggggcagccgtcgcaatcgctgcggtctccggggttggctccagggcggccccggtcgcagcctccacaggggtcggctccgggtctggcagcgcgctgttcagagccccgaagtcgtccacccgctcgccgcgctccgcctaagacaaaacacgcaaaactcagcaaacacaagcacaccccacatgcagcaaacgccaaaccaacaacaacattacctgagccctcgcgatctcggcccgctccctgaccacctcacggccgtgcggaccccacatccggtcatagagggccccgacggattccttcacaacggggtcttcgaccgtatagacatctcgcttaaagtcttcatctgcctggtcgaagacctcgaagtgccggcacccttcgcgggagagtgcgttcatcgccccctcgcaggtgaccagggaggcgtacgacataaagccccccacaacaacggggagttcctgcagctcctcctgcacccattgcagacaacaaagcccgggctctcggtccggcacctcgaagtcgccggtccgcgcgcccagctcgcgatatgtatccttaagctgagcgcgcgtccgttcagcctccgcacgcatcacggtctcggcccccttcgcgcggctgtccagggcgggcagccgctcttgcagatgttcggcgagctccttggcaagattgcccctcggccgcgccagtttgggctccgcctgcgcagcctgctccttggcgatgggctcggtngcctccctccctctcgcgcaattggcggcggagtcagccttttcctttcaggggggcaccctgtccgaagcttaggcactgcttgcggagccgatttctacggaaagggcaaatgtggggc

SEQ ID NO: 16778 - DNA, 72 bp, Xenorhabdus bovienii
cgccggcgatgttgagatagacctctccgaggagaaattgagcccgcagcgcgattccagcacagcgagcag

SEQ ID NO: 16779 - DNA, 1275 bp, Xenorhabdus bovienii
aattaccattttcaaagtgttttatcgactagttttaaaaggaaaagagataacaaagtaggaactctccacaaatgatgaaaagaagaatactaaagtgacaccaccaccgatagtaagatctttcaaattggtacaacaaatggtacgttctatatggtggtaagtattcttaggcataagttaattcattgcaaatttgtcatgccttgaccatgatatgtaatgtactccccatgagactcttaactgaattgaaagtgcatgtgtcaagtcattcaaatacttaatgcacatatctagtgggagaacattatatatcttgtgttaaagagaataagtttctcttgagtaagctatactaagacaatccaaaatggtaaatttgtatctcattcatatagattgtaatctttgttttctaaatagctactcttgatgcagtttaaaattcccttatcattaattctaaaagtgcataagaatctttttgttgatattcatcacatacatatgcactaacatggatatgatttttaaactgtaaaaggtataattagtgatccatactctctaaattttgaaaacccatattttgatattttagaaatctacttcaattgatatccgtatgcttcacattgaattagatcactaagttgtaaattccatgcataacttgtctttatgatatgaatgcttgtgcgactaaccttgataagctaggtgcacccaaagtcaaggtaggttcatcatcaagaaggcaacacaacgatgtattaataaaaggagaaaaggctcctattcttaactctagtttttatctaagtgattaaatattgacttgaaaccatgtaagatggttgtcaagtatatgtgggtgcctatacaaagagaaaggccacagtaaggaatgtgtgggtatccaaggctcttactactaatcttaaaggacccaattaaaattgggtaccaaaatacaaagcttaaacttgttttgcaggatcactccttcaatggatcaagttgggtgctcgataatgaatatataaatcatatttggagatagtagcaagggtggtaacaactgaatctcaagtgcatattattttcaaatcttatctcttttgtgacttgtgtagccactaagggaaaagaagcacttgaggatatacatcagttattgattatgaaataaaggtccaattggaagataaatgaatattatcatatggtgaaacaaattcaaaactatgacctcaggcagcaagctgc

SEQ ID NO: 16780 - DNA, 181 bp, Xenorhabdus bovienii
  unsure (1)..(181): unsure at all n locations
ccccccccccccgggggggggggggggggggccaaaaaaaaaaaaatttttttttggggggggggggncccatttcttttttggggggggaaaaaaaaaannnncccccccccctcctttttggggggggggnnnaaaacaaaaaggggggggggcaaaattggcaaaaaagtttttggcc

SEQ ID NO: 16781 - DNA, 130 bp, Xenorhabdus bovienii
attcatatagtctttacaataaatcaaagtgcggaaaagaaacgtagataaacgcggccttcacaggcagccgactgggggttgccgctaacccacgcctagaactcatcgataatctggaactcctgat

SEQ ID NO: 16782 - DNA, 609 bp, Xenorhabdus bovienii
  unsure (1)..(609): unsure at all n locations
tttttaaaaaaaaacccccccccctctcccccccggcgcggaggagaaaaaaaaaaaagaagaagaaaaaaaccccccccccccccctcttttttttttgttgggaaaaaatttttgggggggagaaaacttctccccccccccccccctctttttaaaaaaaagaaggggggggtgttttttttttttttttttaattatcctccccaccacgcccgggtgtggtttattttttttttttttttttgtggggggggcgcgccccccctttggttgtttttttttaaaaaattttctccccaagggtttttttttttaccccccctaattaccggggccctctttttttgcgcccattttttttttccccggtttttttttgggtgggggggcgctccacctattttccccgttttattccttccccccccgtttttaaggcgtgggatcttaaggaaggnttcccccccggggtaacccgaggtctncgaaatttggtatttttttnnnnnnnnnnnnnnnnnnnnnnnnccnatggncttcttncgatnggtggtcctcngccgtcgcggaggtttncggnngtcccccccgggtccggacccgggg

SEQ ID NO: 16783 - DNA, 1118 bp, Xenorhabdus bovienii
  unsure (1)..(1118): unsure at all n locations
cgcagaggtttagatactattcgagctcggggccggggatcctcttttcaaaaaggggaaagaagaggccgttttccagaaaggctgcataccaaagaagaacgatagctaagattaagtgcgatagtgacgtacagggtccactacgcgacggaggggctatgtcggagtgcatacacagaccgccgatgaagtacgcatggctaggctgtcttatgatcaanaatgtccggcactgatagcggtcaccaccccatgtagcacactatagccccaactgaccttactgctgcaccatatatgatagcaaagatttaatactatgactaccgccgcacaaaccctgatttacagtgcttgcagcgctaacaacacgtacccgaaatgaatgtcagatgactgtgcgagagcatgatcggacatagttagtagttgttctacacgtatctactccaatcgttgattcgagactccgctttccgccgcacacatgttgcgttccctgccgcgcagcttgagcccatcaatctcgtactacatctgtgtatatacacctaccaaactcgtcttccccctcttattatctagctatatcatacaccctagtaaaatcacataccacttcccctcccacactcctctatgatttaactctagcaagatacaacacttctctactattatattactcctacagtgtgactcgcaattacaccttcattattttccgtcccactatgcctagagatatttattatattcctgcaggaacttcctccagaccccttctaacctcatttcccactcgctctctcactctcctaacacgtcggcctattctgacatatatccggaatacgtcctcaccttaagtgcggactcgcctcctaccgactatcgcctctcagtgtgcgctacagcgcggaactgaatttacctcatcttccctctttgatactagatatcgtgattatactttatactgcatccgcatgtccctgtacacgtcttctgtcagtcctcaccaatcttgtggcatttctcccctagttataataacacataacgcaaactaatatctcatacaatacagacatgcacctatccacacacaagaa

SEQ ID NO: 16784 - DNA, 1675 bp, Xenorhabdus bovienii
tgggggggggcgtggtcgcccttctccccggtctttttgtttgtcgattgagaagggtgtgtttcctcgtgtggttatggggggtggccggaaaaggcgccctgggggggagcgttccttctatgccgactcgtgcgcccactcgcgcttggatggcctagggctggagcatgttcagcggtagataagttaatgtcaaaccgcggtataggaagcaaataatatgaaaattaataatgtggaaattggaatacatagcttaattgattaactaaaagaaacatactaatcaaaagtcatccgcatccgatgatgcttcttcggctcgttgtttattcatacgctcttgatttcgttggatccttactgatcttctaacgacgacaggtcgtttgcgctttgacctaggttcttcaattaagtcgcttgaattgcaacagagattttctagtccttctccattggtcacatggaatcggtgagctatgtcttgattcgacgccgcttctggttgaaaaacagcatcatcgttgtccctgctcgtactcacgtagtcagcactctctggagcgacgacttgtgggttgactttgattgcaacccaccaagccctaaggcttgggtgaggatatggcaggtagtacacttgttttgcctgatttgcaaggacaacatcgctcatactgctcggaatcctagagctatgcttcacctcgacattaccatacttgtcgacacgagtcccactatgagcatcaaaccagtcgcactcgaaaaacacgactttaagttccttggggccatcgaaaatcaactctacaatgttttgaagaacaccgtaatagtccactactttgtcatcgtcaacatatgaacttgccaacacaccactattggtggtggctgccaatggtcgactcttctccaatttcgcggttcggaagcgatatccatttacatcatagcgagtatagttccggacggacacagaggtatgtgccatttgctgcaagtccgggtgcacagagtttttggaaacctatacaaggaattagtatatgcattatatcttcgaagtccaaaattcaaagattaagtatggacaatgagagaacgacaattactaacataattacgaaaccactgcacgaagtttggtccacctttcaacccatcacgtcgaagattttctaattggatggccgtaggtttactagtagatttccaacattcttcatcaaacatgctggacatattagaaacatggagattacacactatagaaattatgagatgagaaaatggaagtaactatgaggaaaacttactcgaacgcctcctgtgtgctgtcaatattgctatacatatatagcattagcgtgttcaaatctgatcccttcatgtgacgtacactcccttttccaactgctttacccggattcgcaaaaatttgaagggtgctttggggcgattcattttcgacatggagtcgcactgaaggagcaaacacattgttgggtccaggcgaatacctgggtgagaaatgagaaatctcctttaagggcaaagccctccgcaaaaaccccttcgacctcagcccttggtgcgaacaaaccccctgagcttttttcacgccctttccattaggatcactccccctgaatgcaccggtcca

SEQ ID NO: 16785 - DNA, 866 bp, Xenorhabdus bovienii
  unsure (1)..(866): unsure at all n locations
cagcaggcgaagaaagggggcggaaagaacggcgccccgcaaaaagggcgccgcgcagacaaagcggggcaggacgccagaaacnacaacgngggaggagcaacagggcgaaccgaacaaagacagaccaccggaggaggaaggggagnganaccccgcgccggaggaaagagcgcggaaaacacaccaccgagggggacgnaacagcacgggacggcgaaaaaaggaaaagagagccaaaccaanacaaccgacanagcaacaagagggcacccgggcccggacggaacaaaaacnagccagacgggcgcggacggaagcagaggangcacaacaggnacangaaagaggngggcaggangaaaaccaaaggccgagggcaanggcgcccaaagaannnccaaagggcaagncaaaccggacagaaaagcccgaaaggccaaaggacccaaggaaggaaaagacgcaagcaggccaaagnggaagccggcgaaaaaaacgcccggaccggaacaaaagcaggaccaacnnacaacaacgccccgaagaaacccggcacaacaccgcaaaaagggggggcgcgaccggnnaaggcaagaaagaaacggaagccgcaaaaacaaaagacaacccaaggagccccgcccgancgaagggggggcaaccccaggggaaaaaaaaaaccgaacccccagggaggcaaaggacaaaannggcacgcccccaggcccggaaaagacaccagggccccaagggagaggaaaaaacgcccgaggaagcacgggcgcggggcgacaaaacggaaaccagcccgggcccccacgaggggacacacgacgccgaaacaccagagccgcccccgcccc

SEQ ID NO: 16786 - DNA, 612 bp, Xenorhabdus bovienii
  unsure (1)..(612): unsure at all n locations
cgtggtttacacggtattagcggaccccggttacccggggggtaacttttaagaaaccccgttattttgggtttgaagggaaaaaattaccccttcaaaaaaatttctttggcgaccacatatagtttgttaaccggggggagggctcctttttatataaataaaaaaaaaaaaaaggggggggggggggaagcaacaaataaaaaaacacggggttttttttattggccccccctcctttttcccccaaaaaaaaaaaaaaaaaaacccccgccggggggaaaaaaaaaaaaaaaggggggggaacaaaacttttttttttttttttgggggggggggggggggggaaaaaaaaaaaaaaaaaaaagagggggggggttttnttttttttgtnntgggggggggggggggccccggttttnnnncncccccccccccccccccccccncagcccaaagaaagagaaaggggngnngnggnggnnaannnnnaaaaaaaaaaaaaaaaaaaaaaaaatggtctctttttttgtttggggggtgctccgggggggaccggcgaaaaaaaaaaaaaaaaaaaaaaattatttttttccgggcgcggccggcgca

SEQ ID NO: 16787 - DNA, 559 bp, Xenorhabdus bovienii
  unsure (1)..(559): unsure at all n locations
ggttttcctccccccccacaacaatattttttttgtttttttcccaaacacaaaaaaaaaaaaaaaaaattgcccccccaaaaaaaaaaaaaaattcttttgggggggggggggtttttttttttggggggggggggttttcccacgggggggggcccccccccccctttttttttttttatttccccgcgggttttttttttttttttaaaaaaaaccccccccggcccccccaaaaagggggtaatatatatggggggnnnggaaaaattccccctctggggcccccccaaaaggggccccccgcggttgtttttntttttttttttaaaatatttccccccccaaaagaggggggggaaaaaaccccgcccgataaatattcccccccccccccaaaaaaaaataataaagaggggggagaataaattccccccccccccctctttcctttttttcccnccccccgcgcggtttttttntcttcctcccccccccctttttttttttgtgnnnnggggggggggggnntttttttttttgttgggggggaaacacc

SEQ ID NO: 16788 - DNA, 862 bp, Xenorhabdus bovienii
taaagttaaatgttcttctgctaaccttaagaatgaaaatgagaaaattgcttgttagggctaaagttttggattttgcatgtttcttatttctaaccttagaagggaaaagggccattttcattgtaggggttttagaattaaaatcttgcaaacccctttacatctattgttgagccatgtttctatttgtcttagatgtagagatgttgatattaatgctattcatgatcacatggctttaaataaacacccaaaatgatcatatagcaaaattagatgctaaaatttccgagcataacttagagaatgagaaatttaaatttgctcgtagtatgctttataatgggagacgccctggcatcaaggatggcattggcttccaaaggggagacaatgtcaaacttaatgcccctcctaaaagattgtctaattttgttaacggcaaggctcccatgcctcaggataacgagggttacattttgtaccctaccggttatcccgagagcaagattaggagaattcactctaggaagtctcactctggcccaaatcatgcttttatgtataagggtgagacatctagttctaggcaaccaatccgtgctaagttgcctaagaagagaactcctaatgcatcaaatgatcatgacatttcattcaaaacttttgatgcatcatatgttttaactaacaaatccggcaaggtagttgccaagtttgttgggggcaaacacaagggctccaagacttatgtttgggtacccaaagttcttgtttctaatgccaaaggacccaaaaccgtttgggtacctaaagtcaagaactaaacttgttttgtaggtttttgcatccgggggca

SEQ ID NO: 16789 - DNA, 1348 bp, Xenorhabdus bovienii
atcaaattttcctacgtgtcattatctctatactatctattaagttaatagtgtagatgacggcactaccatgactttaccctccccagaccccaccggcagatatgcggcccgtcgcgacatctattggtcattccagtttcaaggcctaagcatggcggccttgcatcggatgcccaaacccaacataactagcttcagttcagtacacccggtagctcgatagcccgacaataattagcaacaacgacatacacgtagaagcggtagttgagtttaagtgcagaaacaacctagctccagcagtgtgtagctagcagcaagtctaccgagcagcgcaatagattttttattgcctctcacttacaagtatattgtagtatctgttcatgtatgcacacactcacaccaaaacgcacaccaactctcccctagcgtacataagcagaccatgactccaccctcccctaggcccgcgcacgctcgccaacacccgtgtcacctcccgcaccctccgcacgacacgccccaactagcctctcgcttctcgcattcacgccgattggctctcgcaacgaactgccttcgcccgcaaaccatgccctccacgccagtcgccagttttcacgccatccgcaacatctatgccatgtcagtcgtcggatcccacccggccactccacaaaatactctcgcccgcttctccacccgcaccaaaacgcacaccaactcacctctaccgtacacaagcagaccatgactccacccctaggctcgcgcacgctcgccaacacccgtgtcgcctcccgcaccctctgcacgacatgccccagccaggctcccgcttctcgcgttcgcgccgattggctctcacaacgaactgcctccgccaacaaaccatgacctccacgccagtcggcagtcttcacgccatctgcaacctccatgccatgtcagtcgtcgcgtcccactcgcccactccacaacagactcccgcccgtttctccacccgcaagaaggagggtgcccacttagataaggttgcatcggcttctcccgtagctgccactgccgaatggcgattggttccaataattggtgggagctttgctcactaacctaaccggccaacaactcacgatcgagtattcgagtgttatcccgccagatgctcgtccacaagctcgatgatgcctagatgaagctgacgctgaggttccgcctcgccgccacccccgcaacgccgtgatcggcctcaggtccggatttggacccgcaacagtagcagtagccaccgttttcccgaccacaaggcaccatcactggcgacctgcaggcatcaagctgc

SEQ ID NO: 16790 - DNA, 1028 bp, Xenorhabdus bovienii
  unsure (1)..(1028): unsure at all n locations
nnnnnnnnnnnnnnnnnacgagcttctgctgctgtcagaacgtcagccaatttggcttcagttcaacacggcgagcttcgaagaattcgatgtttttcttagtcgcaggaacggctttgccctgtggaactaagaagttacgggcataacccgctttaacgttaacttggtcacccaggctacccaggttcgctactttatcaagcagaataacttgcattaccttatcctctcaaagtcgttaatggactgagcctattactgatgacgatcagtgtaaggcaacaaagacaggtagcgcgcacgcttgatagcacgagcgagctgacgctggtattttgcacgagtgccggtaatgcggcttggtacaattttaccgctttcggtaacatagtttttcagcgtaacgatgtctttataatcaatctcttgaacgccttccgctgtaaaacggcagaatttgcgacgacggaaataacgtgccatttggctagtctccagaatctatcaattcaatctgctcggcatgaagaaccagtttactaagaccattacgcccttgatggctattaatgaatcctgaaacggttattcggctaccgaccgttatactgtgagtgaactcttgtaataactgtccgctggcaataacgggcattttgcaccatgattgcctgctacatccggcttcctgctgttgtgaacgatgttcgagcacaaactggcaatgaggaataccggatgggctaacttttcgtatcggcactctgcaaactgtgccagaaagcaccaaacgattagctgccacagtaattactcttcagagtccccagcttcatcagcatcatcagccatgtcttcttctaagaccaggtcacggctacgacgttcgtctttagctttaaccattggtgatggttcagttactgcgtgcttaacgcgcataaccatgctnnnnnnnnnnnnnnnnnnnnnnnnnnnnnnnnnnnnnnnnnnnnnnnnnnnnnnnnnnnnnnnnnnnnnnnnnn

SEQ ID NO: 16791 - DNA, 1027 bp, Xenorhabdus bovienii
  unsure (1)..(1027): unsure at all n locations
cctttgtttgagggattggcggaagctcttgatgacgagcgccatttcctcattgtcgagcttggaggcgtcgattggttgtctacttgatgtagactcttccttcttctcctccgtcgccttgaatgtgaccggttgtgcttcgggtgtggaggaggtgccttgctcgatgattttctttgagcctttaatcattagctcaaagctcacaaattttcctatgacttcctcgggagacattagcttatatctaggatcacctcgaattaattgaacttgtgtagggttaaggaatacgagggatctaagaataaccttgaccatctcatggtcatcccatttttcgctcccgaggttgcgcacttggttcaccaaggtcttcaagcggttgtacatagcttgtggatcctccccttggtgaagcatgaagcgaccgagctccccctcgatcgtttcccgcttggtgatctttgtcacctcgtctccctcgtgcgcggtcttgagtacgtcccaaatttcctttgcactttttaacccttgcaccttattatactcctctcgacttagagaggcgaggagtataatagtggcttgggagttaaagtggtgaatttgggccacctcgtccgagtcgtagtcttcatcccctacggatggtacctgtacaccaaactcaacaatattccatatacttttgtggagtgaggttagatgaaatttcattaaatcactccacctagcataatcttcaccgtcaaaggttggcgggttgcctaatggaacggaaagtaatggagtatgtctacaggtacgaggataatggaaggggatcttactaaaactcttacgctcatggcgcttcgaagttatggagggtgcatcggagccggnaggtaaaaggtgatngagtggtcngtctcgtaataagaccacttccctcatctccttaattccnccgcactccgatgcggtttgggagaggaaagcttccttttccttcttctccccttccctctcccccttggtg

SEQ ID NO: 16792 - DNA, 1451 bp, Xenorhabdus bovienii
  unsure (1)..(1451): unsure at all n locations
nnnnnnnnnnnnnnnnnnnnnnnnnnnnnnnnnnnnnncaacggaataatactcgacatatctttagcttgagaatggacggcctctctttctttacgtgccttctccgccctttcaagatagcgctcgcgccgctcttcttggcgttgttcataatcattaacttcatcattttttttcagccactcgatccgtaatgcttccgtggcttgtactaatttcggcgaaatttttcctaatctggtttgacgcacaccgttattaatcaaataacctttttcatccacaatatagtaatgcacaacacagcaaacgtcactctctgtaatatgacaaagttcatttcctttaatatgacaaagtttatcacctttatccgtcattaaatgtgaaaactcttgcgattgccattcttcataattactcattttctgtactcctgcgccaaacggggcgctaccgcgaaacaacactattgccgttccaatgaaaatattatacgactaatgacctcatatctcaacatctatatactgtttttaaagaaaaaaataatctaattttgttattcaaactgttttcaattttcagatacacctgaagtcaacgccctgaatgaaacgcagcgcagttttgtgattgatgcccgcaagggcatggaaggaggctctaaaaagccgcagagaacaccagaaggccatcccgacgataaaaaaggggagccgctcgaggagcaaggccccccccgcccctgctaaacccacattgcacggaaacttaagccactcggttgtttgacggtcggagacaaaaggtattagaaacagcacccaaacacttgaaaaagtcgcatgattccctttagggttccaatttagtgattgacaacatgtaagccacttaacaaacagtttttttaggggggtatttaccgttggccaccttgctaaaaattactctgcccttcagcatcgcttggtatccggcaggacagagacacgcagtggctctgcgaagcttgccgaccgtctctttgggcggttagcgcagtccaggcgacatttttcccgttcctttgggaaaaatgcctccggtgtcccaattaaacacaactaggaaaattcaattctcctgctgttggtcactcgctaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16793 - DNA, 1440 bp, Xenorhabdus bovienii
  unsure (1)..(1440): unsure at all n locations
tatacatcgagctcggtaccggggatctctagtgctaggggtccttttatagtccaaggcagctaggagccgttgagagcaaatctggaaggccaatcttgccttctgtcgtcgggtgcaccggacagtccggtgcacaccggacactgtccggtgcacaccggacactgtccggtgcccgatttccttcctaaaatggcgcagccgaccgttggccgccagagagccgttggcgcaccggacatgtccggtgcccccttctagccgttggctcggccacgtgtcccgcgcagatcgcgcggccgaccgttggcccggccgaccgttggctcaccggacagtccggtgtacaccggacagtccggtgaattttagccgtacgccgtcggcgaattcccgagagcggccacttcgcgccgagtcagcctggcgcaccagacactgtccggtgcaccaccggacagtccggtgtgccagaccgagctgagtcttggctgtacccagccaagccttttttcatctcttttctttctgtttctaacacttagacaagtatattagtacataaaaccaatgtactaaggcttagaaacatacctttactcttgatttgcactttgtccatccatgagcataaattcacatttaagcacttgtgttggcactcaatcaccaaaatacttagaaatggcccaagggcacatttccctttcataagcccggtcatttcattgcaaaatgtcctatatctagtgacagtgacaggggcgacgacaagaaggggagaagaaaggagaagaagaaatacaacaagaagaggggcggcgatgcccatgtttgtcgggagtgggactccgacgaaagctctagcgactcctccgacgccgaggacgccgccaacatcgccgtcaccaagggacttctcttccccaacgtcggccacaagtgcctcatggcaaaggacggcaaaaggaagaaggttaaatcaaaatcctccactaaatatgaatcttctagtgatgataatagtgatgaggaagataatttgtgtaccctttttgccaaccttaacatggaacaaaaggaaaaactaaatgagctaattagtgccatccatgaaaaaagatgatctcttggactctcaagaggacttcctaatcanagaaaataaaaagcatgttaaggttaagaatgcttatgctctagaggtagaaaatgtgagaaaatatctagtgagctaagcgcatgccatgacactataggcaaccttagaaatgaaaatacccaaataattgctaaagttgattctcatggttgaaatgtttcaacttccatcctagagatgatgntgatttactttgctagaatgatgagttgaatgtttctcttgctagccttagaatgaaaagaaaattgcttgctaagctaagattttgaatt

SEQ ID NO: 16794 - DNA, 207 bp, Xenorhabdus bovienii
  unsure (1)..(207): unsure at all n locations
tttttcctttctccctcccgccccggcgggggggggtgagggagtttttttttttttttggaggagggggggccgggcgcccccccccccaacaaaaatatttttttttttttttttaagcaccgcgcggggggggtttttttttttttttttccccccccccccccgcccnnnacaaaaaaaaaaaaaaaaaaaagagtgcgtgca

SEQ ID NO: 16795 - DNA, 336 bp, Xenorhabdus bovienii
  unsure (1)..(336): unsure at all n locations
ttataaaaattatttttttctcccccaaagagagggggggggggggaaaaaaaaaaantatataacnccctttttaaaaaaaaaaaattttgtggtnggntgtttttttattacnaaactttttttttcccccgggggggtttttctccnncncttttttaataataaaaacaccacgaagaggggggggggtgggtgtttttttttgggcacaaaaaaacacatttctttttttgtgggggngggntaattatttttcctcccccttttataaagaaggggggggagaaaaaaaaaaaaatttttttataaagggggggggcgggggggtgtttt

SEQ ID NO: 16796 - DNA, 1410 bp, Xenorhabdus bovienii
tgcacggagaaggatccttttcagggtatcccccttcccggtccctgttgtaagagagagaaagaggaaaaggaaaaggatacgaaatcgaatgacgtggcgtaccttttttgacgcggtcatcatggcgaaggcgaagcgtcgctcgcttcccctgccagaggcgccgcctgtcccgccgcggagttaatgcgacggggtgagtagttcgcggggcggctgttgcgcgtgcgcgagccgttcgaggaacgaaacgcgggcgcgccgtcctcacaccgtgagagagggttctctcgctgtccctggacgggacgtgagcttggctgacgacgtgaccgctgcttctgcccgcctgccaccgccattactgtcggcccatttttggccgtattgaccgtcgcgcctggctggcactgctgggtcgtatgcagggttgcctcgagtcgcggtactggttccgcagtcgaggaggcgtggtagtggtgcgagtggcggtgcagttgcttgcacgtagcgaccggcgcgccggttgcatgacgcgtgggcgtgggcccccatgttgggtgcgttggaagtcggaggggcgcgcccacttggcgcggttgcatgccgcctgcatggctgcccgccctttcacccgctggtctgggcgaaagtggaggaatgctcgtaaccgctgggcggttgcatgcaccgcgcgcggcggtttggcttcttctgctctgggccagcttgcatgacgtgtgggacccagccccgcgccgtagggggaggaccttggagcatgttggagaagactcagcccacgacggctggggacgcaagtagggagagtcgcctttaaaaggagggtgacccccttgaaaggcgaccatgtcttcgcgctcccttatgtaatgtgtctttccaccttccgagcccccggatgggggacacccacaatccttctgtcttgtcgttggaggaacgcaactctgtgggagttggtacctttcagccatcgttcggcttcaaggattttcatcacgcggcccggctgcaccccctcgccggtggtcaccctagacggtgaccaccagccccctggatggggagaagcaagtcgggctgcggcccccgcctctccctcagcttcaaggatgcttaccatccttgctggggcggagagcgaggcgagccggggctctacctcccgcacgggtcggctggccacctcctcttccagcttctggtggtggaaaccatcctccagctctgcggaggaggcgtcctccagccatgctggggaaggcgaattgttgctgcccagctaggatgcaacattccaccctcttcctcgctttcgtgccgaggacgggagcgaggacctccggtgcagcttggagcggcctcgacctcaggcatcactgc

SEQ ID NO: 16797 - DNA, 1036 bp, Xenorhabdus bovienii
gcagcttgctgcctgcggtccgtaatatggaaactccccttgagcttcagaggttaattgctaatcaagaattgatgaaagtctgtaataaggttatcaaaaaatatcatcatacagatgaacgaaaaaaagcattgatggaagtgggactaaaagaagacttggcagataaattactaaaagatgatcgcttcggaggcattggctatgcccattttactttaagtaataatagcgcaaccatcagaaggatctcaggtcggattgaagaaataaaaaaattgaaagaattatctgtagaaataaaagaagaatttgaatgttttactttccaaattgacaaggaagataatcgcgtaaaattcatttttccaaatgacaaaaggccggatgaaaaaataaagcagttgctaaataataaagcgtttaaatggagtcctacccgtaagtcttttgtgagacaagcaacggcaaatggaattttggcgggaaaataccttaaactggatattattaaatacctagattctattaaaagctagaccagattgaacttcataatataataaggcgttcatatacgggcgcttttttgttgctatcaataaataaatgatgtgaataattaatggtaaattttttttcataaaaataaattaagcgttgtaattagtggttgttagtcgtataattatctcatcgaaatagcaataggctgattcgcggtagcgccccgtttggcgaaggagtttacatcatgaacacatttacccccgctcaatttgatgatatttcaacgtatatcaaagataacagtatatataccccagttcgaattttccctgtatggacaatgataaacggttgtgaagctgtaaggggggataaccaggatgaagttattatttttcaaaataaagtacccgtagcaatgtatattttagatgatgatgaagcaactgtggggatttatcaattgaaggaaaaaaataggtaaatgtaaaaaagagcgggagaaattccgctttttcaatgc

SEQ ID NO: 16798 - DNA, 297 bp, Xenorhabdus bovienii
  unsure (1)..(297): unsure at all n locations
ctttttctccccccccctctttttttttatttttttctcccccccccaaaaaaaaaaaaaattttggggggggggaaccccccccaaaaaaaacccccgggggggaaaaaaaaaaaaccccccccccccccccccttttttttaaacccccccaacacaatttttaccccccccccacnccgggacaccccaaaccaaaaaaaaaaaaatttnttccccccccccccnnncgcggggggggggggagggggnaaaaaaaaaaaaaaggatgccaaaccccccacccacaacaaaaaa

SEQ ID NO: 16799 - DNA, 717 bp, Xenorhabdus bovienii
gactgcggctgccgcagtctcttcccacgatccttctcgtgtcgcagcgcctcccgcgaggcctgttcgggaccagctttttttacattccccgaaaaaaaagggcgcgggggggaataaaaaattttcccggggtttggccttttggggggaaaaaaacttggggcccccaaagacccccttttttcgcggggtaaaaaaaaacccccccccccccccccttttttaaaaaaaccccccgccttttttttaaaaaaaaaaaaggcccccccccccaaaattttttttttaagggggggggaaaaaaggggggggggggccccccccccccccctttttttttttttcccgggggggggggcccccccacccccccccgggggggtttctcccccccccccccccccccacaaaaaaaaaaatttttttttttttttttggggggggggatgttttttctccccccccccccccccccccccttttttgtttgaaaagaggggggggggggttgggggcacaaacaaaaaaaaaaaacaccccccccccccccccgtggtgtgttttaatttccccccccccccaccaaaggggggggagccccccccgcggggggggggcctcccccccccccccggggggagcagtttttctccccctatttttcccccccccccggggggggcccccgggtctctctctccccccccccccccc

SEQ ID NO: 16800 - DNA, 727 bp, Xenorhabdus bovienii
  unsure (1)..(727): unsure at all n locations
aagaacacaaagagggggcgatctgcccttcattgaagatacaccaaggaaaaaaaacaatggggacttcactgaaccaaacaaagaaaaaggttttttggccgcgaagaaaccctccgttggttttttgaaagcccacaaaaaaagggcgcattttttggcggggggaacaaaggaaaaaaggctggttaaaccccccctcgggttaaaaaaaccgtgaaaaacccgaaaaccccaccctccaaaaggggaaaaattaaaaccccccccccaaaaaaaaaaagggggggggtaaaaaaggcgcccccccaccccaaaataaaaagggggggggggggggggaaaaatcgcccccaacaaggggggggttttttaaaaaaatttttttccaatagggggggggggggaaaaaaaaaaaaccccccccttttttgggaggaaaaaaaaaaaaaaaaaaaaaaacaacccccccgggggggggggggggaggggaaaaaaaaagaacacccccccgtctttttttttttttttggggggggggccgcccttttttttttttaaattttttaaaaaacagaggagggggttggggcccccccccacccccccccatttttattaaaaanaaaatttttttttgggggggggggggggggctgtttaaaaaaaaaaacgggggggggggggaaccccaacccccccccccctctttttatttttttgggga

SEQ ID NO: 16801 - DNA, 862 bp, Xenorhabdus bovienii
  unsure (1)..(862): unsure at all n locations
ttactgatggaagattcatctatgtggtaactggacagtatggtccacaatgtaggggaccaacaactcgaaattttgtattggacacagaaacaaaagaatggcgtggcatgccaccattgccagttcctaggtactatcttcttttgttttttaaaattggggcatccatgcattgttcatctatccattacttgcacttgaaagttgttggtcccatgcagagtagggtggcacacaggtaccaccatagaacaaatttactagaaatttccattttcaccatataatgttgtatttgtaatagatgcatagaagtttgcaccactagattttaactgtagctctgcccctgatcctgctattgcaaatactgtctgaatatttggtcaacttgtaggctgtaaagatcttgaaccaaatatatttccaactaaaattcttctgtttagatatgctccagcaacacaactttggagaggcagacttcatgtgatgggtggcagcaaggaggataggcatgaacctgcgcttgaacactggagtctcgcggtaaaggatgggaaagcattggagaaagagtggaggagcgagaaaccaatacccgcgtggaggtcctcataggtctcgaactttcccttcctatgttatcagcagttgtcattttcattggaaagcatgctgctagatacctatgccctaggctgtcttggcagtttggcgctttgcacttccacttatgctctgggcaacatttatgcttctaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16802 - DNA, 2573 bp, Xenorhabdus bovienii
  unsure (1)..(2573): unsure at all n locations
nnnnnnnnnnnnnnnnnnnnnnnnnnnnnnnttttcttcatcgaatcggcgcagaggctgcttcacgggtcgggctccagcttggatatctagcgagtgctcggcgacttccctcggtatgccgggcatgtccgagggactccatgcgaagacgtcggcgtttgcgcggagaaagtcgacgagcactgcttcctatttggggtcgagctcggagccaatccggatctgcttggaggcgtcgttgcaggggtcgagagggacggacttaaccgtctccgctggctcgaagttgccggcgtggcgcttcacgtctggcgcctccctagagaggctctccaggtcggcgatgagggcctcggcgtactccacacactccacgtcgcattcgtaagcgtgtcggtacgtgggcccgacggtgatgaccccgttggggcccggcatcttgagcttgaggtaggtgtagttggggacggccatgaacttggcgtagcatggcctccccagcactgcgtggtaggttcctcgaaacccgaccacttcgaatgtgagggtctcccttcgaaagttggagggcgtcccaaagcagacgggtagatcgagttgtccgaggggtcggacgcgcttcccggggatgatcccatggaaaggcgtggcgcccatccggaccgaggacagatcgatccgcaggagcccgagggtctcgacatagatgatgttgaggttgctgcctccgtccatgaggaccttggtgagcctgacgttgccgatgatggggtcgacaacgagcgggtatgtttccaggctcggcacatggtcgggatggtcggcctagtcgaaggtgatgggcttgtcggaccagtctaggtagactggcaccgccacctttaccgagtagacctcccgacgctcttgcttgtggtgccgagccgaggcgtttgccacttgcccaccgtagatcatgaagcagtcgcggacctcgggtaactctcctgccttgtgatcttccttcttagcgtcgttgagagccttgccaccctccgtgggtggcccggccttgtaaaagtggcgtcgaagcatggcacagtcctcaagggtgtgcttgacgggcccctgatgataggggcacggctccttgagcatcttgtcgaagaggttggcacctccaggaggtttccgagggttcctgtactcggcggcggcgacaaggtccgcgtcggcggcgtcgcgtttcgcttgcgacttcttcttgcccttcttcttggtgccgcgctgagttgacgccttgggaacatcttccagtgggcggccctggggctgcttgtccttccagaagatggcctcaaccgcctcctggccagaggcgaacttggtggcgatgtccatcagctcgctcgccctggtgggggtcttgcgacccagcttgctcaccaggtcgcggcaggtggtgccggcgaggaacgcgccgatgacatccaaatcggtgacgttgggcagctcggtgcgctgcttcgagaatcgccggatgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16803 - DNA, 1468 bp, Xenorhabdus bovienii
ggaagcttgatgcctgcaggtccttcctcccagactatgctcggcaatcacctacagatggttaagcataaaatcatatcactttaaccagattatacctaatataccattattcttgtcttttgcatgcaccttctatatgaaatcagttaaaactaagctaagtacaccacacaaaacatcacaagcactcatgcccctgctaaatacacccagcctattaactccaaacaaatcccactgtcaaataccaacgttccaaattgtttcttttgtctactcagtcttactgaaacgcaccggacgaccaccttttttggatcatcctcaacgcacacgctgtcacacacacacgtcccccacgtctcttttgctgaaacacatcggacgaccagtctttaatggatcatctcaacgcacgcactctcacgcagaaacacacccgcactcgctcgtgtcttcctccccaaccctggcctcggccccgtcaaaccttctctgcgacgaggtcgccaacgatgacggttatgccatcgccaaatcctccacggacgagctcgcaagcctcaccgtctgcccacccgcctgaacgtgcctacaccacagtgaccgtcaccgccgccaaatcctccacggcgcgtgtcttcactatgacagccccgcttgcctaagatgtccccgggcatcagatccgctcctcacctaagacgtccccgggcatcggaccctaaaaccctataatactccagtttggcacaattgtacatcagccaccctcaaaagcagtaagaacattttgttattagcctgcacctaggaataaaaacattttccctctaccataatgtcgatcaagagatacagttgctcaaagaaaaaagatactacaagggacacttggcagcaccccaaagtgccgagatcaaaattacaagggacatatttaattctccatttcataaccgttgtaatattgcatctatgttcatgaatctagagagcacgccatatagcaacaaaataagcattttcatgttactataactatgaattccctcagaaaaaagagtcattcaaccaaaatctagttgaggaaccaatatacataccaaccaatatacatagcaaatacgccggagacccgatagccgttccattggatgaccctgcatcccagagcctctatcctcgcctgctcatcctttatggtcacttcaagagtagttcgatcatcgctgatatatggagttgctagatctgttatgattggtgcgaaggttaacctgagcccttttactttggtgattcaaattctaaaacgaatggtaaaagagaagtaatactttcatagtttgtcttatgaaacactgtcttttattttgtttaattctattgtttgtttgtaaggtggtcatctgataaatttgaaatgatacctcacacatctaagacctcaggcagcagctgc

SEQ ID NO: 16804 - DNA, 2092 bp, Xenorhabdus bovienii
  unsure (1)..(2092): unsure at all n locations
nnnnnnnnnnnnnnnnnnnnnnnnnnnnnnnnnnaagggctcagattagaagttcacccatctgaaccggtatgccatactgaccgcacgatccaagatcgacgggcaagattttaaatgggcgagattgactagggaccgctcgatttccacccaacgacatagatctaatctacaccaaccggtacgctagagactaatcgggaccgcccatccacgaatcaacggctctggtgccgtcctcacccccctggctccctttctctctcttctttactctctctctccggctaatccccacggctgagcgccattgacacggcagcaaactgcccgagctcgccattcgagcccccatccaacgacgccacccatcatctccccaaactccatgtcttcatcttcccaggtcgtctccccaggtcggcaccctacaatccgcccgagtctgcacgccgaagatgagctcgccgtcgtgacggcgagtaaacggcccggaaccccccaccattgcacacgcattcgagggaaacgacaggcacagagatgagcgatctaaacaaaaggaccggtggcagaggaggatactaccggncaccccatgacctgaatccgcggcggcgcagtccagtgatggcgtccggccggtgagagttgcaagaaagccagtgcccacaaccaagcgcagctagacggtatacgtaaggtagatactggcgcgaacgcacgtatgacttacccgaaccggccgatgcaaatccaagaagtccccggaccggcctgaacaccgcgattcctttctcggtccaacagagcaatggctaaagccttcggcctccaggtggtcgtggaggaggtggggttcagccctcttgtaggcctgccgcggagagtccgatgtggcgcgacgctcggcgtacgacgcgggccggttgttacagatagtttcggatgaggtgaagaagaaaacacgcgcgctattcttgcggggaagaagaccgggcgcgagaggatctacaggactccgtctgacgagagggaccacggcgcagcgaaacgcgcgagccgcgcgtagaaaccagagaggcggacggcgggccccgcctgtcgggtgcgtgagcgcagaagcagcggcgtgggctgcgcagaggggaagtgttggtgggctgaaaatggggtctggggcccaggtgagctttttttctttttctttttattttctgttttataattcttttgaattccaagtttttgaattccaattcattatggatttattatttcaaactaacacttaatatgaatatactagcatcacttttataatatgtattttatatattttctctatagtgcccccattatcattacattttattcatattatcattgcttttaatgcacaaacaaaatccaaaatgatgcaatggtttatttgtgtcgtagtgaagtttttattcattttaaacatgaccagtcacatgtgatgataaacagagatgcacataaattcaaaggagacaattcctccttttattctcccttacgatttgagtattacatgcgttcctatactatactccatctgtgatacaagcaccagtcaccctatacgtgaaaatatataacacatgtaataaaggacctctacgcatcaaagaaaaaaatcttccaagaactgaacattggcatctactatcagtagccttttaagtcatataatgattatattttgtatgggatgtatagttatatatacccagcccgctgcatataatttgtgtacatataacaacctaattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16805 - DNA, 1064 bp, Xenorhabdus bovienii
cccgggggaaaggatgtcttcgcccgagctccgggagtcttcggctcggatgctgagggttaccgggggttgctggcctaggaatgttcctatcccctgcgtggctgaggaggactgttttacatctcgtatggtttgtcagtggagagtttttccttacgggcgaaatatcggtgttgttgtgtgggcagtgatggacaaggatcgccaaggggcggcacaaaaacgccaggcgactgtcaggctgcatgaagctaggccgaagcggcagcggggggctgcgaaggctgcggcccccggcggaggcaggtcgccgctggcggcgaaggcgggcgcctctgcacctagcaaggcgccggaggcgacggcgggcgccggaggctccaaaccgacgaaggtggtgccaccggccagcggagtggcggaggcttcgaaggcggcccgagcgctgccgttgtcgggcaaacgtgttgccgacttcggcaccgatattactgtggacgactatcttggtggtaagtcgctggcctattattgttattaatatatatatatatatatatattttaatttgttgacgcgttgcagggccggacgagggccagctcgctatagttgcgcctggcgcggcgatcgcgacggccgccatagtgccgaaggcgaggggcgagacgcttggcgccggaggcgaggtgtcggccctcgcgttggtcagggacgaggcgggcgcagcgacccgccggctgaagggagtgacggaggcgctgagtcaggcgacggaggcgctgagtcaggtccgctgagttatactctctcccccacctctttttttggagcaaaggccttacgtgtgccctgcaggttgctgacttcgccagccgtactgcgtcgggggccctcacggcagttgtgtctgccgaagtcgagagacttcggacacaacatgctgacgctgtccgtgagaaatcggcctccgacagcaagtgccgtaagctgtcggacagggtggccgccctggagaaggaaaaggctgacctccggcgccaactggcggcggagaggag

SEQ ID NO: 16806 - DNA, 1991 bp, Xenorhabdus bovienii
gcagcttgatgctgaggttctcttgtgtcttgctcttgtgtttgttggtgttcttcgttctctcaccatcccgcgaaagaattgtttatatctttttggtgtgtagattttgagaagtgcccttctcagatctactactttgaaccctgtggatcatttaaaacatctcatttccaaagttaactgggtgaatttcgagatcaattcagttttacccagtttgcttctagattttgttgaagaagttttaacttgcctattcacccccccccctctaggcaactttcaattggtatcagagcctaatcctcgttctaacgcttaaccgcgtgaggaaagatcatgtcggggggactaagaaacgaaagtgcttctaagcttgaaaaatttgaggttgcctcgacttcatcttttgttgcagatgttgatcctagggcaatagatcttgccatgagaatcgccgaaaggatgttcctcaaaatgaaggaagataaggcgaagaacaaaattgaagaagaaaatgatcgatggagaccaaacgatgaatccacctcttcacaaggttcgtctttcaaatccacttctcatatgtgctttattgctaatgggagtgacagtgaaagcgaaagtgaggatgaggaggagcaagaaagtgatagtgaagatgaggacgatcttcaacaattcttcgctcaactaagcaagaaacatcggatgagcttgctcaaactcatgaaaagagcagaagaacaaaaagaaatgcttcataagcaagaagacttcctcatcagaaaaatcgaagacttagagaagttgaccaaagagcatgagaagctaaagtgctctcatgatgatttggtccaaaggtatgaagacatttcaattgagcaaattaaagttgttaatcattcatcatatattgctcaattagaaaacaaaaatgctatgttcaagaacacgatagaaaggctaaatattgaaaatctagctttgcaagaaaaacatgatatgcttgtgtgctctcataataaatttatggattcacatatcatgttagaaatggctcatgaggttgtgttaactaattttaaatcataccaacctcacatatgcacatgtactcaagtagaaactatattatcatgtgctaacaaatgttgctctcaagaaagccaatcttccattgagctagaaatttcaggaattagtgatatttctatcacacaagaaaataaagagttcaaggaagaagttggaaggctaagaaggagcttaactattttgaagggaaagtgtcatgctcaaccttctcaagataaccgtgataatatgatgaaaaagcttgagaaggggacaaccgtagcatgcacaaaaccccttcaaaagaatatcaagctttccaagaaggacatgagcaagactcaaggtgagaaaattaatgctcatattatttgctctaacaatgtacctatgtgcttcaacaaagaaagatcaaagagaagcgataggaggtgctatggatgcaaggagaagggtcatgaaattggttcatgcccccacatgaagaaccaaaaccttgcacgatcaagaaagatgaccatcaaaaaggatgaaagcaaagggcaaatgcattgcaaggacaagcaccacatttgttacaattgccgtgaaaagggtcatctattcaaggtttgtccaaagggtaaaaatcctaagcttaacttaacaatacattcagatatgcttaggagacccaaatttgactcttgtgctagaaaggtgatgacttcaccacattctaggactaaggctatttgggtgcctaagtccttattggctaaccttggtggacccatccaaaaatgggtaccaaagtgtaattaacaagttttgcaggtacccagagatgatatgaagctttgggtgcttgagcggttcaattcaattcttatctcaagctatcaatcttacattgtctatcctttaagatt

SEQ ID NO: 16807 - DNA, 1528 bp, Xenorhabdus bovienii
tccttttctttctgtttctaacacttagacaagtatattagtacataaaaccaatgtactaaggcttagaaacatacctttactcttgatttgcactttgtccatccatgagcataaattcacatttaagcacttgtgttggcactcaatcaccaaaatacttagaaatggcccaagggcacatttccctttcaatctccccctttttggtgatttatgccaacacaacataaagcaactagaacaagtgcaatatcacttcaaataaaactcaaatttattttgattcaattttggcatatatggatcatcctttgccaccacttggtttgtttttgcgaaccaacctcaaatttctatctctaagtcaaacacacatgttaaggcataaagagagtcattccaagagtatttgactcaaaatttcaaaaactccccctttttcccataatcaacatttctccccacaagaagccaacttttgacaagagagacaataaaagagttttgacaaaacaaaaaactctattctactattttcaaaatctctcaagtggtagctgatccatttatcgctttggcctttattttctccccctttggcatcaagcaccaaaacgggatcaatcttggccctttaaccccattgcctcaccaaaatcttcaattaagagcaaataggcaataagagttaaaagatgaacttggaataagttaccctctcatcggagtgcagtggaagtctttcacggtccaagtccacctttccctttcaaacctcctttgagactaaaacaatcaaactcaagcaaacggttagtctcaaagggtcaagttgtaacacatctccccttaaatatgtgcattactggcacaaggacttgtgaggtccggggagtgcttgtacaacttgagcaccataataagcaacacaatgcagaatgaacatgatcaaaggcataaacacatgtatgctacaattcaatccaagttccgcgaatctaagacatttagctcactatgcagcctgcaaaaggtcttctcatctagaggcttggtaaagatatcggctagctggttctcggtgctaacatgaaacacttcgatatctcccttttgctggtggtctctcagaaagtgatgccggatgtcaatgtgctttgtgcggctgtgctcaacaggattttccgccatgcggatagcactctcattatcacataggagtgggactttgctcagattgtagccaaagtcccgaagggtttgcctcatccaaagcagttgcgcgcaacactgtcctgcgacaacgtactcggcctcagcggtggatagggcaatggaggtttgtttcttagagttccatgacaccagggaccttcctaagaattggcacgtccccgatgtactcttcctatcgactttacatccagcatagtcggaatctgagtatccaattaagtcaaagttagaccccttaggataccagatcccgaagcaaggcgtagcggacctgcaggcatcaagctgc

SEQ ID NO: 16808 - DNA, 1836 bp, Xenorhabdus bovienii
  unsure (1)..(1836): unsure at all n locations
nnnntcttcttcttgattcgagctttggtactacatcgagttctttgtggattcattactcttggagcttctagctcctagacgactaggtgtctcttgtgagtctccaaatcttgtggaagaccacaagaaagtttgtattacccgctcgtttgagcaaagattagtgtgtgagcttgacctttgtggtcggcaaagggaggattagggttgaaagagacccggctctttgtgggcgcctcaacgaggaagtagggcaccttggtggtgtgaccgaacctcgggataaatcttgtgtctcttgtgttcttgctcattgtgtttgttggtgttcttcgttctctcaccatcccgcgaaagaattgtttatatctttttggtgtgtagattttgagaagtgcccttctcagatctactactttgaaccctgtggatcatttaaaacatctcatttccaaagttaactgggtgaatttcgagatcaattcagttttacccagtttgcttctagattttgttgaagaagttttaacttgcctattcaccccccctctaggcaactttcagatatcgatgatgttgatgatgatggctattcatatgatgatcttgttagaatgttaggtgaggccgatgactacatgcacaaagaaaaagaaaattttaagaccttgaaggaattgtataaaaacctccaagtgtcttttgaggagctcaagacctctcacaatgacctcaaagaaaattgtgagaagcttgcggatgctcaaaaatcatctattgtgcatgaagttgaggtggtcactaaggatgttggagtcacttgtgacttacttgatagtcttacaagtgaaccactacctactaactctatttgtgataaatgcaaaatttctctcaatgataacattgctcttgatgaatcaaaaattattgttgagaatggagtgttagtagatagaataaatactctaactcatgacctagaaaaggcatatggtggtaagactaaattggatttcatattgggaagtcaacgatgctctcttaaccgtgaaggtcttggatatgttcccaagaaaggaaagaatgcttttgtaaagcaaaagacattgtttgtgaaagaatgtgacaaagtgtgtcacaagtgtcacaaaaagggacacgttaagaaaaattgtcccaagttcaaaaatgtatcctccacttgttttgagcattgttatgttctttctcataatgcaaaaggtgttcatactaaatttgttggtacttcaattgttggaaacaaaaagaaagctatttgggtaccaaagaccttggtcactaacatccaaggacccaagcaagtttgggtacctaaaagagattgatttccttttgtaggtaaactacaaggcgggagggaatcattgggtgttggatagtggatgtactcaacacatgaccggggatatgaaaatgtttacccaaatgagtgaggaagattgctcaaattatgatagtatcacatttggagataatcgtaaaggaaaggttaaaggtttgggtaaaattgctatctcaaatgatcattctatatcaaatgtgctattggttgagtctttgaattttaatttactttccgtagctcaattatgtgatttaggattttgttgcaatttcacggttgaagatgttattatctctagtgttgatggtagcaatcttaagtttaaaggttttagacatgaaaatctttatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16809 - DNA, 903 bp, Xenorhabdus bovienii
  unsure (1)..(903): unsure at all n locations
nnnnnnnnnnnnnnnnnnnnnnnnnnnctctgttcttgggtgagaggtgtgatgtgtccaaggagatcccaaaatcgttcctgataatcatccgccgtggaacaaaaaggaaggtgtgccaactcacctagtggattgttccgtaatggtggtccaaagcgttgctgacagaggaacttgaaacgagcccatgatagaggaggttcatcgcgctgcagctgggagtaccatgttcgggcgatgcccgtcatgcggtaggatgcaagccacaccttccaatgtacgttggtcgatgaagaactactcacacctattcaaccagctgatgggatccccctttcctgaaggtggcaaattccaagcgatggaatctaagcacgcctgccatagtaggagcgtccgtgatggtggtctgcatgtggctggttcgtgggaatgatggaagaggagatgggaaatggggaacaggtagcagatggatgggtaagggagatgtggatgtagtctgggaatatggcgtggaggtgggaattatggttgcggctgctatggtggaggatgttgcggcgcccgggatgccagtcggtagtgtgggaacaccgccgtacccgggtatgccgtagggaaagtcctgtggcatggtggttgctggcgccatggtggttgtttccacggcggcaacacgagaagagatggacgacatttgcttggcgaagtcactcagttgacattgcacttcaccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16810 - DNA, 1794 bp, Xenorhabdus bovienii
  unsure (1)..(1794): unsure at all n locations
tccagatgatgatgacacctcatccaagttactgccggaattgccatcaaggaagctccctcactcttctcatcccccccattgtctcatggcaaagggagatgctaaggtaaaaatcatcaccgatgtaaatgatataaaagatgatgatgatattgaaagtgcattcatcccttttgtgagttttggtgatttggataacaacacatttaaaggtctaacgagtttgctaagtgttgaacaggaaattcagtatgatgaacatacttgaatagtgtataatgatcagtgaacaaaggttcaacacgaggttaaataaccaatgagacaatgcaaatggatataatatgatctctatattggtttgaatatatggacaagacctgagaaatcactacatacatatgaccagaatagaggacaaagtgatttagaggattggtcaagccaaagagaataagatatgaggaatcgtgaattggcttgaccatattactgtcagtccatatatgcttctatgagaatcaaactagagcttgattgatcttgacaattatatctagaagacattcaagcaaggttcacaatattgaagaaatggttctctcaatggatgctcaatttgatgtgactcaagaatggcttgatagggtgaagatagcaaggaaagggcttcgaggaactaagcgaaggtgaaggtcaagcgacggcttgtagaccgaggtaccatggctaaggtgaagaagagagtacttgcactaagtcgatgaactaatcagctatgaagagttacaacatgttgatgcatcagtaaggtgacttgaagccatgatttgaactcatataaggtgatatggtacaagtcacagggtttgatttgagtttgcttcaaaaggtgagacaaagatgtttgtgatccttatgaagcaatgccatggagaaatcacacatgagacaccaatgactcaaggagtttacttcattatattttatttaacttgagtataggaatcgtcgtactataaagggggatccaaaaagaaggttggtgtttgccaaagctcaaacctctctattcaaaagctatttttgaaaagcaaaaatctctttaacgttctatggttgaccatggttaggtttgagaaacctagagtgttcttgttgaaaagcagctgaacttcttcaactgcagctgagctttccagctgaacttgacttcagctgagttgagcttcttcagctgcagctgagcttttcagctgagctgaacttcagctgggttgaactttctcaactccagctgaacttcaacttcaactggggtccaggcaggtcaaccggggtccagggcaagttcaaccggggtccaagaaaagttcagccggggtttttttcccggacctcactggtcaataccggttgaaccggccctaggggcggttcaaccggtgtcaggacctgtttttgcagtctgacttgcagtctgccagtctgactggtagactgtctgtcagcctgccccaggcggttgaaccggtcttaggggcggttcaaccggtcttggtcaactttgaccagtctgtggtcagtctgcgcgtcagtctgccagtcagactggcagacaggctgccaggtctgccaggggcggttcaaccgccctagggggcggttcaaccggttttcaacggattttttagtccaacggctagttttgagctcccactnatatatactacctcctacctctctccccaaaagcagtgagcatgatttgacctgcaggcatcaagcttc

SEQ ID NO: 16811 - DNA, 1286 bp, Xenorhabdus bovienii
  unsure (1)..(1286): unsure at all n locations
cgggggaaaggaggtggatgggaggacggaggaccggatacttataggcgtgggatgaaaatgatggggcaggaggtcaggcgcttcgggcgcgcttcttctccggtcttcatgtctgccgtctgcggaagcggaacgccggaatcagacaaaaattatcgaagctgtgcctgggggtggtctccgccagcgctggggccgggtcttccgcactgctgtgctgtgctgttttggctgcggcttcgcaatgcggcgaacagctacggcggtttcggtttaaaacagaaaaaagatggtcagaaggtaggcgcgcgtgtatcacagactcacaattcaaaatcgaaggaagctgttgcgaaaattttagtctcgcaaaagatggagtacactatgtacaccagagctatattggttttgctttattggttaagtacttttttctatatttcagttgtctatttttttagatgcaacattattctcgtataaattgttttttatgatttatctgtgtatcaaattatgtttcccttttttgactgtagaaatagttgttgatcattttgtgccaaaaccaatcagttttttgttgattttatgatttttaatagatttttattctcaaaaaacgaaaattgcagtttatgtctaaaaactacaacaaaccgaatctgtaattttagtataaaatatatgcaacaactatcgtctaataaactaaaattcagcacctaaatttcgcaaatcttattggttaagtctaacgttcttcttggtcagaccttttagcaaagcaggccagataatatctagcttagttctaatctctttgtcctagattgtaagatatctagttttctagaccgtcaaaacatatcaaatttaacaagacatatatactaacattgtgataccaaataagtattattatattagatattaactacaattttagtatacttattttatttatagatatttatgttttttttataattttagtcaaattcaagatgctttgacttttagcaaattgaaatacctttagtttcgaatggagggggtaagttaatttagaacggagtaagttagctgacatcaaacatacagctaagacccgatggctttttgcgcactatacatattaactcactgcagcttcctaccagtaaaggttattgcattattgtaagatatttatccctacagctgttatttatcaccacgntcatcccagaatattggacattgaccatgaaaattagccagtagcgaactaaactccg

SEQ ID NO: 16812 - DNA, 1586 bp, Xenorhabdus bovienii
tctcccgataacatctagttagcttgactagactcttggatgcctttgtacaccaaaatacgacaaacaaacggcacaatgtatgttataccccgctatcttcagggctcaggctatcagttccatgaacgtaacccccgaccccgagccacacaagcaaaacaacaggcatttcagatagcactgtcagttcgcagcagagttggccagctgcacgagaccgtccacgatttccagcttgctgccaagctgcaccttctgctcccccgggtcaccgcaggggcagggccagtacaagctgggctccccgaaccccaagttgttgtagctcggcagagcctgagctagtgagtgctgcgacggcagcggctgcaggaggttggtgaggaaatacggtggcaagctgttgctcgactgctgggactgggagaacgaacgagcgctcagagcggcctggtcttctgcctccggagctggcttctgaatcaacttcctccccaggatggggatgtctcgttgagcgattgctagcaggttgtaccggctgggctcgaagttggtcacggcattctcgcccctgaacttcagtgccgcgatgtcgtacgcctctgcagcctcttgctcggttgctgcaaggagcagggtttatgttattagtgcagatgagtcttgagggagaccaaatcactcataaaaataaccattgcatttgcataatgaaacatgcgcgatttatttttaaggaattaagaatatgaccatagttctcctgtacacaagtccataagggtacttccatgccacgctccggtttaaaaaaagaatagaaagcctaaattcattcaggatctttagtatgaggagaaatcaaaattacaggcccttaccgaaagttccaagatacagatccttgttccctgcaacacggccgattcttgcctgccagcgtccatgttggtggtgcctgacaacaaatcaagtgaaaatgactgccaaaaaagttatcgatcatgatggcctactgtaactgaaacttactttgttactcctctgtagattgatgctcctctagaaaagccactgctcttcctggaagattgacacgttgaatttgtaagcatgcatggaagcagccatggacgtgtagctgcggaagtatgaagttataaaaatacctcctcagtgatgctacaacatcacgcctgttcatgttctgcatatcctgaatctctctgatgtagttctctctctggaaagagatgctccattttcagtcaatatgtcatgagcaaagatgtgagtacacctataaagttctgtttgtgctatattatgaaaatgaacatatgacatatgtatatgcccagttcacagccagcatttttttgtgaaacaaaaggcaggagatctgccagattttattgataagaagaataacaagaagttttaagacattacagagacaggagcaatgacagaagcccaaccctatcagaaaagaaaaaaaaacagaccctactaaatggcagctaaggcggcaactaggtgcctagccgtcatctccaggacctcaggcatcaagctgc

SEQ ID NO: 16813 - DNA, 1062 bp, Xenorhabdus bovienii
tgcctgcaggtctgcaaataatctgaaactgctagctaaatccagaaacctccctctttatgagctacaaaatcaaatagttgaggcttttcttcttaaacatgcagaaacagaaataagatacgtgccatcaacccatgatgataaaaatcgctataatgtattcgtaagcgatagcgtgtttgctcagatccaaaatcgaagtatcgaggatcaaaagagcaatgcaaagattgtttacaacgctatcatttgttacgccagggtcaacggactgaacaataagttgctttaatgcacaaaactaaaacgctaatagcgactaaaagtatagctatcattcctacttttaggcagtgataaggatacatcacaaaataaaacaactaaacaaaggaaatcatatgggtacgtcaaacgatcatttaaaattctttagacttcgaattgatgaagatatcatagaaaaaattaatcgtgaagcgcaaatcaaagatggaatgaagcaggatcttatctctgatgttgctgattggtttgctacacaacgtagcaaaggtgagatcccccctcgttatttcgcaagtcgaacgtgtgctgaatacgaaggtatatgggtaagaaaagaaacagccaagcgaattgaagagcttgcaaaaactgatggaacaaatgcttcaagagttctttatacagcacttgcaagatatgtagaaaaaaagtgaaagaagcccactcttagagtgggctttttcgtattcctctccccctgaatccccacctattcacttcaaaaaacgtcctttgcactcaaataattaatgatgatacaaaaaactttcataaaaaattaaatgatgtttgcctgaaaaaatgaagcggttataatcatcccattaatgatgtaaatttatatcatgaagatgggaggagatatgaaaggcaaggcaacactcaagatagcatttgttgcagggatcgggattctatcgaacgcagcccttgcagatcgatcattcaaaagtgtctgtagttttgatgatcaacgccaacaacggctta

SEQ ID NO: 16814 - DNA, 2386 bp, Xenorhabdus bovienii
  unsure (1)..(2386): unsure at all n locations
nnnnnnnnnnnnnnnnnnnnnnnnnnnnnnnnnnnnnnnnnncttcagcaaaaacaaaatacaaaattcacacttacttgcagcgatgcaatacaaggaccaatacagaggacatcaatatcagattcaggtccatacgccttcaaagtagaaaacttttagtcgaggtttgtcataaaaagataaatcacagtattcaaaggtgcaactacagaggcaatatcatacaaagtataaacaagcaaactcagattataattcttacatagccagctgctttacatgcaattaaactatcaaaagctaatcaaaacatgcatatagttagcacttagcaatacaaattcatgtttagaagctctttctaactccctcagtatctgctggattaaacttctgttaaggctttaagagcacatagactatacaagctcatgcatgctattaaccatagaagcagacttcaattaaaaaaattctcccatgctccttaaagcatagttattaaggcggtaaggcgacataaggcgcccgaccccctttttaccttttaagcggtaaagcggcgaggcgacgccttaattatataataaaataaaataattagtatatcacttagatcaaatagtatagaatttgttgataactttccacacctttcctaatctgtccctcagtccatcaccttctctgntccnttatattttaaaattgaaaagaaaagaaaaggaaaataagttgaaggctcatccagcccatgtagaccaccgggcacgggcaagtcaccacttctactataccctaattcctcacagccgcacacagttgcacgcagcccgccgcccaggaggacacgcgctcgcgccacccaggaggacgcacgctcgcgccgccgcggagggagggtggagccgcaacgctgcggagggagagcggagcagagccgccatggaagggaggactggcggcggagcaggatggccgcgcgaccgccatcaggaaagttaccgccccacagtgcttgtctccatctgcacctcttctccaaccctacccaggctaaggcgtccgcgatccagcgccttaccaacgccttgcgccccaaagggcaacgctctaggcaaaggccttacgccgacgagtaaggggacggcgacgccttgccctccagcctcgccttactgctttagcgacgccttaatgactatgccttaaagtcatacgattatgttgtttttagatgtgcactgttaaactttttagacacatgacagctatcattttacattgatattctgaaaacagtacaagtagactatctaaaaatcatcaaattatcaagaaacaaacttgagcccaacgaatagccttccctgaggcattatcactagaaggactctcaaccacacaagcccaagaaaagacccaaaccctggcttcacccgtactgccacaccataacccaggccagcgtccaaaattactatgtggattgccaacgagagaacttctttcaagtgtgtagtagggctcgaaccctgattggcagcctccgtaatggacgtcctagcaccttgttatcagcgtgtttgatattgctatgttttatatacatatcacaaaacaattttgctgacagtgttttagagaccatgtagatggacaaaatagtgattctttctgactggagagaacctccctcatatgagcagtaactctcttcttaaagttatgaccacatgttttgattaacctaccacccgttaaacttacattgacgtacaggagcaatacaatcagacaaatcattccaacagaaacattaactcagcgagctcaggaaacaaatgactaaaagattgagcagctaaacgttgctcatattgctttgttgaaacactattgaagtcatcataattggcagattcgtcaaaacaagagacactgtttactaaacagaccatgttacatatgcaactgcaacacaacacatacttgcactagaatgaataatgtaacaaataacagtactgcatggatagctgataaacgtaatgcctcgccagaaaatatccaggcaattaaagacaggtgatataaatttcggcaacaattaatttgtttaaagagaacacaacgtatagaaaatgaagtaaaagcaacacagacactacagaccattctaaatcaattccatgaacaactaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16815 - DNA, 1686 bp, Xenorhabdus bovienii
gcagcttgatgcctgcaggtccgttgtcctaggctcagaccccgaggggagttccttcatccatcgcttgccgaactttgttgaggtcgttgtagacccgaggtttgagtccttgtagaatcatgctgttggcacgctctacttgcccattcgtcatggggtgagccacggcggcccagtccacccggatgtggtgatcctcgcagaagtccaggaactttctgccggtgaactgggtgccgttgtcggtgatgatggagtttgggaccccaaaacgatggatgatgttggtgaagaacgccaccgcatgttcggacctgatgctgtttaggggtcggacctcgatccacttggagaatttgtcgatggcgaccaacaggtgcgtgtagcccccgggtgccttctgcaaggggccaacgaggtccagaccccacacagcaaaaggccaggtgatgggtatcgtctgtagagcctgagcgggcaggtgggtctgcctcgcgtagaactgacatccttcgcaggtgcggacaattctagtggcgtcggccaccgccgtcggccagtagaaaccttgtcggaaggcgtttccaacaagggctcgaggtgctgcgtgatggccacaagcccccgagtgtatctctcgtaggagctcctgaccttcggcgatggggatgcatcgctggaggatgcctgaggggctgcggtggtagagctccttcccatcccccagcaagatgaacgacttggcgcgtcgcggcaaccggcgaggctcggctcggtcgaagggtagctctccctcgtggagatattgcaagtacggggtctggcaatttcgattaggcgtgaccccgcttcgctcctcctcgacgcgcagtgcctcaccctcgggggccaagggtaccttgggctgaaccgagggtgcctcgggccgagctgagggtgcctcaggccgagccgagggtgcctcggactaagccgagggtgcctcggactgagccgagggtgcctcgggctcgggcgtgtcgtcgatcttgatggagggttgatgcaggtctcgggagaagacgtccgggggaaccgttgttcgccccgaggctattttagccagctcgtccgcagtctcgttgtagcgccgggcgatgtggttgagctcgagcccgtagaacttgtcttccaggcgccgaacctcatcgcagtaggcctccatcttcgggtcgtggcagtgggagttcttcatgacttggtcgatgacgagctgcgagtcaccgcgagcgtcgaggcgttggacccctagctcgatggcgatccgcaacccgttgactagagcctcgtactcagccacattgttggacgccgggaaatggaggcgtatcacgtagcgtaggtgcttcccgaggggcgagatgaagagtaggcctgcgccggctcctgtcttcatcagcgacccgtcgaagaacatggtccagagttccggttggatcggaactgttgggagctgggtgtcgatccattcagccacgaagtccgccaagacctgggacttgatgggcttccgaggggcgaacgagattggttcgcccatgaattccaccccccacttcgcgattctacctgagggctctccgcattggatgatctccccccgggggaaggttgacaacctagttacccgatgagaaccgaagc

SEQ ID NO: 16816 - DNA, 1319 bp, Xenorhabdus bovienii
  unsure (1)..(1319): unsure at all n locations
actgtgattacagcacctcgtaaaagcacatttttgaaaagtgaaaaaaagaaaagtggaacagttatcgaacataaagatactgattctatttttattcgtttggagcgtgaaaatgcaaattaacaaaatgtttaaacctgctttattaagtctatttattctctctggttttgtgcatgcacaacccgcacctggtatagctgtattgaaggcaactggtacaccggagttaaaaaaggttcaagaaactcaagcaggttcaattgctgaagttaaagccgcgcaagacgaatttaaacaaaccttttctcaaatgaatttcactaattttgctgaatcaccagtgaaaggaatctatgaattacataccggtggcaacgttatttatttcacacctaaatcggaagatcgggaaggtgtaattatttttggtgaaatgtgggattcaaacggtgtaagcctgacaaatgaaagcaagctaaaagctatcaaaggggaatggaaaaaacttccagttaaaagcgcaatttcaattgggaataaaaatgcgccttcctattatgaaataactgatcctgattgtccttactgccattcctatcatggatggataaaagattactccaaaaccaaccctgtacaacgcaaccttatctttatgttgaatccagggcatccagaagcaccggctaaaatcgaacacatcatttgttctaaagataaagaacaggcaattaacgatatgttcgaacaaaaacctgtgactttagaaaagtgccctgaagcaaaaggcattattcaacaacatcaggacattgttaaatcattaggcgtaaacggtacaccatcattcgtatttgatgttaatgaagaacctgaactcatcgttgggtttaataaaaacaaagtcatggaggcaataattcaagcaacagagaaagtaaaagccagcgaattaacaaaaccagacgccaccaaaaagcagtaataacagaaattcctttgaatttaaatctaatcaacgttaaggaaacaaagcatgattttaacgctaagcactcatgttcatgagaacacgcagtctatttttatgaaaatgaaaacctggtacttgagccttagcaccatacagcgcttatgtatgggtttattactaactcttattcctgttgctgcaatggcttggacagaacccgcagctggtgattttggctatcaaatctatgacgttggtatcaataaaattgccaaaggcccaatcgggtttgcaggtggcgnnnnnnnnnnnnnnnnnnnnnnnnnnnnnnnnnnnnnnn

SEQ ID NO: 16817 - DNA, 2348 bp, Xenorhabdus bovienii
  unsure (1)..(2348): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagtgttctgctcgagttactactccagagaagatacttgagatacaataaacagctgattaaagtcaggtagccgagttcacgcgggcatcgtataatggctattacctcagccttccaagctgatgatgcgggttcgattcccgctgcccgctccaagatgtgctgatatagctcagttggtagagcacacccttggtaagggtgaggtcggcagttcgaatctgcctatcagcaccacttcccctgttcttgcctcctgatttttcttcctgtaaatacctaacaagcgactgtttggttgatgtggtgaaaccaccgattccgtgttttagaggaacaatctaatgtctaaagaaaagtttgaacgtaaaaaaccgcacgttaacgttggtactatcggccacgttgaccacggtaaaactaccctgactgcagcaatcactactgttctggcgaaaacttacggcggtagtgctcgtgcattcgatcagatcgataacgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggccgtcaggtaggcgttccatacatcatcgtgttcctgaacaaatgtgacatggttgatgatgaagagctgctggaactggttgaaatggaagtccgtgagctgctgtctcagtacgatttcccaggcgatgatacgccaatcatccgtggttctgcgctgaaagcgctggaaggcgaagcagagtgggaagcgaaaatcattgaactggcagaagcactggattcctacattccagaaccagagcgtgacattgacaagccattcctgctgccaatcgaagacgtattctccatctctggccgtggtactgtagtgactggtcgtgttgagcgtggtatcgttaaagtgggtgacgaagttgcaatcgttggtatcacagatacggtgaaaacaacttgtactggcgttgaaatgttccgcaaactgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctatttccgtacaactgacgtaaccggtactatcgaactgccagaaggcgttgagatggtaatgccaggtgacaacatcaacatgatcgttaccctgattgctccaatcgcaatggacgaaggtctgcgtttcgccatccgtgaaggtggccgtactgtaggtgctggtgttgttgctaaagtgattgcttaacgtttgattattaaaagattatgaaaaaaagagaagctatagcttctctttcaaatcttgaaccaccggaaacggtggttttttttatctataaacaaaataaaaacaataattgaaatgagagttatttctatttactatttggcaatatctattattttataaatatggctatgcttctacccaataattttaaagttgcagtcggtagtaagcgaacgaatctctaagagcatagataacgatatgactgagagtgaccaacaaagtagtaacttgaaagatgaaaggtagagtcatatctattgtgcctagcctaaatagttagannnnnnnnnn

SEQ ID NO: 16818 - DNA, 2332 bp, Xenorhabdus bovienii
  unsure (1)..(2332): unsure at all n locations
nnnnnnnnnnnnnnnnnnnnnnnnnnnnnnnnnnnnnnnnnntccaacccaccaaattaactatctggatcagttgccgtgtttatggtttaaatttttacttgctggtagttttctaaatatgttatgtggtaaagccaggttaacctctctaaaatgctaaatatcaacagttccatttcacccacctctattattggtgcaaccgtgcaagtgcaatgtaggattaaggcttgcatgtgtccctaagtgccaggttgataatatttcatctgcttctccacaggataccaggagtactgattttaactggagttggctctttgcaccttttccatatggtgcaagatacaaatgctttctccgcatagttctctctgctccgatgggagaagaattgcgtgactgggttggatgggtgaaatcacgattccgcaaccttcttctcaaggtcatttcatcttttctttgggcatgcatgcttttcttttccacatttctgggttgtgttgatgttgatgttgatcttgaactctccaatgatgttctgcagctggagagtcttggtgtttactgtgaccctgatccctcagaacaagttgatcataccatcactgatccaaatgttgtattcttctggggtctcatctatagaaggaatattcaaatatgtataagttctctcaaagaagatttcatgaaaagtgtctgcaataacatctatggaaaggaaaaatgtgcccattcagacatcacaatgtccattgttgggcctccccagctgccaaaaagtgtctttgatctctcagtttactctgaaaagctgccacaacatatgatggggcaccaactaatgaagcagaactacaatgcagtcagttaggctcagctgtcatattgcgtgcgagcttcatatgtcaatatcacaacagcaagaagctgctgttgaagtcgttttcaacatcagatttgaatttttttactgccctttttagatgtaggggcttgttcatgcctcgggaacaaggaatatgggagattttttccttgtgaagctggatgtcgatagctggatctcttcaagcatccagcaaaatgagatggaagcatctcttgaagcattcaagcgacttattcctgttatgaggtgtgtgtgcaggtacatgcatattcatgtacacatcatagcaattggtatacaagtgaggaggaggtacggtatagctgtatgtaaactgtagatgtaatgtttgtactcagcagcagaaatgtgtaaattgcttcctgttagcgctgcttctgggcacagatgctgaggttgatatggaggccatgaatggaagctatatattccaggccagtatgcaaatgcaagtgttttggatcgattcgacccacttttgttttttaggctgtaaaaaaactgtgtcctagaatccaaggattcttatggtaatgagtatgactttgtggaagaaaaacgtttactcatgcgaagcttttgatgtaattgtggtgaatattctttccgatctctcttacaaaaactgagggtgcaagattagaattcagcccttccggtttgtggttgaatcaacttcgccatagtttgggcctttgtggctcatttggatagatggcagaattctgttaatgcaaatagtttggggctcatgcattacaggacactccttttttctttgtaaagatccgcatcggcttgtatttacaacaattgttggacaatcatagactaaactgtaggcaattcaattttggcacggaaagtttatgctcagatgaagaagacctgtttctgtatgcagcaattcttactacgccaccttgtttcagtataaaaaggcagaaactgaaaatttcaatacgttgtattgtattatatttacttttaaacttttttatttggtttgtgaggagtaattggttaattcatcgccgtctcttttctcattacttaataattagaataataatttaagattaagttatttcactaaatttaagaaatggacttattagagggttttttattgtaataacgggagctctgcctctcaattaaaaaggaattgatccaattttaagaaaaattggacccaaaatctacacatggtgcacaagaaacccagacaacaacaaccccacacacaagccatcctgagtcattgttgctaagctcaacacaagagacgagcagtttcgactccccaagatgagtagcacatgaccaaagtaaaaacgacgactacaaacatcggcacagaagaaggaagatatcgatatgttgtccgctatcgtccaagcnnnnnnn

SEQ ID NO: 16819 - DNA, 3922 bp, Xenorhabdus bovienii
  unsure (1)..(3922): unsure at all n locations
nnnnnnnnnnnnnnnnnnnnnnnnnnnnnnnnnnnnnnnnnnnnnnnnnnnnnnnnnnnnnngataatcgggatgaacatgaggaaaatcttcagcatccatggattcagtgcccccagctgaggattgggcctctgaatcagtggttggtgtatagtcatcatcatttccacgagggcgcttggatttaaagcgacctgcaagtttcttgcggagaccaccaaaaccactgcaacaatgtgacagacatccatagataaataattgatatcaatcaccactatacaaaggaatggaactgtaatgctctgccagggtccggacggtccgcgctagggggccggactgtccgcgccagaggcccggacggtccgcgtccaccaggcggacggtccacgaccgaccaggggcgactccaaagaaccctagccgccacaaatgttgaatttgatgattttgcagagaatactcatccaaacgagttcaaaattttgcatagcattcacattgaggagaactaacaatcccaccaatcagattttgaaaactattgctcaatttcagatcagagaggaaacccaaataatctcaaaattgaagagatgtgaagaaatccacaagatttgaagataccgtgatgaagacatgttgatggaatgttgccacaagctgtcggactgtctgcgtgcaacttcacttcaccgtccgcgcacactcgacacaggagagtatttggcgagtggagagcaagagagaaagagcgaatgagcacaaatgacaagtctacggccactgtcccaatttactgccctgtcgcggatggtccacgctggggcggcggacggtccgcgccctgatgagttcagacggtctgcgaggctgatcggactgtccagttcctgatgctgcggacggtccgcggtccatgggcggacggtccgcggcctgatactcatttttccaattgctgtccactttctgattttgaatttcgaatccgagttggtgcttatatatggacatttcgaccaatccaagagttagtatgcatgcatatacatattatgtaattgagtaatgcaaaatttttgaatttaactatctagagcaatttggaatgaaaaatgcccaaataatgccaaataaatagcataaagagcatatttagacccgagttgcaatacgacacatgtgtgatcaacttcaagccacatttgagagatcgatcacattcatttcacttcttagagaacaaaatcttgtttcatccaaaggctttgtaaaaatgtctgctaattgatcatccgtgccaatggaataaatagagatatctcccttgccaacatgatcccttaagaagtgatgccgtatatcaatatgcttggttcttgagtgttggaccggattggtagccaattttaccgcactctcattatcacacatgagaggcacattcttgaaaataattccataatccaataaggtttgtttcatccataatagttgagcacaacaatttccggccgatatatattccgcctcggcggtagatagagcaaccgaattttgtttcttagaagaccatgaaacaagagatctaccaagaaattgacaacaaccggaggtgctttttctatcaactttgcaccccgcatagtccgaatccgaatatccaattaattcaaagtgagcacctttgggataccatagaccaatattgggagtatacttcaaatatcttagaattcttttagcggccttcaagtgaatctctctaggtgaagcttgaaatcgagcacacatgcatacactaaacataacattgggcctagatgcggtaatataaagcaaactaccaattattgaacgataaagtttttgatcaaccatagtacctccttcatctaagtctagatgaccatttgttgccattggagtcttgataggcttagcattttctaaaccaaacttcttaagcatgtccttcaaatattttgattgacttataaaaattccatctttcaattgtttgatttgaaggccaagaaagaagctcaattctcctatcatagacatttcaaattcttttgacatcattcttccgaactcctcacaaaataattcattagtagattcaaaaataatatcatcaacgtagatttgacaaacaaataagtctttgccaattcttttagtgaatagggtagtgtcaaccttcccaattttgaagtctttggaaagcaagaaatccctaagcctttcataccaagcgcgtggagcttgcttaagcccatagagagctttagaaagcttgaacacatggttaggtcttttggggtcctcaaaaccgggaggttgttcaacatacactagttcactaatcttaccatttaggaaggcactctttacatccatttggtagagcttgatattatgtgcacaagcataagcaagtagaatccggattgcttctaatcttgctacgggagcgaatgtctccccaaaatccaatccttcaatttgagtatatccttgtgcaactaatcttgccttgtttcttactaccacaccatattcattgtgcttgttgcgaaacacccattttgtaccaataacattgtgggtctttggtctctcaacaagctcccaaacttcatttcgagcgaagttatttaattcttcatgcnnnnnnnnnnnnnnnnnnnnnnnnnnnnnnnnnnnnnnnnnnnnnnnnnnnnnnnnnnnnnnnnnnnnnnnnnnnnnnnnnnannncnaannnatnnnanannnnnntnggnnacccttannaanannannnncaannnnatcnannnggtnatcnntcanannnnaatgannnnttcnngataccgtttgataattgcttgttgaagcattaggaggaaccgaaggtctgaaagtaccttgatcatgagtatccatggtntcattgagttgttggctttggtgatcttcctcatttatagttgtggatgaaggaatggcaaccacactattttcatcatcatcttcctttggttttatttcaccaatggacattgttttcattgcatttatcaattgagttcccccaacatcatcgagattatcactctcatcttgagacccacttgtttcatcgaattcaacatcatatgcttcctcaataataccatgagttttgttgaagactctataagccttactatttgatgaatatccaagaagaaaaccctcatcacatttcttctcaaatttagagagccggctcccctttctcaaaatataacatttgcaaccgaataccctaaaatatgagatatttggctttctaccaatgagcaattcatatggagttttcttcaatagcttgtgacaatatagtctatttgatgaatgacaagcggtatttattgcctcggcccaataagaatccgatatactatattccgctaacatagaccttgccatatcaataagagttctattctttctttcaacaataccgttttgttccggggtatatttggaagagaattcatgtttgatacccttgtcatcacaatattgatcaattcttgcatttttgaattccgacccattatcacttctaacctttttgatgtcgaaatcaaattgattttgagccaatatagcaaatgacttgaatgtttcaaacacatttggatttgtctcgtagaaaataaacccaagtaaatcttgaataggcatccacaatcccaagacattaagaataccaccaatacttacaaaagataggggccccaataaaatcatgtgaaagtaattccaaaaggcgatgaggggacatttgactttatttgggagaaggtttgccacttgctttacgggtttgcaaaaactaacaaatttgtcttttcaaattccattttttagcccc

SEQ ID NO: 16820 - DNA, 1533 bp, Xenorhabdus bovienii
  unsure (1)..(1533): unsure at all n locations
nnnnnnnnnnnnnnnnnnnnnnnnnnnnnnnnnnnnnnnnnnnnnnngtcgctatggctaaaactaaaatatttccctttctatagaacagcttagtgaagttcagcgctatgttacgcaaaaagcaggaaccgaaccgccattttcaggaaaactgctgcataacaaaaaaagtggcatttaccactgcctgtgctgccgtcagccattatttgtttctgacactaaatttgattctggctgtggatggccaagcttttaccagccgttcaatgataaatccatcaattgtcttgatgattattctcacaacatgcatcgaatagaagtgcgttgcagtcactgccaggcacacttaggacatgtttttcccgatggccccaaaccgacaggagagcgcttttgcatcaattctgcggcactgcgcttcattgacgaggaaactggggatgaaacagaaggttagtttcgttactgggcctgttttttgacaaaacagtaattagagaaaaaacgattcagcataatgtacgtagccgtaaggaaatatcgatgaagttggatgatttactctccgccatgacacctgaaatttatcagagattggttcaggctgttgaattaggcaagtggcaggatggtgtaccgctaacgccggaacagaaagagcacagtttacagatggtgatgctttggcaagccaagcataatcacgatcctgaacacatgacgattggtacggatggccaaattaccataaaaagcaaacaagagttgaaggccatgttccagtcagaaatggtcgtgaaactaaaaccacagccagaagaatgaggaaataacctcgtcttgtgcagtgattcgacgaggttatgttctggaatattatgtccagaagtattggctgtcggtttaagaaagtgttgttatttcatgcagtgggattagtttagcgcctttagttgccatttccttaaatgccttcaggctgtcatcatcctgaagattgaccccacgacaaccatcagtaatcacgtaggtttcatagccttgttccagtgcatccagtactgtaaattttacgcagtaatccgtagcaatacccaacacaatcagtcgttgaatattttgatccgctagccacccatgcagtcgggttgcgttcttatggtcattatcaaagaaggcactgtagctgtctatctgcggattttcacccttacggaaaatttcttggatagcggattgattcaacgcaggatgaaaatctgcgccgaattgcccttgtacacaatgaacgggccaccatatttgaggaatgccattgagcagcccagattctccaacaggctgactggcattaactgcaaaactcatatgattggcgggatgccagtcctgacttgcgataacagtgatattgtttttctggcagaggctgatggccttattcgctattgtgatgacctcttcactctctttgactgccagtgctcctcccgaacagaaatcattttgcaggtcgatannnnn

SEQ ID NO: 16821 - DNA, 3281 bp, Xenorhabdus bovienii
  unsure (1)..(3281): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnataaaaagaaaactaaatttattctctacgctattttggttttaacagcgctaacttattatgaagtgagcaattcagcggacaaagcaaaagtagttattactcctttcgccagtgtggattctggtgatttttgggtgactggaagaacggcatcagagagttatgttaatcgcatggctaaactggtcgctgcgtattacgggacggtttcgcccacaactgtaaaaaactctaatgcctctcttctggctatggttcaccccactagaagtgaagcgatgaggaaaaaattcaacgaacgagaaaagaaggttactcagtttacaactgtctcattcattacagaattaaaccctgaaaaaccaatccaagttactactaatcctgaagttgaatataaagaacatggttctttgcctgtttatcgtctggagatccctgttaccaaaagaaaaataattggtgagacttctcctaatcctgaaacagcaaaatacaccgtagattacaccatcgaatcaaatcaattctggctgcttgatataacgggcttataaaatgaataaactactcctaatttgcgctctcagtcttacctctgctgtggcgacggcaaaagtaactaatattagtacccaaagggtacttcctgaagtatctaccactgttacattgagcaaccgtgatgttaatcggattgtttgtgaatctggcgaagcagttaaaccagttttcagtaaagaaaaaccaatgaaagtagaaattggtgctgatagaaaaactttttttgttaagttcttatttttacagagtgctgggggcaaccaatactactcagagcctaccgaattatatttaacctgcggtaacgctacttttgagttgattatcaatcctcagcatgaatctgccagaaaggttttattgggttctggtacagccaataccattaaagagaatcaaaagttattctcagctctatctctggaagaaacagcaacacaactatcaattagcgttatgaaagatgctaacgattccggccttgggcttcctccaacatttgaacaacaagcaataaatggccgttgggagaaagcatttcctgatcgtcgtggtgtggctattcccatcgaacttaaaaaagatagagaagttaatgttgaaggaacaggtttaaaagcgactcaatttaccattagagcattacgcaatgttcaactatcagaaatgatgtttttgaatacccgctacggaaagaacatattcgccataacattagagtctttgtctttaagttcagggcaaatgacgtcactggtcattattgaaagggaaggtctatgatgaatatcgaagacaataaaacaacccttttggataaggctaaatcctggtactactctaaatcttcagctgatagaaagaagatcgtcaaatatggcactattaccagttttattattattatttttggtttctattacgcttcaggtaaggccgaaatcgtaaacaagccaacatctaaaacttcagtggttgcggatacagctgaagataaattattgaaagacgatgttgtcgctcaattgcaaggcgatataaaggacagtaatgcaaaaatcactgatgatgtggccaaaaaaattcaggacatgattaacaagggtgaatttaaactagcacctacaccgccagttaacttagcagaggcagatatatctccagttaaagagagaaatgaacttggctcgactactggaaatccggttgaattttcatatccacaacctttaagtgaatcatcaccagtttcttcagacaatggtacaccggtagacgggactacaccgcccgatactggccccatttgggttggtgatatcgcgatagataacagtacatttacccagcctccggcagaggtgaataccgaaaaaaagaaccagatccagttgccggttggatttatgaaagcccaccttttagtaggcgttaatgcgttaaccggtgaatttggcgcagaaaatccccaaacagtaatgtttagggttcaagcaccggcccaattgcctaacttcattaaaatgaatctctcaggttgtttctcagtggctaacgtcactggtaatttatcgatggaacgtatcattgcacttccaatcagcatgcattgtattaccagagacaagcgattcatcgttgaaggggcaattaaggggtttgtctctgatcgtgatggtaaacgtgatatgtctgctcgtgtcgtttccagagcggggccgttacttgcttctaccatatttgcgaagagcattgagggctttgctaacgtagttggttcacagggcgtcacacagaacgtatccgctttaggttccgtgaataccattaaaaacgcagatttagctaagacagctgcctcacaaggtttagccggtggcttaagtgaagttgggaaatatttattagacctcgccaagcaaacagcacctgccctggaaacaggttccggtaaagatgtcattttgtttattcaagaaaccgcaacgcttgaaattaaagaagttcggattaaatagctcaattcaaatagggtaacaatatgaaatttattaaactcacaattattcttcctgtattgattttatctggttgcggtattcttccttatcacaatgattttgcctgtaaattagaagatggttatggaaaatgcatttcctcagctgacgcatatgatgaggcggttactggtattaataaaggcaaggaaattacagacagcggagtaaaggatgacccaaaggcatctgccgctaaagcggctaccagcgctaatagctctgtggcctacgataaatatcgtgaccgtgtttatcagcaattaacacaattaattgcacaaccacaaacaccggttgtaaaaccagctaaagtcgtcagaactttaattatgtcttattcccctagcatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaancatanttncggcngacatatacttgatttnnnngnncgg

SEQ ID NO: 16822 - DNA, 3960 bp, Xenorhabdus bovienii
gcagcttgatgcctgcaggtccgcagagaacaccagaaggccatcccgacgataaaaaaggggagctggtcggggagcaaggcccccccccgcccctgctaaacccgcattgcacggaaacttcagccactcggttgtttgacggtcggagacaaaaggtattataaacaacacccaaacacctgaaaaagtcgcatgaggccaaatttgtcaatcggctaaatcgcgggattccctttagggttccaatttagtgattgacatgtaagccacttaacaaataggtttttttagggggatatttaccgttggccatcttactaaaaaagactcctgcccttcagcatcgcttggtatccggcaggacagagacacgcagtggctctgcgaagcttagcgaccgtctcttagggcggttagcgcagtccaggcgacatttttcccattcctttgggaaaaatgcctccggtgcccatcttaaggggtttcttcttatacagtttttaatattttcacgcctgaatgttttcccgcaaacagtagcaaataattgtattcatccggtattaattggatatcagcgacactcattccatcatattctacctaatactaaagtgaactgaggatcatcacagaggtaaaatcgttcttctggtatactggttgcttgtaatacagcaagggatgggtaaatttttccatttaaataagtgtaggatgacaataaagatcttatccttggggttttcgcttctccccttaaccttggtgattttattttcaaattagtatgacttagcatatctctgctactatgcattatgtcgtcacaaatatggggaaaatattgtataggtctaatggaatactccccgaaaatgacgacttctttatttttctgatagttataaaattttctacatttttatttggtaaattgaccattacactcgtaacgatcaatttttttatttgcgattatctaaattcgggcttataagcgtttagccgaattgtcatttctacagtgtcagttactcagggtattaaggtacagtccgatgttatttacatcgtcttcactgtatttagctgggatctcgaaatacctgatacctgctttattacaggcttctttctttattgtatcacggactgcggcattaccttgataatgcccagaaccctgatattcaactacagcgaatggttcgcctttctggtcaataatggcaaaatcgacacgcttgctattgatggataaataagcatttttgctgtcagagcctataatctctcccaatgaaacttgtggaaagatcccgaaaagacggatggttcaagttgagaaatttttctaacttacaaaacagataatactcacttttattcatgatagtacgtttcttgaacgtattgttcactacataaataagctgtttctcggctatgctttgcgtactttcggaacgtcggctttgctgcgtaggtttccgtcttggcttattactgagggatttaaaaatgaagagggctactacaaataaaacgaacaatagccaatatgtggtgttcatctgatgcatcatcctgattttttatggttatcaatatagtatcacgtactgatttcgacgtcttcccgcttccaagcgtcaatcttaattgaacataaatcataggtggaattaatataacaaccattaattaaaaataattaatattattttttcatttaactattttctatactttcaataaattgatctacacctgaaatgtcttcaaaatgctttggaagctgctctccatcgaatgatgaaaaccaataacatttactacaactaacacctgaattagttgttctattgccaaagttgatttttttaacttgcgttttcattcgtccagttttcgtattaattacacgtctatgctcaattaattgttcaacccagaaataaacttgctcaccacagttgggacaaacatatttttcattgctcatctgctccacctgtttccttcttttcaagaagtttatatgttacatgattaatattcaaattgacttgaacggaaaattgggtagaattagggctgtattaaattttcttcgaattctgaccctaattttctcattttatccaaaatggataataattctttctgatccaatgtcaattgggctgctataaaaaaaagaatatgttgatttaattcccgtggtttttccccaccagtatatttacgccactggttactaccagatacccctgccagttctgccatttgttgacctgtaaaacgtaacttaccttttagatccgctagatcatccgtcgaagggggtacataattttcaattaaccgcataaatcttccattagaaaaatggggcattccgccccatgtattagcctacaaaaatgtattttatggctgcgatgacaacagcgatcccaaccgtaataattaattttttcaaccaatccatatcatttttaattgatgttaaatcagcttttaaattgttctcagcttgctttaaatcatcttttgtcgctgcactgacattttgtaagtcagcaataatctcgacaattttttccgcttgtgcttcactcatccccgattctttcagagatttaatagcattatgtgtattcatagttatggctgacatttttcatccttttggggttgatggctgctgattattagctaccttttgatacttaatttaacaccaaaggggctaaatagcaaattttttatacggtgatttttcttatttattatattaatcatgtttcacatgattaacaacgaaagggaagaattatacatctaagacagagacacgcagtggctctacagaacttacttcccgtcttttggggtaatattcctttggtgctcttgttttattttttcactatttgattattttccttattatagatcacctcataatcaacgaatttttcaccacggcgaaccggtgtaatacgggtcacattcctagctacatgatttataaccataactcgttcaattgcagagagtagtttttcatcttcagctagaggccaccataggttattgttactgccacttagcaaagcattacggcagaaatgaaaccctttgccttcattgagttcgcatacaataacaatttcgctatcacgtaatgggaagagatcatcagtagttttgttatttcgttgcatttttttctctatttttctgcatagaaaattgtaaaaattcttttagcatctttatttttagtttttaattaattaccaaattccatttcttcaaataaagaaatatatttcctgagaagacaaccataaatctggtgctgatggttttctctatatctatcaagttcaaaaccttcaacaatttcagacaatattgggaaaccctctgattctagctgatttaccaaattagctcgttcattactaacaatacggttactatttaaatttaaggcatcaatcgacttttcaatgagttcaatcgctttattttttgttttcgttggattagctgaattacttggcatttacttattcctttattcttagttgagaatacattcaaaattttaagatatttcatagcatcctcacacgaggatgctaacgattaacgaacagcccctaaaattttctctgattcagagtgctgatttgcataatatttcagccattcctgacgctcaatcaaccagtgatttaattcatgatcgccagcctcgtaggcttgccaaataaaataattaagagcaaacagggttacagcgatccccgcagcatcggcacttaacatcccgctaaagccgttaccatgtacatgtatagtgaagtttttgtctgtaatcggagccatataaccaccgccgcaggataagtcataatacttccaggagtcacattg

SEQ ID NO: 16823 - DNA, 1419 bp, Xenorhabdus bovienii
  unsure (1)..(1419): unsure at all n locations
nnnnnnnnnnnnnnnnnnnnnnnnnnnnnnnngagctggtcgtactgaattgatgaaggtgatctacggagcattgccgaaaactaaaggcaggatcctgctggatggaaaacccctgactattcgcaatccacaggatgggctggctaacggcattgtctatatttcggaagaccgtaagcgtgatggcttagtgttgggaatgtcggtcaaagaaaatatgtccctcacagcgttacgttatttcagtcaaaaaccctatcgtttgaatcattccgcagaacaaaaagccgtaactgacttcatcaaattattcaatatcaaaactccctcaatggaacaatcgattggcttgctttctggcggtaaccagcaaaaagtggcgattgcccgtggtctgatgactcgcccgaaggtattgattttggatgagccaacccgaggagtggatgtcggtgcgaagaaagagatctatcagttgatcaatcagttcaaaaaagaaggtttgagcatcattttggtctcgtctgagatgccggaagtcatgggaatgagtgatcgtattctggtgatgcatgaaggtggcataagtggtgagttcagtgcggataacgcctctcaggaagcgctgatggtcgctgctgtcggcaaacaatacggtgcagttgaaaggtaatgatcaaggataagagatatgaattctaacacagcaccaacctccagacgtttgctcacgaaagcctggttgatggagcagaagtcactgattgcactattgattctgattgttgtcgtttccttcctcagccccaattttttcacactgaataacttatttaatatcctccagcaaacttctgtcaacgctatcatggcggtgggaatgacgttggtgatcctgacttctggcattgatttatccgtcggatctctactggcactgacgggagcggtggctgcatctatggtcggtacggatgtcaacgcgctggtggcagttgttgcagcactggcattgggggcagcgattggcgcatgtaccggtgttattgttgcgaagggcaaagtccaggcgtttattgccacattagtgatgatgctgttattgcgtggtgttacccgtgtttataccgatggcagtcccatcaataccggattcagtgataatgccgagctatttggctggtttggtattggccgtccattaggagtgccggcgccagtctggatcatgttgctggtttttgctgctgcctggtacattctgcatcacactcgccttggccgttacatctacgctttaggcggaaatgaatctgcaacacgtttatcaggtattaacgttgataaaataaaaataannnnnnnnnnnnnnnnnnnnnnnnnnnnnnnnnnnnnnnnnnnnnnnnnnnnnnnnnn

SEQ ID NO: 16824 - DNA, 945 bp, Xenorhabdus bovienii
  unsure (1)..(945): unsure at all n locations
gacgtcgcatgctcccggccgccatggcggccgcgggaattcgattccatggcagatctggttcttttcttagctctttatacaacaacaaatgcaaaatctttccaacttttttctttcattttattattcaactccaaattaacaattattaaacaacgatggcaatgcatccacgtcatcaaaaaagtatatgaaataattagtttaaatttaaatagatatttatggagagaagcggtttggcaggtagcaatgggaagtgagaggagtgctgaggtggcagtgtgcatggccagtaggctcataatgagaagaggtgggagctgaggtggcagcatgcatgcccagtggtgtcatcatgggaagaggaaggagctcacgtggcaacatgcatggcgagttgtgtcatagtgaaaaagccaaagtcgaaagtgacatgagacatgtgtggagaggagggagctgaggtggcagcgtgcatggtgagttgtgtcatgtggggaatcaaaaattctaatttgattttcccttttttatttaattgtatatattatatatattccctagtttatccttatttattttactctgttgtgaactacaatgattgtactacatacatgactaaatgatcacacaggtgtgagaggatctgaatgactttagaatgtttttttaaaattatattttttaaatatttgtatttctataaactctaatcatgtattagaatgttttgaaaaactctaagtttttacaaaaatatatgtataacatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16825 - DNA, 3111 bp, Xenorhabdus bovienii
  unsure (1)..(3111): unsure at all n locations
nnnnnnnnnnnnnnnnnnnnnnnnnnnnnnnnnnnnnnnnnnnnnnnnaagactcttttagcatgtccattatgatcaccctaaaaaacattacggtcgaatttggtagccgcaaggtattaaacaatatcactttcagtctcagacaaggcaagatcctgacgttaatcggcccaaatggtgcgggcaaatcaacactggttcgcgttgttctgggcttgattcaaccaacttctggaactatcgaacacagtcatccactgaaaatcggttacgtcccacagaaactcagccttgatcctaccctgcccttaacggttaaacgtttcatgatgctaaggccaaatgttaaatcagcagacatcatgcccgtattaaagcgtgtcaatgctgaacatttattacagcaacccatgcaaaaactgtcaggaggggaaacccagcgggttttactcgccagagccttgctcaatcatcctcaacttctggtgcttgatgaaccaacacaaggtgtagatgtgaacggccaactggcgctttacgatttgatcaatcaaatcagaacagaacttaattgcgccgtgcttatggtatcccatgacttgcacttggtgatggcgaaaacagatgaggttttatgccttaaccaacacatttgctgttctggcacacctgaggtggtatcaatgcatccagaattcatcgcaatgtttggtcgtcatggtgcagaacagctggcagtctaccgccatcaccacaaccatcaacatgatctgagaggaaaaattattttgaaaaacggtggggagccacgtcgatgattgagttattactcccaggctggctggctggcattttattggtcatcgccgcagggccgctcggctcttttgttgtttggcggagaatgtcttattttggtgacactctggcacacgcttcattgctcggcgtggcattcggttttttattagacgttaatccgttttatgccgttattgctgttacattgatattggcaatgattttagtctggctggaaaaacgcccacaattagcggtcgatactctgctgggcattatggcgcatagtgcgctatctctgggcttggtagtcgtcagctttatgaccaatatccgagtcgatatgatggcgtatttatttggtgatctgctgtctgtcacttatgaagatctctggctgattgcagcgggtgttgccattgttactgggttgctgacatggcaatggcgtgctttgctgtcgatgacggtcagtcaggatttagcatttgttgatggcatcaaaatccagcgcttacgtgtgcttttaatgctggttacagctttgaccattggattggcgatgaaatttgtcggggcattgatcatcacttctctattaattatcccggcggccactgcccgtcgattctcccgtacgccagagcacatggcagtttttgctattactgttggtatgcttgctgtcacgggaggattaactttatcggcattttataatacccccgccggaccttctgttgtgctctgctcggcagcattgtttgcattaagtttgacgtgtaaggcgaaaaactgataattcagattggcaataaaaaattaaaaatatgataatggttttttataccatataaatacagggggttattatctcaatgattgtagccctttttaatcgagcaatatctaataatttaaattggtttgatttatccgttaaaaataattaaccgcaaccttaacaattcgtttaaaaattattttcattgattcatcattgacacaagcaccataaatgcaagtcacaaagtatatccagctcttggcaactagcctgagctggtatttgagtatttctactccacttctttactcagtccaaaatgccgataagcatgattggtagcaattcttcctcgaggagtccgctggataaaaccttgctggatcagaaatggttccagaacatcttcaatagtttcccgctcttcaccaatcgcggctgccaagttatccaccccgacagggccacccatgaatttatcaataatcgcaattaatagcttacggtcaagataatcaaaacctgccgagtcaacattcagcatattgagagcttggacggcaatgtcgccattaatagaaccatccccttttacctgagagaaatctcgcacacgacgcagcagacgattggtaatacgaggtgtaccacgggaacgcatggcaatttgccttgctccctcttctgaaatgcccaaccccatatagcgggcactacgggaaactatgttctgtaaatcatctacgttataaaattcaaggcgctgtacgatgccaaatcggtcgcgtaatggggaggttagagaccccgcgcgagtcgttgcaccaactaacgtaaatggaggcagatcaatttttattgaacgagcagctggaccttcaccaatcatgagatccagttggtaatcttccatcgcaggataaaggatctcttccacaaccggagacaagcgatggatttcatcaatgaatagaacatcatggggttcaagattggttaacatggcagcaagatcaccggccttttccagaacaggccctgatgttgtgcggagattgacgcccatttcattcgctacgatattagccaacgtggttttacccaatcctggagggccaaaaatcagcaaatgatccagtgcatctcctcgttgccgggcagcttgaataaaaatttccatctgttcacaaacgtgaggttgcccaacatattcagacagtaattttggcctgatagcgcgatcaatgacttcatcatcttgcaaaacttctgctgaaatcagacggtcagcttcaatcatcatttaactcctgtaactacagagccgcacgcagcgcttctcgaataagcgtttcgcaatctgcgcccggtttagccaccttacttaccatccggctggcttcctgcagtttatatcccagtgaaaccaatgcggaagcggcttctgcttcaatatccgcattagagttggcttgtttagccaccgcaggtaaattaatatcgttgctttggttgaacag

SEQ ID NO: 16826 - DNA, 935 bp, Xenorhabdus bovienii
  unsure (1)..(935): unsure at all n locations
atgcatccaacgcgttgggagctctcccatatggtcgacctgcaggcggccgcgaattcactagtgattctgcagtcctacataattcttctacagttaaccttcaaatcatattttcattattcacaaatatctagtcattcatacgaataaatatatatttttttcacatacaattatgataatatattaaaaagtgaactttaaatttaatttaatcttataaaatcaacttataaaatgagatttctacctacgattaataaaaataactttgatatcatattaaaaaataaactttaaacctaactcaactttataaaaccaatttataaaataaaatttacactcagttatgaattataaaatgaaatagtttttaggtgacgtggaatctccatccgattaatcaatatttgatgatgttattgttattatagaaactaaaaacatgccaaataatttacaatatatagattcagttaaatcaattcagcttgtctccttgactaataaaaaaaaactttagactattattcagatttacacttcatctctcatgatatccctcaaagtgaatttcattcatggcaccatttatataatcaacaattttaaaaatatgcaaatttgtaccagtaaatgctttaatgtccctgataaacacaaaaaaaaaaaattcatatttttttcttattaaataaagaagttcattgtaagagaaattaggatccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16827 - DNA, 7421 bp, Xenorhabdus bovienii
  unsure (1)..(7421): unsure at all n locations
caagttcgagaaaagcgggaatagctcagttggtagagcacgaccttgccaggtcggggtcgcgagttcgagtctcgtttcccgctccaaaaaaggcgcgttggcagagtggccatgcagcggattgcaaatccgtttacctcggttcgactccgggacgcgcctccagattcaagcccaggtggtgaaatcggtagacacaagggatttaaaatccctcggccttatggctgtgcgggttcaagtcccgccctgggcaccatacataagtttactgacgtctactcaagtaaacaaccccctagaaagacctgataaatcaatcaggttttttctttttacgtctactctagtccattgcaatctacatgcctctgggggcataatcaggggcatcttaacttctattttaaatatgcccccaatatgaagctaaatgcgcgactaatcgagactgcaaaatccaaggataaaacctataaacttgccgatggtggtgggttatatctggaggtcacttcacgcggttctaaatactggcgtatgaaatatcgccgtccaacagacaaaaaggaagaccgactggcttttggtgtctatccggcggtgtctttggctgacgcccgaaccaaacgagatgaagccaagaaattacttgcgcaaggaattgaccccaagatagagaaaaaagggggactacctaagtcggcaggagcatattcctttgaacgggttgcccgtgaatggcacgccagtaataaacgctggagcgaagatcacagcaaccgaattctacgcagtcttgagcaatacattttccctcatattggcaggcttgatatttccattttaagaacaagccacctattagcgccaatcaaagccgttgatgcagaaaccaagcatgatatagcccggcggttacagcaacgtgtgactgccatcatgcgttatgccgtccagaacgacattcttgaatccagtcccgccaatgatatggctggcgctctcactacagtgaaatccaatcaccatcccgcattaccccatgaacgtttacctgagtttttgacccgtcttgcccgttatcgtgggcgtttaattacccggatcgctttagaactaactttacttacgtttgtccgttccagtgagctgagatttgcccgttgggaagaagtcgatcttgaaagagccacctggaagatacctgcaacaaggaaacccatcgagggggttaaattttcaggacgtggcatgaagatgaaaactgagcacattgtgccattgtgtcgtcaggctgtgtctctcatagaaaccttgcgtgggctgagtggcgattgtgacgtgatgttccctaatgatcatgaccccaaaaaagtcatgagtgaaagcacagtcaataatgccttgcgtgttatgggttatgacaccaaaacagaagtttgtgggcatgggtttagaacaatggcacggggtgcgatgggtgaatctgcattgtggaacgatgatgcgatagagcgtcagttaagccatatagaaagaaaaaacgttagggctgcatatattcatacttctaaacatttggacgaacggcggctaatggttcagtggtgggctgattatttggatgcgaacagagaaaagcacataacaccgtatgattttgcgaagaaacgtcggaaatagttctgagcaaagtcacatattcgatactcacaggactggacaaatagacagcggtaattgtctttagtagactatcgcagacgttaaagaataaagctatgtctagggtcgctcccgaaaatccgtacacctctacggactggcatagcttctaccaatagagggcgtgaggtgacgtgatgaataatgtgtttttagcggatccgcttagtgaattaaaaagcaaagcaaaagattttatttctatagaagatactctaaatattatttgcgagatgctggattgctccttagtgactgccgctgagattatcttattgaaattaccagatgatagagattggaataatagtccagttaatcctcctttttttggggaaaaattaggaatagctacgttttcatactgtgataatagacctctgattcgagagttactaaaaaacatcattgaaaatgatccatttagctttgaagacagcatccctttttagagtgagtttattatgacagagcgtaaattagctagcgaatataggaagtttggttttgtgaaatcccaacttgaggatgttttaggtttctctctagggggagagcgttctttgcctgattatcttaaaccatataaaacaagaataggcatacaactagatgaagctgcaaatatttttgctgggtgtagacctagtgaacatataaattctggtccattggttgatattattcgtggttatagagcctctctttgggatgcatatgataatgatatattgtcaggcaacaatatcatcatggattataactataatgaagaatatagagtcgatgttactttagttaaagatcaagttactaaatgggctagagagcataacctagattggccttttgaattacctgaaagtgaaatagataatgaaagtagttcggttgatttactctcaaaaattgaaagtttagaattagaaaataaatctttaaaaacaaaaatcaatgaattaaaagaaattataccgctactattgtctgcatatagagatgatgacccattatcaatagctattaaattaagaaatgaagtgtgggtagactacaacgaagattcaagatcaacaataccaacccaagagtgggtggtagcaaaactcatagatgaatataaagagtttgaaatgacaaaggctcaagctcaagcaattgaaaaggttgcttgccctattaagcgtaaataggtggatacgaatatctacactgttcacgctaaagtaaaacaaccctcaaccctgagggtaaaaatggtcttttacccttaaccatgatggtaatgagccactatttaccctctaccctcatagtgttttgtacaataaatagccgcacaaggtacaaccctcatagttaaattttcaaaaaagccattaggcctaatggtatgatcaaaaagcattttttcgtgtaaatataaccccgaatctacgaacgtctatcaaggcgtattacaaactagatagcagggggctacatgccagcaatcataataactaaagaaaacctcatccgcttacccgaagtccaacgcagaactggctacggtaaagcatggatctacaaactcattgcaggcaataaatttccgaagcaagtcaaaattggcactcgttcaatcgctttcgttgagtcagaaattgatgactggatatcacaacgtattgctgaatcacgcggcgaggtaatgtaatgaaaaactttatattcccgccaacagtagagaacgtgaataacccatacagccgtaaacctgctaattaaggaataacatcatggaaaaaattactgccttgattggcaacggtcaaacttaccctaaattcagccagagtgatatttcaattatccgtaaggcggttatttcgggtaactggacggtaattaacaaaggtatttgcacactcaccgatttgggattacgtcataacggtcaggggttagtttggctcaattctggtgtatcggttcatgatgcagaaagtgatacagggctgacaggcaaggataagcaatcccatgagtaccattcagaggtgcgctcagttaaccatttgaatagtggtaactattatggatttgtccagctaaaggatattgatagttacgcattgaatatcattacttcaatcagttctgaatatcacacccgtaaaaatggcacacctttagcgacgttcgcgttactgattgaccagaagcaacggaaacaggccgtggataactggattttataccgcaatccaaaccagccagataagtacaccattctcaataagcatcatgaactggcgaagtgttatcaggctaaaggctggatgcgtgagccgttggaatatctaagcaagttaatccgtaatgatgctgagttcagcaagcttatgcgtcggttgggttatgttcccgttcgcacaagaaaactaaccggaaaacgtgagagattttggttatacagaaaaacaggaaatgataagggggttgggacaaaaaaaataaataaaatcaatagggttactccatttgtccagtatgcaaaacgaccagtgagagccttcgagcatattgctgtagatggtcagtggctctatgtctatgccgatcacattcgctttctaacaaagaaacgtcaccgcgttgagggtgttcgggttcagggttatacggcaaaagaaatagagctgcgagaggtggtgtgatggtcattatgtctggtgactccttgaggttaaggagtcctcaatatcagaaccacatatctttaagagatgtagttagaaatcaatcattgtttttgaaccgagtgaatgtcggtaactcagttcaatcggctgaaattttagctgatgggtatgcggatattttcggacacccatcagcgaaatattgcgccaattgggatttgaaagcccattttgatgataacccattgatatataatcagacggcatatttgcagtctggtcataatatgcgcgtatcatttagcgacgcggttaatttgcgatcctcattgagtggagcacaaaaagaaaaggatagcacggcgaatgctaccctttggcgtgactcagatttgctttacggagaattacaacagcttaagaggctacccaatagttttgggttggttaggctcacctctttaagaggtgtggttagttattgttcaatcaacttaccatctttaagagggttagttaggctccccgataacatcgggttggttagttattgctcaatcaacttaccatctttaagagggggagtgaaccaagtaaaggatatttacttggttagttattgctcagataaccatgtgaataatgttcacttggttagttactgttcagatgatgctttggttttgcgtcgctggagttcttcctgtgcaacactgataagtaatcttatttcttcattgacttttgtaccgatttcttcgacgcgggcaagggcatcaagggacgagagtagtggatctttacagttgccctcactttggcggcgagctatttctacacgcatcgcagtaataataaatccagcattgctttcattaccttgttttactgcttccattccctccattacatcatgcggtacacggacggtagttaactgtgactttgcatttttgtttggtgttggcatcaatgaaactccttacaattggtgtgtttcattatacacaaaaaagaaatacaaaaaagccttgacgtgtgtttcttatgaaagtatcgtgaaacacaccttgagaattcaaggtatacaaacagcgaagcccagtagtgcgcgaacactaactggacctctaaccaaaaacgtaaaggagttttacgctatggatacaccacagcataaccaaactcgccttaaatttacattcctaattgcatcgggcaatcaacgtctggtggatattcaccctgtacgcctcattactgttctggcggactgtgaaggtgaagcccgtttactggcaggcaaatcctctctggtatttgtttcccgtcagggggtgtccgcatgagcaagcctatcactattcatcaagccgctgaaaaggcgcagcaactcgaatttattaatcagcttattgagtcataccctcatcaaatacagggcagtgaaatatccgttatgccttcactgatggcgaagctatccggcgatattgctgtatttctgattgaagtaatcgcaggtgaggaagctattgataacacttcccactgtagcgatatgtctactgttcagggggtgaaccatgcctaaccctgcccctcatgactattacacccatcagaacggggaaaccgttcaggtgttgtcggtcgcctttaatcgcgtgacgtttgtccgtgatggttatcacaccccgtgcatcatgccagtaagccgtttcactaaagaatacacctacgcagggagagcctgattatgtctgatatctataaccacttagtacgcaacaactttaacgcgatgagcactgaggaaattaaagatctgcgtaagcattcagagggtgcacacagtgcagtgatggcggcaatgtcagcgatgggtgagttggctttctggtctgctgataatgaaaactatgcaaattgtcaggcaagggaagatttacgccgcgtgggtgaagcactgatgtatttgccgaggattgccgaagcgctgaacgacacagcacagcatgcggattttgaaattcatcaccgtgaggggttccccaaatggtaaatcatattgatatccgttcagtgaaaatggcggcgaaggatcactggcaaggattgctggctgcctgtggggtggatgttccgacaaagggtaagcatggcgcttgccccctctgcggcggcactgaccgttttcacttcattgacgatcacggtcacggtgactggcattgtcgccagtgtgatgagccgagttttggggatggattggatttgttggtaagagctaaggggatcaccattattgaggcggctaaagtcgttgctgatgcactggcgttacctttgccagaacccaagccagccagaaaggaggctcccaaatcaggggctcccctgatagccgaaagaattaaaaagctggcggctcaaaccacggtcgggcaatcggaatatctgactaacaaggggctgcaatgcccccatcagaagctattgaaagacggttctttgttactggtcatgcaagcgttggacggagccgtgacaggtgcccagacgatcaagccgaacggtgaaaagcgccttgtctcaggctcacagaaaaagggcagttttatccccttatccgggataaccggaacgccggacacgatcatcattgccgatgggtatgcaaccgcgttaacggtcagccagttacatgatggcgtggtactggctgcgattgatgaagggaatctattcgctgttgcagaacaagtcagggaacggtggccagatgcgaaaatcattcttgctgctgacaacgatatgaagtccggtcataagaatgtggggaaagtttcagcagaaaaagcggctaaatctgtcaggggctgggtcacattgncgcccacggaagagaaagccgactgggacgattaccgccagcgtcatggtattgaggcagcaaagcaggcattcagtaatgggttgtatcaggtgggggagaaagag

SEQ ID NO: 16828 - DNA, 5678 bp, Xenorhabdus bovienii
ctatggacagaaaaataaacggcccgttactttttgagccgtttattttgtgtgagatagcagcctattatagaaccgctttctcaacgacgcgaactaaagtccaagatttagtcttagacagtggacgggtttcgcggatttccaccacatcgccaattccacattcattgctctcgtcatgtacgtgcagtttagtcgtacgtttgatgaatttaccatacagagggtgtttcaccacacgttcaatagcaacaacaatggacttttccattttatcgctaataacacgaccttgcagagtacggattttatcgttcattacgcacccgccttctcagtcagtaaagtcttaacgcgtgcaatattacgacgcacttgtttcaacaggtgagactgttgcagctggccacttgccgcctgcatacggagattaaattgctcacgtaacaggttcagcagctcagtgttcagctcttcaacgcttttatcgcgcagctcttgtgctttcattacatcaccgtcttagttacaaaggtggttttgataggcagtttcgctgctgccagcttgaatgcttcacgagccagctcttcaggcacaccgtccatttcatacaggactttaccgggctggatcaaggcaacccaatactctacgttacctttacctttacccatacgcacttcgagtggcttttcggtgataggtttgtctgggaatacacggatccagattttaccttgacgcttaattgcacgggtcatagcacgacgtgccgcttcgatctgacgagcagtcagacgaccacgacccacagctttcagaccgaaagtgccgaagctgacatccgtacctacagccagaccacggttgcggcctttatgcactttacggaatttcgtacgctttggttgtaacatcagcgactctccttacttgcggcctttacgctgctgctttttaggttgagcagccggtttttccgcctgttcaactgcagccataccacccaagatctcacctttgaagatccataccttaacgccgattacaccataagtggtgtgcgcttctgaagtgttataatcgatgtctgcacgcagagtgtgcagaggtacacgaccttcacgataccattcagtacgtgcaatctcagcaccgcctaaacgaccactgacttccactttgatacctttagcgcccagacgcatagcgttttgtacagcacgtttcatcgcacgacggaacatcacacgacgctccaattgtgaactaatgctgtcagcaactaattttgcgtccagttcaggcttacgcacttcggcaatattaatctgcgcaggaacgccagcgatctccgctacagtcttacgcagtttttcaacgtcttcacctttcctaccgataacgatacctggacgagcagtgtgaattgtcacacggatgcttttcgcaggacgttcgataacgatacgtgaaatagatgctttaaccagttctttgttcaagtactggcgcactttaaaatcgctgtccaggttgtcagcgaattctttggtattcgcataccaggtagagttccaaggtttgacaatccccagacgaataccattaggatgtactttctgacccattgctagtctccagagtctcagcgatcggacacaaccacagtaatgtggctggtgcgcttcaggatacgatctgcacggcctttggcacgaggcataatacgcttcatggttgggccttcgtctacgaaaattttcgtgactttcagatcatcgatgtcagcgccatcgttgtgttctgcgttagcaatagcagactcaagtactttcttcactaaaccagcagctttcttgttggtatagagcagagtttccagagcttgcgacactttcttaccgcggatcaggtcagccacgaggcgaaccttctgagcagaagaacgagcgtggcgatgtttagcgatagtttccatctcttcctcctaccttagcgctttttagcctttttatcggccgcatggccgcgataagtacgggtcggcgcgaattcacccagtttgtgaccaaccatttcgtcggaaacaaaaactggaacatgctgacgaccattatggacagcgatggtcaaaccgatcatgttaggaaagatcgttgaacgacgggaccaagtcttaataggctttttgtctccgctttccaccgctttctctaccttcttcagcaagtgcaggtcaataaatggacctttcttgagagaacgtggcatggtttatcctctaattattatttagaacggcgacgtacgatgtattgatcagtacgtttgttactacgggtcttcttacctttggtctggatgccccatggagttacagggtgtttaccaaagttgcgaccttcaccaccaccatgtggatggtctactgggttcatcgccgtaccacgaacggtaggacggataccacgccagcggcttgcaccagctttacccagaacgcgtaacatgtgttctgcgttaccaacttcacctaaagtagcgcggcagtcagacaacactttacgcatttcaccagaacgcagacgcaaggttacataggaaccgtcacgtgcaacgatctgagcgtaagtacctgctgaacgagccagctggccacctttacctggtttcatttctatgttgtgaacagtagaaccaaccgggatattgcgcattggcagagcattaccggccttgattgctgaatcagcaccagactggatttgatcacctgctttcagacctttaggtgcaaggatgtaacgacgctcaccgtctttatacagaactagtgcgatgttcgctgaacggtttggatcatattccagacgttcaacaacagcagggataccatctttgttgcgtttaaagtcaaccagacgataatgctgtttatggccaccaccaatgtgacgagtggtaatgcgaccattgttgttacgaccaccagttttgttgtttttttccaacaacggagcataaggtttgcccttatgcagctcagggttaaccactttaacaacgtggcgacggcccggagacgtaggtttacatttaacaattgccattgttctttactcctccgacttactcagcgccgccgacgaagtccaaattctggccttctttcagggtgacgtaagcttttttccagtcgctacgacgaccaatacgctgaccgtggcgtttaactttacctttaactagcaaagtgtttacaccttcaacttcaacttcgaagagtttctgtacggcagctttgatctctgctttagtcgcgtctttcgcaactttgagaacgatggtattgcttttttccatcgctgtagaagctttttcagatacgtgcggcgcgcgcagtattttcagcagacgttcttcacggatcatgccagcatctcctcaacttgctttacagcatcagcagtcataaccactttgtcgaaggcgatcaggcttactgggtcgatacctgctgcatcacgaacgtcaaccttatacaggttacgagctgctaagaacaggttctcatcaacttcgccagtgacaatcagcacgtcttgcagagccatttctttcagtttctgtaccagcagcttagttttaggtgcttcaacagagaacttctcgacaacgatcagacgttcttgacgtaccagttcagacaagatgctttttagagcaccgcggtacatctttttattaactttttgactgtggtcctgtggtttcgctgcaaaagttacaccaccagagcgccagattggactcttaatagaacctgcacgtgcacgaccagtacctttctgacgccatggttttttacctgaaccagaaacttcagcacgagttttctgagcacgagtaccttgacgagcaccagctgcgtacgcaacaactacttgatgcacaagcgcttcattgaagtcacgcccgaaggtagtttcggaaacagtcagcgcgctttgcgcgtctttcattaccaattccattcctatctcctcgacgttacgccttgacagccggttttacgatcaggtcactgccagttgcacctggaacagcacctttgaccagcagcaggttacgctcagcgtcaacacgtactacatctaggctctgaacagttacacgttcattacccatttggcctgccattttcttacctttgaataccttgcccggagtctggttctgaccgatagaacccggaacacggtgagacaaggagttaccatgggtagcatcttgagtacggaagttccagcgtttaacagtacccgcgaaacctttacctttagatgtaccagtaacgtcgacttttttaacgtcagcgaaaatttcaacgctaatgctttgacccactgtgtactcttcgtcgtctgctgacagacggaattcacgcagggtacggccagcttcaacgccagctttagcgaaatgacctgcttcaggtttattaacgcggttagcttttttgctaccagtcgttacctgaattgcacgataaccgtcactctcttggtctttaacctgagttatgcggttatcttcgatttcgataacacttacagggatagaaacgccatcttcagtgaagatgcgagtcatgcccacttttttaccgactaaaccaatcattgtttcaacctctcaatcgttcaatgacctgattaacccaggctgatctgcacgtctacaccagcagccagatccagacgcatcagagcatcaacggttttctcggttggctcaacgatgtcaaccagacgtttgtgagtgcgaatctcgtactgatcacgcgcatctttgttaacatgcggagaaatcagaacgataaaacgctccttacgagtcggcagcgggatcggaccacgaacttgcgcaccagtgcgcttagcggtctctacgatttccgcagttgattgatcgattaaacggtgatcaaatgctttcaggcggatacggattctttggttctgcatgagaccagagctccaactattttataaacgtagataattactactcgctcccatttcgattgatgggggagtgtaatcgttcaatgtataacccccatatcgggagtattttaacaatggcggtaaattaccgctcattactgataataaatcagtcctactgcgtaggtaagctcgcgtattatacgtaaatctgctgacaatgcaagataagggtgaaatctattcaaaagataggcaaagagggaaaacgccctatgcaaatttatagggcgttaatattattccattattcttcaataagttgagattgaatataattttgtattcccattcgattgagcaagtccagttgggtttccaaccagtctatgtgattctcttcgtcagaaagaacctcaatcatcaagtctcggcttacataatcataggctgaatcggcatatgccaattgcctctctcagatccttagcaccgcgtatctctagtgctagatcagattgcagcatttcttctatatcctcaccgatattgagtttgcccaaatcctgtaggtttggcaaaccttccagaaacaagatacgctcaatatacttatcagcgtgtttcatctcctcaatagattcacgatattcaacttca

SEQ ID NO: 16829 - DNA, 5772 bp, Xenorhabdus bovienii
agtcaaagagcggggatgtcgcaggaagcttttgccgataaatgcggattggatcgtacttatatcagcggcattgagcgtggagtcagaaatcctactttagaaattatttatgtcattgctaatggcttacagattgaactgaatgaattgtttaatcttgaaacaagattacctccgaattaaggcccattatcaattttccattccgtttttttatcgctgatttattgatcaataacctagcctcgataatgggaattgaccatataaaaatgtaagttaagtgctcgtggtgagcatatgaaatctatgctgctttttatatatgatatttgtttttgctatatcatctgatgatgctttgtgtaatcgggtgagcgaatgcgctttgatgaaaaataagcaggaaatgagatgatgttactgatccctgaattcgcgattggggcggctgttggcttgattaagccgcttttattgactggctaaaatcttcttttgaccattgaagctgagaagcagcttcaatggtattccaaggacatattggacgccgctgttaatatcaggacgctgtttcgccaatatttttcagggcattaatcaccaattgccagaatttggcttgatccaattttacggcaacttgtgtatggcaatcttttggtggcgggaaacggaaatcagcgacggtcatgcccgttgttaaggttccggtcaactcgatattcacggggactttttgtgttgtcatcacggtaggatcgatcacataagcgactgcacagggatcatgcaccggaggatagtcaaaaccctgcgattcccgatacctctccccataaaactgcaacgcatctaaaacgaattgggcaggacgggttttgatcttggagatagcgtcaatgacatcaggcgttgcctgagcttgatgcgtcagatccagccccaccatcgtcaggggccatttttcattaaaaataatatgtgccgcttcaggatcgatcatgatgttgaattcagcgacagcgctccagttaccagtatggtagccacctcccatcaacacgacttcttttacgcgttcaacaatatgtggagacttacgggcggcaagggcaatatttgtcaaacctgccgttggaaccaaggtaatgctcttggggggattttccataatgatgtcgataatcaaatcaacagcgtgacgggcatccagccttaatgcaggttcaggcaaaacgacgccatccagaccggtttcaccatgaattgctggtgcagtttggatatctctgaccaatggtctatgacaccctgcggcaaaaggaacattgtgaatattggcgatgcgggcaattgaaagggcattgcgggtgactttattcaaggtttggttgccaacaaccgtagtcaccgccagtagttcaatgtcaggatttccatgagcaagcagtaacgcaatggcatcatcatgcccgggatcgcaatcaaggataattttcttggggagcatcttcattccttttagtgataactaaacacaaatgtagatgttaagaataattcaccttggataaagattcccccaacactaatcacaaaacgacaagataaaaatctaaacttattaataatatgtttaataattgtgacataattagcatataaataataaataatttgagcattgtaagtacatatgattcatatatgtatgctataaaaaacaaacagatagttgctattgttatcattattaatttattaataaaataaaaggtgaatgtatttgttgttattccgcctgaataaacaatgttaaataaatgcgacaaagtgtccctgaagaaacagagtaacaaaattgttggctgtacatcatcagggagtaggcagatgctcacggggtataacatgaataataatcttgattcattaacatactatgctgcaaccaaaaaatatgatcttcgctttcccacactgacagaagacttggatgttgatgttgttatcattggtggcgggttttccggtgtgaatacggcactggagctggctgaaaaaggcatcaccaatattgctattctggaaggtcggacgttgggatatggcggaacggggcgcaatggcggtcaagttatggcgggtattggtcatgatttggataggattaaacgtcatgtcggtgagaaaggtctagagactatttttaaaattagcaacatgggtgcaggaattattcgtgaccggattgctaagtacgatatcaaggcggatttttgtaagggttacggctatctgggttataacgcccggcaggagaaaactttgcggggctggctgaaagagtttcaggcagcgtgtcccgatgaagagattgaactttatgtcggtgctgatgttaaaaaagtcattggttcagatctttatacctgtgcgctgaagcatatgggtgggggacacgttcattcactcaatctgttgctgggggaagctaaggctgcaacggagcagggtgtcagaatttttgaaaacagccaggtggtgaatgtagaatatggcccacgggtcacagttcgcacagcaatggggacggtacgggcaagtaagatactgtgggcgtgcaatgctttcctgaatggtcttgaaccgactatctacaaaaaaacgatcaatacttacgctttccagctaatgacggaagaactgtcagacgatctgattgaaaagatcagcccgattcgtggggcatacagtgatattagtcctgtcatcaactactaccgagttaccaaagagaaccgagtgctgtttggcagtgctacacaatatcttgagtatatcccttctgatttaaaagcatggaaccgcaaacgtatgctggatgtcttcccctacctgaaagatgtgaaaattgaattggcatggggcgggccactatcttgtagcgtcaacttgttcccacaaattggctctttgcccgaacatgacaatgtgttttatgtacagggttattcaggatttggtgtaacgccgagtcacattgtctgcaaaatcttggcagaaggaatgagtgaaggctctgaacgttactcactgatgagttcgattcctcatctcaatgttgtgggcaaagacaaattaaggagcctgctcctttctgtcggcaaaacttggcaccaagcttcaggctattggaaaggccgtcgctagttttatcacttttttgacgttttttatttttgttctttttttgaataataaattctgaaaggtaaaagtcatgataaagccattattgttagatcaagcacttcctgaattaatgcctattggcagtgtcactcatcttggttctattgtgttggagggggatccccaggcaagtggcgcaatgacccacggagagcctacggataatctgacttgcggtatttttgcctgcaccaggggtaaatttaaaatgatctatccctttgatgaaatggcgacggttcatgaaggctcggtgaaactgaccgatgtcaaaacgggggctacggttgagtaccataagggcgactcttggtttgcggcgaaaggcactgaaatgatgtgggaaatcaccactgaacgctttgttaaacattacatggcttgtgtgaacgcttaaatatcgggctaaccagagaggaaacatgatgagtgaaataaccttgctaaagcccgttacggattttctgcaacgtcctcatggtcattatatcaacgggttatccattcctggtcagggaaacaacaccttttctgtcgttaatcctgcttctgatgaagtgatcgctaaagttaatcgaggagaggaagccgaaataaatttggcaatggaagcagcctcgaaggcttttcatggttcatgggcgcagacatcgcctatggagcggggtaagtgcctgaaccggctggccgatttattgcaaaaacacggtgaagaattagcccagctggaaagtttatgttcaggtaaaccgatccagcttgctcgaatgttagacgtgggcgcttctgctgattacctgcgttattttgctggttggtcgagcaaaattagtggtgagacattgaatgtttcattgccatcactcaaaggggaaaaatacacggcctttacccgacgtgaaccaattggcgtggtggttggcattattccgtggaatttttccattatgattgccatctggaaactgggggcggcactggcctgtggttgtactttagtactgaaacccagtgagtatacccctttgactatgcttcgtgtggcagaattggcgaaagaagccgggatacccgatggcgtgatcaatgttgtcaatggttctggcgctagagttgggtcagccctgctcgctcatcccaaatgtgccaaagtcacttttactggctcagtcccgaccggcactattatcggtaagtcggcgatagagtatggcttgactcgtgcgacgctggaattgggaggcaagaatgcggctgctttcctgtctgatatgtcagttgaaaagattgttgagggtgtgttggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgaaaaagcgcgtcaggatggcagtgagatcgtatatggtggccatgcgctggaaggcgaaggtttttttgtcgcaccaacgattatccgagccaagagtgctgaagacacattaatgcaagaagaaaccttcgggccgataggaacgttcctcagctatgatgatgaagaagaattaattgtcatgatgaacgcgacgccatttggtctgtctgccagtttatggacgaatgatctcagtaaggcgatgcgtatgatcccccgcattcaagtgggtactttgtggattaatatgcatacatttctggatccagcggtgccttttggtggcgtgaagtcgtcgggcattggccgggagtttggtagtgcatttattgagcattacaccgaactgaaatcggttatggttcgttattaatcacgcattattacagcttattttcgtgatttattttcagcttgtgattaagccgctatgatatatgatatatgatatatgatattgggaatcattatcatttgattggcggtttattatgatcagtgcaaagcggggtttaaaactggctttttggcagagtatcaccggattatgggggagtttgttattcagtctgatggcgtcaatactggtaataaccggggcagggatcgagcaatttaagataagtattctggctgctatgctgttgacacttgtgctgctgctgcatcgcgatgcacgccatttcctcttaattcctgcgggtattgctgtaatgtgcagcttattcgcgggcttgcgctatgcggagtatttttgagatagcgtgaattcttaagaagattagttgagaatgggatgaaataaagaaatgaatacagggagcagataaatattaacagtggtgcgaagggggggacttgaacccccacgtccatacggacactaacacctgaagctagcgcgtctaccaattccgccaccctcgcaggtactgccatttatctaatttgtttaaccgacg

SEQ ID NO: 16830 - DNA, 12891 bp, Xenorhabdus bovienii
tattattaaaatacattaccctaaaggtactgttgcgcaatggattctttaccctgaccacaatatagacgacatacttgatgagtacgccgcctgtcgcgttcaaggtgatcctatcaacgatatgaatgttaaaaataccagccaatatttgcgaaacggtgctgagaacggcatccatcctcagatgaatggtattcctgttcgtaattttcgcgtattctatacactcaagtgtgaagagatgattagggaggatttgctctcttcaattgagcaaatctttgataccgctggcatggcccctcgcagaattggggccaccgaacttattcgttggatgagtgagtttttctgtgggaaaaaatttgctggtgaatataacccagaacgaccgttagctaagcagatgatgtctaatgaccctgcttacgagcgttcgtttgacaacggaggacatcatgaagccttacaaaacttttctgtaacgcctaatattcttggtcatcgctatggtacatgtttatttcccaacgttattccacagaaagacaataatccactccgtaccaacgaactgttcggcgggtacaaaggtgttattgatgatcggggccagattaaatatccattcctttacacgctcaccattatctacgatgaactgcaaaccgagattgcaaataaagcatctcaaaccatgtttcagcgagttggtgcagggttagtatttgcgctaaaggaacgtattaatgaattctctgaaatgcaacaaactctcgccaaaggcggggattttgcctatttcatcccgcaactttgggtttttggtaaaactaaaaaggacgttcgagccgccgtttctgaagctaaagatttatggggaaaccataaatttgaattaatgccagaaacaaatatgtccaaagttatgtacctaaccgcactaccttttggtttttataatattgatagcaatctgaaaaacatggatcgttttttttatgctgattatgaaaacatagcgcgtttcttaccggttcagggtgattttaggggcggaggtaagccagtacaaacctatattggaagaaaaggccaaatcattggtctggatatgtttgataaacgagttaactcacataatttctacgtggtggctgaaactggtggtggtaaatcatttttacttaatgacctgcttgattcctacgcatcgtgcggggctaaaatacgaataacagatctcggggcttcttataaaaagttaacccatataagaaaaggtcgatatatagacttcgcgctagataatccaatgtgtatgaatccttcaggttttatagccaaagatgcagaggatcttgaacaaaatattgcggcggcggttctcatttattcatcatgtgcctattcatttaccggtcagactgtaacagaggtggaagcaaacttactcgatcaggcttgccatgctagccatagaaaaggtaatcaagaaagtggtgttgatgatgttatcgcttatttgagaagtggcgaatggaaaaaggggcaagaaatttctcctgttgctgctcaagaaattgaaaatcaggctcaacgattatccttcctgttaaataatttcggaagtaatgggcaatttaaaaaattcttcgtcggaaagtctgaatttagtatttctcaagatgaatttgtttgtgtcgatttggaaaaattaaaaagtcagaaacagttattctttcccatgatcatgcaagtcatgaatgcaatgacacaagatttatatctttctgatcgcagccagaaaagctttattctttttgaagaaattgcctcgatggttaaacagcaaggcaatatctctatggatggcctagcttcaatggttgaagaaggttatcgcagagcgcgtaaatatctcggtgcgtttggtattgttcttcaatcacctctcgatctcttactactaaaagggttaggccaagtggcgcaagctaacgccccgttcaaatattaccttgaatctaaaatgtacgctgaagctgtttcaaaaggcgtcctacctggtattaaaggcggcttccctcttacactccttgaatctgttaaaaacgcccgtccccgctatggtgaagtcttcattgatagtcctctaggaatgggcgtagcgcgcctttgcgtagataaatggcgctattggattaatacctctgacggtgatgacgtggctcaatacaacactcttatccagcgtggattccaacctgtggatgctttacgccagttatccggcgtgaccctgtaagatgaggcaggatgaataaactatcaataatcgtatgggcggccttgctgccctgtttttttgtgcatgcacaaaaacaagaaagtatcagtaaagcctcacaagacaaagttgattcaatagccaatgacattagtgatgtagtcaaaggtaaaaccagttcagcttcaagtatcaacaattccctattgagtccgatgaacggacaagaccagatgacaacctttgatgggaagcagtcatttgatggtaaggccgtctgtaaaggtacgtctgagtttatgaaaatgctggttcaaccaggagctggcggtgatgtaaccattctgaatgttatgcaagataccaatatggacggcaagctagatataacaatggctcctaattggaacgtatcagcggtgtgttccaatgggtttatgacttgtaccgatcccaataacaccactacctgtacctcctggacgtggatagcagacagtaaaagctaccagttagggcgcaagcgagtagccctaactgatctaggcggttgttactgtatcaataataaatgcggtagtaatctagcatggacgaatatgggccaaattctccgtaaccttggcggtggggcatctcaagctctggcagctgtaaatccttggtacaccctttctgatgtcaaagttgacggcgttgtcgcttcattcgttggtggtgacgcgggttcatgcaatgttggtgattccaccggcttctttaacagccccgatggttctcagctcctgacataccagaataacgaaacgaaaatgaaggacgatgcgactaattcaactcaaagttctgatgcgtataaagccatcgtcagtggtagtttaaacccaaatgaaagctctgaaacccgacgttgtgaggtgcgccgtaatgttggtatcgatgagctaactttagatgaaatcatcaagtttgatggtggtgaaggacaggtaactcaatgtggaaccgattgccttcagttggtactcggaaaactaggcgacgactactggcaaggcagctgtagctattatgaggttaagagtaatttcatcttaaaagatccttcccgaatcaaatccgcaaccttaatcaatgctgtatttgatgattggatgcaagtatgggtaggtgacaaagttgcatggaatggcccttatggtaactggctggatgctggccctgttcctggtgcatgtgagttatcgacgagctggaacgttaaccctaatgtggacttcgcggagtacataaaaaaccctggccctctacaattcaaaattcgtgttgaggttagtggcgaaggtgaaggttatgctttattgcgcgttaaaacggatatgagctgtaagttaggagccgaatccatttcgaatacttgtactgcttatgaaaacgactcgacctgtaagctggtagaggaagaaattgacggtattaagtcattcatcggcggcataaataccggtcttaagcctttatcacaaacacacaaggtaaatggcaatttctgtagcattgaagttaagcgggattggttcactaaaaaaagagtctatcgttgcaacacaaagaatgactacgatacatctaaaattattgagcgtaaggggtatatcgaggacaacgttaaaccggatcactataaagacaaaatgttttcagagaatggaaaagtcacattaggagaaggtgatttattctggcctaaattacctacagtcaatgaatgcgtaaatgtctgcaaaacgagaaaagagaaaacgacccctgatatgtcagtctctggtcaagttgataaaaataaagccacaggtcaaaaagtatacaattattattatcacgaatgtggaacggataataaatgtgtaacagactccgatgaagaagtggttaaagcctgccagtgtattaatgagttcgctgaagcggcggctattatgcagacaatgagagaggccggacaagatatgatatgcagttccggtgaggtaaagaaccctaatggaaccccactggaatcaaattgaggttaacatgataaaaatattattaatcgtattttctctattattttccagcggttcacttgcagcttcaaatcttatttgtggtattgaccaaaataataatggttacttaggcgatgaaggtgaaacagcgacttgcatcggtaatgatcctggactttgtcctattgggaaaatagcttgtaatgcagtaaacaatgagcaaacaagtgatcctatctacagctgccctgtgggaacaacgttaaagaataatgtatgtatcggtgataatgagcctcactgggaagaatatcacgctttagactttctaatgtgcacaagctgtgcaggtaagaccttatacgacgagatctacataaattgggcaccagattataaatacttggggtgggacaagcctccttattactattacggccctagatattatactggtagatatgaagccggagaactaaatacaggcatggagttttatatatataaaacaaacattaacaacggtacaattgatgataatgacaaaattaaagtccgcattggtaattatagagaaagatccggtaaaaactgtatagggctagattgtcaaggtacatggactattttcgtccaaataggtgatgcaacagctacaagcccatctattacatgcgtggatacttacacatggaatacagtagaaaacaaatgtaaaaaagtaatagtggaccaagtttgtcctataaatggtggcggcgcttgtatacctgatggcagtggttattcatgctcacctaataaatgtgttaataccaatattaatatacctgttgatgaaggtgatattaacggcggcatgctagttaatgatggaaagaaaactgaagacggcatttgtcttgatcaattatatatattttccggtcggggccaacgttgcttaccttctggtatgtcaacgggatacaagaactgctgtgcaaacaaaggcagtgcattacaagataacgccggttccttagcttcaatggctagcagcgtttcaactattagcaaagtgtatgacgtggcagagaaagggtatcaagcctataacgctgccattaccgcaggaaaaacaataagccaggcttcaacgcttgccggttctgctatgcaggggcagatgcttatagcttttgacccaacatccctagctatcagtgtggcgatccattttgcaatgaaatacttcatgcaagcttgcgatcaggaatcaatggaaaccgccatgtttgctagtagtggttactgccactatgtcggtgaatattgtaagaagaaagtccctttgctgggctgtgtgcagaaagctaatgcctattgctgctttaacagcaaactggctcgaatcatccacgaacaaggtagaccgcagctcagcacgattggagatttcggcacagctaaggcacctcaatgccgtggttttacccccgatgaattccaatctattgatttctctaaaatcgatttatcagaatacatagaggatatgactaaaaatacaacagaacagattaaaggtcagattagtgacacaatcaaagacttctacgaaaaaacaaactgatttcaattagggtttaatatgaaaatgaaccttaaagatttttatcatcaaattaaaccagatatgagtattaccaactctcacatcatttctaatgtgatagatgaaatatcagttattaatactaaatttgataccaactccaatgacctaatcaacatggcagaggcccactcatcaacctatagaaacctttcagttgagcaaacacggatggtgaacaccatatttaacacacctttatttctataaataacacctaaatagaaacctaaaaatcactcattacactctatgtgatacatgataatcatgtgtcacatacgaaaatgaatgatacaaattactatcagtaaaatcatttttaaaatatgataaaaatatgtattacattgaaatgagggaagcatgaaaacatcactctcagcatcggcattcttagttgccatgctgctatcttcacatgttgaagcctcacaagatgttgtaggtcaactttataacattagtgaacccgatgctttgaagcagattcaagagcgtgttgctaacgttgattggcaaaaagaactcaacaaagatcgtgaaaagtggggggcattcaaaggtgttccactaccaaccactctggaagataaaacccgtaaaattgtaccgttctattctgcgccttttgaagtgaaaggtgaggatggacgtttactatttccgaaaggctacacttttaacccactggtacatgttcggctcccgcaacgtttaatcgttgtagagaaaggacaagaagactggcttaaatccatagcaacggaatctgacatgatcatttatgcaagtggtgatgttattgaagttagccagcgtatcggtagaaatgctttcatcctcgataagaacttacaacaacgcctagatatcaaagttgttccctccatcattcaacaagaaggagagcatttaatcattcaagagttttctaaacaacatgtggaaaatgctaaaaataaagctctgtttgattttaatggtaaaaaactggcgtggtcagtagtcggttcagtgatggatttcttagttccccccgcacacgcaacctgcaaatcatcatttataaacccaattacagatattagctggagttgcattttcccaatgcggatagctggggtacaggttgttggcggtgaagagaatccctctaataaccaaaaccctgtttgtatctgtaaaggggctgctcttccgatgatcggccttaaaacttccttttgggaacctaagcggataatcgataccgtcagtgacccttattgcatgatgcccctggggacgcaactaagtaaaccagtgcctggcactctcgccggtggctacaacgaaactaatactagtaagcgggtattccaacaagcacattactttattttccccgcatggaaaattttgaatatgttctatgacattccctgcctggatgacgaaggttttgatgttgccatgatgacggagatcttaccgcaatggaacaatgaagcactcagtttgattattaatcctgaagcccttctttttgctaatccagtggcgacaattgcttgctctgccgatgcggtagctggcacttatggcatgccccttaacgccttgttctggtgtatgggaagttgggggaacgtctatcctctgtctggttcaatcacaagtaccgactttgttgaagctaatgctggtatagcggctcgatcaattttcactatgggccggttaggtttgttgtggaatacatcagatgatggctgttatcgcgaactggctcctatctggaaaaaagaccgcttcaagttgcagcttatgaggccaacccgcgctagtgcatgcatccctatagggcgtgagggtttgttatggactggcggcaagcatgacccacttaaagacaactttatgtggatgatgtttgaaaagaaagattgctgcatcagggcttactaatgaaaaaactatttatcactatatcgttagcgctaacgacaaattttgtgcatgcacaagaagttgctatctcacctgagatgatgaaagcggcacaatccgcagttgatcatcgggttagcaataaagaaatgaacagttttgccgaaaacatagttggctattccaaatcatcagaatttaagcaacaacagaaagacctacaacagcaggttttcaagacagctggtttagatcccgataaacagcagcaagatgaacgtcctgaactggttaaagaccaactggttctttttgtatcaagcagtatgcctatccataccctacgaaactatgcgcgggatttgtctaaagtaggaggtgtaatggtattacggggcgcggttggggggattagtcgtattgccgacaccatgaagctgagccgcgagatcctagctgttaaccagacctgcgatacaacatcatgcaaaatgtggtcaacccagattctaattgaccccgttctatttaagcaatatgacattaaagttgttcccgcgttgatcttccagccagatatgaacattaatagctattgtgatggtttggaattaatgaaaaagtctgaaaccgttatttatggtgatgcctctattgcaaaaatgcttgaagccatgaaccgaattactccaaataaaaagtacgagtcacttatcaaagtaattagggggctataatggatacttataatagagaatattttaatatcatgattattatttcaatcatgtttattatttactctgcattccaatatataaatatcccactaaccagtagtgtgttaccccatgtgttgattaaaacaggtgatcgcccaacgcaaacggacgactacgttatttttactttggaacatccttatttacctcacgctaaagaccaacttaccaagcggattggttgtatagaaagacaaaaacttgagcgaattaatcagcatttctattgcgacagtaagcttattgtcattgctttagaacatgatattcagggggcttctcttcccgttttctctttcactggcactataccagccggaaaagcttttttagttggtgatactcctaatagtttcgatagtcgctattggggattttttgatattcaaaagacagaaaaactcatccctattatctgaatcattgtgcatgcacaaaaaaggaaacgtcatgaaattcatcgataaatctattgctaaaacattgttagtcatagcctgtttttcttttgttttagcaatcactggatgcgcaacggtttttactgagaaatctgttgctgtcaccatccacagcaatcctgaaggtgcaaacgttttcagaaatggtgagatgttggggcaaacaccactgacggttgagactaccccacgaagctctgtcttttccatcactaaagagggatacgaaggcgaagtgctaatgcttgaaactggcgtcaaccgcacaacgcatggtaacgccgcagtattcccactgttccctattactgacgcagttgattcagtcaccggtaactatcagaaaatcgaacagaccactgcaacagtcactttaaagaaaaagtaaggaagtaagatgattaactcacttatcacttcagttttcagtctatttgttagctttggctctgtatctgcgcatgcctctttgcctaatcagctttcattatcggagtcgcttattaaaacgccgaaacgtgaccttttttggtatgacttaccgacgaaaacagaaaaaaaatctgatgaaaaatatccgcgcccagctattccctctgctgaagcactatttcaaatgcatcctaaagaactgaaagcattactggatgacaccttagattacgccgttttcaaactgtctcctgaagccacaatggactattacaaagtcctcgatgttgctcgtcgaaaatcatctgcttttaccaaccttaccggtttcgtgatgctggataagccagaattgaacgccgcccaagattacccaattaccaatcctggtaacgcagagaaaaaacgccgtactgacaatgatgtgacaaaaaattgcaagcggcccgtgatgaatacgctttgttattcttcacacaacctgcatgtggtttctgtgtccagcagtctcaaatacttgagaacttccaacgggaatcgggctggattataaaagaagtcgatatcattaaagagcctcagtcacgcgcaaaattcaatatcgaccggacgcctgttaccgttttgatccgcaaaaacggtgattcaaaacaatggatgcccgtctctgttggtgtggattctctaagtaatcttcggtcgaatatttaccgcatcactcgtctatttggcggtgaaattaggccacagcaattctatacaaacgagcagcaacaaggcggcttctttgacccgttaaagcgttaatagggaacggtcatgataaatcttaagaaaatagtaatccttaccctgaccagcctatatatcacagctgcaaatgctgataattgggctgataaatggtttgataatgcggtctatgacacacccagctcatttgagtcacagaaacgcggctattacactatggggggattctcagcccgtaataactcatcaactgattatcctataacaatctccccgcccaaacttagcgttggttgcggtggtattgatgcatttttgggggggttctcattcctcgatcctgattatctggtagagaaagcacaacgtgctatgcaagcagctccgtatgttgcctttgatatggctcttaagacaatgtgtaaagagtgtgcggacacgctaggtaagattgagcagatcactaatttcctaaacggtattcagatgaatgaatgtgctctggcaaaacctattgcgaccgctgcaatcactcaggatgccgaagccttaaaaggtctttggactgagatgaccggcacgaaaagtttagatgaagctagtgatagactttggactgaatcgacatcaaaaattaaggctaatgataataagccaactcaagacctgaagagcatgattgaaggctgtccggttgagttcaaagatctaatgcaacatggctctatcgtcgaacgggccgcgcagaaagtgggccttggcaactacgccgacactattcgtgggtatctcggtgacgtctggattgagtctaaaaccgccgaccgtattccggtagcagtctcgataccaagttgtccccaaaatcagaagtacagcctcgatgatatgttaacaggacgctcttttgtcaaaacgattaataagcaatgcgttccttccagcagtaaaccagtaagagatattgtttatgcgaaaatgcaaaaagttctgaataaaatgaaagcagggcaagagctggggacggatgagattaaatttattaactcaaccaatattcctgtttattcaattcttaaacaagcaattaccagtaaacaagatgatgtagtgttaaatgtcttggctgaattagttggtctgaattattcgtattatattttctctgatttatatcggaatacccaaagtgcattcgatgctgttaacgaaatgatgtcatcacctttatctgatccgaataatgcgaagaagccttgccgtatggatttgttcgcgccggcactgacaaagtttggtgatcttattcaacaggcccgagatagtagcgtcaaagttgaagccacctataacagccggttgcaaagctacatgctgaattcaggctttatcgaaacattccgtgagcaagaaatgcgagatcagcggcaacgcgctggggagttagcaaaatgaagccttctcttttgctactcttaatccttattccaagtgttagttttgcatctttggatatggaatacgtggtacaaggcggtttttctactgtagttaatgcctttacacgtattaaattcatgtttaatgaccgtcaatattcatcattgatggctgcaatggtggtgtttgggatcgtttctggccttatgtaccgtgctgcaaaaggtggtgtagaactgctagaaaccggcaaggccagtatggggttaggttggttggcttacaccctgattggtacaatgatatggtttggtttgatggtgccgaaaggcaccatccatatttatgatcagactcgtaaccagtaccaaccagtaagcggtatccccgattttattactttcgtcgcaggtgggactaacctgatttatcaggcttttactgacatggcgaataccaataccgctactaccacccgcttcagtggggaaggaatgccaatcaaggtgctaatggcgcttatgacgcgcaacggcgcatcatttgatccctatatcagcaaatcaataaccgaaatgtggaagcaatgttcaccaattgctgaaaccagagggtttgatgctaataacctaaagaccggtagcaccacgtttaatatcgtttcgactttaagtgctctgcgtaatcctgctgtctttactacctggtactcagctgctaaccctggtggttcaacagtaagttgcaccactgcctacagtaaccttcagagcgctatgggttcccctactgcctacgactcacgtttaaaagatatctgctctaaattgggctacaactctgcaaatgcggcttcatacgtcgattgtaagggccggatggaggacacgttacaaacagtatacggaagtacaaccgttactcttaacgctgcaatcgggggcattatggtatctcaagcaatcagtgatgccttagtacaacaaaaccctgaagttgccggaacaatgcttgctaatcgctcaatggttaattcggctttatcggatgcttcaacaaatccagaatggctaacaactataatggcggg

SEQ ID NO: 16831 - DNA, 13535 bp, Xenorhabdus bovienii
tctatgaaaatcgaccaagcaaacaatctcattgttttgcaactatgtggtcgttttccagatctaaagtaaccaattttccgggaatcagtttgcctgaaaggatctgctgggccaaagggttttcgatctcttgctggatggctcgttttaatggccgagcaccatatacaggatcaaaaccagcgtcactcaatttctccaatgccgtcgatgtcatcgtgacctgatagccacgctcttccaaacgatagtataaacgttgtaattggatattcgcaatggatgtcagatgttcttttcctaatgggtggaacacgactacttcatcaacacggttaataaattcaggcctgaaatgatgaccaactacttccatcactatatctttcattcccgcataatccagtgcgccaaaacgttcctgaatcatatctgaacctaggttagaggtcataattataacagtattgcgaaaatcaaccgttttcccctgtccatccgtcaggcgaccatcatccaatacctgtaacagaatgttgaagacatcaggatgagctttttctacctcatccagtaaaatcactgaataagggcggcgacgcaccgcttctgtcagataccccccctcttcatatccaacatatccaggaggagcccccaccagtcttgaaacagtatgtttttccataaattccgacatgtctaggcgcaccatcgcatcatcactgtcgaataggaaattggccaacgctttacccaattcggttttacctactcccgtcggccccaaaaacataaaagaaccaatcggacgatttggatcggataatcccgcacggctacgacgaattgcattagatacggcatcaacagcctcattttgcccgatgacacgtttatgtaattcatgctccatgcgcagaagtttatctttttcactctccaacattctggatacaggaattcccgtccagcgagcaagaatttcggcaatttcggcatcggtcactttgttacgcagcagtttcatatgatggctttctaccgttgttgccgttgccaaacgtttttccaattctggaatttttccgtactggatttcagacatcttcgctagatcaccactacgacgggctttttctaattcaaggcgcatattctctaattctgctttaatgttctgagtgccagtcagctctgctttttcggctttccactcttcttccagctcagaatattcgcgttctttctccaccagctccatattcaacatttcgagtcgttttttactgccatcgtccgattcttttttcagtgcctgctgctccagctttaactgaataacccgacgctccaaacgatccagtgcttctggtttagaatccatttgcatacgcaaacttgctcctgcttcatcaatcagatcgatggctttgtctggcaacatacgatctgaaatatagcgatgggacaatgtcgcagcagcaacgattgctggatcagtaatttgtacatggtgatgcaattcatagcgttctttaagcccacgcaggatagcaatggtatcttcaacggttggctccgcaacatacaccttctggaaacgacgttccaaagcagcatctttttcaatgtattgacgatattcatcctgtgtcgtcgcaccaacacagtgtagttcaccgcgagccagggcgggtttaagcatattaccggcatccattgcgccatcagccttacctgctcctaccaccgtatgcaattcatcaatgaacagaatgactgagccttcctgcttggcgagatcgctcaaaacacctttcaaacgttcttcaaattcaccacggtatttcgcacccgccactagcgctcccatatcaagggacagaacgcgtttgtttttcagcccctccgggacttcaccattaataatacgctgcgccagaccttcaactatggcggttttcccaacacccggttcaccaataagaacagggttatttttagttctacgctgtaatacctgaattgtccggcgaatttcttcatcgcgcccaatcacgggatctaatttgccctgttcggcgcgttcagttagatcgattgtgtatttttttagtgcctgacgctgatcttcagcgccttgatcactcactttctcaccaccacgcatctgttctattgccttagcgattttatctttggttgttcccacagctttaagtatgtcacttaatgttccacgttcttctattgccgccaaaataaagagttcagaagaaataaaattgtcacctgctttttgcgcaagtttgtcacacaggtttaaataacgtcccaactcattggatacctgtacatcaccaccattaccctctactttcggtaatcgatccaaggcttggttaagttgattgttaatgctactcgtatcaacccctgccgatgtcagtaagggacgaacagagcccccctcttgattaagcaatgcgctcatcaagtgggtcggttcgatgaattgattatcacgccctaatgcaagggattgggcctcagcgagagcaagctggaatttattagtaagacgatccagacgcataacacctccaatactggtcagaatttgctactggaaactagataaggtcattccttaaatattcaaggtactctgaaaagttaattggaaactagccactatacgccagaaatcgtcctataaagccgattatctcagccagattaaagttgccatacgtccagtgttaccatcacggcgataggagaaaaaatttctttcctcagtggcagtacaagcagtccctccaaatacttcatttataccaatagactgcaactttaatttagccagtaaatagatatttgccaaaaatttattaccataaggcgtaaaggcttgttctagctcaggattggttacaacaaacgcgtccataacttcacgacccacctcaaatttttcagggccaatggctggccctaaccatgcgcggatcatttcaggttttgtgctaaatcgagacacggtattttctagaacccctgtacataacccacgccatcccgcatgcgccgctgcaatttcatctcccgcaatggcgcagaaaagaacaggcaggcaatcagctgtcatgacagcacaaacctgcccgggcatattcgtgtaaacagcatcagcctgattatctttcgctggctggccatccagattgatgacacgagttccgtgtatctgctccaaccagacaggttgttgtggcaactgagcatattcaaccagcagtttcctgttccgctccacacattccgaatcatcaccaacatggttacccagattcaaactgtcataaggcggtaggcttactccacccaagcgggttgtactgcaagcgccaacattatcaagctgtggccaatcaggaaaaatcagcggggtcatttacctaccagtccatctcatctttgaaagtttcaatatccgctttcatcacatcaaccagtttaaccatatcatccggtaattctgcatgccattccatctcaataccagaaataggatggtaaagtcgtagcatggtggcatgtaatgcctgacgatcaaagttgcgcatcacttcacgaaattcgtctgaagcgccttttaacggacgaggacggccaccgtataaaggatcaccaaccagagggtgcttgatatgtgccatatggacacggatctgatgtgtcctgccagtttccagtcgcaggcgcagacgagtatgtgcccggaaatgttccataacccgataatgggtaactgccgatttccccataggatgcactgccatgtgtgtccgttttgtcggatggcgggatataggttcttctaccattcccccagctgtcatgcatcccaaggcgatcgcttcatattcacgggtaatttcacgcaattgcagggattccaccagacgggtttgtgctggaacggtttttgcgataaccatcagcccggtcgtgtttttatcgagacggtgtacaataccagcgcgagggacatctgcaattgcaggatagcggtataacaaagcattcagtactgtaccatcagggttacctgctccaggatgtacaaccaaatcacgcggtttgttaatcactagaatatcattatcttcatagacaatattcaactcgatatcttgtggctcccaacgcgcatcttcttcaatgatggcatcaatggaaatttcttcaccgcccagtactttttcttttggcttattgatcaatttaccattaacctgaactttattatccaaaatccattcttttatacgggatcttgaataatcagagaacaattcagccaaagcctgatctaaacgttgaccgagctgtgtttcagcgactgttgcattaagtcgtatttgttgtgccatatataaattctgtattttacgttgagttttgacggcaaagccgtttcatttaaaataatgtgctattgtagctctatcttttgctgggaacttcatggatagtctcccagaaaacactcagaggataatcaacacgtgatgattcgcatgaaatatctggtggcagcagccacattgagtatggttttatctggatgctccaacaataaggatgctgttcctgatatcccgcaatctcaaatttactcagccgggcaaaaacacctgcaagaaggtaactataaaggggctatcaaacaattggaatcccttgataaccgttatccttttggaccgtactcccaacagactcagcttgatttgatctatgcctattacaaatcagcagaattcccaatggctctcgcatccattgaccgtttcatgcgtctgaacccaacccatccgaatatcgactatgtaatatatttgcgtgctctgatatcccaagccttggatgacagtaccctgcaaagctttttcggcatagatcgttcagatcgagatcctgaacatgcccgtgcctcattccgtgatttcaacctgctagtcagccgctatcctaacagtcagtatacatccgatgctgccaagcgtttagtcttcctcaaagaacgtttggccaaatatgaacttgcggttgtgaaatattacactaaacgcagcgcttatgtggccgttgtcagtcgagttgaacaaatgttacgggattatcctgatactcaagcgactcgagaagcacttccttacatggaagcttcctataagaaattgggtctgatggctgaagcagataaagtggcaaaattaattgcggccaacccagtataagatttaagaaaagtaaaaagcatcatcaacagcagctacggctgctgttatttttcatggttcaaatgccctttttacggcactacgcttaatggacttataatctgctttaattagtttcagcaactaacccctagacgtaatgtatcttaagattatcaaccatcttgataataccataactgaccgataatgatgcataacgcccctcttagcaataaatattctctatatcttcttcaccaatcacacttctgttactcactgtcaaaacagcccaataaaagtgatttagatcattctttttacgtcaaagaaaggtatgctgaaaccatcgaagacggagtaacataacgaggtaactatatgttagtgaacatcaccagcaaacaaatggaaattacccccgcaattcgtagccatgtagaagaccgtctaaacaagttgaacaaatggcaagtcaacctaattaatccacatatcgtactcacaaaagaaccacaggggttcttggttgatgccacaataggtataccaaacaacacattagttgctagtgcaaaacatgaggatatgtacgctgccatcaacgaactactgacaaaattagagcgtcaactcaataaagtgcagcataagggagaagcacgccgtgcagatcacagtgttaaagactccaactttgacgtagaagtttaatcacagcttaaccttatttaacgcgctcaatgagcgcgtttttattgccctacagagcctttctattgacactccacaccaaataagttaattaaagtacattagtggcaccataaaaaagtaatacactcataaatgacatggctatcaaactgtttttcttctttttcttttttaccttctcatgaggaggttttttcgttttaaaaaggataagaagacgaacaaaaaacctccctaccgatgggaggtttttttttacagaccattatctatatccataataaaaacgtcaggaacatgctatggaacgaaaattagttaatatacgagaagaaatcagcagtattgatgcaaatttgctggatctgcttgggaaacgccgacaattagcctgtgatattgcgcagactaaacttctcgaacatcgccctgtccgagataaagaccgtgagcgggaactacttaatgtgttaattaataaaggcaaaactcatggtctagatggattctatattactcgcctgtttcagatgatcattgaagattcagtattaacccagcaagcgttgcttcaacagcatctgaaccagacaccttacgactctgcacgtattacttttctagggccaaaaggttcctattcccatattgcagcccgtcaattttcggcgcgccatttcaatcagttagttgaatgcagttgtcataaattcccagatattttttcgctggttgagattggtcaagcagattatggcatcctgcctctcgaaaataccagctctggagcaataaatgatgtttatgatttattgcaacagacgccactattccttgttggggagataaccctgccaataaatcactgtttattgattggtaccgagactgatacgtcaaaaataaaaacagtttatagccattctcaacctttccagcaatgcaaccaatacctcaatcaatttcctcattggaagattgtctattgcgaaagtactgctgctgccatgcagaaagtagcagagctcaactcgtcagaagtggcagcgttaggtagtgaagcagggggggcactctatggattacgggttttggaaaacaatttggcaaatcagcaaaataatagtactcgctttattgttgttgccaaaaaacccattgatgtgtcaaatcaggttcctgccaaaaccacgtttatcatgtcaacagggcagcaggctggtgctctggtcgatacgcttattatcttgaaaaaacacgatattataatgagtaagttggaatcacgtcccataaacggcaaaccgtgggaagaaatgttttatattgatgtagaagccaatcttcgctccatgaaaatgcaacaggcacttaaagaattgtcagaaatcacccggtttttgaaagttttgggatgttatccctcagaaaatgtgatttctatcgacccctgctaaaatagaaaaccggatgttttcatccggtttcacaatttggaatcgatgcaaaatgcactatatccggctatcactagcctgctgcaaaagagactgactctctttcataaatcgagtggcttcatcaccaaaccattcattcacttggttaaaactcgcaataaaagccgacttatcctgactctccagtatttcaatcgcctgtccaaaactctggtgataacggcggatcagctcaatattttcaggactggacataatgatatcagcatataactgagggtcttgggcaaataatcgaccaaccatagccaattccaatcgatagattggtgaggatagtgatatcagttgctgtaaatcgatatcctcttttgcaagatgccgaccataagaaaaagtagtaaaatgacgcagcgcttgaatgaagctcatatttttgtcgtgctgctctgcgctaatttgatgtaatcgcgcaccccatactgatatttgttccaaaaaccattggtatgcttcgggctgacgcccatcacaatacacgacaacctgtttggcaaaactgcccacatcgggtccaaacataggatgcaaccctaaaaccggcccttgatgcacatcaagcatcgcctttaacggcctttgtttaatagaggccaaatcaaccaaaacacactgttccggcaaaggaggtaaacggcggataacctcttctgtctgatgaatcggcacactgacaattaccattcctgcatctgccagtatatgttcggccttatcccaatctcccgactcaagaacccgaacttcgtagccagataaagttaacaagcgactaaacagtttccccattttccctgagccaccaataataactattggcattagatgggtactgagttttttgaatcctttatcgttctcacttacgtaggactctctcataatgcgccgcaaaatatcttcaattaggtctggaggaattcccatcacttccgcttcttggcggcgggaagccagcatggacgcttccctttctggtacgtaaattggcaaacccagttggctcttaatttctccaacttctgccactaaatacattcgcttcgccagtaacaccaataatgctttatctacaccatcaatttgttcccgcaattgtgataattttgctgccatatcaatttatcctgctttttccatcatcatgttacgttttgcaaaacgtggggcaatttgttggtgtaattttcttaatatttgctccgtggtttgccagttaatacaggcgtcagtcactgaaacaccatattgcatctcagaacgaggctgttctgagggctgatttccttcgtgaatgttgctttccaacataataccaatgatagatcgatttccagacataatctgttcagcaacggaatccactacgatgctctggcgacgaaaatctttattggaattaccatgactgcaatcaatcattaacgatggcgttaaacctgccttgatcatttggctttcgcagtcagcaacatgctcagaactataattcggttcgccaccaccacgcaggataacatgcccatttgggttaccttgggtttgtagcagacagacttgccctgactgatttattcccatgaagcaatgtggcatggcagccgctttcatggcgttaattgcagtattcaaattaccatcagtcccatttttgaatccaacggagacagacaaccccgatgccatttcgcggtgagtttgtgattctgtcgttctcgccccgattgctgaccaactgaataggtctcccaagtattgaggattattaagatctagtgcttcattggccagtggcaatcccattttaactaaattcattaataaaccgcgggcaatatgcagcccagcatctatatcaaacgaaccatccatatggggatcactgattaagcctttccaaccaaccgtcgtacggggtttttcaaaatagacacgcataacaatatacaggcaatcacttaattcagtagaaagtactttcaggcgacgggcataatcgagggcagagtccacatcatgaattgagcaggggccacacaccactaacaaacgaggatcacggtgctgaataatatcagcgatggtattacgggcatttgtgatggcatgcagatcgttgcgactcaatgggtatttctgtttcagctcctcaggtgtgataaaaatctgttcaccaagaatatgaacgttattaagtgcatctttttgcatgatcatgttctatgcctgccttgttttgtctgtttaagtttttttttgagtgtcaggcagacaacataccatgcatagtaaagaatacaatccaattgtgtaaataatttccaattaccgtaaataattatttacacatagggtatgtatcctatcggtggctctataggattaacaatccctttgattttttatttccataaaaaatatattaattaatttaaatattttgtgaattaatatcatagttatatttataatggaaacattttattgaaaagataaatatttttaaaaatcattcagtaaaaacaagatttcaattccgtttttatatacagattttaataatattaacatgtaattttaatgtttatataacaccataaaataatatttataattaatagctaaataaaacagcttaaagacccaaagttattaattgttattcgtttattaaaaatagatatgataacgctaaaatttaccataatagtcacataattattgatagacgcgcgttatgctgacatagaattgggactgatcaatgatattaggctttttatactggcatatgtttttgggcttaaactaggtaagctgcctgtagatgtgatgctcaacattcttgtggtaatcggttgtgcatctacttggcaaactgcagatggattatcgatgttccgctcccaaagccaccacttttttattaacgctatttattcttgtctccactttatttttggctctggttaatgtattcaatgttaacctatctctttttattttcgctatcgtactcttatgaactccataccgttcagctcgccttcatcacaaattataaagaaccatctcaatcaaaatcatcggctcaatagtagtgctaaatatgtaattaattcttttttctaaatcaattttcaaagaaatgtttttttggaaaagaagtgtatgaagaagagagttcaggcacgatcgcaacacttacttttaaacgagttttaattataaaaaaataccgtatagaaaaaatagtgcattgtaataaataattagaggcctgcatatgcaggcctctataactttcggatgtagcgaaagcatattatctagcgttaagacgctctttaatacgagccgccttaccagaacgctcacgcaggtaatacagtttagctttacgaacggcaccacgacgtttaacactgatgctgtctacaacaggagagtgagtctggaatacacgctcaactccttcgccattagaaatcttacgaacagtgaatgcagaatgcagaccgcggttacgaattgcaataaccacgccctcgaatgtctgcagacgctttttagaaccttcaacgacccataccttaacttctacggtgtcacccggacggaatgaaggtacgtcttgcttcatctgctcttgttcaatttgtttaataatgttgctcataataactctcttaccctagataaactgatatatcaaagacattccttcacaggatatgcctggattaattcgttgcttgatcctgatattcctgttggaattcagacagcaacatcctctgctcgtcagtcagagctaggctttctagaagttcgggccttcttaaccaagttcggccaagcgattgtttcattcgccagcgattaatttcggcatggtttcccgataataaaacagggggaacttccatcccatccaacacctcagggcgggtataatgtggacaatccaataagccatcagcaaacgagtcttcttctgccgatgcctgacgccccaatactcccggaataaaccgagatatagagtcaatcatcgtcattgcaggaagttctcccccgctgagaacgtagtccccgatagaccattcttcgtcaatttcggtttggatgacacgctcatcaataccttcataacggccacaaacaagaatcaattcctcatgtgctgccagctcacaaactccctgttgatcgagtttgcgcccctgtggtgaaagataaatcacctttgcatcaacgcctgcctctgctttagctgcatagatagcttcccgtaatggttgcaccatcattagcatgcctggaccaccgccataaggacgatcatcaacggtacgatgcctgtcgtaggtaaaatccctaggactccagcattcaatactcagcaggccattttttacagcccgaccagttaccccgtaatcggttattgcgcggaacatttcaggaaacaggctaataaccccaatccacatacagcgtcccactcatttaaaccgttttaaccggagattaaaaactaggatcccaatctacttcaatagttttagtagcgagatcgactttcttgataacctgcccatcaagaaacggaactaaccgttccttgataccgaatgcatctttcaggtttgcttttactaccatcacatcgttagaacctgtttccatcatgtcgttgatagtcccaaggttataacctgcaatatttattacctgacagcccataaggtctctccagtaataatcatcggtttccagctctggtaattgggtagaatccaccaccacttcacagttggtgaataaattcgcagcatcccgatcatcaatctctttgattttgatgatcaaatcctgattgtggtatttccacgtttccagctcaacgtgttgccactggcctgaacgttgaataaaccacggttgatattcaaaaatgtcttcggtacgctcggtggaagaaaacactctgagccaaccacgaatgccatatgcggagcccaatttccccaatactattggatcaacaggtggctccaggccagtttgcttgctcattgttgccaccgcgacagattaagctgcttcagctgattttttagcatctttgatcagtgcagaaacacgatcagacacagatgcacccaaaccaacccaatgttcgatacggtccagatctaaacgcagagcttctgctttccctgatgcgatagggttgaagaaaccaacgcgctcaatgaaacgaccatcacgcgcattacggctatcagtcacgactacttgataaaacggacgcttttttgcgccgccacgagctaaacgaattgttaccataacatcctcattagttagcaaaacaaccagacttcatcgaggaatgaagtccggctattcatataaaaagctcgaaaattttactcactttggcgcaaaaagcaatccaaagagcactttctttctcgactttgttaattattgccccataaagccaggtggcagcatgcctttcatgcctttcatcattttggctagaccacctttcttcatctttttcatcatacgttgcatttcatcaaactgtttcagcaaacggttaacatcctgcacctgagtaccagaccctgacgcaatccgacgtttgcgggagcctttgataatctccggtttctcacgctctttacgggtcattgaattgataatggcttccattttcaccagaaccttgtcatccatttgggatttgacggcatcagggatctgcgacatgcccggcattttactcaacatactggtcataccacccatattgcgcatttgcttgagctgatcaaggaagtcatttaaatcaaaaccatcgccttttttcagttttgatgcaagtttctctgcttgggttcggtcaactttgctttcaatttcctcaatcaatgaaagcacatctcccatacccagaatacgggatgcaatgcgatct

SEQ ID NO: 16832 - DNA, 11475 bp, Xenorhabdus bovienii
agggagaggttgatcagtacgacaccgacaacaaataaccagaagctcagtgagttcaggaatgggaaagcaacgtcacgcgccccgatttgcaggggaactacgatgttcatcagaccgacaacgaacggcattgccatgaagaagatcatgataacgccgtgggcggtaaagacttgatcataatggtgcgggggcaggaagccggcttcacctgcggaagccagagcttgctgtccacgcatcatgatggcgtcagcgaaaccgcgaaccatcatgaccatggcaacgacgatatacatgataccgatttttttatggtcaacgctggttaaccattcgctccagagccatttccatttacggaaataagttaaggtaccgacaaccgccagtcccccgagaaggattgcaatcagagtcactacaataatgggttcatgtagtgggattgcatccagtgttaattttccccacatgcctttattcctcaacacctgcatgagccggctgactcatattcatattatgatccgcagcttcaccatgttctgttttgccgtgacttgctgtaccaaacataccaccatgtttcatgtcacccatgaatttggtgatcgtttcttggaacagctttggtttcactcttgagaagtattcaacagggttattttggcttttttcagctaagtcattaaacgcctgcacagtatccagggttttaggtgatgccttaactttctgcacccactgttcaaaactttcacgatcaggtgtcgctgttgcagtaaatttcatgccagagaagccttcgccgctatagcttgctgagaaccctttatatgtatccggtgtattagcaatcaagtgcagttttgtctgcatgcctgccatcgcataaatctgaccgcctaactgtgggatgaaaaaggagttcatcacagagtctgacgtgattttgaagttcacgggaacattggtagggaatgcaatttcgtttactgtcgcaatgccttgttctgggtagataaatagccatttccagtcaagggaaataacttcaatcgttaccggtttttcttcatagtccaatggcttatatggatcgagttcctgagtcgttttccatgtaatggttgccaagacgatgataatcagaataggcacagtccaaacgacaagctcaattttatttgagtgtgcccagtttggacggtaagtagcggatttattggcttcccggtaacgtagagcaaaaatgattgccattacgatagccggaataacaacgatcagcatcaggccaaacgctgtcagtatcagcgttttttgctcaacgccgatcgcccctttgggattcatcaataccatatcacaaccacttagtattaaagtggctgcgagtaatgacgacaacccaatagtttttttgtatttcataagtctcattgagcgaccccagataacaaaagctttattgtcgtttcatcagtgcgggcattctacggtaaggtcaccggagtgtaaacaattgtaatggaagcaagataacttgtaggctttttatgttagagggatcacatgtgatgtaagatttaacaaaaagttaattttagatggttactttaaccaagagttcaaaataagtatttattttaaaataactttctatttttaaaaagaaaaaactgatgaaaaccaaaggaaataagactaaaacaagcgttttttacaatatgataaccgttgtttatcggtactgatgagcagcttgttgctgctcatcagttaaatttattttagaagttatattttacactataaacaataccatcctgcaagaaatcttcgcctaatttgttatccgcatagcgatattgaatcccagtagtaaaggaaggatgtggagtccaccataatccgacagcaccattgataccctctcggccaccattgccgtagcgctgattacggttcaactcaatttcattccagttcgtaatactgaatttttcttgccagagttggaaatcgtaccctgcaacccagcctatgacataaccgttattacctgagtagaaagtttggtcaacatagtgaagtgcgacaaaaggtttgaaccaaacaccagcaagcgtggtgttatagcccaatccatagagagtatttacttcatggaaattgccaccgttggctttacctggtagtgaataggtgccataaacatgaccataaaggttgaaacccgtatcaccgagatagaaacgacctgtggttttgaaggtgtagcgctggttatcaccgggttgtgcagttttgctgttaaatggattttctaaatcaaggaaaccatatagctcgccccaactgaacccagctccaccttctagttccaaataagcaaagtcatctttatgtgaggtctgccctgttttttgagtggtgtgtttggtccagtcaaggtagttcatgctgacattggcaaaaccccactgatattccgcgctggctgatgcagaaaccaaggcagtagcaactgcggtgagtgtcaaaatatgtcttttcataaattccctttatatggttttaggataaataaagatgtcttgaatggttcggaataaaatacattcggataataatatttgttagtgtgaatataaatgttccgctcttgaaaaagacgttttccaagtcacataatggctgttttttatttttattgtgaagtttatcactaaaataaggcagccaaaggttgaaccttaccaacctttggctttttcagaaagcgcatctaagatgctgtagtaggagttcagggggaacacactaagcgaatttggttttcctcaaagctaaataatccagcgctcctcccaatagaagtcctacagtacccattgcgatactgaatgagaatacgggtgagattgctttttgaagttcatcaaggacgataaaatgagccatactactgatgataattatcaggcagctacaaattaaccaaattataaatatgaaagcggcgagcagcatgataatgaaagcaatccgataatagcccttgaataatgtacgggaaatgaaactatcgtttttttcagtataagccagtgtcttgcggcagataaacaaaagccacagacccggtaatccgatgacaatggagaatagataaaacatggaccagccgtgagattcagcgaaccatcccgcaaccgggccgacataaacccgtccaattgctgctaatgcagaaagcagggcaaattgtgtcgctgaaaatgatttattgcataaggtcattaacagggcgacaaacgctgctgttcccatgccaccacagatattttccagaaaaacagcgccccccatcacgtagatgtctttgggagtgacggcaagtatccaataacccaaatttgaaacggtctggagaatgccaaatatcatcagggcgcgaaacaggctccatttatgcatcaaatagccgccatatagagcacctacaatggtagcagccaagccgagtgttttattgatcataccgacttcagcagcagtaaagccaacaccacgtataaggaacgttgtactgagagagagcgcaaacgcatcagcaagcttatacagtacaattaatagcagaataatccaggcattgtttcggctaaagaaatcagataagggttcgaatactgcctgatgtaatgtttttggtggcgctgtattaatctttggttctttggcattgagtgtggcataaacaccaatgagcatcatgcctgccattatcaaatacatattctgccagccaatataagtggtcagccacaacgccaaaccaccggaaaccaacatggctatccgatatcctagaacggaaattgcagcacctgaaccgcgttcttcctgtgaaagtaagtcggttttataggcatcaaagataatatcttgggaagcggaaaaaaatgcgacagagacggctaatgctgcgagccaccataaatgttcagatggcttgaggaaagccattgtggcaatactgacgataagcaggagctgagtcaccagcatccatccccgccgccgccctaaaaatgagggcgaatatctgtccattgccggagcccagaggaatttaaagacataggcttgaccaaccaaagtgaaaaaaccgatggttttgatatccagattttcaactgtcatccatgcctgtaatgttcctcccgtgagtgctaggggtagaccagaggcaaaacctagtaaaagaaggatgtaataattgcgtaatctggacagcttattgagataatgattagtcatgagcctctcaagaaaactttctgcacattaactaactgggcagaatttggcagaaagttttttcatctcctgttagtgaacgttttgtttgatgaaggtgctgactgacgaatcttgggccatgtctgcgatcacgtcagataaaaccgtgtttacggcatctgcaattttcgcatttgttgcacttaatggcccttgaacattgtagctagtgcgatagtttttgatctgctggctgccatcttgggcataaacaataatggagacttctgcttttgtagaaatatcgtggcgtagactcccttccttaacattggcataaagctgattcacaacgacttgcaagttggcattggcaggagaaccaatcatatagccgcgagctaccatttgcttttccagtgcttcttggagtaaaaaccgtaaatcacgggaaggtgtcagggtaaccagtctggcatcgcgattaacttgggccagtgcttgagattgacgatgatcgaccccactaatactgattgtgatcgctttcattgtcggatctacgggtggcagggtaatttttggttgaattgccaatgtattgccggagtttgcacagccagataagccagctaaaaagaaaagtgcaagcaatgaagtaaatattttttttagcatgtaggttttctcattcaggatacggatacccgatatattaatacaggtagtataaacagtcgcaatcatagcattgctattgatagcggcatatccctaatgaatgcttgaaacatagggagaaataccccaagtaaattctgttaaagatatttggctgccctgatgttataactcacaggaaataaactagaatcaattatatggttgataaataacctttggtgatgaaggagaatgggatggttcgtcaggaaatagaaataaagttacaggcggcatttaagccttctcatctggaagtgatcgatgaaagttatcgtcataatgtgccagcaggttctgaaagccattttaaaataattgtgatcagtaatgaatttgtcgatcagcgagtgcttagccgccatcgctcagtatatagtgtcttagctaaagagttggaagaaggcgtacatgctttagcgcttcatacttatacagaaaaagagtgggcagaattgggagacactgttctagcttcgcctgcatgccggggaggaagtacgacgacgtcaggtttgtgatttttccgggttagactatatatcctacttaattttttattttattaatctgattttaattttagacttcagccttcgggctgtatttttgtatatattcacaccggatagacgatatcgtgatgcagtcattgagccatgtttatcacagaagtcaacgaatattgcctgcttttgtctgcaattctcgactcatactgtctgcgtcgctataatgctgcgtctgaatttttagaatggtttcgggacgcttctgatcacagggattctcggtttttaaatacgaccgccccggttcttgatgagtgttgtaatcagccagtttttcaggcattacgacactctgaagttgaccgagcactatgatttttttgaggtaacaagatgcaagtttctgttgaaaccactcaaggccttgggcgtcgtgtatcaatcaccgttcctgctgccgacattgaaaaagcaattagcagtgaattggttaatgtagcgaaaaaagtccgtatcgacggtttccgtaaaggcaaagtgcctatgaatatcgtcaaacagcgttatggcgcttccgttctgcaggatgttcttggtgatctgatgcaacgcaatttcgtcaatgcgatcattgagaataaaattaatccagcaggcgcgccaagctataaaccagagcagtttaaagatggtgaagacttcatttatgctgttgagtttgaagtttatccagagattgaactgaaaggtctggaagagatcgaagttgaaaaaccggttgttgaagttaaagatgcagacgttgacgcgatgctggaaactttgcgtaaacagcaggcagattggaaagaaactgatgaagcagcggctgcggaagatcgcgtaactgttgacttcactggttctgttgatggcgaagagttcgaaggcggcaaatcaactgatttcgttctggcaatgggccagggccgtatgatccctggttttgaagagggcgtcgttggccacaaagcgggtgaagaatttaccctcgatgtgactttcccagaagattatcatgcagaaaacctgaaagggaaagctgcgacgtttgctatcaacctgaagaaagttgaacagcgtgaactgccagaactgaccgaagagtttatcaagcgttttggtattgctgacggcactgttgatggtttgcgtgctgaagtgcgcaaaaatatggaacgtgagctgaagaacgcggttcgtagccatatcaagactcaggttcttgatggtctggttaatgcgaacgaagttgaagttccagcagcggttatcgatggcgaaattgatgtgttgcgccgtcaggctgctcagcgtttcggcggcaatgaaaaacaagctctggaactgccacgtgaactgttcgaagagcaggcaaaacgccgcgttgttgttggtttgctgttaggtgaagtcattagcagcaatgagctgaaagttgacgaagatcgcgttaatgtgttgatcgaagagatggcttctgcttatgaagatccaaaagaagtgatcgaatactacagcaaaaataaagaaatgctgaacaacgtccgcaacattgctctggaagagcaggctgttgaatttgttctgaataaagcaaaagtttctgaaaaagaagccggctttaatgatcttatgaaccaaaatcaactggcataagtttcatttattgattacctgagataataaaatttctctcagtaatgcaaacccgcaggctatgcttgcgggtttttttattgtccttgaaaaaaacagatttaacctcatatcctttcttactattatgtaagggcttactactttttagggggagaaagccctctgttagttaactttgaatcatggtcatcatcgcttatctcaagtagaatcagttatgaatggcaccagcgtgagttctattaggagacggaaatgtcatacagtggcaagcaagatcaatatgcacctaacatgtctttggtgccgatggtggttgaacaaactgcacgtggagaacgtgcattcgatatttattcccgtttattaaaagatcgaattatttttctgactgggccagttgaagatcatatggcgaacttaattgtcgcccaaatgttattcctggaagcagaaaacccagaaaaagatattaacttatatatcaactctccgggtggggttattacagcgggtatgtctatttatgacacgatgcaatttatcaagccggatgtgagtactatctgtatggggcaagcctgttcaatgggtgcattcctgttgacagcgggagcaaaaggtaagcgtttctgtctgccaaattctagggtcatgattcaccagccattaggtggtttccaagggcaggcgacagatattgaaattcatgcgcaggagatactcaaggttaaagctcgcatgaacgagttgatggcgaaacatactggcaaaccacttgagaagatcgtcgaagatacagaacgcgaccgtttcttatcagctgcagaatccgtagaatacggtttggttgatagtatatttacccagcgcaactaatttattgataattactttattactccggcgctataattttaagggcgtttttttgttggcgccttactcggcggagtaatgacagcgtattttctgttatgccagataaactgggataacagctcataaagtgaggttgactgatgacagataagcgcaaagacggttcaggaaagctgctgtattgctctttctgcgggaaaagccaacatgaagttcggaaattaatagctggcccgtcagtgtatatctgcgacgaatgtgtcgatttatgtaacgatatcattcgcgaagaaattaaagaactagtaccacaccgtgagcgtagcgctttgcctacccctcatgaaattcgtcaacatctggatgattatgttatcggtcaggaaacggcgaagaaagtgttagcagtcgctgtttataaccattacaagagactgcgtaatggtgacactaataacggtgtggaattaggaaagagtaatattctgctgattggcccaacaggtagtggtaaaaccctacttgctgagacactcgctcgttatttagatgtgccttttactatggccgatgctacgacactgactgaagcgggttatgtcggtgaagatgtagaaaatattatccagaaactgctgcaaaagtgtgactacgatgtgcagaaagcgcagcgtgggattgtgtatattgatgaaatagataagatttctcgcaaatctgataatccgtcaattactcgtgatgtctcgggagagggcgttcagcaggcacttttgaagctgattgaaggtacagtggcagcggttccacctcaaggtggccgtaaacatccacagcaggaatttcttcaggttgatacctctaagatcttgtttatctgtggtggtgcatttgcaggattggacaaagttattagccagcgtttgaatgtcagctcgggtatcggttttagtgctacagttaaaggcgagtcggagaaagcaacagaaggcgaattgcttgctcaggctgaaccggaagatttgatcaaatttgggttaattcctgaattcattggccgtctgccagttgtggcaacattgactgaactgagtgaagaagcactgattcagatcctgcaagagccgaaaaacgcgttgaccaaacagtatcaggctctgtttaatctggaaggtgctgaacttgagttcagaaaagaagcattgacagcgattgcgaagaaggctatggcgcgtaagactggtgcacgtggtcttcgttcaatcgtagaaggtgttttgctggatacgatgtatgacctgccatcaatggaacatgtagaaaaagttgtcgttgatgaagcggttgttgaagagaaatcagcgccattattgatatatagcaagccggatgcccaagtttctggtgagtgatgaaaatagggtaggaagtaccgattatcaatatgtattgaaaaaataaaaatgagggattctccctcattttgctttttgcaggcataggctattgaatgtgagattcctgtccccatatattttgtattctttgaagtgaaactcgtgaaaaccgtgtttcacgagattcctaaaaactggcgaaagctaaacgaagagagagctctatgaaccctgagcgttccgaacgcatagaaatccctgtattgcctttgcgcgatgtagtggtttacccacatatggtgatccctctgtttgttgggcgtgagaagtcgattcattgcctggaagcagcaatggatcatgacaaacaggtcatgttggtcgcgcaaaaagaagcatccactgatgagccgggagtcaatgatcttttctccgtaggtacagtggcttctgtgttacagatgttgaaactgccagacggcacagtgaaagttctcgttgagggtttgcagcgtgcccgtattacaacattgacggataatggtgagtacttctatgcgcaggttgaatatcttgaatcccctgtcgttgatgaacgtgagcaggaagttctggtaagaaccgccattaatcagtttgaaggttatgtcaaactaaacaagaagatcccgccggaagtattgacatcattacacagcattgaagatttagcaaaactggcagataccattgctgcccatatgcctttaaaaattaacgataaacagactgttttagaaatgtctgatgttgttgagcgtattgaatatctgatcgcaatgatggaatcagaaatcgatctgttacaggtagaaaaacgtatccgcaatcgcgtcaaaaaacagatggaaaaaagccagcgcgagtactacctgaacgagcaaatgaaagcgattcagaaagaattaggtgagatggatgatgcacctgatgaatatgaaacgttgagacgtaagatcgaagacgctaaaatgccgaaagaggcacgcgaaaaggccgaagccgagctgcagaaattaaaaatgatgtctccaatgtcagcggaagcgacggtggtacgtagctacattgactggatggtacaagttccttgggttgctcgcagcaaggtgaaaaaagatttggtcaaggcgcaggaagtgctggatatagatcattatggtctggaacgcgtcaaagagcgtatccttgagtatctggcagtacaaagccgtgtcagcaaaatcaaagggccgattctgtgcttggtagggcctcctggcgtaggtaaaacctcactgggccgttctattgcgcgtgcaactggccgtaaatatgttcgcatggcgctgggtggcgtacgtgatgaagcagaaatccgtggtcatcgccgtacttatattggttccatgccgggtaaactggttcagaagatgtccaaaattggggtcaaaaatccactgttcctgttggatgaaattgacaaaatgtcatctgacatgcgcggcgatccggcttctgcattgctggaggttcttgatcctgaacaaaacgtggcatttaatgatcactaccttgaagtggattacgatctgtctgatgttatgtttgtggcaacgtccaattcgatgaacattccggcgccactgcttgatcgtatggaggttattcgtctgtcgggttataccgaagacgaaaaactgaacatcgccaagcggcatctactgccaaagcagattgagcgcaatgctttgaaaaaaggtgaattggccattgatgacggtgcgattctcggtattatccgttactacacccgtgaagctggtgtacgtaatctggaacgtgaaatttccaaactgtgccgtaaagctgttaagacattgttgatggataagcagcttaagcacatcgaaatcaatgcggat

SEQ ID NO: 16833 - DNA, 8725 bp, Xenorhabdus bovienii
tgcagtattggggaaaattctttggattgatatttggtattgcttctggtgccggcttttggggcatagcgattggcctgttgctcggtcatgtacttgataaggtcgggatgcgcaatcaaagactttctgacaaaggtccatcccggcaggcgctgttttttcgcagcacctttcagatattggggcatttgaccaaagcaaaaggccgggtgacagaaacggatatccagctcgccagccagttgatggataggatgcagctgcatggtgatgcaagggttgccgcacagcaggcgtttcgtgagggtaagcagccccggtttcctctgcgtgaaacacttcggcaattgcgacgtgcctgttttgggcgcttcgatctgattcggatgtttttggaaattcagttacaggctgcgttttcagatggcgaactgcatcctaatgaaagaatagtgttgtttgtcattgctgaagaactgggtatttcccgcgctcaatttgagcagttcctcgccatgatggaaggtggccgccattttggtgggcaataccagcagcatggacgttatcaggatcatgggcagccgcgggcaacactggcagatgcctgcaaggtgctgggtgttaaggaacatgacgatgcgacaaccattaagcgggcttatcgaaaactgatgagtgagcaccatcccgataaactggtggcaaaaggtttaccgccagaaatgatggatattgccaaacagaaagcgcagtccatccaatccgcttatgatttaattaaaaaagaaaaaggttttaaataacacctgtcaaaaatcggccttgcattcaaaatgcatcggagtgccgtaggccggatgagtaatcgacaactcttgtgcatgtaattgcaggcgaggtgccagttctcttgcctgctgatgagcatagaacctgtcccccagaatgggattaccaagcgccagcatatgtacacgtagctgatgggatcgcccagtgatgggagcaagcctgacgcgagttgcctgagcttcatattccagcacttgatactctgtctgtgccgattttccggtttcaaaacagaccttttgcttcgggcggttcggccagtcgcagatcagtggtaaatctaccagacctttttcccgttctaattttccccatacccgggcgatatagacttttttcggctcacgttcgcgaaactgacgttttagctcacgttcagccgctttggtcagtgcaacgaccatgacaccactggttgccatatccagtcgatgaacagattcagccgttggaaactcggcctgtatccgcgtcatgatactgtccttatggtcctctgctttgcccggtacagaaagcaactcactgggtttattgacaaccataatgtgctcgtcttgataaagcacatgtaaccagggatcagtcgggggattataagattccagcatagtggctccagttgggtcgaaaaaatgacggggcggattttatcagcatatgatttacggtgtgagattaaaatgcaggggcatctcattgagatcgccccgtatttcaggattggctatttattagtggctatttattgatgagagaccaccaccaagcgaatggcatccagacgccaatttgcctgatcaagattgagcagcagatgcttatgttcagactcaaccgcttccagctcatcatcacggatatttggattaaccgctttcagcgcttccagccgtgacaactcagcagacaacacgttatctgcctctttcttcgctttctcaatcacttcacgggcttgctgttctaccagcggttcagattgctgcaaaatagcgtgaacttctttttgcaccgcgctgaccagtttactggcattatggcgattgatggcatttagctggcggttgaaactttcaaactccacttgaggtgccagattggttcctttcagatccattaagaggcgcactggtgttggtggcaggaagcgggttaattgcagatgttttggcgcttgggcttcaacaacgtaaattaactcaaccaacagcgttccgactggcagtgctttgtttttcagaatggaaacggcacagcttccggtatctccagacaaaatcagatctaagccgttacggatgatcgggtgttcccagctcaggaattgggtatcctcgcgggacagggctttttcacgatcaaacgtaattgagcaaccatctaccggtaagccagggaaatccggcaccagcatatgatcggatggattcagggtaataatattgtcgctgcgatcttcctgattaatgccaatgatatcgaacaaattcagagcaaaactcaccagatccgtatcgttatcctgtgcggcgatggtttctgccagcttttgtccctgctcgccaccattggaattcatttccagcagacggtcacggccttgctccagctgctgcctgagttgctcatgatgctcacggcactctgtaatgaatggcgtgaagccagcctgttcgtttggcttggcaaggaaattcaccagagtttcataatatttgtcatagatgggacgaccggttgggcaggtctgttcaaaggcattcaaaccctcgtgataccagcgcaggagaatcgattgcgcggtattttccagataaggtatgctgatcttgatattccggctttggccgatacgatccagacgaccgatgcgttgttccagcaaatctgggttgaaaggcagatcaaacatgacaagctggttagcaaactggaagttacgcccttcagaaccaatttcagaacagagcagcacttgcgctccttcatcttcggaagcgaagtaagccgcggcacggtcgcgttccagcagagataacccttcgtggaacacggcactgcggataccttcacgttcgcgtagcacctgctccagttgcagggcagtttctgccttggcacagatcaccagcactttttcatcgcggtttgccagcaggaaaccaagcaaccattccacacggggatcgaagttccaccatgtcgcattttcgccttcaaactcctgatagatccgctccgggtagagcatatccttagcgcgcgcttctacggattttttggcgcccatgatttcagacactttgattgccgtctgatattgagcgggtaatggcagcttgatttcgtgcagttcacggtgtggaaaacctttgacgccgcctcgggtattacggaacagcaggcggctagtgccgtggcgatccattaacatcgcgaccagttcacggcgcgctttttcactctcttcatcctgatgactgtttgccgctttcagcagaggttcaatatcctgctcgctaatcagttcgacaatcaggttctgctggtcattgttcagcgtttcgccagagagcagcagggtgacggcatcagcgaccggacggtacttctgctgttcatcaataaacacctgataatcgtggaaacgattgggatcgagcagacgcagacgggcaaaatggctttcctgtcctaattgctcaggcgttgctgtcagcagcagtacggatgggatctgctcggctaactcttcaatgacctgatattcgcgacttggtgctttttcgctccattccagatgatgagcctcatcgacgaccattaaatcccaacttgcttccagcagatgttcaaaacgctgcttattacggcgaacaaaatccagagaacagataatcaattgttctgtttcaaatggattatcgctatcgtgcagggcttcggaataacgaccatcatcaaacagggaaaagcgcaggttgaaacggcgtagcatttccaccagccattggtgctggaggctttccggcacgatgaccagcactcgttcagtacgaccggccatgagttgctggtgaataaccatgccagcttcgatggttttacccaatccgacttcatcggccagcaacacacggggagcgtggcgtttgccgacttcattggcaatatgcagctggtgagggattaagctggcgcgaatgccacgcagcccactttcagctagacgaaactgctcactttgatgtttacgggcgcgaaaacgcagcgcaaagcgatccattcggtcaatctgaccggcaaacagacgatcctggggcttattaaacgtcagcttactatccagaaaaacttctcgtagggtgatattttcctcttcagtatccagacgagtaccgatatagattaacaggccattatcttgctgaacttcatcgaccttgagtttccagccttcatgactggtcagggtatcgcccgcattaaacataacgcgggtaatgggtgaatcattgcgtgcgtaaaggcggttttctccgctggcagggaaaagtaacgtcaccatgcgcgtatcaagcgctacgactgttcctaatccaagttcgctttctgtatcgcttatccagcgttgaccaagggtaaatggcataaattttggctcagttttctgttagacaatgttatttatggttgcaggatggctgcttttgttggatatcgatcatcattggttatcgatagggatagttttcaacgacacttttcatcgctcgttttttggaaacgaggtcgtaaaagcaccattgcccattagaggggcgatatgttaattcaagaggagcaagccgtcacctgcaaaagtatccattattcgaaagatattctcatctgccctgtcagcagggtcataaagttatcttgaagaaatggcaggatggcgtctgcaatcggcatcagttgtttattaatgtagtgttcgtaatccggcagcgtagtctggtcttccagaggctcaggccctgattgcgtgatgaggtagctgatccaaccgccattttggtattgcaatggacgattgttcagctggttatactcatccgccagacgtgctgcccggacatgaggcggtacattacgctgataatcagacagtttgcgacgtagctgtttgcggtaaatgagacggtcatcgaattttcctgccagcgtgttggcaacgtaatcacggatataatcttggtaaggcttctggtgaaaaataagggtgtacagttcattctggaaaatctgcgcaagcggtgtccaatccgttcttattgtttccagccctttgaaaatcattttatcgccactcaatccggcatagcgttttttactgccttgttcagtgcctctcacggttggcatgagaaaacggcgataatgggtttcaaattccagttccaaagtactttcaagattgaactgcgttttaagatggctttgccaccattgattgacaaattgcgccagcgaatgacctatttgaccggcttctgcttcagaatgagggtgcttcagccagataaaagttgagtccgtatcgccataaatcacctgatacccttgtgactcaatcaactcacgggtctggtgcatgatttggtgcccgcgcagggtaatagaggaagtcaggcggggatcaaaaaagtggcagcctgacgcacccagtacgccataaaacgcattcatgataattttcagcgcttgggagagcggggcgttttgttgctttttggctttgtcacgttcatgccagatttgcgtgacgatatcaggtaaacaatgttgagtgcgagagaaaaacgcttgccgaaaaccgggtatggcatgttcactatcgggctgggcgaggccttctaccatgcccacgggatcaatcagaaaagtgcgaataatagaaggatagaggctcttgtaatccaaaaccagcactgaatcatacagccccggaaacgaatccatcacaaaaccgccggggctatcaccggagtcagttgcatgaacgggagcgacatagccgatgcggtgcattctcggcagataaaggtgcgtgaacgcagccactgatcccccgctgcgatccactgccagccctgtcaccgtagcgcgctccagcaggaacgtcatcaaatccgtcttatcaaaaatacggttgaccagaatacagtcctgcaaattatagtgggcgagggcgggtttatcctcctgaaagcggcgattgatttcatccatccgatcataggggctatcaatggcttttccttcccccaataacgcctgtgcgacagattcaagactgaacgaaggaaaattccacgttgcggttttcagcgcatcaatgccatcaataatcaggcggccttcagccgaggcgaaaaaatgccccggcttgaaaccgtgctcccgccattccagcaaaccatgatgacgaccgagtttcagcggtacgttatagcgttcagcatgtttctgtaatacttttaaatcaaactggatcagactccagccaataatggcatcgggatcgtaaaatgctatccattcgtttagcttttccagcatctgcggacggctggcgacgtactctagcttgaaatccctatcttgcctgcccccattttctggccccagcataaacaccgtttgctcaccgcaacccgctaatccgatggaatacagctccccatgctggctggtttcaatatccagtgaaacccatttcagtttagggcgataggtgggattcggtttcatttgatagctgccatccggcttctgattgaaccagacgggcgcggtaataaaacgctccatcataaatcggtcaggtgggcggatatcggtttcgtagagcggaatatcctgctctttcagcgctttttccagctgttgcaattgacgatattgcaggcaatataaggcagtaacaggttggcgattgaaatctttcaacggcacaggtttgaattcacaacgctgttcttggccgataatccgctttgccttctgcaaatcatgctggggaataaaagccaccgctttttggtgagaaatagtgatgcggcgtgcaccctgatccgtcgctagccaatatactaactcaataccggatggcgtatctttccagtggcgggtgagtataaaaccttgttcaacatgctttgtttgcataatatttctgcaactgtttttgtgttgagggcaaagagccgcctctacattgtgatgaatagtagtctaaactatagcagttgcagtggttatttatacagtggtttttttagtaaagtcagaatatagggtttttatgatgaagaatgaattgagtaaaaaacaatctgagttactcgcgagttttaataaagaagaattacttgaaatcatccatgcattaatcagaaataatgagctggctcaaaccacattagtcagtggatatttgctggagtctgaagatattctgaaactcattgaaaaagagtataaaaaacgcagcaagagcaaacgatttttcgattattatgaaacggatatcttcttcggtgaactgcatagctatatggcaacgctttttgacacgattatccctttaaagccagcagaatcagaagtgttactgtcaaatatgttacaagattttgaacgcctgagtgaaactaaagacacctcgagtggtggctggcaggattattactactaccttgttgaatcttggattaaggcgttatctctgcaaaaagatattgataaggttacggtagcaaataagcttttcaatattttccaaggtgaatattatttctctgtgtccctgttggctgaatataaatctactttgggtcttgatattcttcgccagctaagagatatcttttatcagcacaaaaatgatgatgaagcactggagttgagttcttccattaaagatattgaattcttcaagacgtatctcgataaggagaaagagtttttatatccaagatattatctggattacgctgaattgctgattgaagatgtcaggtctgatgaagctattgtgttgttggaaaatctcagagaaaaaaacaacaaactgccagttgaactcaatgatgataagataatggaattattgattaaggccaatattgaagagggtaagaaagaagaagccaggcaactttgtattgacgctttcaaggagtactataaccatagattttatgaattatatgaaaatactcttgataaagatgaaaaagggagtgctataaaattatttttggatatagccaatcaatatgaagaaaaccgtttcttttatttactattcctaatagaagtggaaaaattcgatgtgatcaatgattacgttttgaatttaggaaaagataatataataaaaattaccgattctattattcccagtacggcgagaaaagtatcaagtttactgtataaaagtggttttcctctttctgcgacgctcgtaagacgtgcgcttgttgaagatgtgcttggtcgtggagcaagtaagtattataaatatgccgtttctgatcttaagaaaagcttggattatggagaaaagatacaaagtacggacgatattgcttctaatcaaacatatttaaccgccctctacgcaaagcataagaaaaaagcctcattctggtctttggcggaagaaaaaattaagggtgtttcaatggataaagatggcgcttattatggaaaatgaaggttagtttgatcctgcacccgatttgtgtcatttccattaaaggtggctattcagatggccaccgaattcaatattgttttaatgacctgtaag

SEQ ID NO: 16834 - DNA, 16364 bp, Xenorhabdus bovienii
gtttttaatacgttggccatgttcttcgtagtcaccgtgagaaaaatttaggcgcatgacattcatgcctgcattaagcaattcggtcagttttgtttcggattctgtttttggcccgatagtacaaacaattttggtttttttcatgacaatctatctactggttttaatggattaaaagagtgaatcaccaaccattgacatttatgccagcatcatctggatttgtaagttgcgcaacataacggaaaacggatggcagaaagtgtcaaatggttttttttgcgtgaagtcaggcgtgtgtagatatgtggacttgaatcgattaagcattggtaattttttctgagttcggtaaaaaaattggctgaaaccattcaacttatgacaggagcgtattatagaggctaatttctgtgaaatgaatcaaaaaaatgattcttggagatatttatgagtaaaaagcgaaaaatattctggctcatgttaaggaaatcagagagttgttgcgcaaacgggatagaattgaattgttagtatcgtgtgataggttgggtaacattaagtatatggtagggaagtagagttcagcaaaatatgaaataaaagaataaatggctagaaaggaatttaggatattatctaatagatggtgcgtccgagtggactcgaaccaccgacccccaccatgtcaaggtggtgctctaaccaactgagctacggacgcacataagatttttctatgtcagacagatttatggtgcgtccgagtggactcgaaccaccgacccccaccatgtcaaggtggtgctctaaccaactgagctacggacgcaatctaaatttctgtggctgacaacggggaagaatattaacgatcacggggctttctggcaagaggaaaaacgcaaattctgattcgattgctcgtatttacaccttttggaatgaatttgcggcttttcctcttgttttccgacctattagactgaattaatgagtagagcgttccagaacaaagtgggttggttgcttttgtaaccacaaaattcggagacccaccatgactgcggcggcggttaagccgataataaacccaatccagaaaccctgtggccccattggttcagtgacataatgggttagcgccagaatgtaaccactaggtagtcctaagatccaataagcaataaaggtgataaagaagacggaacgcgtatctttataccctcgtaatacaccggaaccaataacttgaactgaatcagaaatctgataaatggctgcaaacagcatcagatgggatgcaagagtgacaacttcatagttatcgttatacataagtgcgatcggttcgcggaacaaagttgtaaaggccgcggtcatacaggctatcatcaaaccgacagcaaggcttgtgtaagctgaaattttggcaccttcagtcgatttttttccaaggttatagcctacgcggatggttgctgcgatcccaaatgacaggggaaacataaacatcatggaactgaaattgagtgcgatctgatgtccagcaacggcagcgactccgagaggagataccaacagagaaacaacagcaaaaagtgtgacttcaaagaacagggccagtgcgataggtaagccaagtaacacaatacgtttttgtgtacgccaattagggccagtaaaattgtcgaacgtatggatgtccttctgtgaaggcgtgtgttttacatacgcaagcagtaacaggaacatgacccaatagaccgtggccgttgcaacaccacagcccacaccgcctaattctggtgcgccaaatttaccgtaaatgaaaatataattgacaggaatgttaaccagtaatcccataatgccaataatcattgcaggcttggttttcgacaatccttcacactgaccgcgtaaggtctgatagaacagatagccaggggcaccccacataatggcatggataaagtttattgctttttgtgccaacacaggatcaacattgtgttgcgcttctataatgaatcggcagttatacaatacagctataactaaaatagagagaaaagttgccagccagaagccttgttggatctgaactgccacattttttctctgaccagaaccgttcatgtgtgccacaatcggcgttagggccatcagtaaaccctgaccaaataaaatagttggtaaccagattgacgtaccgacggcaactgcagacatttcgacagcacccgctttaccagccatgactgtatcgacgaaacccatcgcagtttgtgaaaattgtgcgatgatgattgggatccccagagcgagcaaactacgcgcttcatttaagtatttctgcacgtactacaccttttttgattgaaaattaattagaaaaacaaagaatatttctacgggcaaacgattttattggaaaattaatcgcttattaacgcggatattgtataggactcgttttactaagccaatcgctgcgcgatactaatacgcaacgggagcgcgcactcaccgaaatagtgtttaaaaatgatgggtaggttaaactaattcatttatgcaaatgacgaaagaggttcccatgtttacaggcatcattcagggaaaagcgccgatagttgcgattgatgaaaaagcgcattttcgaactcatattgttaaatttccggctgaattattacccggaattgaaacgggagcctccgtttcccacaatggttgttgcctgacagtgaccaatatcgatagcgatctgattagttttgatttgatgaaagagacgctgcgcttgactaatctcggtgatcttaacgtaggtgatttagttaacctggaaagagctgcaaaatttggtgatgaaattggtgggcatctgatgtccggtcatgttattacgatagctgaaattgccaagattttcacttcagaaaataaccatgaaatttggtttcgcattcacgataagcaattgatgaaatatattctgcataaaggatttattggcattgatgggattagcctgacgattggggatgtcgtgaataaccgattctgtgttcacctgatacccgaaacactggaacgtacgacactgggtaaaaagcgccttgggcagaaagtgaatattgagattgacacacagacacaggcaatcgtagataccgtcgaacgggttatggcgcagaaagaacaggaaaaagtattgtcacaaacggaagaacaataaaaaacattacccattgtaggtgaaagctacaggaatggggttctgtagctttctgtacaacctttttaggttaataccttaccgaggaactctcaggccgttttcaattccccgtggactaaacataatttgccacagttgaatgtctctggcacggaatgcacctgcgcaggcattcaagtaataactgaacatccgtttaaagcgtgggctgtagttatgttctatctcgctccagcttgcggtgaagtgttcataccatgctatcaacgtacggtcataatccgctccaaagttgtgccagtcttccatgacaaattttccagtgctggctttggcgatctttgcgaccgaaggtaggcaaccattgggaaaaatatacttatttatccatgaatcgacgttcagtttatcacgattagagccgatagtatgcagcagaaacaggccatcagccttcaggtttttgcgcacgatattgaaataattggcatagtttttaggaccaacgtgttcaaacatgccgacagaaacaatcctatcaaattggaggttcaaatcgcgataatcttcaaggatgattttcacatccagatcttcacagcgttcttgagcatatttctgttgctctgcggaaatagtaacgccagtgacggatgcaccatagttttttgcagcataggcagccagaccaccccatccacatccgatatccaatagtgtcatgcctgaagacaattgcagtttttcgcaaatcaggcggagtttactggtttgggcttcttctagtgtatttgaatctttccagtaaccacatgagtactgcatgtaggggtcgagcatgcgagtaaaaagatcgttacctaaatcatagtgttcttctcctacaacccaggctcttttgggtgattgtaagttaaatatgcgagcggtaatgactttcagaatatccttggcatttttgggaatgcgatactccagaccagctcgcagtattttatgaaagaatacatccagatgttcacaatcccaccagccatccatatagctttcacccagcccaagggagccttcttttaacactcttttataaaaatttggatttttgacatgtatatcgaaagggcgtttgccgttgatctcaatatcagcttcttgaagcaactcattggcgattctatgccacggatcggtaattatttttttatcttcaatgcaagatgaactcatatactctccaatatttatacgagggaattttgaggtatctctttgtggctgattacttattatgctaaaaccaaaaaggttttattcggaaataatatagaacattaagtaaaagcatatacgctcattcatcctgaaatcaaacagagcttcattgctcttacaaacctcaaattccaagtttttataataatgaacctgtatgagtatatgagtgaaataatatttaaacaatcatctaaaggtcacatttatgacgcaacctttagatgagaatgttcttaattattattttttggcgtgattattaaattcatgtttaatctttcttgtcatatttttgcttttgcaaccaataccctattgccatcaaaacaacagtagaaaccatcactgttgtggtagatagaagagggtttttcatgaatacagagactatcaggcttgcgacaaaacagagacctaattgcagggcattctgcaatgcagccgccttcccgctgtttttagggtaaacagagagggcatttgctacagcaataggataagaagcaccattcattgctgccataatgcagaaagggatgagaatagccataaatgaaggttcatagaattgggaaattaaataaatgatcaccatactgacggcataacctgccagtaagaatggaaataccgtttcacttttgattttttccaaaagaatacggcaaccatatccaccgaccataaatgccagagtctgaggaatataactcaagccgatatctgtaggatcataacccatatcggccagaattgttggtgagccagttagccaagcaaaaaaaccagcactgcaagcagcataaattaatacatttccactgaagatgggggatttcaataaggtaaagaaagaaactccctttttatcagagtcggtatcgatagttttgtgtttattggtcaggaaaaatgtgggtatcagcagtaaaagtgttacagccatcaagacaaggaaaatgattttccagccaacgtgtgacaatagccatgcaccgaccaaaggagcgagtgcaggggaaagggcaaccagaggcattatcatggcaaaaacacgtttagtacgttcaggatcataccgatcgacaactaaagcctgccagcaaactgctgcagagcagactccaaccgcttgaaaaaatctcaatacaagcagttgagtggagtcagttatccaaagcatacctagacagctaatggaaaacagggataagccgataataagaacaggttttcttcccaatcggtcagacagttgcccccataacaactgagcaaaggcaaaaccgccaagaaaaatgctgagactcgcactgatagcactttctgatgtatttaactctgttttcattactccaaaagcaggtagatacatatcaatagccaaatagccgagcatactcaggccagcgagataaaacatgaatgaaatggaattgttatttgttgtcattgtgttaataacttgatgtggtaattgataagaagatacaaggcttattctatatggcatgatttttacttgtgaaacggtaatatttgcatcatgttatgaaaaaaattgaaaggaataaatatgtggtctgaatactcgctggaagttgttgatgctgtagccagaacaggaagtttcagtgcagctgcatcagaacttcatcgtgtcccctctgctatcagctatacggtaaaacaactcgaagaatggttggctgtacctttatttgagcgtcgtcaccgtgatgtagaattaacggaagcggggggtatttttgttaaagaagctcgttctgttatcaaaaaaatgcatcacactcgccatcaatgtcagcaggtggctaatggttggcgagggcagttcagtattgccgttgatcaagttgtaaaacctgaacgaacgctccaacttattctggatttttaccgacattttccagatattgagttgcttatctatcctgaagtttttaatggtgtgtgggatgcattggtagatgggcgggttgatgtcgctattggtgccacacgcgcttctccggtcggagaacgatatagtttcagggacatggggtttatgccgtggttatgcgttgccagccctgcacatgaactggtttcgatagcagaaaaattgaatgacgaccagatgcgcgcttattccagtttgtgcctggaagatacttctcgcagcctgcccaagcgtgatacgtgggctttggataatcaacggcgattgattgtgcctgattgggatattgggttggcttgcctgatggatggtctgtgtgtaggaatggtgcccaagcatcgtgcattaccacttatccgcagcggaaaattgatcgcacttgagcttgaacaaccattgcctgatagcccatgttgcttggcatggtcgcaaaaaagccattcaccagcattaagctggttgcttgattatctcggagatagtgaaacacttaatgctgaatggctgcaggaggactgattgtcaacggcgataatcgatgaaaggcccatctgcaacagatcgacgctcaacaagacgcgggtggacttcgatagtttgtgcatcttcacgcttattgatgatcctgtccagtaacgccgagaaggccatctgccccagacgttctttaggctggtggatggttgtcagcgctggcgtgaagtagcgtgcgttacgaatattgtcataaccaatgatggaaatatcctgagggacacgtaagcctagctcatcggctgcacagattgcccccattgccatcacatcgccaccacagaaaacagctgtggggcgatttttctggttcaggatcttatacatagcttgatagccagattcaggttcgaaatcgccctgcacaatccactcattccgaatggcaatatttgcctctttcagtgccttgagaaaaccttgatgacgcccgccaccggtatttcttgctagtggcccaggaatggaagcaatatcacggtgaccgcgttcaataagatagcgaccggccaaataaccaccatggaaggcgttatcgataatcgcatcggtgaaatctcctctagattcgccccagtccatgaccaccatgggaatattgcgataatcttccagcatacccaaaagttgttcaggatattctgaacacattaccagtaaaccatccacacgtttttgagcgagcattgcgagataagctttctgcttgtcgagattgttgtgagaattacataaaatcaacgtatagcctttgctatagcaactattttcaacggattctattatttcggcaaaataaggtgcctcgcttgaagttgccagtaatccgatggatttggtgtggttaaccttcaaactacgggcaacggcactgggagaatagtttagttctttaatggcagcccaaactgcgatttttgtatcttcggcgacgaaacgggttttattgataacatgggatacggttgtggtcgaaacaccagcgcgtttagccacatctttaatcgttgccatgataaaaaagactcctgaccttatggtctaaatttatagatctttgttaatcgtttgccagtatatttatataggatgaaggctggcaataacttagcgataaaccttgaattttgtctgatctagctcaaaagtgaaagcaataatcgatgctataaagtatatgcactaaatgtcaaatgatgctttttatgtaatagggtgaataaccattcaaaatttatggtgttgcggcgccttaattttcacattgaggatgtttatggatacagatctgaagttgggattattgactgccagtagtgcattggtaatgattgttattctagcaagtctttgcctagtctagaaaaaaattgaagtgtaacgttgcctgcttttgtttgctttaagggtaaactttcgctatccaagatttatggaatcgggaaagtctacccttactatttcaaactggtttgagcgtttatctcattaagccagattttcttcaacaaatttccagttgaccagagcccagaaatgctccagatattgagggcgcgcattacgataatcgatgtaatatgcgtgttcccaaacatcaactgtcagtacaggtttatcttcactagtcagtggagttgcggcattggaagtattgacgatagccacgctgccgtcagctttcttgactagccatgtccaaccagaaccaaaatttttcagggcagcatcagtaaactgctgcttgaattcagcaaaagagccgaaagcactgttaatagcgtctgccacttttccagttggttcaccaccaccgtttggtgacaggctattccagtagaaagtgtgattccagacttgtgctgcgttattgaagatgccgccttcggatgtcttgatgatttcttccagtgattttccggcaaattcggtatctttaatcagattgttcaggttcacaacgtaggcgttatgatgtttgccgtaatgatattccagagtttctgctgaaatgtgtggttccagggcatttttggcataaggtaatgctggtaattcaaaagacattgcatgctcctttttaatatcgggtttttggctctacaagccatggttaacaaggtgacaaccatgggcagagcaaattcaagcttattatcatgttgctattttgataattatcttaacaacttttcagctaaattacagggaaaaagatacgacttaactgcgatctggagtggaactgaactgtagtactgattggaaacggtcacaggggatgaaagcatcacatagccatctgcggcagattgcaacataaaatttgcagaagaaagttcgcggtagaaaattcgcggtagaaagtggtattctgaatcaatcttttctgatgctgataaacagcgcttgtggtttaaggaagtaaaaatgatgagtattgagaaaaacgaacgcccggttgaagaaacaacgactattggaaaaatagaacgccagatcaaagaaaatccaatcttgctgtacatgaaaggttctccaaagctaccaaactgtggtttttctgctcaagcggttcaggcgctgtctgcctgtggtgaacgttttgcttacgtagatattctgcaaaatcctgatatccgtgcagaattacctaaatatgtaaactggccgacatttcctcagctttgggttgatggtgagctggtaggtggctgtgatattatcattgaaatgtatcagagtggtgaattacaagcgttgatcaaagatactgctgacaagtaccgtgaacaggcagactgcgatagcgaataatttatcattttggcgaatgatggttaaagccccatacatcttcagcaggcatggggcttgatttatcaggattcgttatctggggaaggtaatggccagccgcctagtcgtttccagcggttaacgagttcacagaacagcaaggcagtccggtctgtatcatacagagcgctatgagcctgattactgtcaaatggtatttctgctgtaatacaggctttggccaggattgtttggccgagcaccaaaccactcagggctgcggtatcaaaagtggcgaaagggtgaaatggattacgtttcaaactagaacgctctgctgctgccatgacaaagttgtgatcaaaactggcattatgggcgactataatcgcgcggttgcaattactgtctttcatacctttgcggatcattttgaaaatggcatgtaatgccgtgtattcactgactgctccccgcaatggattggtcggatcaatccctgtgaatgccagcgccgctgggtcaaggttagcgccttcaaaggggtcaatatgaaaatgcagtgtgtcagctggcaccagccaaccctcttcatccatctttaaagtaattgctgcgatttcaagtaaagcatctgtctgtgcattaaaaccaccggtttctacatcaatgacaacaggatagtagccacgaaaacgtccacttagcatgttttgatcttttttattagacatctgattcagttcttaacttcatgatagtggatattatgacaaaatttggcatgtattgcagaagtaatacctatccaatttagaaatgaagggcatggaaaatgccctttgcatgtagaaatagttaatttcctaatgcactgctgccgctttggttttcgattaattcgattttatagccatcgggatcttcaacaaacgcaatgaccgttgttccgcctttgacaggtccagcctcgcgagtcacatttccaccagagagtttgatgctctcacaagttgcagcgacatcgtcaacacccaaggcaatatgcccaaatgcggttcccatttcgtagctttcaacatcccaattataggttaactcaatgactgcaccttggctttcatcggtataaccgacaaaagcgagggaatatttatactctggattttcactggtgcgaagtagacgcatacccatcacttgagtatagaaatcaattgagcgctgcatgttgccaacacggatcatagtatggagtaaacgcataattacctcttgaactttataattttattgcgaaatatccttatttaggaaagtccttatttgggataatattatggcgaaatttcgctcattaactgcatatgtgtggttcactataacttgtatagataaaataattcaatttgtcctttcaacttccatatattgtttcatattattactattttattttaaattatcacaatggatattaccctgcgtcaatatgtcaattctcacaggggtaagtgcttggtaggcctagatgcaggaggattagatggctgaacaattagagttttttgctattccaaacccttgcaagggggtttgtgaatctgattcccgtggtttctgccgaggatgttatcggagcagagaagagcgatttatgtggatgaagttatccgatagacaaaaaagagaaatatttaggttatgtcatcagagatatctgaggatattaaaaaataaggggaaaaaagacgatattacaccgaatcaaccttatatcttgattatcacttttacagagcgataatcccctgactgatcatcagggatgctgttgtgagtttgttattattaacctgaacctgaaatgtgtcattcaatggagttcgtaattcagagtaaaccacaacagcctcttctgtatcgcctttaagattgaacggtatcttgtgcctcgagcatctattttataagtctaatcatggcgatatctcctgtgtctctgacaaagaggataaccttatgtctgataacatcgtagtcggtattgatatcgccaaacacaaatttgatgtcgccgtttgggcaggcgaaaatcattacaaaaggaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccatgcctttggtaaagcggaattactccgcaataaaaccgataaaattgacgccaaactgatagcacgttattgcgccagtcagcatcctccggcatggcagcccgcgccgctttgtgaacgccaattactggctttagtccgccatcgcaataagctgaatgaaatgcttttgacggaagagaatcgcctctccgtggtggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgcgctggcagcgatcagttgcaataaagtagtgaaaaagcagtgggaacagctgacagcacgccataaaggggggaaagttggtgtttgtgcagtgatgcgtaaactcttacgattagcctatggcgtgatgaaatcaggcacattatttaacgcagaaataccgcttgcagtttaatgactgagacggtatctgaattattttaattttctgctgatttgtttaaaaaaattacttacatgaataatagtttatgattgccttaaaaataagaaatattaccagtattaaatgatgtataatttatattatacactttttatttgacataggtcgttcgtaaatatcgttactgttgactagttaccgtgtttcggtaaaattttcttatcaaagaattacttattgaacaataaaagagcttattttctatcttattgtttttaatgttatttattataatatgaactatcattgtaagagaaaaatgatattaatgtaaaaatatatagattagtatttggatggcggttattcttatagaactttaaccgagtggaactgtatctatttttagggtttgtatttattttgttgatatttaaaattacaatagtttagctagaggattattttatacagtttatatcgttggtggattaatgcgcgattttattcggtgctccgtaaaacttcgctctttagggcgacgaagatgtcaactttgagtaacaagccaacgcgacactaattaggtaattagcgaaatttctgactctgctaatgtaagcatgatataggtgcgtatccattattcatatgaataaactgattggataattcattgatgttatatgagtctctaattataaggaggggtaattggaattgacattgggatcagacctagcacgtttagttcgtgtttggcgcgctttaattgatcatcgtttgaaaccgttgaaattaactcaaacacattgggttactctatacaatattagtcagttaccaccagagcagtcacagatacaacttgcgaaagctattggtatcgaacaaccctctttggtgaggactctggatcaattagaagaaaagcaactgattacacgtcacacatgtgctaatgacaggcgtgcgaaaagaatcaaattaaccgaggaatcggaaacttttatcagagaagttgacagtgttattggctctacaaggaaagatatcttggagggaattactcatgatgagttaattctgcttgcttctgtaataaaaaaaatcgaaaagaatattagccaattgcataaacaggtaatataaaaattaaccgatgaagagaaaatcgcggtccagcagatactggcaagccgcgatttttttgtttgactgtacgtgaactaatgatgtcagagtggtgatactgtagtcgaatttccaccgtcagctatcttgacacgttgtcctttgctgaatacgacttgatccagtttctgtactacgacgatatttcttccgctatccgtgcgaatatctaattcgacacctttcgttttattgatggccccttcaatcccctggccagccaccccaccagcaatagcacctgcggccgtagcaagtctttggcctgtaccatcaccgaccgtgttacccaataaccctcctaaaacagcaccaccaatcaaacccagcatgtttgggttaccagcctgagcacctttaatatacacaggacgtacagatagaatagtgccgtaggttacgttttgaacttgtttggcttgatcaatagagtaggtatcactagaaagtgctcccatgtctgcgcaaccagacaatgttgttactacaactgcaccaaccaggaaacgtttgaacatagttactcctaattttaatgcccaatgggaaagcctgataataaacctacaaccaagcattaggctactattgccagcaacagtcataacaaatttgctggctactaattgccgatacactaacagctcatttctcgataaataataaatactgaagacgaactcctaaaggaataattcctgaccaaaagtttagcatgttttgtgaaggactctccaaaactcagattttatctctgatattgactgctaaacatatatagtccaaatagatgtgtttcatagtttatgtaagattaaatgtaatctacgaacgaaatgtaatccactctttaaataggggagtatttatgaagtcaggacgttatatcggtgtcatgtctggtactagcatggatggagttgatgttgttctggcggcgattagcgataaagttgttgcacaacaagtgagttattctcacccatttccacaagagcttaagcagaaattgctttccatctgtcaaggtcaacagacgacattatctatggtcggccagtttgactatgaacttggaacactttttgccgaagcagtaaaaggtctgatggacaaagctgggctaaccgcaagcgacattacagcagttggctgccatgggcagacagtatggcatgaaccagacggtgaaaaaccctttactatgcaaatcggtgataataatcgtgtcgctgcattgaccaatattactactgtaggcgatttcaggcggcgtgatatggcttatggtggtcagggcgcacctttagtacctgcatttcatatggcggttctcgggcatccaacagaaagacgcattattctgaatattggcgggatcgcaaatatctccgcacttctgccagattctgctgttaaaggatatgatactgggccagggaatatgctgatggatgcctggatatggcggcataagcagttaccttatgataaggatgctcagtgggcaaatgaaggaacagtcaatcaacgcttgctccagaaaatgatttatgatccttattttgcacgtattgcaccgaagagtacggggcgtgagtacttcaatatggcatggttggaaaaacagttggcagattttcccgacgtctcatctgtagatattcaggcaacgctggctgaactaaccgcggtaagtattgcacagcaggtagtgttgagtggtgggtgtgaacgcttgcttgtctgcggaggtggggcacgaaatccacgtgtaatgagccgcttatctgctttattgccaattactgaagttgctacgactgacaaatatgggttgagtggtgacgatatggaagcactggcatttgcttggctggcattccgcactatgtctgggttatctggtaacttgccgtcagtaacgggtgcggacagggaaacgattttaggggcaatttatcctgttgccagcagataacaatgatatgttaatactcactaagcaatcgagagttagaaatgtcagaacataatgaaacgggtatcgcagacctgcgccgcgaatatatacgtggtggattgaggcggaaggatcttactaaagaaccgattgaactttttgaactttggttgaaacaggcttgtgaagccaaactcattgaccctacggcaatgtgcattgctacagttgatgaacacggtcagccttaccaacgcattgttttattaaaacattttgatgcccgtagcttggttttttataccaaccttggtagccgcaaggcgaagcatctgacccagaataaccgaatcagcctccattttccgtggtatcagcttgagcggcaggtcagtttccttggc

SEQ ID NO: 16835 - DNA, 15234 bp, Xenorhabdus bovienii
  unsure (1)..(15234): unsure at all n locations
ncgttatgcggtaacagccatgctagatgtggcgttgcattcacaagaagggccggtgccattagccgacatttctgagcgtcagggaatctccctttcctatcttgagcaattgttttcccgcctgcgtaaaaatggtttggtttctagtgtccgtggtccaggtggcggctatctactaggcagagatgccggtaatattttcgttgccgaagtgatttctgctgttgatgaatctgttgatgcaactcgctgtcagggcagggaaggctgtcaaggcggtgatcgttgtctgactcatacgctatggcgtgatctcagcgatcgcatcacgagtttcctcagcagcattagtttagaagaattagttaaaaatcaagaagtcttagacgttgctgatcgtcaagacagcgataagcgccgtacacctaacggcaggcctcaagagacgattaacgttaacctgcgtgcgtaaactttgcggcaaacagaagtattaaaagtgttttacggagcatgtgagcaatgaaattacccatttatttggactattcagcaaccacaccggttgatcagcgtgttgctgaaaagatgatgaaccatctgactatggacggggttttcggcaacccggcttcccgttcacaccgttttggctggcaggctgaagaagcggttgatattgcgcgtaatcaaattgcagatttggttggagctgacccgcgtgaaatcgtgttgacttcaggtgcaacagaatcagataacctcgcgatcaaaggtgctgcaaaattttatcagaaaaaaggcaagcacattattacctgcaaaactgagcacaaggccgttttagatacttgtcgccagttagagcgtgaaggttttgaagtgacttatcttgcgccgatgagcaatggcatgcttgatctgaaagaactggaagccgccatgcgcgacgatactattctggtttccatcatgcatgtgaacaacgaaatcggtgtcattcaggatattgtgaccattggtgatatttgccgcagccgtggcatcatgttccacgttgatgcaacccaaagcgttggtaaattacctatcgatctcagcaaactgaaagttgacctgatgtctttctctgctcacaaattatatgggccaatgggcatcggagcactgtatgttcgccgtaaaccacgcgcccgtattgaagctcagcagcatggtggtggtcatgagcgcggtatgcgttccggtacattgcctgttcatcagatcgtgggtatgggtgaagcttaccgcatcgcaaaagaagtgctggaaacagaatcagagcgtctgcacggtttgcgcctgcgtttgtggaacggtattaaagatattgaagaagtttacctgaacggtgatttggaactgggtgcaccacacattctgaatgtcagcttcaactatgttgaaggtgaatcattgatgatgtcgttgaaagatttggctgtttcttctggctcggcatgtacttccgcgagtctggaaccttcttatgtcctgcgtgcgctgggcatgaatgatgagctggcacacagttctattcgtttctctttggggcgttttaccacagaagaagaaatagactatgcaatcaaattgattcacaacgcgattggtcacctgcgcgatctttctccattatgggaaatgttcaagcaaggtgtggatatcagtaccatcgagtggtctcatcattaatcaaatggtttcaggagtaacgaaatggcttacagcgataaagtaattgatcactacgagaacccacgtaatgttggttcatttgacagtgaagatccttcagttggcagtggcatggttggtgcacctgcttgtggtgacgttatgagactgcaaatcaaggtcaataacgagggtatcatcgaagacgcacgttttaaaacctatggttgtggctctgcgattgcgtccagttctctggtaacagaatggatgaaaggaaaatcgctggaacaggctggggctatcaaaaatacagcgattgccgatgagctggaattgccacccgtgaagattcactgctctattttggcagaagatgctatcaaagcagcgattgcggattacaaaagcaagcgcgaagctaaataattcttttaacaaaaagacataattctggtggatattgattcaatatccacctttactagttttaaaagtgaggtgttgtatgtcaatttccctgacagaaagtgcagcccagcgtattttggcttttcttgacaatcgtgggaaaggtgtggggttgcgtttgggagtgagaacatccggctgctctggtatggcatatatacttgaattcgctgataccgttaacgaagaagatcaagtttttgaagacaagggcgtgaaagtcatcgttgatggtaaaagcatcgtttaccttgatggtactgagttggatttttctaaagaaggtctgaacgaaggcttcaaattcaataaccccaatgtttccagcgagtgcggttgtggggaaagttttcacgtttaacccattttttgactgagcactttacgaaatatctgtatttgcaaaacaagagtaacttatggactattttactttatttgggctgcctgtacgctacgcgattgaccgtgaacaattgtcaatccgttatcgggaattgcagcgtcagtttcaccctgatcgttttgctaaccagccagaacgtgaaaaagcgcaggctcttcagcaagcgtccatcattaatgatgctctttatactctgatacatcccttgaaacgtgcagaatatatgctgtctcagcaagggttcaatttgtccggcgagcagcataccatgcaggataccgcgttcctgatgcaacagttggagttgcgcgaagagcttgatgccattgagcatagcgcggagccagaaatcgcattggccgatttttcatctcgcttgagtaaaatgatcaaaacacgcagtgagcagatggaacagcagcttgatgctgcacaatggccaattgcagccgataccgtccgtaaattacgctttctggataaattgcaacagcaggttgaacaactggaagagcggttgctggatgatttttagctggatagcttttgagtaaaatcgcttttggctgaatagtttttataggggcacacatggctttattacaaatcagtgaacctggtttatctgccgaaccacatcagcgtcgtctggccgtggggattgatcttggtacaacacactctctggttgcgacagttcgcagtggtcaggtagaaaccttggcagacagtgaaaaccgtcacttacttccttctgttgtacaatatcgcaaagatgaaactcaggtcggctggcaggcgcgtcagcaagcggcatccgatcctgttaataccgttatctccgtcaaacgtatgatgggacgctctttggctgacatccagcagcgttacccaaatctgccgtaccagcttcaggcaagtgaaaacgggctgccgttgattaatactgtggcaggcctggtggatcctattcaggtttcttctgaaatattgaaatcgttggcccaacgggcagaagaaaccttggatggcaaacttgatggtgttgttatcaccgttccggcctattttgatgatgcgcagcgacagggaacaaaggatgctgcgcgtttagcgggtctgcacgtcctgcgccttttaaatgaaccgactgctgctgccattgcttatggtcttgattctggtcaggaaggtattattgctgtttacgaccttggtggcggaacattcgacgtttctgttctccgcctgagccgtggtgtatttgaagttctggcaaccggtggtgataccgcactgggcggtgacgattttgacctgttgctggcaaattggatccgtgaacaggccgggatcagcgatagtgaccacgggttacagcgtcaactgttggatgtcgcgacgcaggccaaaattgctttaagtgatgcagatacggctgagatcagcattgcaggctggcagggcaatattactcgtgccgaatttaatgagttgatcatatctctggtcaaacgcacattgctggcctgtcgtcgagccctgaaagatgcgagtgtcacaacgggtgaagttttgcaggtagtgatggtcggcggttcaacgcgcgtaccattggtacgcagcatggtgggcgaatttttcgaccgtgaaccactgacctctatcgatcctgacagagtcgttgctgttggggcggcgattcaggctgatattctggtaggtaataagcctgatagcgaaatgctacttctggatgttatcccgttatcactcggtctggagaccatgggtgggctgatcgaaaaagtcattccacgtaacaccaccattcctgttgcaagagcgcaggagtttaccacattcaaagacggccaaggagcgatgagcatccatgtggttcagggagaaagagaattagtgaatgattgccgttcactggctcgtttcacgctgcgtggtattcctccattaccggctggtggtgcgcatattcgtgtgacctttcaggtcgatgcggatggtttgctgagtgtcagcgccctggaaaaatccacgggtgttgaagcttccattcaggttaaaccttcctatggcctgtccgattcggaaatcgcccgaatgctcagagactcaatgaccaatgcgcaggaagatattcaggcgcgtaaactggctgaacaaaaagtagaagcggcgcgggtgctggaaagtttaaccagcgcactggaaaaagatgccgacttgctgagtcaggaagaacaggctgccattgatgctgccgtagaagtattaatcgagagcgcacagggaacctcttctgatgcgattgaaagtgcaattaaacaattggacaaacaaacgcaggaatttgcagcgcgtcgcatggacacatcaatccgccgggctttggcgggtcattctgtggatgaaatttaattatgcctaaaattgtatttttacctcataacgaactttgccctgaaggtgcagtattggaagccaaagaaggcgaatcgattctggatgttgcactgcgcaatggtatcgaaattgaacatgcctgtgaaaaatcctgtgcgtgtaccacttgtcactgcattgtcagagagggctttgactcactaaaggaaagcactgagttggaagatgatatgctggacaaggcatgggggctggagccagaaagccgtttgagttgtcaggccaaagtcgctgatgaggatttgattgttgaaatccctaaatactccattaaccacgcgcgcgagcactgataggagaatggaaaatgaaatgggctgacagtcgtgacattggcgaagcactgtatgataaatttccggatgtagaccccaaaacggtgcgtttcaccgatttgcaccagtgggtttgtgaactggatggttttgatgacgatccgcagaaatccaacgaaaaaatcctagaagctatattgctggtttggttggatgaatttgagtagtcaaatgaagtgtgaaaaaaatagcacaagttcacctatcattgctcaatagcttggcataacctgcatttaatggaaaactggcaatcgccagtttttttacattaataaacccttactgtgaaaacagtgaaaataagataagaagtgagaaaaaatgacaaagcaaatcatgccgataacactgtcttatgagccagctaacgcttgctggggtgaaaaagcgctaattagttcaagtgagcagggaattatcatccatttggaaggtaatggtaaatctggagcgatccaacgtgctggacgtaaaattaatgggcagggtatccacaacgtcgctttgacaggtgaaggttgggatctggaaaaaagctgggcattctggcaaggatttcgtggctcaaaggggctgcgtaccattgaatggccacaattacctgcggcagacaaacaagagctggataatagaatcaaattcgttgattgggtgcgagataccatcaacatgccggcagaagaattagggccagagcaacttactcagcgagcgattgacttactgaatggtgtagcgggtgatgccattagttatcgcatcataaaaggcaacgatctgcgtgagcagggttatgttggggtgcataccgttggccgtggttcttcccgtgatccggtttttctggcgttggatttcaatccgacaaaagagaaaaacgcacccgtatttgcctgtctggtgggtaaaggtatcaccttcgattcagggggttacagcctgaaaccgtctaattccatggattccatgaaatcagacatgggcggctctgcaacattgacgggcgcattggcactggcgatcagccggggcttagagcagcgggtcaaattattcctgtgtattgcggacaatatggtgagcagtaacgccttcaagttgggtgacatcattcgttatcgcaatggtaaaaccgttgaggtaatgaatactgacgcggaagggcgtttggtactggctgatggcttgattgatgccagtgcggaaaaagcaccacttatcattgatgcagcaaccttaaccggtgcggcgaaaatggcggtaggtaacgattaccactctgtattcagttttgatgatcaattggcagcagacttgctggcagcggctgatgctgaaaatgaattgttctggcgtctgccattggctgaattccatcgtagccaactgccatccaattttgctgacctgaataatattgcttcgccttctcataccgcaggcgcaagtacagcagcggctttcttgtctcattttgtggaaaactacaaaaaaggctgggtacatattgactgttcagcaacttaccgcaaatcggctgttgagcagtgggcggcgggtgcaacagggtatggtgtgcgcacaattgctaatctattgctggctaaagcaaaataaacagcgatacccaatagatttaagattacctttcttcatagtctcctttcaaaaggggaggctatgattgaacctttcaatagtctttaacttcaattcaaatattactgttcggagattttcatgagcttgtcaaatgggtccgttgccaccgaaatggaggtttccagtggaagtcgcattaccctcagccagccagaggaacaaccaagccagcttattgacgccttgagtggtttatttaagcagcacaaacctgtgcggcgggcttttctggtcatggctcacgataaaagtctggatgagaaacccaatctattaattgggttggaattgagtgacgcaccgacagacaatgagatcaatgcgctcattcaagaggcaggggaagtggcctgtgaataccttacggaagatgaatcggtagatttttgcctgctcaatgaaaacgaaaggggcattagtcattatctgattcagcatactcagcctttctaccagcgaaaattaggaagctggctgcgcgataccattcctgttgttaatcgggaataaatgcaggaagaattttgttctagatgaaaattccgttattttttctgcgctttggttatgcgaaataggaagtatcataataactatctataaaaaataatatttctaaatatccggcaaactacaagggttatggttatgtctcaacgtcaattttggcaatggtcggcaaggaaaaagcgatatctcgcggtcatgcttgccacgttatttacgctattcgtgctgcctggatgcgatcaatccgaaaatcctgcgaaagaaaacacagaagaacgacaggcatcattgtctaagagtagtgatactgccaatagtcatgcaaaatcggcagcgacatcgcccgagaataaacaagccacggcaaaaaaacaggaacaccaatcgtcagcacagcgctatgcgggtaaagacgtcacgatcctggatgcatcagatctacaattggatggtgccagtgcgatggttgtgacattttccgttcctttagaacctaatcaagatttttcacagaaattacatctggttgatgtgaaatcggggaaattagagggtgcatgggaactgtccaataaccagatggagcttagactccgtcatttaccgcctgcccgtgaattgcagctaaccgtggacgaaggcgtgaagggcataaatgaacgccaattggcaacagcatatgagaaaaaattcaagactgctccaattacaccaactgttggttttgctagcaaagggctgcttttgccaagcaaagcagcagaaggcctgcctgttctggcgctcaatgttgatcgtgtagatgtaaactttttccgtataaaagatgaggctctgccgttattcattgctgattggcaatatagcaacaacatgaattactggaattccaacgaattattgaaaaataccgagttagtctacactggccgcttcgatcttaatcctactgctaatactcgtgaaaaattattgctgccattaagtgacatcaaagagctgcaaagagagggtgtttatctggcagtcatgcagcaggcaggaaaatatacttatagtaatccgagcactctatttaccctgagtgacattggtgtttcgatgcacagctatctgaatagggtagatgtattcactcagtcattggagaaaggttccagtctgaaaggtgttgaaattcgtctgctggatgcaaaggggcaacttctgtcaaaagccacgacagatagtgatggacatgccacactggaaaaaaatgctaaggcaaaattattgctggcgatccagggtgggctaaccagcatgatagacctgacatctcctgcgcttgatctgtctgaatttgatatcggcggcccacagggttatagcaagcaattctttgtatttggcccaagggatctttaccgtcccggagaaatgttgattgtcaatggcttactgcgtgatgcggatggccgtccgcttaagccacaacccgtcaaagttgatatattgaaagcggataatcaggtcgttcgtagttttgtctggcaacctgaaaatgaactgtaccaataccgttacccgattccccgcgaggctgaaacggggatatggtcactgcgattcgatttaggtgataacaccccgcgttattacaaattccacgtcgaagatttcatgcctgaacgcatggcactggaaattaaaggtgcatctaataatcagtcagttctgaagaatgaaaacgttaatttcgctataacaggtcgttacctatatggcgcgcctgctgctgataatcgcctgcaagggcaactgtttctgcgtcctgcccgtgatgcagtggcaaaattaccgggatatgaatttggctcttcaaaagaagagggtttgagccgaacattggacgaatttgatttcacgctgaatgccgaaggaaaagctaatctttcagtcagtgaggatgaatggaaacaggtgacatctcccgtgaaagttatcgttcaggccagtctgcttgaatccggtggacgtccggtgacgcgccgtgctgaacaggcggtgtggccagccgaaaaactggctggtgtacgcccacttttcaataagaaatctatttacaactaccgaacagggcgtgatgaaaaccgctataacgtcgatgaagattcattggcagagtttgaagtggtttatgcggatgccagcggtaaaaaatatgccacgaacgatttaagaacccgtctgatatatgagcgccgggattattattggcgttggtcagacagtactggctgggattcagggtatgaccagaaagatttagtcatggctgataacactattcaaattgcggaaaatggcacagccaaagtcagtttccctgttgaatggggttcttatcgcattgaagtagtgaatccacaaaatcagctcgttaccagcctgaatttctgggcaggttattcatggcaggataataccggaggtacaggtgccattcgtccggatcaggtcaagatgtcattagataaacccgcgtataaaccgggtgataaagtgaaattgcacatggttgcaccacaggaaggtaaaggttacttgctggtggaatccagtgatggcccactgtggtggcaggaaattgatgtaccggaaaaaggtttggatattgatgtatcaatcaatcaggaatgggctcgtcatgatttgtatctgaccgcagttatcgtgcgtccgggggataaatcccgtcaggctacgccgaaacgggcgattggggtattacatttgccgcttatggatgaagggcgcaaactgaatctgaccttgaatgcccctgataagatgcgtccaaatcaggatctcaccgttaaaatcaaagcgacttctcagcaggggcaaaaactgcctaaacaagtttatgtcctgctttctgccgtagattctggcgttctgagcattactgactttaaaacccctgacccttatgacgctttctttgggcgtaagcgttacagtgttgatcagtatgatgtttatggccatctgattgaagccgaagggcgtaaggcgaatttgcgttttgggggagatggtgatgaaaatgcactcgatagaggcggtaaaaagccgctgacggaagtaaaaatcatcgcagaacaggctaaaccgattactctggatgctaatggggaaggggaaattaccttacctattcctgatttcaacggtgagctcagactgatggctcaggcgtggggtggtgaggaatttggtcacagtgaacgcaaaatcatcgtggctgctcccgttattactcagatgtcattgcctcgcttcatggcaggtggcgatcaatcccaattggcgctggatcttaccaatctgactgaacagcagcaggttcttaccgtgaatttcgaggcgaaggggctgatcaaattacaagacccgataagcaaaaaaatcattctggagacaggaaagcgaactaccattcaaattccggtcaaggctgattatggatttggacaaggagaagttttcctgaccatcgatggattgaacttgcccgatgaaaagctgaaacagtaccaaaatagctggaaaattggcgttcgtccggcgcacccggccaagaccattcagtttgcagatgtgattcaccaagggcaaaactggcaattaccgcagacagccactgctggtctggtactagataccctagaagggcaattattgctgaccagtcggccgccactgcaaatcgcccgttatatccgcgaattgtatgcttatccctatggctgtttggagcaaacagtcagcgggctttatccatcactctattccaatgaagctgagttgaaaaaactgggcatcgatacgcaaactgatgaaaaacgtcgatctgccattgatgcaggtattacccatctgctgagtatgcagcgtcatgatggtgctttctctctatggaaccgtaatggcgatgaagagttttggttgaccgcctatgcgacagatttcctgttccgcgcaactcaacaaggttacagcgttcctgctgatgccctgaagtcggccaatagtcgcctgctacgctatttacaggataaaagtgtcattactgatcgttacagtggttcccgcatcgaaacacaattttctgtgcaggcctatgcgggtttggtcttggcaagtcagcaaaaagcgccgttgagcggtctgagacagctttatgaacgccatcaacaggcaggaaatggtttatctctggttcagttgggcattgcactgaaaatgatgggggataatacccgtagtaatgaggctgttcgtttaggggttaataaggcacgccaatctggctatggattaggtgattatggcagtacaattcgtgataacgcattgattgtttctctactgacggagaacaaaatgttgcagaaagagcgtgatgaaaagctgctcgacttatccaatgaattgtcaactcgccattacttctcgacacaggaaagtaattcgctttatctggcggggcgttactttattgacgcttctgaacaatcttggaaggctgcgattaatcagcaaatgccaccccttaaccgtgatagtgcattgactgaaacattgacagcaaaacagatcctagaaggcatcgatatcagcaatcgtggtgacagcacattgtattcgcgtctgaatatggtgggatatccattggccaccccggaaccttcctcaaatgttttgaaaattaagcgtacttaccttgacttggagggtcactatttccctaccgagcgtatgagaagtggtgaaatggtggttgtgaaacttgaggttgatgcgacacagtcagtgccggatgcattagttgtggatctgctgccggcagggttggaaattgagaatcagaatctggcaagtagcagtgctagcttgagcgaaagtgctacggggttgcaggatattgtcgaaggcatgcaacaggcgaatatccgtcacatggaataccgcgatgatcgttttgtcgctgctgttgccgtccagcctcaccagaccgtgacactgttgtatcttgctcgtgcggttgcgccgggtgtctatcaggtgcccgcaccacaggtcgaatccatgtatgttcctcactggcgtgccgtgggtgaaacaaacgaaaaactggaagttgtccgctaatcactacccgcccctatccttagtgataggggctgttccctttcggatacggttttaatgagaagattgtcttcccgcatttacctgattgcgttggttattttattcacactccttgcggcagtgtggctggcagataaaatctggccgctgccattgcataatgtcaaaatggcgcgtgttgtggtgggagaagatggctcgccactgtggcgttttgccgacaatgaggggatctggcgttatcctgtcactttggagcaggtttctcctgaatatattcaggcattgctgacctacgaagatcgctggttttacaaacatccgggcatcaatcctgtttctttgctgagggcggcatggcaggacatccgcgcaggaaaaattgtgtcggggggcagcacaatctccatgcaagtggctcgattgattgatccacatccgcgcaccttcaccggaaaattcaggcagatttggcgcacgttgcaacttgagtggcattactcaaaagatcaaattttggagatgtatctgaaccgtgcgccattcggtggtacgttgcagggtgttggagcagcaagctgggcgtatctgggcaagccgccgtcagaactttcgccgggtgaatcggcattattggcggtattaccacaagctcccagtcgcttaaggccagatcgctacccagaacgtgcgcaggctgctcgagacaaagtattacagcgtctgaagcaatacaatgtctggccagcggaaaacgtcgctgatatcaaagaagaaaatgtatggctggctcctcgtcaggttcctcaccttgcgcctttactggcaaggcgagtggcaaacggaaacccgcaggaagtgatccagacaaccattgatacaggcttacagcgccaactggaggatatggttctcaattggaaataccaactggcggacaaaacatcgattggggtgttggttgttgatcatacggatatggccgttaaggcctatattggttcggtagatcttcaggatgacagtcgttttgggcatgtggatatgataagcgcatggcgttcacctggctccacgctcaaaccttttttatatgccatggcgctggatgatggattgattcacggggaatccttattgcaggatgttccccgccgttttaatgattaccgtccgggaaattttgacagtggttttaatgggcctgtcagtgccagtgaagcgctaacgcggtcgttgaatttgccagcggtacaacttctcgaatcttatggtgctaagcggttcaccgctaatttgcgtaatgtgggaatggtactgcgttttccgcttggcagtgagccgaacttatcgcttattttgggaggaacggcggctcggatggatgaactggtatctgtttacagcgcttttgcccgtcaggggaaagtttcgccgttgcgttttacaccacagcagagaattcgtgacagacaattattctcagcaggggcagcttggattgtcaggaggatcatggcaggtgaaggacgaccaaaacctgatgatagcctgtctgccgaagtccctttggcgtggaaaacaggtacgagttacggttatcgcgatgcatgggcgattggcctgaatgcccgttataccataggcgtgtgggtcggcaggccagatggcacgcccgtagtagggcaatttggttatgctacggcgatccccattatgaaccagatcaacgggctgttaatggaaaatttacgctatagctcacagcgtattcctgtcgatccgcgaccgataagtgtcagtcaagcgaccatttgctggccgagcgggacaatgctgactaaagaaataatagctaaagatatcagcaattgccgtcagcgtcgcttaagctggattttggataatacaatcccgccaacgctgtctgccattgggcaggaagggacttcgggtattaacgaacggatatggatagataaaaatggtctacgcgttgcttctgattgtcctgatgcccggcctgaaaccgtagctttgtggccgattactctggaagcatggctaccggcaaaagaacgtcggtcgaatcggttgccaccgattaatccccaatgccctcctctgaaaacggatgaggctcccttactcattgtgggagttcgcgaaggggatattctgaaacgccttccgggcaaaaatacgctggacttacggataacaacgcaggggggtaacggtcagcaatggtggtttttgaatggtgaacaagtttctgtgacaaaaaataaccagtcgtgggtaaaaaccttatcacaaccagggaaataccagcttagtgttttagatttgagtgggcagatcagcgcaatcaattttgtttttaagtgattgatggtgtgtttgtggccttgattaaaggcatattttgtttttaaa

SEQ ID NO: 16836 - DNA, 16859 bp, Xenorhabdus bovienii
cactgcttttttaaagaattatgcacaaaaacgtttgtttgtttggcttgtaatcgctttgccgattttatcggcaaagcgggttgaaattatccgccaagaagatgttgcagtagtacaccgttaagcatcgcacgtttcgtcaaggcgaatgcaccaatcgcagaacaatgatttagctcagaaactaccaccggaagatcttcacggaatgcttttaacacctgcgtattgatgcaactttgaattgccgggagtaaaacctgctctgcttcggtaatatcaccggcaatgacgattttctggggattaaataaattaatcgcaatcgagatccctttgccaagatagtgccctacttgtctgataacttctactgccagtggatcaccttcattggctgcgaggcagatcgcatggatattgcaattattcaaggctagctggcttggaaaaccctgtcgtaattgatgttgaactctggtttctatcgctgaattggatacgatcgtttccagacagccaaaattaccgcaatggcagcgttcgccaagtggctcgatctggatgtggcctatttcacccagattgccacgtttgttgcgcagaatattcttattgatgatgactcctgctcccgtgccacgatgaatacgtaccagaagtgagtcttcacaattgcgggttgccccgaagtaatgttcagccagtgcaaggctgcgaatatcatgaccaacaaagcaagagatattgaaatgattgttgaggcttttgaccagtggccagttatccaccttgatgtgaggcatatagcgaatgacaccttcatcgggatcaaccagaccgggcagaatgactgaaatcgcgatcagttcacggagccgccgctgatttttctcgatgaaatcttcaatggcggagataatccggttttcgacttcctgttgcgtattctctggaactgaatagtgctgttccactagcgtcttaccgctcatattaaatagcgccaccgtggcgtcatggcggccaagcctaactccgatggtatggaagtggtgagtttcggtgatgattgagatcgcgcgccgccctccggtggaagcctgctgctcgacttcttttatcaagccccgttccagtaactgacgagtaatcttggttacgctggcgggagcaagctggctttcttctgcaatctggatgcgggatattggcccatgttggtctatcagccgatagaccacggcgccattaagctgtttgaccagatcaatattaccgatttgcttctgtgcattatgattactcatcaggcgatatactcacgatagttcgatttcatttccattaacgatggttttgcagatgttgaaatcatgagtaaatgcagtcagattcgcgaccttaccgggttcaatcgtaccgaggcgtttatcaacaccgattgctcgggctggataaagcgtcaccatccgcaatgtttcatccaaagcaataccaacatattcaacactattcttgacgctctcaatcatcgtgattgatgaaccgctcagtgtgccattctcatcaacacataagccatttcgatagtatattgttttattggcaaaggtaaattgttctagtgtattggttttcgggtcaaggccagcagggacgatggcatccgtcactaagattaatttgtcggtttttaatcgcttggagttgcggatattcggccatgaaacatgcgttccgtcacagataatgccggcatagacctcggaagaatcatagatggcactgattagccctggctggcggccggaaatggcgggcatggcgttatataagtgggtggaaaaagagataccctgctggaagccgtggcgagcctcttcataggttgcgttggaatggccagcagaaacaataatgccggcttcggtcaactgatgaatatacttactttccactatttcaggagcgagtgtgattttagtgatcacatcggcattaatacacagatagttgaccatttcggaggttggcttgcgtatataggctggattgtgagtccctttttttatgggattaatataaggtccttccagatgcagccccagcgcctgattaggatgctttgtcagataggaacgcatcacttcgattgccgttatcatcaattcatcgggactagtgatcaacgtcggcaggaaactggtacaaccgtagcgctgattggttttctgcatgatattcagcgtattttctgtaagattttccagtcgctcattaaattgaactcccccacagccattgacttgcaggtcaataaaccctggagagaggtttgcaccgtgcaaatcatgcttttcgatggatttcggtaattcattttctggacaaacttgctgaatcaacccatctgcgatgatcacggcatgtttttcaagtcgctcataccctgtatagatgatgcagtttgttaaagcgtacattctggcctcctgaataaatactaactagcgaattcactgaaaatatccgcctctaactggcgaaaatatttcactgtcttcactttcaattccattgttgcgggttcatcacagacaataatcgatttagggtgcatttgtaggcagcttactgtccacatatggttgatattgccttctattgcagcttgcagggccagtgctttgttcattcctgttgccagaatcatgacttcttcggcatccatcaaagttcctacaccgaccgttaatgcatatttcggaacctgttccacatcattattgaaaaaacgggagtttgcggttcgtgtttcaatggtcaacgttttgatacgagtgcgtgaagaaagggaggaagcgggttcattaaaggcaatatgaccatcattaccaactcctcccatgaacagatgaattttcccataagccttgatcttattttcataacgcaggcattcagcgtcaatgtctgctgcattgccgttgagtaaattgatattttcttttggaatatcaatgtggtcaaagaaattttgctgcatgaacgtatggtagctctggggatgatcttcaggaataccgacgtactcatccatattaaatgtcactacgtgcctgaaactgacttttcccgcctgatacagagcaataagttctctataggtggtcagtggagtactgccagtgggtaggccaagcacgaaaggatgctctgcggttggattgaatgcattgattttactaacaatatagtgagcagaccatcgtccgacatcgcttgcattagttagggggatcagcctcatgattacctcttaaatcatttgttattaattatgggggcgactggatagccgtagggcaaaagcacctatcatacctgttctgtcgacgggtttgacccatttaatacctcgaagatatttttaatcataaaataagttttgtgtgccagctagataattgattgaaaatttatcaaatgtggtgacgtttatcacatatcagaaggatttaatttgcgatacaaaataatctttttagactaaaaaatgttttaacaagaaatacataagtgatgtcatcagatcatgaattaacaaaaagactccattaacggagcttcaagggggcaagaatgaacattctaagctacttacaacgtattggtcgggcattgatggtgcccgttgcgacattgccggcagcggcaatattggtagggatagggtactggatcgatccgacgggttggggcgctgataatgcgctggcagcactgcttatcacatccggcaatgccatccttaacaatatggggatgttgttcgcaattgggttagcctatggcatgtcgaaggataaagatggcgctgctgcactggcaggtttaatcgggtttattgtcgtcataaacctgtgtgctcccgcgtctatcgcaatgattaaaagtatgccgattgatgaagtaccaaaagcattcgggaagatcaataaccagtttgtcgggattttggttggggtactttctgctgaactgtacaaccgctacagtagcgtcgagttaccacaggcgctgtcattctttagtggtcgccgtttagtacctatcttaaattctttcctgatgattttggtatcttttatcctgatgttcatttggccggtagtttatgactggctggtggcatttggtgaaagcatcatgaatcttgggtcatcaggggcgggtctttatgcattctttaaccgtctgttgatacccgttggtctgcatcatgcacttaactcagtattctggtttgatgttgccggcatcaatgatattcctaacttcctcggtggtcagaaatcgattgaggctggtacggccattacgggtatcaccgggcgttatcaggcaggtttcttccccattatgatgtttggattaccgggagccgcattggcgatttaccactgcgcacgtcctgaaaacaaagctaaagttgctggtatcatgatggcaggcgctattgcggctttcttcacgggggtgactgagccacttgaattctctttcatgtttgtcgcacctgtgctttatgttttgcacgccattttaacggggatttctgtttatatcgcggccacaatggagtggattgcaggtttcggttttagtgccggattcgtcgacatgttgctctcctcgcgcaacccgctggcggttaagtggtacatgctgatcccacaaggtttggtattcttctgcctttactatgttgtattccgtttcaccatcaaaaaattcaacctgatgacaccggggcgtgaattatcagccacggatgaaaccgatggttatgatgttgatacggcaaaacaaggaaagaatgtagtaaataacattcaggaagaagcacgtcagtacattgccgcagtagggggatctgataatttgacagggattgattcctgtatcagccgtttacgtttatcagtcaaagactcaggattggtcaataatagactgaccagacatcttggtgcctcgggaattatccgtctgaataaacagaacgcccaaatcatagttggaacccgcgcagagttgattgccagtgccatgaaagaagtattggcaaaaggcccggtagcggcaatcacagaaactcaatactctgagtctgatgttcagacaaaggaagatagccagcaaacaggcattccaatcttgactttaatcgctcctgttacaggggaattggtcaaactggaagatgtccctgatgaagccttttccagcaagttggtaggggatggtattgcgattaagccgacgtcggacactgttttagctcccattgacggtacggtcgtgaaaattttcgatactaatcatgcagtatgtattgcggcagataatggtgttgaagtcattgttcatataggtattgataccgtcactcttaatggcagagggtttgagcgtctgattgaagaaggtgtgaaagttaaagcgggtgagccgctattgaagctggatcttgattacttgaacacccatgctaaatcgatgatcagtcctgtgattatcagcaatattgatgattattttggcattagaatgattgcgaaagatgctgttgttgctaaagaatcagatttatttcaggtgatataatgaatttaagataatcatatcgcttaagttttaagaataactcggatttgtatttgatattctttttgtatgagcgaatgtggattaagccgtcactaacatcttccttttcaaaagtgaggtattcagtggtggcttatcttttttaaagcttcacctgaacatccaacatctgtacgctacggcattgtgagagccttgtttatatatccctttatcttttgcattgtagctttgttggctgtattccttcatcccagccaaaccgttatctatgctcccggggattcgttctcttaccgtcgcgctgcaactcgaaatccattgagtatagaaatgataaacaaaagtttaaatatattatcgtgattgtttgttttatttttcatttaattattcattaatttatttttgtcattctttctattaagaataatttattataaatataattttggaatttatttatttgattaacattaatgtgtgatttgcatcaactttttttaaaaaaagtatttttttatttgaatttcacattgcttgctgtagtttatttttaatgcgtttatgtttgattcttgttgcttatatttttctatatttaattctatttcagtatatattattacatttagtttatatctaataattaggtaggaggaattatgtctgaatttctttctgaagaaaaaatggggcagtatttaaaaagctgggatgataacggttatatagttatagaatcagcggttagtagagagcaaacccagaaaacagtcgatgctatattctattttttggaaatggataaaaatgatcccgttaatttttataacaccgatatccgttctcgctcaggaattgatgaaatggggcgtattcctttttatcatcatcagaccttgtgggataatcggcaaagtcaaataatttactctgtatatgaaagaatttttggtataaaagaactattggtgagtattgatagggtcaatatgaatccccctgttaatgatgattggaaatacgaaggttttattcattgggatattgatgtttcaaaacgcccgttagagagtaaaatacaaggcctattgagcctaactgacgatgatggcaattctggtggatttcaatgtgtaccggggtttcataaagtaatctatgaatggctgtcgaaacaaccggaaggatataatagccgattccctgatacgacaggaatgaaaattgtatctatcccattgaaagccggggattatgttatctttcatggcgcgctgcctcatggaaataaacctaatatttcggataatccaagattagctcaatatttttgttgttttccacggactgatcttactgagcagcaaatcgcagaacgaattgctgcttataaacaaggattaccgactacatctataacgggtaaacttttcccggttaaaaaagttaatcaacaaggtacatccagcataaatttaacagagctgggtgaattattgttggggagttagcatattgtctttaaggtgttattatggagaaaataatgcatcacggagtgaataatattgatgtttcaattattcttcctaggtataatgaaagttatttagttatagaaaaaaccatacagcgcattaagaatattcaagaggtattgaaagtacaggtcattataattaatgattcaaataaaaataatttccatgatatagatattatcaaggtaaaaaaacagtaccctgatgttgaggttgtctctaactgtggtaactatggaaaaggatatagtataaggcgaggcgttgatttagcaaaaggaagatatattttttatactgatattgattttccaataaaggagagtgatttttttagtgcttatcaaaaaattgaaacttctaatgttgatttaattattggggagcgattctcaaagaataaatcaaaagcgaatttatatagaaaaataaccagtaagttttttttgaaaattgttaatttactattaaactgtaaagtttctgattctcagtgcccatttaagatgttaaggtctgatgtagcaaaggaagtattttctaagcaaaagattaaggggtatgcatttgatgctgaaattatttaccttacaaatagactctctaagaaactatatcaattccctgttatttgggaggatacaagagagaactggagttttatgaggacgtttattaattatagtattatgattttaggaattttctctattaaaatttattggattatcaatgatcctaaaattatctgagtctattaatatacccaatgaatttcatgtttcaatgcggcggcaacttgaaagatgaagggtttaaataagtagttcgttattgagcttttactgctggtttatcatttctttacttaattataaattaccttaattggtatgaagtctggaggagtaatggagatttttaacataaaagccattttatttgatatggatggcactttagttcaatcactttcagaagttgaagttgtttggtctaaatggtgcgaaatgcacaacatatctatcaaagatgtattagatatttgccatggtgttcgctccaaggatgttattttatccattgctccatatttgaatgtggaagaacaaattaagttattagatgatttagaaattaaatattctgctactgccaaggcgttaccgggggcaaaagaatttctgctgtctttaggcacttgtccgtggtctgtcgtcacttctgccagccaacgagttgcatatcataggatggcgatttgtggtcttaagataccagacttcataattggttctgatgatgtgctgaatggcaagccctatcctgatccctatcttatggcagcagaacgtttgaatattgcggctgaagattgtttagtttttgaagatgctcatgctggggtgcaaagcgcattagcagcagagtgtaaggtcatacagattggtggaaaagaaaaaatgtttgattcagttataggtctaattaatgactggaatgaaattaagattgctgagatgggaattaattctttcagagtcagtatgaacttataagcgtaaatttgaaactatttactgttaaatatttataagtaactgaaacgtaattactttatttaaaatattatagttgagatgcttaatgaataatgttatttctactagagttgttttcttggcagcaggtatgggaattgctgcgtgggctcctcttatacccttggtaaaggctgatttaaatattgatgcaggagagttaggttttttattactttttcttggtttcggttcaattgtttcgatgccgattacaggatttcttaccactttatttggttgtcgtaaggttattatatcttcaggaatttttgctattgtttctttaccgattttaatattggcgcctaatgtcactcaactgggttttatgctttttatatttggtgcatccattggtacagtggatgttgcaatgaatattcaggcggttgaggtcgaaaaaaatacaaatagaaatttaatgtcaggatttcatggattttttagtttaggggggatctttggtgctgctggtgtatctatattactttatttgaatttctcagcgcttgcagcatgcttaattatatcctttatattgtctgtgttatttttgttttctttttctggactcattagtcgtcataaaaatcatggggatagcgatagtaaaaaaattgtttttcctcggggaatcattattgtagcgagtttgctttgttttttaatgggaattattgaaggttctgtaattgactggagtggagtatttttagttagtgagcgtaatattgatatttcattcagtggatttgggtatgctgcctttgcagcagcgatgacaataggacgattcatgggagatcgggttatatcaaaaataggaagggggaaagtattttttgctggtacactcagtatcttcattggatttcttatcgttgttaatgtaggaactctcaatctatctatgattgggtttttctttattgggttgggatcatcaaatattgttccaatcttatgttcaatatctggaactcaaaaagtcatgttgcctagccatgctgtcgcttctattgtcacatttgggtattttggaattatgattgggccagctttaatagggtttattgcccagagttctggtctggagacagcattttatatattagctattggtgcattaattatggtagcaaatacaaaattgataaagaaacattgaaataatctgattgattagttatgtgatttattttataggattaattttatctattttaaaaatattaaggtgtaaaattatgaatttcccacaatggccaagttttacagaaaaaacactgaaagatattcaagaacccctgttatctggtcaagtaaattactggactggaaaaaaaggcatggaatttgaaaataaatttgcgcattggattggcgcagaaatggcaatttcatgtaattccgggacttctgccgtaaatattgctgttggcgcattaaatattggccccggcgatgaagttatcgtgccttcttacactttcattgcaacctcctttgctgttttacaatgcggtgccattcctgttttttgtgatacgacagaagagcacaccattgatcccacgaagatagaagcactgattacaccgcgcacgaaagcaattattgttgtgcatctttatggtgtcgtatctgatatggatccaatcatggagattgcccgccagcataacctcaaagtgatcgaagatagcgcacaatgtctcggcggaaaatataaaggaaaatcggctggcacaattggggatatcggtacgtttagcttctgccagtcaaaacattttactacagggggagagggcggcatggtcgtgaccaacaatactgaaataggttgggaatgccgggcttatcgtgatcatgggtttgatgtgagaagaaaatttgaccttctcgctttagaagaagtttcgtggcatgtgcataatcgaatcggttacaattaccgtatgactgaaattcaatcgattatcggtctgaacgagttagagcgatttgatgattggaatatgaacaatcgcaagcgatatgcgaagatctacgatgaaaaatttgcggatatcgacttgatccacggcctgccattgaataatgaagacagatgcaatgcgtactggttatatcccattgtttttgatcttgccaaactggattgtacggctgaaatcatcctgagtgatttgaaaaagatagggattccggcatttaaaatccagtggcctgaagcctatggcgaaaaagtattcagagagctacgtgggtttggttcagctaatttcccttttcattcgaaagaatacacatcacctgaatctgttaattaccgtgatgtcgtctgtgaaactgcacgttctttattgccgagaacaatcagcctgtatctgcaccctacttgggatgaagagcatattgtttattgtgcggatcaactgatcgccgtattgaacagtcatcgtgtgagttgattttattgatgagcgttaaaccaacagcttattttgttgctcaaaaatacgtaacaaatgttgaactaaagtaagattttctctcaattgtcgcgggaaggagtctgtcttcccgcttttccgcattaactttgccctgaactcccctttcccactaacaaagagttgtttctcggttcagcttattagaatatagaaggttatattgaagcgttttttgcattgaggaataacacgatgagtgaggcagatgcccgcccgaccaactttattcgtcagattattgacgaagatctggcaaccggtaaacatacatccgtacatacccgtttcccgcctgaacctaacggctatctgcatatcggccatgcgaagtcgatctgcctgaatttcggcatcgcgcaagactatcaggggcaatgcaacctgcgttttgacgatacaaacccggttaaggaagatatcgaatatgttgaatccattaaaacggacgtacagtggctgggtttccagtggagtgacaatattcgctactcttctgactatttcgatacgctgcatcaatacgccattgaattgatcaataaagatttggcctatgtggatgaactcagccctgaacagatccgcgaataccgtggaacgctgaaagagccgggcaaaaacagtccttaccgtgatcgcagtgtggaagaaaacctggctctgtttgaaaaaatgcgtgccggtgaatttgctgaaggtaaagcgtgtctgcgtgccaaaattgatatggcatctccattcatcgtgatgcgtgatccggtgatttatcgcatcaaatttgccgagcatcaccagtccggcaataaatggtgcatctacccgatgtacgattttacccactgtatttccgatgcgctggaagggatcacccattcaatatgtacattggagttccaggataaccgtcgcctgtatgactgggtattggataacattacgattgcctgtcatccgcgtcagtacgagttttctcgcctgaatctggaatacacggtgatgtccaagcgtaaactcaaccaattggtgaccgaaaatattgtcaatggttgggatgatccacgtatgccaaccatttccggcctgcgccgccgtggttataccgctgcggctatccgtgaattctgccgccgtattggtgttaccaaacaggataacaacgtcgaaatagccgcattggaatcttgtatccgggatgatttgaacgaaaattcaccacgggcgatggcggttcttgatccggttaaactggtgattgagaatatgccggaaggtgaagtgatcctgacgatgccgaaccatcctaacaagccagaaatgggcagccgcgaagtcccattcagccgtgaggtttatattgaccgtgccgatttccgcgaagaagctaaccgtcagtacaaacgtctggtgctcggcaaagaagtgcgcctgcgtaatgcttatgtgattaaggcagagcgtgttgaaaaagatgcggaaggcaatatcactaccatttactgccactatgatgagcagacactgaacaaagatccggctgacggccgcaaggtcaaaggtgtgattcactgggtgagtgcggtacatgccgtgccagcggaattctatttgtatgaccgtttgttcagtgtgccaaacccaggggcggaagatgatttcctatccactatcaattcagaatcgttggtcgtgcgtaaaggttttgtcgagccagggctggtgaatgcacagccagaaagaacttatcagttcgaacgtgaaggttatttctgtgctgatagcggcctctccagtgcagaacatctggtatttaaccgcacagttggcttgcgtgatacttggacaaagatctctcaggaataaccagagctaatttttataaccaaaacattaaaaaggcgcgattattatcgcgctttttttatgtttaaaatatttgtaatgaaaattgactctcccgactaaagattaaaaattgccttatagtcttattttatgtagggttattcgctattgataactggtggtacaaaaaatagcctgttcttctgggcggaaaaaatattacatttactgtaactatgccaattagcatcttttatggactgtcgtcgctgtttctgcgtttgttatagcgcggtattgactgacagaagcagcattacccagctatacccgataaatctgaagttgcagggtataaaagaataataagttcagacgaggtcattcatgaaaagcgttaaattgcgtaccttggcagcactcatcacgacagttggattaatgggctgtgttcatgcagaaatgacgtcacagcagatagtggattcgcttagtcaattaaaagtgaatttcaaaattaaggataatcaagcaggagcacatggaactgattgtgccattttaggcgcggacggagcttcctgtaatcgggttcatatcacattagctaatggcaatcaggcgatcgactcttctgactgggcgatctattttcacaatattcgccagatcctgaaagtcgatcatgagcaatacaaaatcacgcatatcacgggtgacttacataagctggagccgacggaaaaattcacaggtatcaaggccaatgaaaaaatcttgttaccgatctttggagaatactggcagatttacagtacagattttatgccacgctggtatgccacttccggcgatgcgatgcctaaaatactggcgaataccgatacggaagatctgagtgcgtttttatctgattttacaggtgatcagtggaaacgtactacgtcagataacaatatccagatgactccggaaactcgttttgtaaaaaaccagcagatggtaaaaatcagcgaggataaactgcgtggacaggttattccgacgcccaaaatgctgactatccattcacaagatgtgaacctatcccgtggtgtgaaactggagttgggtgggttgagcaacgcatcaatcgacgttattcgagaacgctttgcctctcacaatatcaagctaacggataatggttatcggattgcggcacagatcaacgcaaacaaatttacgggcaactggcgagtacaaggagcttattcgctgaatatcacaactcaaggaacgcaaatcgtcgcttttgatcaatccggtgtgttttatggcctgcaatcattgttatctctgctccctgccaatggtgatcctaccattgccacactaacggcaaaagacgcgcctaggttcgaatatcgaggcatatttttggatgttgggcgtaacttccacagtaaggaagctgtcctgcgtctgctcgatcaaatgtccagttataaactgaacaaattccatttccacttgagcgatgatgagggctggcgtctggaaatccccggtctgccggagctgactgaagtcgggagcaaacgctgccatgatctgagtgaaactcaatgtttgttgccgcaattaggatcagggcctgatagcaataatatgggaagtggctattttagtcgtcaggattacattgatatcttgaaatatgccaaagcgcgccagatagaagtgatccccgagattgatacccctgctcacgctcgtgcagcggtcgtgtcgatggaagctcgttacaaaaatctgatggcgcaggggaaagagcaggaagccaatgaatatcgcctgcttgacccgactgataccacgaatgcgacatcagtacagctttacgatcgccgcagttatttaaatccgtgcatggattcctccaagcggtttgttgacaaaattatcagcgaaatcgctttaatgcacaaagaagcggaattgccgttgaagacatggcattttggtggtgatgaagcgaaaaacattcgtctgggggcggggtatcaggacaaagatggtccaatcgaaccgggcaaggggattatcaacaagaaaatagaagacaaaccatgggcaaaatctcaggcttgccagaaaatgatagcgcagggcattgttaaagatgttaatgaacttgacagccattttgctattgaagtcagcaagatcgtcaatactcatggtattgatacaatgcaggcatggcaggatggcttgaaacatgtgaagtcggcaaaagatttcgccaccaagcatgtggcagtgaatttctgggatacactttattggggaggctatgactccgccaatgattgggcgaataagggctatcgagtggtcgtttccagccctgattatgtctaccttgatatgccgtatgaagttagtccgaaagagcgcggctactattgggcaactcgcttcaatgatgaagcaaaaattttcagttttgcaccgaacaatatgccacaaaacgctgaaacatcggtggatcgcgatggcaaccacttcaatacccagagcaacaaacattggccgggggcttatgggctgtcagggcaatcatggagcgaaactatgcgcactgatgatcagatggaatacatgatttacccgcgcttgttgccgttggcggaacgtgcatggcaccaggcgagttgggaacagaattatcagcagggcagagaatacaagggtggggtaacacattatgttgataccaatgcgctcaacaatgactggatagattttgccaatttgatgggacaacatgaactggcgaaattggataaagctaacattgcgtatcggttgccagtacctgggggaaggattgtatccgggacgttggaagctaatatcgccttgccggggctagggattcagtattcgctggatggcggtaaaacatgggagatttacgatgacaggcagcgcccacatgtcagcagtaatgtgaaagtgcgctctgtcagtactgatggcaagcgttttagccgagatgaagaagtaaaaatcacgctctgatatttcttttaaaaagcagcctgccgattagcttgagctaatcggcagtagcttattcagactaaatgagacacagaagtggataattgtcataacttcttatcgtgtcgtgctttctcatcatgagttttcatcatgcatcgtgctatctttgcggcaatcaccagcagtacagtgaccatacaagtagagactatggtttgacagcttgatcccgtaacgttcagcgatatctttctggcgctcttcaataaactcatcactgaactcaatgactttaccgcagtcaaggcaaatcagatggtcatggtgatgctgttgagtgagttcaaaaaccgacttaccgccttcaaaattgtggcgtgtgacaatgccggcatcatcgaactggttcaacacgcgatagacagtggcgaggccaatctcttcaccgatatcaatcagttttttgtagagatcttccgcactgacatgatggcattctggatcctgtagcacttccagaattttcaggcgtggaagtgttactttaagtccagcatttttcaatgctttattgttgtcggtcatgcggattcagtcctgaactagtaagg

SEQ ID NO: 16837 - DNA, 22612 bp, Xenorhabdus bovienii
aaaaaaaatgataagttaatatctgtagatgttgagggagttaaatctatttttgatgataaaaaattccctatatatacgttatttcacagctatatagtaggggtagaagttcttatatttagaaaagaattttttggtgaagaatcatcctcaatatatcatggaaaaacagatagaataataaaaatatgccaaaaaatgtccatatctattgaaaataatatctcttatttttcgaataaatcaatatatatttttaaaaaatcaaaagaattgataaataaacttactgatgaagagataataaaatgacgtataagaatttcgttttatttaatgatattaaagaaataattaactccaaagaatacaattcagatataacatgcaacaataacattattaactatatacataaaaataaaatcactaaaaatatcaaagatgaaatatattataaagtatctttgaatggtgatatatatataattgaatttaatgaagaagatactatagatgaagctgtcattttacttgaagggatttttggttatcctcttacttataagaatagaaacaataaaaaatatgaggtcataaaaaacagtaaaaatccaaaatggttttttgaatcaaattattcacaaccagtacatacagatgaaggtcatgaaaaaaaacaaccaagtatacttgcactctattgtaaaacaatatcaaaaatcggaggaaataatatattggttgatacaaaatccatttataattttttattaaataaatatggttataaagtagaaatattattcaacaataaatgcattaacttaattaacaaaaatgaaaacttaacaaaaagcatactctcaacaataaaagaaaatattggaatatcattttctccattgatcaataattttaaatgcactcaagaagtttatgctatgctgaaagatataaataaattcatacatgataaggaaaatcagtatcgatttaagttaaaaaaaaatcagtgtgttattttcagtaattatctctacttgcattccaggactgagtttccaaaagactcaaatagaacattatataggatttggttttaggagattcagaatgaacttacttatagccgatgcattagaatacaaaggaaaaataaaatcttttgcctctggaaataaaaatttaattatatttctttgttttttatttattccagcgaaagcaagtggcattatttacgggttaatttatttttcacaatttgcagtaacacctaatacgcctatgcaatcattctatatttcgttaatacttttgttgatctatgttatttttcattcactacaacgaccattatttccggtcaaatattcaaatagtataatttcgtctttaatagataaaaaatcctttttcttattcagaataatattcttagcttacagtgctgttccgctatctattttcttttttattggattattatctaacgataaaagtagcatagaccatattacatcagtgttatttttagttacttcattttcttgcatcggttttttcttgtatgaattaagattattctcttttcttagtctatctgttatttttattttattttttatctttaaacatgggccattatataatatggcttatactgccattatcttattggtggctttgaatttgtttatcagaactaacgataatataagtcaccgaataacagaaaaatcttttttgccttcatttcttttatccccttactttataaatttattatactttataaaaaacaaaaaaatattcaccataaatttaattatctcagtgatactctcctatctggtttgctatattgcttatcagcaaacacccgatagaataatctatataacaataatatatctcagttttacactttatatattcaccctatttttctacaatatcattcacatagaaattaaacacctatcttatcttgttaatttctcatcaaaaagaaaatttattttcattaattacactctgtgtcttttattatttataatatgtggcctgtattatattataatgaccaaatcaactgcgatattaattttttattattcaggaatttactctttaacagcactaataaatttatcaagatcgcaatatacaaaattaatcaccctgtgtgttattgttttattttcttgtttaggaggatatatttatgcttaatattatcggattagatatttcagttggccataaaaaatattctctgatattaattgccagtttgatattgggataaatcgtattgtaggtgttaatggttctggaaaaaccacgtttctttcctgtatttctggtattaacaaaattgataaagggaaaataaaccttattaaagacaataaaaatcacccattcaagctacaaaagcagggtttttatctttctgatcatattgatttttatcattttcttaccggactggatatcataaaactcattaaacgttataaaaaaataaattgccatcatcagttagatgattatttaacaggatttggcatatccggttatctgaatactaaatttggtgatatgtcactgggaaccaaaaagaaactattactgacatcagcattaatgactgatgtcgatgtttacattttagatgaacccaccaatggccttgatgtgacatcaattagttttctaaaagaaaaattcaattctcttgctgaccagaaaattatcattttcagttcacatgacgaaaatttcttaaaagatctcaacatacatgattataaaatacatgaaaaccgtatttccaaaacgggaagttagcataacttatcgtggtcaataacgcttcgtcacgttattgaccttttttcatttgcagtaattcatcttctgacggcacatccggttgctcaataggaaataccggtaaagcattcaacagacgggaaccataacttttgctcagtaggcgccggtcataaatcaccacctcaccataacattcatgactgcggatcaatcttcccacttgctgaataaggctgaaagacgcactcggcaaactttgtacttcaaaagggtatcgctttagggatttcagccattcactttccgtaatgatgaccggattggtcacaggaggaaaagctattttatggatatgtacttgtgaaagataatcacctttcaagtccagtccttccgcgaatgactgcaatccaatcaacacgctgggctgcccttcatcaatacgtctgcaatgagtttccaccaatcgatagcgcggctgatcaccttgcaccaataacataagccgcaattctttcacgaaagtgagaaaaccttccattgcacgctggctactaaatagcaccaacattccccgataggctcccatcagtacctgcgaacgaaaataacgcgccatttcttcaagatgctgcatttcattttgaatagtgggttcctgcgtcatctggggaataataatacgtccctggcgtacatgttcgaaaggagatgacaaggtgataaagcgatcatcataattttcatgcagcccagtcagctcctgaatacgagagaagctatttagagaacgtaatgtcgctgatgtcaccacaacatggggaatattacgccataacaactgcgttaattgctcgctgactcgaatgcctgcacagtgaaaataaagatgcgattggtttttctcataacggcgagtgagccatttcgatattggtgcatgggaagattcttcctgtgatgctaaacgccacagtttcaccatattctcaaagtaacccgatgttcggctggtttgcagaatagcatgatgcaacctgacaatatcttgtttggctgtttgatcggtaagatcatttaaaatcgcttcagacaggccacgcaacccatcagtaagtttgaataattgctggcagcataacagcaaattttcaggtaattttcccagttcaaataaatattctgctgcttcacggcgttcgggcaataatacctgtgtgatatccgccagctccttaaaacattcacgaattttttcacaatgcgcctgcaaacgggtgatatttgccaaagctggcggtttggccgggcgaaattgaagcaagtattgctctacatggcgaacaaaggtatccaactgcccattaagttgaaataacgtgatttcgccttcaacttccagcgaatcccttgcaacatcaggaatatgatgcccttcatccaaaatcagcaacaggtttttcgcgtccggcaaaacggattcattttccagtgcagctatgaccagagaatgattggcaacaacaacatccgcattttcaatttcccgacgggcaaggaaaaatgggcaacgatggtaaaactggcaatttctcgccaaacaattcattttatcggtgctgatctttgcccacagcgaatccgataacgccagttgatgatggtcacgcagaccatcccaggcaaaagtggtgtaatcactgcgcagcctacggcacagttcccgctcttcactattggcgatttcagttttgtcttcgaccaaaagcatcagatcaatctgctccccctccgcagcacagatagcttccaaattgcgggggcaaacataccgcgcacggccaaaagccccggtgaatttcaggtcagggatgagcttgcgtaacaacggcaaatctttgctgtaaatctgatcttgcaaagcaacattggctgtactgaccactagcggctttttttccgcccgactgacggcaatacctgggatcaggtaagacagcgttttaccgaccccggtcggggcttctatcaccaaatgtcgtccctcttcatctgccagtgtctttgcaacctctgcaatcatctgacgctgaggctcgcgtggaatgaagccatcaatatggatggataatgccttataccattggctaatctgattttttattgaactggaaagtgccatgagttttgctacgtaaaattggagggctattctcccatagagcgaccctcagatcagctttatatcgctattattgggaacacgtttccagctttttcattggagaagcaagaaaatcggttattacttgtttggaatacagaagccgatatacttttggctttccgtgtcggctataaaccatgactagaagctatcactgagaaccacgacttaaaaatatagcttttaaaaacatagcggctaaaaattctgattaaaaatcttattgagaactaaagatgaaaaaaatcctgcttattatcatcgtgttattttccctcggctctattggcggtgtctttttggcagggctgaatatgtacactcgctcaacaactccggtagaagagccacagcagtcacagcaggaaaacgccccgatagggcaacaataaccgtcaatacatccgcttttattgcaatatccggcattgcaacatcatgtgagaaagctcatgaaaaatgaatattttgttagtccgcaatggttaaacgaccatctccatgatgagaatgtcgtcattgttgacgccagcgcccccatgcctacccaaactatcgattatcaccagttatggctagataaccatattccgggtgcccagttttttaacctggataaaatcgccaatctccagactaacctgccacatatgctgccagaaccggagattttccgtcaggccgttagcgcgatggggatcagtgaaaaccatctggtgataatttacgatcaggggaatatgttctctgccccacgagcatggtggactttcaagatctttggcactcgcaatatccgtatccttgaagggggtttacagggctggcagcaagtgggttattcaacggaatcaggtgaagttacccgtcagccccaaattttcaatagccaattcacccctgaaaaagtctgttctcaggaacagatccttgatgctctccataataaagcgccaatacagtttattgatgccagagccgaagaccgttttcaagctaaagtaccagaacctcgccccggtttgagaatggggcatatccccggctcaaaaaatgtcccgtggacagcattgattgataatggaagttataagtcaccagacgaaattgcagctatattcaaaaagcaaggcgttgatttaaaacagccaatgatgactagctgtggttctggaatgacagccgcagttttagtattagggctggatatgattggtcacaaagaagtgggattatacgatggctcttgggcagaatggggtgccgatgattctcttccgttagaaaaatagataaaacagcaaagggcatcaaaatatcatgccctttttcctatcaagcatatgaatcctactgcttttataaaacgattaattagaaattttatggtatacaaataggacaactatcgcacccacgactgcaatggcaaaacttcccagattaaatccatcaacttttcccatgccgaagaatgtactgatatatccgccaacgactgcaccaataattcctaaaatcaccgtcatgatgataccgctgctgttatcccccggcataacccacttcgcaataattccagcaattaagccaaagataacccatgacaggatacccatatacaacctccagaattgattagatgatttgcttaagaaccttagtataggctctaatagggttttactgtatatttctcttctatgccctaatttaagacactaaataaaagaattgcaaatagtaaaagaaaagatatttataagtcattagccatatttatataaaaattaacattaaaaatcagaatccattaatgaaatttaaaagttaatttttccaaatgaataattatcacaggtcagttagcaaaatatttttcagtataatgggaaatattcggacaatataataaagatgaaagggatatagcagataatttaatagcggctgggtgagtcccagccgctacgttctctcaatttatagcaataatcatgcttctgcagctgaagagataatatttgagatagcagcagacgttttcaatgctctaatctgcataaataactcatcggcttcatcatactctttacgtagatagccaagccactgcttgatgcgggcaacgtgatacatgcctgtattaccccgcttttccagataagtatatttttgcaataactgaagcacaccattccacggcagtcttggttcgttatatttaataacacgactcaagtttggcacattcagtgcgccacggcctatcatcaccgcatcacatcccgtcaccttcatgcactcctgagcactgtgccaatcccagatttcaccgttagcaatcactggaatggcgaggcgacgccggatttcaccaatcgcctgccagtctatgcgttctgctttatagccatcttctttagtacgcccatgcaccaccagttcggtcgcacccgcctgctgaacggcatccgcaatttcaaacttatgatcaccggtatcccatcccagacgcacttttaccgtaaccggtaactcttcaggtaccgcgtcccgcatcgctttggcaccacggtagatgagttcaggatctttcaataatgtggcccccccaccgctaccatttacggttttagaagggcagccgcagtttaaatcaacgccccatgagcccaattcaactgccctgacagcattttcggccagccattctggatattgccccagaagctgcaccctgacgggtgttcctgatggtgtccggctctggtgctccagttcaggacacaaccggtaaaaggatttcaccggcagcagactgtccaccacacgtagaaattccgtgatacagaggtcataatcgttgacctcactcaacagttccctgaccagatgatccagaacaccttccatcggggccagtaaaacgcgcatggattattttcccgatacggctagtttgctttggatgaagtacgcggccagccctgtcgcgatggtgcacctttactacgcggacgatcactgttttgtttggcactgccttggctagaacggttctggctggaacggctcggcttagtactaccctgattggaagggctttgtctgccgttgccacgctgactgccacgggaattacttccgttcagaatgggctcagctttaatggaaggatcagggtcataacccgaaatcgcaatacgtggaatttcacgcttcagcagtcgttcaatatcgtgcaggagtttgtgctcatcgacacaaaccagcgatattgcctgtcctgtcgcttccgcacggccagtacgaccaatacgatgtacgtaatcttccgcaacattaggcaattcaaagttaacgacgtggggcagctgatcgatatccaatccacgggcagcaatatctgtcgccaccagcgcgcgtatccggcctgacttgaaatcggccagcgcacgggttctggcaccctggcttttattaccatgaatcgcggcagcagtgacaccatcttgactgagctgttccgccagacggtttgcaccatgtttggtgcgggtaaagaccaatacttgctgccagttctggttgcctatcatatgagagagcaattctcccttacgttttttatccacaaaatgaacagcttgatcgatttgttcagaagccgaattacgacgggcaacttctatgctcaccggatcacgcagcagtttattggcaaggctcttgatatcatcggaaaaggtcgccgaaaacagtaaattctggcgttttgcgggcaatttgctcaatacccgacgaatgtcatgaataaagcccatgtccaacatgcggtcggcttcatccaaaataaggatttcaacatgggataagtccaccgcattctggtgttctaaatccaacagacgccccggagttgccacgagaatatcgacaccaccacgtaatttcatcatttgtggattaatgctgacaccaccaaatacaaccagtgaacgcaatctgagatatttactgtaattgcatacattttcacccacttgagccgccagctcacgggtcggtgtcaaaatcagcgccctgaccggacgacgaccttttgcctgagccggagattcactcagtaattgcaaaattggcaaagtaaaccctgccgttttccccgttcccgtctgggcactagccaaaagatctttaccggacaacacaacaggtatggcttgctgctgaataggggtgggttccacgtaaccttgttcttcaacggcacgtaaaatatcagccttcaagccgagtgactcaaaattcataaataagaaatgctccagacttcaccattcctgaaacccgttcaggagcagttttatgggaagaaaacagacgcgataaatcgcaaagaaattacacaaactgcaatgcatcataagctggcattataacagatatgtttttctaaacagcatagaagaaaagaataattgacttttatatgctaataaacgtgcctattggcagaaaacgtttgcaggaaatgacaaaaaataggcatattatttttttttggtggcgatttaacgtagatttatgccagctttacatcaggttactttagttttaaagttaatcatatgattgatatattgatggcattttcgaaaattctttgtaacaggataccgcataacatggcagctaaaacgactcaaacatcgcgaggcgaacaggccaaacagcaacttattgaatcagcgatagaaattttcgggaagtccggtctggaaggagcgaccacccgtaatattgcccagcacgcaaaacagaatatcgccgctatttcttattatttcggctctaaagaagggctataccttgctgtcgcacaatttattgccgataagctaaaatcggaattttccccactcgttgaagcaattgaccgtttttttgtcgaaacttctcagccttatccacaagcgcagatactggcatttatccatgaaggaatgacgaggtataactgtctgattttcgaaacaagcagcatcaatctcagccgaatcatgtcacatgagcagttgacgcccacagcggcttacagcgttatccatgagcaggggcttgccccggtttattcccgtctgaataaactcatcgccaattatatcggcgcggatgaatgccagatttcaacacagatccacacacatgccctgttgggggaaattctttctttccgtctggcacgagaagcgttactacgccaaacgggttgggacaatcttggcaccaaagaatacgaattaatcaatcaagtgttatctcaacacatcactttattgcttaacgggttacggcagaagtaactcacccaacgccatacaggctgaaaattaaaaattgaataacgcataagggatggtatgaacagtaaaaagtttgctcttttcctattagcgatcatcgttgttatcggagctattgtcggaattgattattatcaggaacaaaatgacaaggaattaatgctgtatggcaatgttgatgtcagaaccgtcaatcttggctttcgagtcgcgggtaagctggcagccttgcaagtagatgaaggcgatgcaatcactgcgggtcaggcactcggccaactcgacaatgcccccttcatcaatgccctgaaccaggcgaaagcaacccgtgacgccgccaaagcaactcttgccaaaaccgaagccggttatcgcactgaagaaattgctcaagtacgtgccgagaccacgcaaaaagaatccgcattccgcttcgctgatagcttcctgaaacgtcaacaggggttatggcaacgtaaaatgatttccgataacgagctggacaatgccaaaaccggccaacatcagacgctggcggcctatcaagcggcaaaagataagttacgtcagtttgaggcgggttatcgtaaagaggaaattgccgccgccaaagcgcaactggcacaagcagaagctgccgtggcacaggcagagcttaattcacaggatacgcaactgacttcaccgtcagcgggtgtcattcttacccgagccatcgaacccggcacgatgctggcagccggaaacaccgtctttacactctcgctgaccaaacctgtctggatcagagcgtatattgatgaacccaatctgaatcaagcgatagcagggcgcgaaatccaaatttataccgatgggcggaaaaatcagccctatcacggcaaaatcggctttgtttctccaacggctgaattcacgcccaaaaatgtcgaaacacctgacttaagaaccgatttggtctatcggctgcgcattattgtcaacgatcccgatgaagggctaaaacagggaatgcctgtcactctgcgttttactaattcaaataagtaaggtgcgaatatgaccagttcggcttacacgataatactgaacggcgtagagaaaacgtttccagggttggaaattcctgccgtatcgcacttgaatgcagaaattcaagggggatcagtcaccggtcttgtcgggccggacggtgctggaaaaaccacgctgattcggatgctggcagggctattgaagcccaataacggcaatattaaaatcatggggcttgatcccatcaaagacagcgttgaagtgcgttctgaactgggctatatgccgcagaagttcggtctgtatgaagatttaaccgtgctggaaaatctcaatttatacgcagagctgcggggtgtgcttcgcgaagagcgcaaggccacttttcaaaaactactgactttcacagatttaacccatttcaccgggcggctggcgggaaaattgtccggaggcatgaaacagaaactggggcttgcctgtacgctattgggaagcccgaaagttttgctgcttgatgagccgggagtgggtgttgatcccattgcccgtcaggaattatggcagatggtgcacgaactcgcttccgacggaatgttgattctgtggagcacgtcttatttagatgaagcagagctgtgccgtgatgttttactgctgaaccgtggtgaattgctctatcgcggtcagccgcagaaattgacccagaatattgtcggacgatcttttctactcgatgtcaaacaaggttcccgccgtaaaatcctgcaacatgcgcttacgctgccacaagtgacggatggagtgattcagggaagatctgtgcgtctgatcttaaaagctggtgtagaccaaagcgatctactccagcaaatagggctgcctgatgccaagctatttgacgccgaacctcgcttcgaagatgcctttatcgatctactgggtggcggcccttcccatcgctctgcactggcagaaatcatgccgcagataccgaccaatccgacggaaaccgttatagaagcccgtagcctgaccaaaaaatttggtgattttgcagcaactgatcatgtggattttcaggtgaagcgcggggaaatttttggcttgctcgggcctaatggtgctggaaaatcgacaaccttcaagatgatgtgtgggctgatcatccccacttcgggcaatgcgctggttctggatatggatttaaaaaccagttcaggcaaagctcgccagcgtctcggttatatggcacagaaattttccctctatggcaatctgaccgttgcacagaatcttaagttcttctccggtgtttacgggctgaaaggccgccatcagcgggagaaaatggctgatatggtcaatgcctttaatctcgaaccgatcttgcatcaaaccaccgacagccttccgctcggctttaaacagcgtcttgcccttgcctgcgccttgatgcacgaacccgatattctgtttttggatgagccaacgtcgggcgtcgatccactgactcgccgcgagttttggctacatatcaacggaatggtagataaaggtgttaccgtgatggtgaccacccactttatggatgaggcagagtattgtgatcgtatcgggctggtatttcggggaaaattgatcgccgcagggacacctgatgagctgaaacagttggtcactactcctgagcgtcccaatccttcaatggaagagacctttatcgatcttgtggtgaattatgataaggagccgcaatgagtcatcctgaacgcattcgccctgaatatcagggatcccataaagctgtcagtttttcatggcgtcggttaaaagcactgtgcattaaggagagcaaacaaattgtccgcgatcccagcagtgccttgattgcggtagttatcccgttgatgctgctgtttatctttggttatggcattaaccttgattccggcaaactgcacctcggcattctgatggaacagcaaagtgaagatgcccgtgaactcgttcatgcatttacaggctcgccctatatcgatgccactgtcagcgacaatcgccaactcttgatcaataaaatgcagatgggtggggttcgcggtatcatcgtgataccggtaaattttgatgttcagctcgcccgtattgatggttatgcccctatacaagtgatcaccgatggcagtgaacccaataccgccaattttgttcaaggctatgcgaaaggcgtctggcaaatctggttacagcaacgggggcaaaatcgcgcggtttcaacggctccactcattgacatccaaatccgttactggtttaaccccgcagccatcagccagcattttctcatccccggcgccatttcaattattatgacggtggtaggagcgatcctcacttctcttgtggtcgcccgcgaatgggaacggggaacaatggaagcactgctgtcaacccaagtcacccgaactgaattactgctcgccaaattattaccctatcaagtgctgggttctttcgtcatggtgctttgcatggtattcaccgtgtttgtactgggcattccctatcgcggctcactctggctattggcactgatttccagcctctatctcgctaccgccttgggtatgggcttgctgatttctactgtgacacgcaatcaattcaatgcagcaatgattgccctgaatgccgcttttttgcctgccattatgttatccggctttgtttttgaaatagacagtatgcccgctttcattcaggcaacgacttatgtcatccctgcccgctattttgtcagcagcttacaaacgctatttctggcgggtaacatcggcactgtgctgatcacgaatttgcttctgctgattgccagcgccatcgtttttattggcttgaccgcatggaaaacccgtcggcatctggattaagaaggaaagagcatgttttacagcctgtatacgctagtcataaaagagttgcagtctctcctgagaaatccccagacacgagccactctgattgtgccggttctctttcagatgaccctgtttccttgggcggccacgctggaggtcaagaatgccacgattgccatttataatgaggacaaggggcaggcttccattgaattaacccagcgtctggcaaaatcgaaagcatttcctgacattattttgctgaccagttcacaggaaatccgcccgacgttagataaccgcaaggcactgctattggtgcgctttccccaaaatttcagtgccaatattgccagccagacaccgacttcaattcaggttttactggatggacgcaactcaaacagcgcacaaatttccgctaattatatccagcagattgtgatgaattatcagaaggaattattaggcaattcggccagtctcaacaatagcgacttgatcattcgtaattggtataacgccaatctggattataaatggtttgtggtgccatcactggttgccatgattacgacaattggcgttttgatcgtgaccgcactttccgttgcccgtgaaagagaacagggaacactggatcaattgctggttgctccgttggcgacatggcagattttcctcggtaaggcgatccccgcattggttgtggcaaccactcaggcaagtattgttttacttatcgggacattgttttaccaaattccttttgccggttccttgctgctattttatggctgcactctggtttatggtctatcgcttgttggttttggcttacttatctccgctgtctgttcaacgcagcagcaggctttcatcggcgtgtttgtgtttatgatgccagctattctgctgtctggttatatttctcccgtcgaaaatatgcccgtttggttacaggatattacgtgggttaatcctattcggcattttactgatatcactaagcaaatttatttgaaaggtgcggatttttcggtgatttggcacagcttatggccgttattagttattaccgtgacaactggcgggatcgcttatcggttattccgtagtaaaattgcttgatgaattatggaaaattattttctcccgaacttttggctgatttttccagtcatgtattccacagggacaacacttgaccggaggtgcaaaaagaggaaagcataatcgatcatcattctatttttacattctctctaaaaataattaacaaaaaaataatgggaaataatatatcaacaattaatcagaaaaagatcttcttactttcttttatttctaatataaaaaaacctgctggtgcaggttttttccaaaatattcagtggcgattaacgacgatcaccgagaatacgtaacaacatcaggaacaggttgatgaagtccagatacagagtcaatgcgccagtaatggaatatctgcgcaggttctctttatcgttaacatccagctccgcacccatttctttcagtttctgggtgtcataagcagtcagacccgcgaagactaaaacaccaatataggtgattgcccacatcagtgccgggcttttcagccagaggtttatcagagaagccagaacgataccaatcagccccataaacaggaagctgcctaaaccactcaggctgcgcttagtggtgtaaccatagacactcagtgccccaaacatcgccgctgaaataacaaaagtgctggcaattgaaccactcgtgtaaatcacaaaaatactggaaagcgtcagtcccgttagcatggaatacagcataaacagccctgtcgccagtgcaccgctcattttgtgaaccaagccagacagcacaaataccaatgcaagctgtgcaatgatcaggccataaaatacgatagagctactaaagattgcgtttaagatttcagggctattcgctacatatcctgcaacaaacgcagttaacagcagaccacaagtcatccagccgtagacttgtgccatataagtttgtacaccagagccagctttctggacaatcgaaccactagaacgttgatatcggtccatgacgattaccttttaataacaagttaagggattgagactgcttaaaaataaacaatctattcaaatgttatacattagcatagaacattaacaaaaccatccgccaattaatggcaatttcagcgatatattatttaactatccagttttagagataggccgcaaaattatcagccaaaagattttaccgttatttaccagcgcccagccgcttcctgatcactctctcgcgttgctacccagcgctctccttccaccagagactcctttttccagaatggtgctctggttttcaaataatccataataaattcagccgcagcaaaagccatgctgcggtgagcgctggtgacaccaacgaacacaatctcctcacccggatacaatgcaccgatgcgatgaatgacactgattcgttgcagcggccagcgctgacgagcttcgtcaatgatagcctgcaacattttttccgtcatacccggataatgctccagtgtcagtgccttgacgctatcccccagattatgattacgcactttgcccataaaggtaacgactgcgccatcatcatcgcactgcgagagccattggtattcatcaccaacgttgaatatctccctttggacacacactcgtgtgttttccatgatcatccccccgtaactggcgggaaaaaagccacttcatcaccatccttcaaagggtgttcagcatgtacaaaagattggttcactgcggcaagtaatttgccctcctccagtgccagcgcccatcgttctcctttctcaatcagagagtgacgaagatccgcaaccgttgggtattcatgaggcagttcgagtgaatcagcccctaccagttcacgaacctgtgcaaaaaataggacttttatcatgatcccaccttaaaatttcctgatttgccgccgcttttttccagcaaacgtaccggcccaatcaccatatctttttgcacagccttacacatgtcgtaaatcgtcaaagccgccacagaagcagcggtcaaggcttccatttccacgccggttttccccgtcaggcggcagcaggattcgattctgacacgatgatgttcggcttgtgcttctagttgtacttcaactttactcagcagcagcggatggcacagtgggatcaattcccaagttcgcttcgctgcctgaatccccgcaatacgggcagtcgcaaaaacatcgcctttatggtgatcaccagcaacaatcatggccagcgtttccgcctgcatttcaacaaaggcttctgcccgtgcctctcgcacggtttccgctttggcagaaatatccaccatatgggcttcacccgcagtattgatatgggtcagttgggacattctccgctcctgaaaaatgaattgagccgttaaattaaccgccaatgaaagaaagattaggggtaatgccactatccccctgatgtaaaaagtgagtctcacgcttatggcgcaacccaccttgaatgcgcaattttagatcatcaagtaacgtgtcatcggacaataaatcacgcaatggaattccctgctcaccaaacaggcacaggtgaagattgccaatcgcagaaacccgcaggcggttgcagctttggcagaagtttttttcatacggcatgataaggccaatttcgccctgataatcgggatgactaaagacctgagccggcccgtcactgcgggcgcgttgctgttgctgccagccctcttgcagcagatggcgacggatcacttcaccggaaagatggcgacggcggaacaattcactgccttcccccgtttccatcaattcaataaaacgcaattggatcgaacgatgtttaatccactccagaaaaacgggcaggctagtatcattgacgtttttcatcaatacggcgttgactttcactccactgaaccctgcgtcaaaagccgcgtcaatgccacgcataatctggaaaaatttatcctgtccggtaatggcgtggaattggcggggatcaaggctatccacactgacgttgatcgccgtcagccccgcctctttccagcgggcaacatcgcgctccattcggtagccattggtcgtaatggcgatttttttgatctgtgggttttcatgcactgtcgcgatgatatcgcagaaatcacgacgcatagtgggttctccgcccgtcaggcgaattttttccgtccccagttcagcaaatgcacggctgacgcggcgaatttctggcaggaacaggaacgattggtgcccatgagggtgatagccatcaggcaggcaatatgtgcagcgaaaattacacacatcggtaatcgataatctcaagtaataaaatttgcgggcaaatgcatctacgagttgttccacaataacaccttccaaatacgggagatgcaggcatttctaccttgcaccctggtgactcaggagccacggccaaagcatcatatcaatgtggtatccgtgtgatagaacaacgacttagacacagaggctaggagttaataccaatttcaatcattatatgaataattgtgtgagtaacgagattctcgttgctgattctaacgtttaagataataaaaagctaacaccaaccttcgatatatatcttattacacaacgagttaatgaaacattgtcacatctacttccgaagatgcatcactctgttatcaatcaaaatattcggcaaaagatcggataaaatcacggcaatttctcaaagcatcatattttatgataaattacacccgatttattaaggccatataagtttagtcaatatcagtaacaggaaccctatgcgaaaccgcacattagatgatttagatcgtgtggtcgccctcggtggcggtcacggacttgggcgcgtcatgtcttccctttcatctctcggtgcccgtctgagcggtattgtcacaacgactgacaatgggggatcaaccggaagaatacggcgtgctgaaggtgggatcgcctggggtgatacccgcaattgtctgaatcaactgatcactgaaccgacggtcgcttccgccatgtttgaatatcgattcagtggtaatggcgagctggccggccataatctgggcaatttgatgttaaaggcgctggatcacctgagtgtccgcccccttgaggccattaacctgctccgcagtctgctaaaagtcaatgcacatcttatcccgatgtccgaacaccctgtcgatttaatggctgtcgatgatcaaggcaatatggtgtatggggaggtcaatgttgatcaactcaattgtgtaccacaggagttaatgctctatccccatgtcaacacgaccaaggaagcgctggaagccatcgagcgggcagacttgattttgatcggacccggtagttttttcaccagtctgatgccgttgttattgctggaagatttaactcaatctctgcgccgtagcaatgccagtatgatttatattggcaacttggggaaagaactcagccatgctgccgcaggtctgtcgttgagcgataagcttgaaatgatggaaagtaaaattggccgcaagatgattgatgcgattattgttggcccttgtactgatatcagctctttaagtgaccggattgtggctcaacaaattttagaggctcaggatattccctatcgccatgatcgtgaattattacgacaggctatcgaaaataccctgcaaaaattgggctgactattttgcaagtggagagtgatgctattcactccccacattccattctatttccattacgagttagcaataaactgtgcccgcaatgcctgtacctgatcacgaatattcgccgcctgttcaaattccagatcccgcgcatactggtacattttttcttccagttcacgaattttgttttccagctcttttgccgacaatttacggtaatcatcagtgtcgggagaagctttacctcttcctttggcttttcctttaccatgcgctggttgaccaattttcaggagatcaccgatttttttattcagccctttcggtacgatgccgtgttcctcgttaaatgcctgttgtttggcacgacggcgctcagtttcatcaatggcttttgccatagaatcggtgatcctgtcaccgtataaaatcgccttgccgtgcaagtgacgcgccgctcgaccaatagtctggatcagggaacgctctgagcgcaggaaaccttctttatccgcatccagaattgccaccagagaaacctccggcatgtccaagccttcgcgcagtaagttaatgcccaccagtacatcaaactcgcccaggcgaagatcacggataatttccacccgttccacggtatcgatatcagaatggagataacgcactcgctcgccgtgctcttccaaatattcagtcaaatcttctgccatccgttttgtcagcgtcgtcaccagtactcgctcgtttttctcggcacggatacgaatttcagatagcagatcatcaacttgcgtggctacaggacgaacttcaatttcaggatcaataagacccgtcgggcgcaccacctgctcaaccagttcgttacctgatttttccaattcataacggccaggggttgcagaaacataaatcgtctggggcgccagtgcttcaaactcctcaaacctcaatgggcggttatccaatgctgatggcaggcgaaaaccataatccaccagcgtttcctttcgggaacgatcgccacgatacatgccgccaatctgcgggatagtgacgtgagattcatctaccaccagtaaaccatccgctgcaaggtaatcaaacaacgttggcggtggctcaccttcggcacggccagagagataacgggagtagttttcaatgccagagcagtaacccagttcgttcatcatttcgaggtcaaattgtgttctctgggtgatacgctgttcttccagcagtttatccgtcgccagaagcattttgcgtcgctgttccaattcaactttaatgtcttccatcgcctgagtaatacgctcacgcggtgtgacatagtgagtcttgggatagacggtataacgcggcacgttgtactgaatctgaccggtcagtggatcaaacagggaaagccgctccacttcatcatcaaacagttcaacacgcagcgcatgttcattagattctgcggggaagatatcaatcacttcgccacgcacccggaaggtcccgcgctggaatgcctgatcattgcgggtatattgcagctctgccagacgatgcaagatggcgcgctgatcaatgagcatgccatcggtcagatgaagcatcattttcaggtagctatcggggtcacccagaccataaatcgcagaaaccgaggcaaccaccaccacatcccgacgttcgagcagggcttttgttgccgacaaacgcatttgttcgatatgctcgttcacagaagcgtctttttcgataaaggtatctgagctgggtacataagcttctggttggtagtagtcataataggaaacaaagtattccaccgagttttcagggaagaattctttcatttcgctataaagttgagccgccagcgttttattgggagcaaggatcatcgttggccgattcagatttgcaataacattagctatcgtgaaagttttgcctgatcccgtcacccccaaaagcgtctggtgggcaagaccatcttccagcccttcctgtaatttccggatagcctctggctgatcccctcccggttcgaaatcagaatgtaacttgaatactttgctcgtttctttgctcatgctccacttccacctgatatcatttacaacaaaaagcccctgcacatccaaatgccgacccaaactctcttataatactggataaaaaaccagcttcaagtgagttaataaaataatattgttttttattgcaaaggaagcatgtggaggttggcaaaagaaaccaaaataactttatcgtgatattaacttttagttaacacctgacgtgactatttttatccccagatattcgtcttgatttttcccattcttgtattagcgactgaaatgatgaagcact

SEQ ID NO: 16838 - DNA, 20588 bp, Xenorhabdus bovienii
ttatccacagaaatagtggataactcagcaaaccctattaggcatgggaggttacggagttatccccttttataaatttcttcagtagtggaatattttcatgctgttttagcattgattcgcactatttgttgctcaaaaatggctcaatcgttgttgaaatgaagtactttctatacctgaatacccactttcccaacggcctagttatcaattttaactgacgctaagtaaacaattagttaaccaataaatcaatatttatatattcgccgatattattgttatcactcaattcgctcaagtgagggataacccctagtaaaggtgcgggaatcatccgttccaacgtctccaaatacgctgtctgacgtttaccggcgggttcaatttcattggcaatccagccggctaacctcaatccagaatgttgaatcgcttttgccgtcaataccgcatggttaatacagcccagtttgactcccaccgtcaaaatcacaggcagttcttcctgaatcacccaatcagcaaaagtggtattttccgacaaaggtgtataccaaccgcctgcaccttcaaccaaaacccaatcagattttgccgtcaatctttccaaaccctgtgatatcacctcaaactcaatcggctggttaagttcagcactcacaatatggggagatgtcggttcaacaaataccagtgggttgacttcttgataagccaaggatacggaactgttgcgctgtaaggccagtgcatctccattgcgtattccttctgaggtgatctcactgcccgatgccacgggtttgtaacctgcggtttgatatccttgcttatttgccgcttgcagcaacgcgcaactgacgatagttttaccgacttcagtgtcggttccggtaagaaaatatttatttgtcacagtaaataactccaaaagcaatctgatagcttaatgggtaatcctcattattccgtggatacgcttcagccagagtgttcaggcgttttctggtcatgagtccatgctggcgaccatgatgaaggtgcgtagcccctattcctttcagcgagttcaacaaaggcagcagttgcgggtaatattggcaatattgtcggcttattatcttgtgtcgataggcttggcacgcgtcagtgattgcttgtaaaggcagaaattggttgatatgccgataagtgtcaacctgtctccacgccgcttccaactcatacagcgaaccttgcgcaagtgtggagaataaaatgaggccaccgggacgggtaacccgatgaaattcctgcaatgcacatggcagttcattacaccactgcacggccaagttgctgaaacagatatctacgctattatccgccagccccaagtgctcaatatccccttgcaggtagtaatcggcaacttgctgctcctgcgcatgatttaacataccagaagccagatccagtgcgatgacctgcttgccccgctgcttccagtgcgcactgaaaaaacctgttccacagcctgcatccaatacccggacaccgagattttctgcctgcgccagttccatcaggtattcacctgtttgctgttgcaatttagcagccgtatcgtaacgagaagcggcgcgcccaaaagcgcctgcaatcgcctgcttgtcaacggccttaacagccagatccatgcaacgcctccagtaatatctcaatatcctgttgtgtatggctcgccgtcagtatgatacgcaagcgggcactttccagtggaaccgttggcgggagaatcgattttacccacactttctgctgtctgagcacatgggatagagcaatgcagcgttcattgtcaccaatgatcaaaggctgaatggccgtctctgaatccatcagggtaaaaggcaaatgatgagcttcgcggcgaaaatatctgatgttgttttgtaatcgctgacgcaattcatcgccttccttgatttgccgtaccgcttcagacagtgctaccgcctgtgcgggtggcatggaggtgctgtaaattaagtgtctggaatactggatcaggtattctgcggtttgttcatcacacagtaccgccgccccactcaatccgaacgccttaccaaaggtgacaatcaaaatttccggtttgacattctgcgcccagcaactaccccgcccttgttcaccgtggatcccgataccgtgggcatcatctaccatcaaccaactgcccgtggattttgtctgctgtgcaagggatgcaagcggcgcacaatccccatccatgctaaaaataccttccgtcactaccagcgttttgcccgcacaatcttttaccagatgctgcttcagggaatttggatcgttatgcagaaaacgtcgaaactgtgcgggagagtgcatggcggcttctatcagcgaggcatggctcaggcgatcagcaataatccggtcgtctttttccatcaaagccgctatcacaccttgattggccgcatagccagaaataaatagtaaggcgcgggaataacccaaccattccgctaattgctgttccaatgtgtggtgaactgcggtgtaacctgtaacgtgccccgaccccccactgcctacgccgtactgttcagctccctgctgccaggcagcaataatctggggatgctgactcagcccaagatagtcgttgctggaaaaattcaggtattgaccgtctgaagtgtgtaataaacgcccatctgatcccagatggacttgtctgctacgccatagagatgttccccgacgttcagtcaatcgtcgggaaatcgtgtctgaccagttcattatactgccgcattatagaattgttcgtaatcaacattattgatgatggcttcagtcaggttctgctgttgttgattgtcaccaaatgctgtttgagtctgttgaggattgatgcccagcctgtggaacagttgcagatctttgtcttcattcgggttcggcgtggtcagtaatttgcagccgtaaaaaatggagttagcacccgccataaagcacatcgcttgcgtctgctcattcatctgttcacgtcctgcggataaacgaacatgggatgctggcatcatgatccgagccacagcaatggtgcgaataaagtcgaaaggatcaacatcatcgttgttttccaacggggttccctttactttcaccagcatattaatgggcacactttccggcggcttcggcaaattcgccagttgcaccagcagtgccgcacggtcacggatttgttctcccagaccgacgatgccaccagaacagactttgatgcccgcatccctgacatttcccaacgtatccaatctatcctgatagctgcgagtggtgatgatattgccgtaaaattccggagaggtgtccaggttatggttatagtagtctaaaccagcctctgccagacgttgtgcctgagtttgattcaacattcccagagtcatgcaagtttccatacctaattctttaacttccttgaccatggtctccagatacggcatatcacgctcgtgagggttcttccatgctgctcccatgcagaaacgggttgaaccggcatttttggccttacgcgcagattcgatgacttgctcaacttccatcaaacgctctttttccaagcctgttttgtaacgggagctttgcggacaatatttgcagtcttctggacaggcaccggtttttattgaaagaagcgtgctgacctgtacttgctgcggatcaaaatgttcacggtgtacctgctgtgcctgaaataacaattcgaaaaaaggttgatcaaacaaagcctgagcctgtttgatagtccattgctgacgctcattcacaataacatcctccagtgtgaaaaaatgttgtcagtttaaataacgccgctatcatgtcaaccaaaatgaaccaagaaaggtttacaacaaacttattatgaatccttcagatcttgaatttgacctacgccatatctggcacccgtatacatcaatgactcatccactccccacttatcctgtaatttcagccgcaggggttgagctggaactgtcagatggccgcagactgatcgatggtatgtcttcatggtgggcggcgatccacggttataatcatcctgtgctcaatgaggcagcaaagtcgcagattgacaggatgtctcatgtgatgtttggcggtatcacccaccctcccgcgattgaattatgtcagcaattagtcgcgatgacgccggccgcactggagtgtgtttttctagcggattcaggatctgtcgctgtagaggttgccttgaaaatggcgctacaatactggcaagccaaaggagaaaaacgccacagattcctgaccctgcgtcatggttatcatggcgatactttcggtgccatgtctgtctgtgatcccgacaattcgatgcataacctgtataaaggttatctccctaaccatctgtttgctgatgcaccacaatctcggtttgagggtgaatggcaacctgaggatatcacttcgttccgacagttattgctccaacaccacaatgaaatcgcggccgtaattctggaaccgattgtgcagggtgcaggtgggatgcgcatttatcatcctgaatatctgcgtcaggttcgtaagctgtgtgatgaataccagatcttgctgattgccgatgagatcgccacgggatttgggcggactggcaaactattcgcctgcgagcatgcacagatcgagccggatattttgtgtctgggcaaggcgttgacaggcggttatatgacattatcggccacattaaccactcgtcatgtggctgaaactatcagtcaaggtgaagctggctgttttatgcacggcccgacgtttatgggaaatcctctggcttgtgccgttgccagcgccaatctgaaattgctctctgataatcagtggcagcagcgcactcaatccattgagagccagttgaaagcagaattgctcccgttgaaatcacacactaccgtcgaagatgttcgagtattgggtgctattggtgtcgtagagatgaaacagcccgttgatatggcttcgctacagcgccgctttgtacagcatggtgtttggatcaggccatttggccggttaatttatttaatgccaccttacattacccggtctgagcaattatctaaactgacaaatgcaattaatgatgtaataatttaaaaaataaagccagcattaataacatgctggctttatttgtcattctcgatattttaattatcacattattaataaaaaaataaaataatgaaggtattatcaaaagacactcactgacaaatattatttaccgccgacaagtatattctatgacttacaggtgaatttcctgatatattccaatcaaccatcatgttcattcaaataaaagaggaatatattatgagcgacgaaaaatcaattatgccttctaacgaagaaatgcaagctacattttcattatctaaggagatgcatgaaaaggaaatatcacaccattcaactgttgcaagagaaatacctgagctagcccatttgtttgtaaaaaatcccaacgtgatttcatcaacgggttatggtgctggtctgatagaatatattagtggaagttttaatcttaatacattccaacaatatggaagttatccttttatccaaatatcatcccattcggctataattgggtatgcgccaaatgttggccagcgggttaaatttaatggatatgttaatgctgggcacactattccaattattaattggaataatttttattttgcagggacagtacataatattagatctattataaacgtacaacttactattcaactttacattaaccaacagaatattttcatccgtcttttcgatgggaatatttatttgggcgatttaatttctgtatatagacctaattcaattattcctgttcctatagtaatatcaggcgttggttcatttagtttaatctaaaactgtattaactagttattttataattcaactttcatacctaatagatttcaagttacagccaaaaaagcagcaacttgaaagataaaggggaaatattgccgcgctaaaaatagcgcggctcaagtttacaatgccagcactgtaacccacatcgggcctttgcccactggataacgcgctaattgcgttaattttccagaatatttatcaatacgtgacactgaaatatgatctgatttctgccctgaggcaatcaggaagctgccgctgtgatcaatcgcaaaaccacgaggctgactttctgtcggataatttccgactaatgtcaggtaatagccatcttctgaaacgcggaaatggctgatcaggctctctgagcgctcacaggtataaaggtgacgaccatccggtgtcatgtggatatccgcagaccagcagacactggaaaaattagccgtcaatgaatcaacagattgcacaatgcgatatttgtcccatttacgcagaacatcgacagtcgcatccagttcattgatgcaataaatcgccgatttttcaggatgaaaagccatatgacgcgggccagctcctgctaccgtactgatttcatccgccctattttctgtcaaataaccctgctcatccagattaaaaatgcggatgtgatcttctttcaggcatggaaccagtaactggcgattttcccgatcaatattggcagaatgaggcgcttgcaggccttctacgatctgaaccggcgctttggcagtgccgttttcatcaatagggtgaacactgagtttgttgaaaccataggaagcagaatacaaaaaacgtcccgctctatccgtagaaatatgcgtagggctacccggcaacggcgcaatagcctgctgttcgagctgtccatctgacccgattgcataagtgacgatactgaactgagggcgaattcccacatataagtgtttgccatcagggttaactaccatcggctgtacttcgcccggcacattcactgtctggagaagtgagagctcccccgcaatattcagcgaccatacgtgaatctgactactattagggctggctgtataaaccacctgtttcattttctctccttaatgcttcatcaccatttcattgatctataaagattcttgaaaagttgtgtttgttaaagtgatcgcatgacggtttaactatattttgttaccgtataatatttgcttatatcatcgacaatttagaggcctactcatgtcatatcgcgttatcgcgctggatctcgacggcacagtgcttgatccacaaaaacgtattttgccagaatcactagctgccctgaatgaagcccgtcaagctggtgttaaggttttgattgtcactggccgccatcatgtcgctatccatccgttctatcaagcactacaactcgatactccggctatttgctgcaatgggacttattcatatgattaccatgcaaagaaagttctggattccaatcccctttccacccaagaagccgttcaggtgctttcttatctgcaaggaacggaaattcagcatctgatgtatgtcgatgatgccattttatatcaatttcatgacactgtttcacgcacgcttgcatggtctgattctctgcctgaacatcagcgccccaatctccagcagaccaatagctttcaagatgccatctatgatgtgaattttatttggaaatttgccaccagctccccgaatgtggtgaaactgcgtgaaatcagtgaacagattgaggagaaagtcggtcttgagtgcgaatggtcgtgggttgatcaagtggatattaccaaaaaaggcaatagtaaggggatgcgcttgaagcaatgggttgagtcacaaggcatatccatgaaagaagtgattgctttcggtgataattttaatgatatcagcatgctggaaacagctggtttgggcgttgctatggaaaatgcggctgatgcagtcaaagagcgtgccgatattgttacgcgggataatacccagcctggcatcgctgaagtgattcgaaaatacgtgctttaactcggttaatcaaattaaacgggagcgccagacaaccgtgctccctcaatttattgcagtatgtgttaaaaagtctgattcagcgaaacactctttatttgcgcatacaaccattgacctgaccgcaggttaagttcttcccgcgcccaagcggtaattctcgcccacaggaaatgttcacgcagtgctaacttgacatcaacctgaccatcatattcaaaaaattcaatgactttaacctgtagggtattacgaatactgctggctttcggtggttccaaaacgagagaaacgtccgatgcatcaatgcgaatacgcaggtctgtccccggagccacatcgattttgggcaaccagagagctttatctcctatcgccaccgctgtcatatgataacgctgatgatgctccatgacagagactgtcagtatgctgctaaggctctctttttgcagccacgggcgtaatatgctgtttgaccagacttcttccaatgtgcctgtcgctctgattttccccttgtccattacgatcacgttatccgccaatcgcagaatttcatccaaattgtggctgacatacaggatcgggattttgacatcggcggacagtttttcgagatacggcagtaattcacgcttgcggggtaaatccagcgaagccagcggctcatccatcagcaagatttcaggcgcggtcagtaatgcccgtccaatcgctacccgctgcttttccccgccggataaggtcatgggaaaacgtgacagtaagtgttcaatgcccagtaagccaatgatgttgtcaaactgtggtttcatgtctggcgacataccgtattgcaggttgcccttaacgcgataatggggaaaaaggcgagcatcctgaaaaacataacccattcggcgtttttccggcggcaggaagattttctgctctatatccaccaaaatgcggccattcaggacaatccggcctctctgtggcctgctcaacccggcaataacattgatcagagacgttttacccgcgccggaaagcccaaatatagccgtaatgctttctgttggcagagtggtatcgacctgcatgtgcaggttacccagacgttgttcaaaatccagctctagcatgctgcccccagacgttttctgccccaacgggtcagccactcggaaagcatcaatgaaaccaatgccagcacgatagcaatcacacataaacgcgccgctgccgtttctgcgccgggcgtttcaatcaatgtgtacatggcaaggggaatggtgcgggtttcccccggaatattcgatacaaacgtaattgttgcaccaaactcccccagagaacgggcaaaagccagaacagcaccaacaatcacacccggcaatgaaagtggcagggtaatggtgaaaaagaccctaagcgaactggctcccaatgtacgcgcggcctgttccagacgacgatcaatgctttccagcgccagcctgatcgctctgaccatcaagggaaaagccacaactgccgaagccaacgccgctcccgtccaactaaacgcgaaactgacgccaaaccaatcataaagaaattcaccgatgacaccacggcgccccatgctgaggagcagcagatatcctacaaccactggcggtaataccagcggcagatggataatgctatccagcagggatttcccgaaaaactggcagcgagccagaacccatgccatcaatatccctaatggcaaactgaataacaccgagatacctgagatttttaagctcagtaaaatcgcctgccattcatattcacttaacatctccaaaagatcagttcctacagtggactgaaaccatagcgtttgaaaatgactgcggcttcaggggttttgagataatcataaaaatcacggacggcctgattttcatgacctttaataattgcaatgggatattccactggtttatgactctctgatgggaatataccgacaactttcacttttttgctggcaactgcatcagaaccatagacaattcccaacggtacttctgcccgctctaccagcgccataccactacgtacattgttagtacgtgccatcagtggattgaccgcctcccatgctcccagagattgcagcgactctttggcataaatgccaacaggaacatgatcgggatcacccacagccagacgcccatctgccagcagagatttccattttgtttttcgatcgatgtcgattttatccagcttgctctctttgggtgcaatcaagacaagttgattacctaataaagtatgacgagtattttcagcaatcagttttttgcctgcggcatagtccatccactgctgatcagcagaaataaagatatcagcgggggcgccctgctcaacctgacgtgccagtgttgacgatgaagcataagaggcaacaatgtctccctgttgttcttttttgtactgagcggcaatatcgttaagtgcattggtcaatgacgccgccgcaaagacggtcactttttctgcactccagctattcccaaccagcgcaaaagaaaccacagcccctgtcagcaattggtacatgctctttttcatttcgtattccacttatgataaccaatatggtgcgctgtatataacaagatacaacgttaaatgaaaatactatcctgagattaatcggcaagttgtgagccacttttagcttttatgttaatctaggcagaaattgcagttcaggaagcaaacaaaagtttgccagtaagcgggaattcaatcagatgggtaggtaatgagagagaaaagaaattacccggcaaaaccgggtaacagaaacactaacggtaaaatcagatcaaggctgccgttcggtatttcctgttttggaaataacgttgaacacttcgccaagcccgtaaatcagccccaaaatcagtgccatcacaacgggaaccatgatcaacgcaaacgccatacttccaatcaactcaaacatgcaaacctcatatcatgagtgaccataatttagccaaaaaattaactgtgcaacactcggcgttatttttccttaatggaaaaacggtgcttcatgacacaggcggtgatctcgctattctagacaataaaaaagtaacagtaaccgacgaaacgtgcgattcttacggttatcctgtaaaaaactctcaaatatttgcctgaaatgaatcactatgcaagccgaaatattgttaacactcaaattacagcaacgccttttcgctgatcctcggcgaatcgaattgcttaagcagattaaaataacaggttctatcagtcagggagcaaaacaggccgggatcagctataaaagcgcctgggatgccatcaatgaaatgaatcatctcgcagatgaggtattggtagaacgtgccactggtggcaaaggtggagggggtgcgcaacttacgcactatggtgaacgcctgttacaactttatgatctgctggaaagaattcaacaaaaggcattcgatgcgctgaaagaggattctctgcctttggatagcctgctcgcggctatttcccgtttttcgttacaatccagcgcccggaaccaatttttcggtacgatagtcgaacgtgatcatgaaaatatccagcaacatgtccgtatcttactggctgatggcaaaacatcgatctctgccgcgctgactgagcaaagcgcaaaccggctgaagttggtaaaagggaaagaagtgctggtgttaattaaggcaccgtggataaccttaagcaaggagcctgtaacagcgacgccattcgataatgccttatccggccaggtcagtctgattgaaacaggaacagaacacagtgaagttatcctgacgcttgatgggggtgaatcactctgcgttacgctaaccaatcaggaaatggagcgttcaggtcttcagcctaatgatttcgtcaccgcactctttaatgccgataaagtgattattgcaaccctgtgttaatggtacatccctctgataaacctaagtgtcagaggggaatggcaacttacctgtttcattctgtagtcaccttccaaaaataacccaccttcaatgaataacagacagctacgcattgacattgagcattattccgcttatttctggtgatcctctagttgatgttgcttaaaaaggaatagaaatgtctgagttgcaaataacacaaggtagtttccgtttaagtgacacccgtaccctgcggctaccgtcactgaaaattatttctggcgaaagttgggcgtttgtcggcgcaaatggcagtgggaaatcttctctggctcgtgccctgtcggatgaattaattcaactttcaggtgaacgttattgttcatttaatacacctgtacgcctctctttcgaacaacttcaacaactgattaatgaagagtggcaacgcaacaatacagatttactcagtgaaggagaggaagatactggacgtactgccgcagagatgattcagctccaccataaagataatgaattatgccttgaactggcagcatattttggtatcaaagatttgctttcacgtcggttcaaatatctctcaactggcgaagttcgcaaagtgttactttgtcaagcattaatggctaatcccgacctgctcatccttgatcagccttttgacgggctggatacttatgctcagaatcaattatcccaattattcggatcgctggcagcaaaaggcatcacattggttttaatactgacccgattccatgaaattcctgattttgtcgaacagatcggtgtactggctgattgccacctggcactggcaggaaagaaggagagtattctgtcagaatctctcgtggcacagttagcccacagcgaagcactgaaagacattcggcttcctgaaacagacgaataccgtgcagatgaacaattccccgaagatcaaccactagtgtcgatgtgcaatgttgttgttcagtacaatgacaaaccgatactgcatggtctgagctggcaaataaatccagatgaacactggcaaatcatcggtgaaaatggtgcaggaaaatccaccctcctcaacctgattacgggcgatcatccccaaggttacaacaatgagctaatcttattcggccgacggagaggcagtggcgaaaccatctgggatattaaacgccacattggttatgtcagtaacagcattcaccttgagtatcgtgtcagtacctgcgttcgaaatgtcattctctctgggttcttcgattccattgggttatatcaggccgtttcagatcggcagcagcaactggctgatgagtggctggccttgttgggattctctgaagcaatcgcaaacaacccatttcacagcctatcatggggacagcagaggctcgttctgattgcccgtgccctggtgaaacaccccgccttattgattctcgatgaaccgttgcagggacttgatccccttaaccgtcagttagtcctgcgtttcattgatatcatgattgccaagggggatacacaacttctgtttgtttcccatcatcaggaagatgcgccagaatgcattactcaccgcctgaaatttattcctgatggcaatatttatcggtatgaaaccgaagatatctcccaacagtctttgtagtgccatcctgtcagtgcaagttctctcccgatttaacgtcgaaagagggctttcactcgaattttttcactaaagaaatagcaactgccagaaaatccctctccgcaatgaaaaaatgactactttttaaaaattttttataatgactcaaggttattttaacctattgcaatttatttaaagtctattttttagactatttgtctaatccaccaaaaataacagggaattatatgtcttgggcgttacttgccgtttcattggcgcttttggatactcgtcgcattattgcattttccatcgcatttctagctttaatcattgggatcagcactaacgtgctcacctttcccgcaattgctgcgcttattgtgattgctggtttaggtacagcacacgtttacctcaaaaaacatcctacatccagaattatcactgaggtgttactgctcatctctgtggttttactgttcatgcattacattccgggatttaataacttgaaatacctagataaggtgcaggttggcccgcttagtgcacctttttcaatgtatttcaactttgacaaggcactgattcctttcattctattattctgcatgccaagcctgttcactcgaaagcccgtggtagaagccttcccgcatgtatgggcagcattgatagttgcgatacctgcgctattgggccttgccacagagttagggggattagccgttgagctgcatttacctagttggttccctgctttcgtcgttgccaatattttctttgtttcattggcagaagaagccctgttccgtggttacctccagcaaaagctgagtcagtggataaatccctatttggcactcgttatcacttcgctgatttttggcgccgcacattttgccggtggcagtttgttgatgattttcgcaacactggcaggattaatttatggtctggcatggatgtggagtggtcgtttatgggttgcggtcgctttccacgtttcactcaatctgggtcatctcctgtttttcacctatccggtaaaatcattactcatacagtagctattaccaaacatgatttagaacagggggttcaagactattgtttgccgtttcggtctatcgcgccatataatgcccgcagcgaccatttcattttgtattaaaaagcactgataggagtttaagctatggctgtaactaaactggttcttgtaaggcacggagagagcgagtggaacaaagagaaccgttttactggctggactgatgttgaattgtctgacaaaggccgtactgaagcacaacaggcgggccaattactgaaacaagaaggtttcgtttttgatttcgcttacacttctgttttaaaacgtgctattcacactttgtggaacattctggaccaagtcgatcagcaatggctgccggttgaaaaaaactggaaactgaatgaacgccactacggcgcactacaaggcctggacaaagctgaaacagccgctaagtacggggatgatcaagttaaattgtggcgccgtggcttcgcgatcacgcctccagatttgactaaagatgatgaacgttaccctggccatgatcctcgttacgcgaacttaaaaccagaagaacttcctgccacagaaagccttgcagccacgattgagcgtgttgttccttattgggaagacgttatcaaacctcgtgttgcaaacggtgaaaaaattatcatcgccgctcatggaaactctctgcgtgctttagtgaaatatttggatggtatgagtgaagaagaaattcttgagctgaatatcccaactgctgtgccactggtttatgagtttgatgaaaacatgcaacctatcaaacactattatctgggcaatgccgacgagatcgcagcaaaagcagccgctgtagcaaaccaaggtaaagcgaaataatcttgtatctaagatttaggaaacgtaatactaaaaagccggtaatcactccggcttttttatgctgctttaccccctccgggctttgacagactgagataactgacgcagtaacgtttctgtgtcatcccagccaatgcaggcatctgtcacactttgtccataaactaaaggcttatcactatcgagattttggcttccctcaacgagatggctttcgaccatgacgccaataatcgcgttttctccccttgcaatctgatcacaaacatcatcattaacgtccatttgccttttgaactgcttcgaactgtttgcatggctgaaatcaatcatcacacgaggagctaaaccagctttcatcaattcctctttaacgacattgacatgctccgcactgtaattcggctctttgccaccacgcagaataatatggcaatcctgattacccgtggtgctgacaatcgcagagtgtccccatttagtcacagaaagaaaacagtgaggtgagctggccgcgttgatagcatcaatggcaacttttattgtgccgtcagttccatttttaaagccaaccggacaagaaagccctgatgccagttcacggtgaacctgagattccgttgtacgtgcccctatcgcgccccagctcatgagatcagcaagatactgaggggttatcatatcaaggaactcacccgcagcaggcagccccatgtcgttaatatcgatcagaagcttacgggcagtacgtaacccatcattaatatcaaagctacaatccatgttcgggtcattaattaaccctttccaacctatcgtggtacggggtttttcaaaataaacccgcatcacaatttccaaatcagctttcaattcttcacgtaacttattcaggcgttctgcatattccaatgctgcctttgggtcatgaattgaacacgggccaatcactaccaagagacgatcatcttcaccagttaaaacgttatgaatagcttcacgggcttcacgaacggtagtagcagtattttttgttgcaggaaatttttcgagtaatgcaactggtggcaataattccgttatttttcttatccttatatcgtcattctggtaattcattgtcctttcacctaatgtgtttacagttatttgagataattttgtgatctcaatctaactgttaggcgttgtgctgtaaataatctttgtgagtaaaaagagaggatttctttatggaagaggtttttttgagtaaaaatgatgttgattcaaatgattgaacgggtggaatttgaatacattgaagcaaaacacttaatagcaggccgtagatagattggctacctatgacctgtatgacctgcggatagattttaattcatattttcggtcgattatgagccattgggtttagcagccttgatccacaggcgggcaccgttcagtgcaatacccgtcaatataatgtattgcaaggacatcgccagaacaccttggtgaaaataaatcactacgctgatcacattgacgatcacccataccagccagttttccacgtgtttacgagtcatcagtaccattgccactatcgataatactgtcatcaccgaatcccagaatggaaatgcatctggctctaaggctggcatcgtaatattgaagcccattccctgtaagacaagaactgcaatttttgccatatagccaaagatttggtcgatattgaacatcattatcaagattgcaaatatggaaactgcggcgacgataattgtttgtttggggttgagccagcggatcttaagttccgtctgtttctgttcattgacacgactccaggcataccagccgtagatattggccgcgaagaaaaagatttgcaggagaagactggcgtaaagttgaatttggaagaagataacggcaaagagagaaacattaatcaatccaaacaggtaattaatgattttctcctgactggcaagccagatacataataaaccagctatcgtaccaacagcttcaatgtacgaaagatcatagccgcctgcacctaatggaatatgtaccaatatgctattaatactgaaaaaaaccatcctttcttatccttatcataagtagtgtttagtatatcaatacaaaaaacgcgaaattacgataaaaattgactattatttctatcaatgttttttatactaaacaagatagcgagtttataaataaaagtctttaattattttaaagtttttaaaatgataatggataataaatgactcattttctgagtcaacacttacgagctaggatctgctgatctaccgactgagctgacgatttgtctaaggagtatttgaacggaagtttaaaatggtgggtcgtgcaggattcgaacctgcgaccaattgattaaaagtcaactgctctaccgactgagctaacgacccatctaaatctgcttgacagcattccctgccaacggcggcatatattactgatttctcagaagggcgcaacatttattttattaaatctcgttcaaacgcttactaatcacccagtcacccccgaaaagaccgatatatgacctttcggggataattattacatccccgcaatctttttctcggccattttagccgaattagtgccgggatattgtttaacaacctgctgataaactgctttcgctttagccttctgtcccttttcctgcatgattaatcccactttgtacagagaatcgctacttttctgtgatttaggataatctttcacgacagtagcgaaataaaaagccgcgtcgtctttcttgcctttgttgtaattcaactgccctaaccaatagttggtattcgatagatatttcgacttaggataggctttaacaaatttttgaaacgcagagattgctttatcatattctttggtattgatcgccaaagcaaccgcagcatcgtaatcacctttttcactccccgtacttgccggagcagcaggtggattaccatcggtttttgccgatggcgtagctgtattatcgccttctgtacctgatgatggattagtgattttatccaactgttggtaaatatctttctggcgctcaataacttgatttaattgatactgattttcctggatctgaccacggagtgtatcaatatcacgttgagagtcagcaagctgttgttgaagttgagttaacaattgactgtgagcatcggaaacacgctctaattgggagaggcgctcatcggtggagcctgagccgacattactgattggcgcttgggcggtagcggcccaaggagccgctacgccaaccaataacgacagacccaacacataacgtctgaagttactgttcatgcattactcttagtatacgattacagcacgacggtttttagcgtatgctgcttcgtcatggccaagtacagctggtttttctttaccgtaagaaacgatagccagttgatcagcagaaacacctttgccttgcaggtacattttcactgcgttagcacgacgctcacccagagcgatgttgtactcaggcgtaccgcgttcgtctgcatggccttcaatggtcactttgatagatgggttgctgcgcaggaatgccgcgtgtgcatccagcatctgagcgaaatcgctgttgatgtcatacttatcgaaaccgaagtatacgatattgttgttttgcagctcttgcatctgctgacgtgctaattcttcagcagacagacctgctttagcagaattatcaacagtgcctacaccagactgatcattgttgccatttttgttagtactacacgctgctacggccatgattggtaaagctaacatcagcccttttagcactttgttcagttgcatttctttgatccttttatagtttgccatacatattattttattatgcatcacagatacggcgaccaggcagggaatttaacctgtccatcggtagccggaagacgcgctttgaaacgcccgtcggtcgaaactagctgcaatacagtccccaacccttgagtggagctataaatcaccatagtgccgttaggtgcgatactcggcgtttcatctagaaacgtatctgtcaaaatttggacagatcccgttgccagatcttgtttggcgatatgctgactgccacttgctgagctaaccatcacgataaaactaccgtcagaactaacatcagcatcttggttctgagaaccttcccaagtcaggcgctgtggagcaccgccattaatatcaattttgtacaactgcggacggccaccttgatctgaggtatagaccagtgtctggttatccggcatccagcttggctcagtattgttactgcggccatcagttacctgatggatctgaccagaagccaaatccatcatgtaaagattcaaactacctgttttagatagtgcaaatgcaagtttagtcccatctggagaaaatgcaggcgctccgttatgacgagggaacgaggcaacctgacgcactgctgtcgttgccagtgtttgaataactagcgcagagcgaccactttcaaacgtaacataagcaagttgagaaccatctggcaaccatgctggcgacattaatggttcaggtgagcggtggacggtaaactggttataaccatcataatcagaaacacgcagttcatatgggtatttacccacactcgctttcttgacgacataagccaaacgggtacgaaatgcccctttaatacccgtcagtttttcaaatacttgatcactggcagtatgggcggaatggcgtaaccattttttctcattttaaaatgatccctgaccatcaccgttcctggtgcgccagc

SEQ ID NO: 16839 - DNA, 17674 bp, Xenorhabdus bovienii
tccctgacatagtttttttgaattttattttcaagtgagcattttttgccccaccaaatacaaaaagcacccaatcgggacgaatttaatacggttctttccattgcatggtggtctattactcaataatatcgctgataattgttatccactcttactgttgttgaggttttttatgtctactgttttacgccaatacttaaatctctgcccacaggttggtcaaagagtcatgttagattcttcttctattgtgattggagatgtcagattagcaaatgatgtgagtatttggccccttgtggttatccgtggtgatgtaaattatgtttcaattggtgcacgtacaaatattcaggatggttccgttttgcatgttactcataaatcacctgataatcccgccggcttcccactgataataggagaagaggtcactgttgggcataaagcgatgctgcatggctgtaggattggaaaccgagtgctggttggcataggttctattctacttgatggcgcgattattgaagatgatgttgttattggggcgggaactcttgtccctccaggaaaaaaattagaaagcggatatctgtatataggcagccccgccaaacaagtgagaaaactcaaacctgaagaactggaagggctactttattccgctaataactacacctactggaaagataattatttagcagacacgtcagagggcaaggagtaacgcccaaattgatcaccatgcccactcaagatagcggcttcaaatttctcttccagatcccagcgatgtcggtgaaataggtcgagtgggtgatgatctttaccataacgttcggctaactcatcggaactaatcatacattgcaccaataacccatcgaccatagctgggaaaatcactttgctttccacctcattccattcttcacgatcaggaaattgaatagcttgattcatgcgtgtaactctcgccttaaagcggttaaaactgattctatttcagggaatactccgtgccacaattcaaaagcattcgcagcttgccccaccaacattcctaatccatcagccaaacgtgaaataccattttgccgggcaaaatcaaggaatggagttaatccgtgttggtaatacatatcgtaacaagcagtatcattgcgaaaaatcagcggtgatacctcaggaatttgtccatcaataccagaagcagtcgcattgatgatgatatcgaaatctggggaaagaagggattccatttcaattggctgaatatcacccaatcgggaaaatttatctgcaattatctgcgcacgctcgaatgtacggttcgtgatagtgacggcacatcctagttctaataaaagagataacactccttttgctgcaccaccagccccaataatcagaatatgccgacccttagtaatgaaacctagccgctgtaaatctgccagtaacccgatcccatcagtattatcaccaaggagacgattaccctcgatcaattttaatgtgttaaccgcaccactaattcttgctcgctcagtcaattcatctgagcgctgataagccctttctttaaaaggtacagtaatattcgctcctaaaccgccctgctcaaaaaagcgatccaaagtttgttcaaaatgttctatcggagcaagcacccgcccatattgatgatcaatccccgtctgatcagcaaataatcgatgaatgtaaggagatttactgtgtgcaatagggttaccaaaaaccgcaaatttatccattacttactatccttgtcgatataatttacctgttaaagcatctctgatttctgatggatttttacgtccccccacttctccttccaaaacagggactcggtttccaaattgctgacgaacttcttccgcactccgacatggctctagtccacttaaatttgcactcgtcgatacaaggggtttcccataaagagagcataattgtttaaccagaggatgctctgtgacccgaaccgccaatgttgaaaattgccccgttaaccactttggtgtcgtcgtttttgctggtattacccatgtcactggaccaggccaaaatgaaaataccgtttctttctgtatatcactaagttgctcatcatcaatataaaggcataacctttcatagctatcagcaatgagaattagccctttttcccacggtcgatttttcagcgataataattcgttcacggctttttcgctgtcaggatcacaacccaaaccaaaaacggcctctgtcggataagcaatcactttttcttcttttaacgcagttataatcacatcaaatgcaggtgaaactttgttactcattatatttctcaatttcattgatttgcggcttgctacacagtttactggcacaaaacaactttacgccttgagccgttctcttttctattaacaatgggtaatggcagaaaagacactctccggatacaggcttattgttaagtacaaactgacactctgggtatcggttgcaggcatgaaatgttttaccaaaacgtgacttacgctggagtaattttccttgttgacattgggggcaattaatcgatgtatcatcgggtttatcgatcaattctgtgtgttcacattcaggataatgactgcaaccaataaacatgccataacgtccttgccgcaaaaccagagtaaagccacacttcgggcaaatttgcccatccaattctttaacaatatgcccatctccttgagtctttagaggacgaacgtaatggcatgatggatagctggaacacgcataaaatgaaccatgagctccattacggatcactaattcagcgccacactcagggcaatgttctgtttcttttatctcaaagggaactttcttagacatatctcactcgctgaaccacagccacaataatgttggaaaaagtataaattaaacagatcaatttacccgaatatagccaccagcaacaacggcgacttttcccatgagttccagctccaaaagtctggtcatgacttctgtgacaggaagacaagagcgttgagcaatcacatcaactggagtaacttcatgacttacgttaaccagcacatcggcaaatggcaactctatttggtcaacttgcacgcgttcttctttttctatattcaaccatcgaaacgcgccattaatatgttccattatatccgttggattcactgccaaataagccccctgctttatcagccaatgattgccctcacttgaaggagtgcctaatgcaccaggtaatgcaaaaatatctcgcccctgttcaagcgcacaacgcgctgtaatcaacgaaccactcttttcataagcttccacaataagaagagcgagactcaagccgctaatgatccgattgcgccttggaaaatttttagctttaggtggcatttcagggaaaaactcagaaaccaatgcaccattttcttcaataagccgcgccagagagtcatgcctatagggataaattttttcaagcccactgccaagtacagcaatggtttttccgcctgcactaagcgctgcctgatggcaaatcccatcaataccaattgccaacccactggttatcaccactccatttttcgctaattcaccagcaaagattttcccccatttctcaccataaaagcttgctaacctactacccaccattgccacctgcttttgggataacacagttatatcccctgacacaaaaagtataagtgggggagagtgtatctgttttaataaaggtggatatgcgggatgagagaaggttaacaaatggttgcccggccgctccagccacgtaaaacaagtagccagctcagaagagttagccttagtaaactgtaaacactgtgtgggagacaagccacacgccttaagttcgttattactatagttttgagttctcaatagacgttctataatagacacagctttaatcgttgaaagatgggaaaccatcttcattcgcaaccatatttccatctctttcataatgtcatcctgacctgattgataactttgactggccttgattaatttatggtcgatactgtcaatctaaataggaaatgtctagaataggcgcaaattatcactcacttcttggatacagatctaaacatatatgtcagttttacaagtattacattacccagacgagcggcttcgcacaattgcaaagccagttgaaaaagttgatgcagaaattcagagcatcattgatgatatgttcgaaacaatgtatgaagaagaaggtatcggtttagctgcaacacaagtcgatattcatcagcgaattattgtcattgatgtctctgagaatcgtgatcaacgccttgttctcatcaaccccgaattgatgaatgaagttggtgcaacagggattgaggaaggatgtttatctgtccctgaacaacgcgcatttgtaccacgttttgagcaagtaaaaattaaagctttagattatcacggacagccatttgagctggaagctgacgacctgctagcaatctgtattcaacatgaaatggatcatctagtaggtaaactctttatcgattatctgtcgccattgaaacgtcagcgtattcgccagaaagttgaaaaaattgaccgtctgagagctaaagacaaataaactttatcattacaggaaataacagtgtctgattctttacgtattatttttgccggaaaccctgatttcgctgctcaccatttggctgctttattaaaatctcaacatcaagttgtcggagttctcacccgaccagacaaaccggcaggaagaggtaaaaaactgacaccaagtcctgtaaaagcattggctgaagaacatagtatttctgttttccagccaaaaaccttacgcacagaagaaagccagcaatggatcatggatcggcaggcagatattatgatcgttgttgcgtatggcctgattctacctcaaaccgttctggacataccacgtttaggatgcctgaatgtccatggttctttgttaccacgctggcgtggcgccgctccgattcagcgtgcaatctgggcgggagatccagaaactggcgtaacaattatgcaaatggatgctggtcttgatactggcaacatgctactaaaagcggcttctccaattacaaatcaagataccagcgccagcctgtatgaaaaacttgcaaatattggatctgaagcattactcaacacattaaatctgctaatgttgggaaattgccaaccaagcattcaagatgatactttggcaacttatgctgaaaaactcagtaaagatgaagccaaaatggactggcatttacctgccattcagcttgagcgatgtgtccgctcattcaacccatggccaatgagcttctttctcattgatgagtaccccattaaggtatggaacgctgaagccatcgctgagcaagctactcagtcccccggaaccatcattaaggcagataagaaaggtattcaaatcgcaaccgctgatggaatattaaatatcacacaattacaaccatcaggtaagaaatcaatgtcagccgccgatttcttaaactcaaaacgtgattggtttacaccaggtaacaaaatcaaatgagattaatttgtctgtatgctttgagcatacaggcgtcttcctttttataatgctgacgacagtcagcttttttgaccatatcatgaaaaatacatataacctgcgaagtatcgctgcaaaagcgatccatcaagtactggaacaagggcaatcactcagcactgttattcctgaactccaacaaagaatttctgacaaagataaagctcttctccaagaactctgttttggcgtaatgagggtattacctcagctagaatggttcattagtcagttgatggcaaagccattgaaaggcaagcaacgtatttttcactatctaatcatggttggaatctatcagcttacttatactcgtatacctgcacatgctgcacttgccgaaaccgtcaatggcgcaatcagtttaaaacgtcagcaattaaaaggcttaattaatggcgttctccgccaatttcagcgccaacaacaagcattagtcgagcaagttaatagtgtcaacagccatttacatcccaaatggctgttagatcatattcaaaaaacctatccacaggattggcaaaagattattgacgtaaataatcaaaaaccgcccatgtggttgcgagttaatcagcgctatcatagtgcgaatcaatattttactctgttgcaagaagctaatatagaagcagaactagatgaaaatcatcctagtgctattcgtttgctaaatccttgccctgttaacgttctgcccggatttgatcaaggatgggtgactattcaagatcgctctgctcaagggtgtgctgaattattaacgccatgtgacggagaatctatactggatctatgtgctgctcccggaggaaaaaccacccatatccttgagatagcgccaaaatcaaaagtacttgccgtcgatattgatgaacagagaattaagcgggtgaaagaaaatttacagcgccttaatttgcatgccgtcgtcaaaacaggtgatgggcgccttccacatgagtgggcaacaggggaacagttcgatcgcattcttcttgatgcaccatgttcagcaacaggtgtcattcgtcgtcaccctgacataaaatggttgcgccgaaatgaagatattgaccaattggttacgctacaatctgaaatccttgatgctatttggccatatttaaagaaaaatggcactctggtttatgcaacctgctccattttacctcatgaaaatagccaacaaataaaagcattcttaggacgccatacagatgctgaattatcagatacaggcacacttgaaaaaccagggatacaaattattcctgaaacaacaggtggtgatggcttcttttatgcccgactaactaagtattgacgtatcttcctcgtcaaaatatcggacgaggaggggtttagtgactttactaaaatatcaagaataggaatacagcttctaacacgaagagaatgctatgaaaataattattctgggtgctggtcaggttggtggaacattagctgaaaatttggttgatgaaaataatgatattactgtcgttgataccgataccgatcgcttacgccagttacaggacaaattcgatctacgggttgtaaatggccatggctcccaccccagagtattgagggaagcaggtgcagaagatgccgatatgttggtagccgtcacaaattcagatgaaaccaacatgattgcatgccagatcgcttactccttatttaatacccccaataaagtcgctcggatacgttcatcagaatatatctatgaatcagagaaactatttcaacccaatgatatccctattgattacctgatatctcctgagcaattggttattgattacatctataaattgattcaataccccggagcattacaagttgtcaattttgcggaaggccgtgtcagtatcgtcgcggtcaaagcctattatgggggttcactagtgggtaatgcattatcctcgcttcgagagcatatgccacatatcgatagcaaagttgctgcaatatttcgtcaagaccgcccgatcaggccacaaggctccacaattattgaagcgggagatgaagtattctttgttgccgcatcacaacatatcagagcggtgatgagtgaattacaacgccttgaaaaaccatataaacgtctcatgattgttggaggtgggaacgtcggtgcaggtttagcgttgcgacttgagaaggattacagcgtcaagctgattgaacataatcaagaaagagctacagagctagcagagctcttgcacgatactatcgttttctacggtgatgcctctgatcaagagcttctgtcagaggaacatattgaacaagtcgatgttttcattgcattaactaacgatgacgaagccaacattatgtcagccatgcttgcaaaacgaatgggagccaaaaaagcgatggttcttattcaacgcagtgcatatgttgatttagtacaaggtggtgttattgatatcgccatctcacctcagcaagctaccatttctgcattacttggccatgtccgtaaagcagatatcgtcagtgtatcttcattaagaaggggggtagccgaagctattgaagccatagctcatggtgacgagcatacttccaaagtagttggacgcaagattggtgatattagactaccaccaggcacgacaattggcgcaattgtccgcggtgaagaggtaatcattgccaatgattacagcattatccaacaaggcgaccatgtaatcatgtttattaccgataaaaaatttgttcctgaagtggaaaaactattccagccgagcccttttttcctgtaagaaacacctgctttgctaaatcagataatacttcccactcaataaattagaaggccaatgataacaacttgaaaaaattattatcattggcctcccaaccactacttttgccatgtttttctttacgactataacttcctttaccctttttgtttgtttctactcgctgcctaaataaagggtcgtgtaacagtgcctctatagcattatctttgatgacgccttttttatggcggtatgtcgtcataatgacctctaatgatatttatttgattaaatatcaaataattatactctcagcacccggaataataaagaaaaattatttattagttgctccttcttccaaaatttccaatatggaacaatatgtgctggtatgcgcactaccacaacatgcatcactcaacatttttaaagaattacgcattttttgcatttccaataatttatcttcgacctcctgtaatctggaatcaacaatttgtttcgattcttgacatgtatgatgctcaggatcaacacgaatagacagtaactctacaatcgtttccagtgtaaaacccgattgttttgcataacgaataaaacgtaatcgttgtaaatcctgttcggtataaagtctataaccgccttctgttctttcctcatgagccatcaatccctgtttttcataaaaacgaatagtatcaggcgtgacactcgctaatttagccaactgaccaatacgatacatagtgaatcacctatcaaacaggaaataagttcaatactatcagaatagattaagagagcaccagcacaggtgaaattttcagattaacttgtagaaaaagagataggtaattattggaagaaaaaataaagagcaataaaaaaccgggtgttatcccggttttttatgcttctacagattactctgcagatgctgcttctgtctgagactcaacggcgcggtcaacaagctcgatgtatgccatcggagcattgtcaccagcacggaagccacacttcaggatacgagtgtaaccacctgcgcggctcgcaaaacgcggacccagttcattaaacagttttgccacgatttcgttatcacgagtacgggcgaatgccagacgacgattagctacgctgtcggtcttggcaagagtaatcagcggctcaacgacgcgacgcagttctttcgctttaggcagagtcgtcttgatgatctcatgacgaaccaaagaacctgccatgttgcggaacatagcttggcgatggctgctgttgcggttcaattgacgaccactcttacgatggcgcatgaccttatccttctcagtaaaaccttaacctgtgatctagttattcatcagaaatacttgctggtggccagttttccagacgcatgcccagagaaagtccacgcgaagccagtacgtctttaatctcagtaagagattttttacccagattaggtgtcttaagtaactcaacctcggtacgctgtaccagatcaccgatgtagtggatagcttctgccttaaggcagttagcagagcggacagtcaattccagatcgtcaacagggcgcagcaggatcggatcaaactctggcttctcttctttaacttctggttgacgtacatcacgtaaatcaacgaaagcttccagttgttcggccagaatggtagctgcacggcgaatcgcctcttcaggatcgattgtgccgttagtctccatttcgataaccagcttatccaagtcagtacgctgttctacacgagctgcttcaacattgtaggcaatacgctctactgggctatagcaagcatctactaacaaacgaccgatagggcgctcatcttcttccgaatgaattcgggcagaagccggcacataaccacgaccgcgctgaactttaatacgcatgctaatggaagcacttccgtcagtcagatggcagattacgtgctgcggcttgacgatttcaacatcaccatcatggatgatgtcggctgcagtcacagggccaatgccagatttattcaaggtaaggataacttcatctttaccctgaactttcaccgctagccctttcagattgaggagaatctccaggatatcttcctgtacgccttctttggtgctgtactcatgcagtacaccatcaatctcaacctcagtcaccgcacaacccggcatagacgaaagcagaatacggcgcagtgcgttgccaagagtatggccaaagccacgctctaatggctcaagggtcaccttggcgtgcgtcgaactgacttgctcgatatctaccaggcgcggttttagaaactctgtcacagaaccctgcattgtgtcctctctttggtgctaagctttacttagagtaaagctcgacgatcaggtgttcgttaatgtcagcggatagatcagtacgttcagggatacgtttgaacacaccttccatcttcgcagcatcaacttccaaccaagttggtttctcacgctgctcagccagctctaaagctgccttaatacgagcctgcttcttcgctttttcacgaacgctgactacgtcattcggggatacctgataagaagcgatattgacaacgcaaccatttaccatgatagccttatggcttaccatctgacgtgattcagcacgagtcgcgccgaagcccatacgataaacgacgttatctaagcgaccttccagcaaagtcaacaggttttcacctgtgttgcctttcagacgagttgcttctttatagtagttacggaattgacgttccagaacaccgtaagtacgacgaactttttgtttttcacgtaactgtacaccatagtcagacagacgcggtttacgtgcgccgtgctggcctggtgcctgttctaatttacacttggtgtcaatcgcgcgcacgccagacttcaggaaaaggtctgtaccctcgcgacggctcagcttgagcttaggacccaaatatcttgccattttctttctccaacaatcctaaaaacgaagacgtcttattaaacttaaacgcgacgttttttcggtgggcgacaaccgttatgagggatcggagtcacatcagtaatattagtgatgcggaaaccagccgcgtttaatgcgcgaatagttgactcacggccaggaccaggtcctttaaccataacttccaggttcttaattccgtattcttttactgcttcagcacagcgctctgctgcaacctgagccgcaaacggagtagatttacgagaaccacggaaaccggaaccacctgcagttgcccaacccaaagcattaccctgacgatcagtaatagtaacgattgtgttgttgaaagaagcatggatatgagccacaccgtcagagacttgttttcttacacgcttacgtgcacgaataggtgcttttgccattattcaataccccgattatttcttgatcggcttacgcggacccttacgggtacgtgcattggtcttagtacgctgaccgcgaactggcagaccacgacgatgacgcaaaccacgatagcaaccaaggtccatcagacgtttgatactcagggtcacttcacgacgcagatcaccttctacaacgtatttggcaacttcgtcacgcagcttgtcaatttgctcttcagacagctcactgatcttaacattttcagcaatacacgctgcttcacagatttgctgtgagcgggttttaccgatgccgtaaatcgaggttaacgcgattacggtatgtttctgatcaggaatgttaatgcctgctatacgggccactatgcactcctacaatatttattcactgcaacatcattctgaaaagcccgttttcaggatactcaaataatgttgctgtcagataaaaaagattggctggccaatttagccagctcaacccaactttgcaagaaaaatatgcgattaaattagccttggcgttgtttatgcttaggctctgcactgcagattacacgtacgataccgttacgtttaactattttgcagttgcggcataatttcttgacggaagcacgaactttcatttttactctccgtaacttctcaagcaaaccaattagcggttatacccttttaggtttgccttcttcaatgcagactcatattgactcgacatcatcagagtttgcacttgagccataaagtccatgatgacgacaactacaatcagtaaggaagtaccaccaaaatagaatggaactttcattgcgtcacgcatgaactccgggattaagcagataaaggtaatgtataacgcaccaactaaggtcaggcgagtcattactttatcgatgtacttagccgtttgctctcccggacgaattcctggtacaaatgcaccggacttcttcaggttatctgctgtttctcttggattaaataccaaagccgtgtagaagaaacagaagaagatgattgcagatgcgtacaataacacataaagcggttgacctggctgcaaatacatagaaatagttgtcaaccaattccagcctgttccaccaccaaaccaagaggctatggtaccagggaacaaaataatactagaagcaaaaattgcagggataaccccagccatattcactttcaacggtaaatgtgtactttgtgccgcataaactcttcgaccttgttgacgtttagcatagttaacaacgatacggcgttgaccacgctccatgaaaacaacgaagaaagttacggcaaacactaatactgcaaccaacagcaacaggaggaagtgcaggtcgccttgccgagcttgctcgatggtgtgaccaattgcaggtggtaaacctgcaacgataccagcaaagattatgattgaaataccgttaccgatacctcgctcagtaatctgctcacccaaccacatcaagaacatggttcccgtgaccagacttacaacagccgtgaaatagaacgcaaagccagggttaataactaaaccttgcattccaggcatattcggcaacccagtagcaataccgattgactgaaatattgccagcactaacgtgccataacgggtgtattgactgatcttacgacgaccagcttccccttccttcttaatctctgctaaacggggattaaccacagttagcaactggataatgatagatgcagaaatatacggcattatacccagtgcgaagatagaagcacggcttaaagcaccaccagagaacatgttaaacatttcaataatggtgcctctttgctgttcgagcaatttggcaagcacagtggcatcaataccagggattggaataaaagagccaatacggaaaacaatcagagctccaataacaaacaaaagtctgcgttttaactcgcttaatccgcctttggcactttgaaaatctaatcctggttgtttagccatctgttacttattcctcaattttaccgccagcggcttcaattgcagcacgggcgcctttcgtaacacgtaagccacgcacaattactgcgcgattgacttcgccagaaagcataacttttgcgaattcaatttgagggccaacaatgttagcagctttcagtgcattcagatcgataacatcgccttcaacatgggcaaaatcagacagacgaatttctgcagtgatcattgctttacgtgaagtaaaaccaaattttggcagacgacggtataaaggcatttggccgccttcaaaaccacgacgaacaccaccgccagaacgagatttctgacctttgtggccacgaccgccggttttacctaggccagaaccaataccacgacctacacgtttagatgcgtgcttagcaccttcagccggagacagagtatttaagcgcatctgttactcctcaactttaaccatataggaaaccaagttgaccataccacgaaccgctggtgtatcttcgcgttcaacagtatgaccaatgcgacgcagacctaaaccagtcagagttgccttatgcttaggcaaacgaccaattgaactgcgaacctgagtaattttaatagtcttagccatggtcattacccctgaatttcttcgacggatttgccacgcttagctgcgaccatttctggagacttcatgctgtctaaagcgtccagagttgcacgaaccacgttgatcgggttagtggaaccgtaggttttagccagtacgttacgaactccagccacttccagaacagcacgcatcgcaccaccggcgatgatacctgtaccttcgtgagcaggctgcatgaacacgcgagaaccggtgtgtccacctttcactgggtggtgcagggtgccgctgttaagtgcgacgtttttcatattgcgacgtgctttttccatcgctttctggatcgctgccggaacttcgcgtgctttgccgtagccaaaaccaacgcgaccgttaccatcaccaactacagtcagtgctgtaaagctgaaaatacggccacctttgacggttttagatacgcggtttaccgcgatcagcttttcctgcagttcgccagcttgtttttcgatgtgagccatcttacacctctaccttagaactgaaggccagcttcacgggcagcatctgccagtgcctggactctaccatgatattggaaaccagaacggtcaaaggatacatttttgatacctttttccagagcacgttcagcaacaattttaccaactactgctgcggcttctttgtttccagtaaatttcagttgttcactaatagctttttctgtagtagaagcggccaccagagtttcagaaccatttggtgcgataacctgcgcataaatatggcgaggggtacggtgtaccaccaggcgagttgcacccagttcctggagcttgcggcgtgcgcgggtcgcacgacggatacgagctgctttcttatccatagtgttaccttacttcttcttagcctctttggtacgcacgacttcatcggcgtaacgaacacccttgcctttatatggctcaggacgacgataggcacgcagatctgccgcaacctgaccaatcacctgcttatcagcacctttcagtacgatttcagtttgtgacgggcattccgcagttatgcctgctggcagttgatgctcaaccggatgcgagaagcctaaagacaaactaacagcattgcctttaactgctgcacggtaacctacacccaccagctgaagcttcttggtgaagccttcgttaacaccgataaccattgcattcagcaaagagcgagttgtacctgcctgtgcccaagcatcagcaaaaccttcgcgtggagcgaaagtcagttggccatccgcatgtttaacttcaactgcattgtggattttacgacttagttcgccgtttttacccttaatcgaaataacctgaccgttgagtttaacctctacgccggcaggaatgacgacgggtgcttttgcaacacgagacattctttcctcccgaattaagctacgtagcagagaatctcgccacccagaccagcttggcgagctgcacgatcagtcattacacctttagaggtagaaacaacagcgatacccaaaccagccataacttttggcagctcatcttttttcttatagatgcgcagacttgggcggcttacacgctgaatgctttctacaacagccttaccttggaagtatttcagagtgacttccagttctggcttagtgtcgccttcgattttaaaatcttcaatgtaaccttcttccttcagcacgttggcaattgccactttcagcttggaggaaggcatggtgaccgcaactttattcgcggcctgaccgttacggatacgggtcagcatatccgcgatcggatcttgcatgctcatctgtctttactcccgtgattcaattggtgacaattaccagctagcctttttaaggcccgggatttcaccgcgcatagcggcttcacggactttaatacggctcaacccaaacttccgcaaaaatgcatgcggacgcccagtctgacggcagcggttacgctgacgacaagggctggaatcacgtggcagtgtttgcagcttgagaacagcattccaacggtcttcgtcagatgcgtttacatcagagatgatcgctttcagttcaacgcgttttgcgaagaatttctcagctaatttcgcacgttttacatcacgtgctttcattgattgcttagccatgaataccctgccttacttgcggaacgggaagttaaacgcagccaacagtgcgcggccttcatcatcagatttcgcagtagtggtgatagtaatatccaaaccacgtacacgatccactttatcgtagtcgatttcagggaagatgatttgctcacgaacacccatgctgtagttaccacgaccatcaaatgatttagcggacaaaccacggaagtcacgaatacgtggtacagcaatagaaatcaggcgctcaaagaactcccacatacgttcgccacgcagggttactttacagccgattggatagccctgacggattttgaagcctgcaactgatttgcgtgctttggtgatcaatggtttctgaccagagattgctgtcaagtcagctgctgcattgtccagcagttttttgtcagcgatagcttcaccaacacccatgttcagggtgatcttctcgacccgagggacttgcatgacagaatggtaaccgaactgactcatcagtttctggactacctcgtctttgtagtaatcatgcagtttcgccatcgtatactccaaattacttgatagtttcgtcattagatttgaagaaacgaacttttttgccgtcttcgaatctaaaacctacacggtcagccttgctggttactgcattaaagattgcaacgttagaaacattgatagctgcttctttttcaacgatgccacctggttgattcagtgccggaaccggcttctgatgtttcttaaccagattgataccttcaacgataattttaccagaagaaagaacctgttttactttaccgcgcttacctttatctttgccagtcagcacgataatttcgtcatcacgacggattttcgctgccatagtttcgctccttacagtacttcaggtgccagggagataattttcatgaacttttcattacgaagttcacgagttaccggcc

SEQ ID NO: 16840 - DNA, 9095 bp, Xenorhabdus bovienii
  unsure (1)..(9095): unsure at all n locations
agcagatttttcgctgtgccataaagcacaacgaaccggccccagccggtgagagaaaaacacaaccccagttgtgatttttcggtgggctgcgccccgtcaaagtgaatgccagtgagcgcatgaccaaaatgaaaaacagcgaagcgttaggtgcgttcagcggcgtagtttttgattttggtcatgcgcgagcatgacggggcgcgggtgagtttctgacgttggcggcgtccagccgacataagacagaaagaggggaaaaatgaatgttggcaggcgtccagactgacataaatgaatttttccctttgttgttttcgcagccctagcgaagaaaataaccatgccgacaggcataaagatagctatataatataggtgattaaataagttgttaagtaaaaaagggttcttatatagctattgggtgaccgtgcaaaacattaagttcagtagatattccgcttcctcgcccactcgctcgctgcgctcgtgcgttaggctgcggcgagcagacggtgctaaaaaaaccaatgttctttagctaacgtcaaaaaacaaaaaagccccaaaaaggggctgttatctgatataggttatctggtgcactcaaagcaaaccatttttctttttgtggtaataccagcggcgactaattcctagtgattcccacggcttgagcgttctctctgagcttgggatcgcgccacgctttgatttacgtcctctggcggcctggatctctggcgtatgcgtgtctgcaacatactgcgcgaacgccttttcgctcatacgctggtgtgtccacttggcaatactgcgcccgatacaggcgcattccggcagcgatagcgggttggtcagctgaacgttgtacatttccacacgctgaatgacggccagttgccactgggcaaaatcgggatacccctgccgaatcgccctgtaagcccatttacgcgttttttcgaataactgacagttacgccccagcccgtagttaaaatcgtttacgcgggcttctgggacgttcaaatcgacataatcggccagctcgtccagcgtgtagactgcctgacgccatgtggtcacctgccagtgcaggttaagggggtttttgcaaatcagtccgctgtaattcacgtcggcacggagtttcacacacaagccacgttctaccgatgcggcatatttcagggctttgatactggcatcgggggcagttctgacggctgtttgtagcccataaagcagatgggcatgcccgttcgtctggttctttaccgtgatgttgggggcaggcgcgttgctgtccgtccagtctatcgccgcgccaacgcgatcaacatcaaacacaaaccagaaagcggcatgggggggattgtgttggatgtaacgggcgagcttggccacatcggcgttattgatacgcaacccagagagtaaatcatccgtgtgatagggttttcggggcagatggtcggcaaaataatccagtgcaaaactagtcatttatggctgagcttatggcggggtgttgtttctgtctgtacatatgctaaactctttttaagttttgagcctgcgccctcgtgaattgtgagtcttccgccaagttgatgcacaatttcgggggcgtatgtgtttatagtttaaaactactctgcaacaatcattttgtctaattataaaactgtgggcaatttatgctatctgcctaatatatcttaaaaaacagcgcgtaactcttatcctgactcatttcagacaaatgcctacacagtcacagaaaagcattaagactttgcgatcataaatcgtttcgaggtttgcgttctatcagattgcccatgtcatcgaaataacgattgggccatatttcggagggatgaagttcaagacgattcgcaataatccactcccctttaggccaagggcgtgacaatgtatttgctaaagttgatgcgctgagtccagcttcacgggaaattgctgataaggtcgttccctttttgcgtaaacctagattattctgtggtcagtgacgaccggattcgtcatacaaaccaggtagtattagtgtgttcttttcctgtgttcactcctgatagcagatttcaagccagaaatgcgaatcttacgcaatgttctgccataacatttaattttgtgagtttgatgttttttctatttttagagtcttttggttcctgatggaaacataaaggaaatagaagccgatcaacagcatgtatgtacctagaataaacatggtttcactggcattaaagtacttggaaaggaaaaacgagactgcggaaccaagtggaatggctgaatagataattacataagaggcggagattacacaggttgtatcgttctggtgaaagttagtctgacgttctgtgtaaaaaacaataaggttaatagagctgagaagcatcacagcacaccatgccagactagctataacgatgttgttggttaatggaataataatcaggctaacggcgcagataatccctgttgcagagatgacataccatttgttgatatcttgagcatagataaaacgtccaattcggacaccaaccaagagtcctaacgctgaaatggcgaagaagaatccaacccttatatctgccaaatggaatttatcaatcaaataaaatgttagcactgattgaaacccatgcaatgctatattagaaaggaagaatctcgttagtaagaaattaatgaaagaagagttttttattaattgaaaacctttggtagttctaacgacgaaactgtcttttatttctgaatttcgttcatcgatttttaatatcttaataagaaggaatgatagtgtataaactatggcaataatcaaaaacacatgattataattgaaagcgctcagcattactgcaccaatgagaggaccaacagcagggaataaactatcgacaaaggcaattctgcgactagtaatagcaattgcatctttgtcgtggaaaacatctttaattacgctatggatgagtgtttgaaacagcgttagaacagttgagagcataaataaaatagtcagaaatgcagtactattaaacccttttctaaaatagaagaaactgaatgcacatgatgctaatcccaaaaaattcaggattagcaagcttgtttttctagcaagcttgccatcgattaaattgatgaaaggtggggcgataatgtttggtgtaaatagtaatccataactaatagtcatcatctgcagggattgtgtttccgcatatagcgccaaaggtgctataaatttgaatgcccaattgattaaggcatttataacgtatgaaacaaagaacagagacgactgactatggattagtttaagcatttatctacctgaattttcatttcatcaaaaatctgtcggccgcgttcggttagatcaccatgttgctggacaactaaatacgtttcgttgtatcgagcaagtgcgcgagccaagaacaggtcgttgtgtatttctttatcatcaggagttactttaacagccttgctgaagtaagccacgatattcccaagcacataatttgcatggtaaattcctgacattggacgcttatctttgcgaaagggggctgcgtagaggtttactacggggttgttaaccagctgatcctttgtttgttccaggaagagtcgagtatgggaggcttcgtgtaccaaatcttcaatgtactgaccaaccggactgaattcctcttttgtgttaggtgatataatgatgcagccaagcgttttcaacgtagagccagattttattccaccgcgttcagtctggccgacaaggactatatgcttaaccaaggaggttacaaaactgtaatactcaggagaaacggattgcaataaatcaaaagcatgtttgattcttgcgaattcctgacttgtattgccagggaaggggccgaaagcataaacgccatcatcgttgacatcattgtccggcttgtcatagataccctttagtgttctggatagttcagagtctatattttcaggcgtaattactgttacttctggacgaccatgatccacaatggagcgtgtcgaagaatcagtggtaagactattcagagctgagcgcagataatcttcggcgctgttactgtcaccttccttgatagcgtccacgcaaaggaaataattggcatatacttgccagttataattaacggaaacattatttttaacaggaatcttgaagttttcagaaagatatttaagtgaagtgagaatttcgctattaaaataatttttattggtttctatgatagcactaatttgcgacatgatgtgatccctcattgtataaataaagtgccgaaatatttctatttgagcactttatattttgcgactaaattagctgattatttaacgttaatcagtactactgcagtgtataggtggcctttaggtgcaaacagtttagacaagttaatattgctcattagataaatttccatagttttaataaaaaggaagtgctatcggtttaaatacccagaaggtaataaagccgcacaattcacgataactattaacataattatcaaaaaccattaacaaataacaatgtatcaacctttatgcaagtaatatttctcatcaatttgacccagggcgcgagcacactattttagctgcgtttttaagatgattatctcttaatgttcagttttaatagtgtttttatcgagtgaaatttaatcgcacaggcaattctttagacttttatagaaaactaaagaattaaagaacaagattgacattttaagttcaaatattaatcaaagtatgctcgcgccctgaatttgaccttaatcaacatattagacacaatcggcggaatcagaatacacaactggaacgcaatattcgtggttctgttgcattaatggctatttttgcccatcccccgatagggttcgcaagtgaagtatcaacaaagttgacacttaaaataatcactgatagagtatcttcattgttgatacttagaggatttaaacatggcacaagttgtcgtgaaaaaatggggtaacagcccttctgtacgtcttccggtcgctattatgcaagctgcttcacttaatgttgatgatacggttgatattgctgtcgaagatggtcgaattatcattattccggtcaaggcgaaagaatattctctcgatgcgctattagctgggattacccccgaaaatattcatgaaaaaatggattttggttctccagtaggtaaggaattgatctaatggtttctcgttttgtgcctgattctggcgatattatttggattgactttgatcctgtggctggacacgagcaaggaggtcatcgccccgcagtagtgctgagtccatttgcctataataataaagtgggattactgctctgtgttccttgtacaacgaaggcgaaagattatccttttgaagttgaattatcaggaagccgtgacagtgttgccttagctgatcaggtgacatgtgttgattggcgagccagaaaagtaacaaagaaaggtcatgttaattcttcagagctggaggatataaaggctaaagcaaaggcgcttatcggataacaggacagtttagggggcttatcagccccttaagtgggttgacttggaacattatagttataaacagtagaagggcttgaaaagcaactttgaaccctatcggggaatgggcaaaaataaccttaatggaacatcaggtaaatttcccggtttttgcgcgagtcccaaataatgtctctgatccgggtccagtggaagaacccccagatctgtaaactttgtgaatgctacgaattgtcagtgcatttaaatatatttaaaacgcgtgatcggggttgtacgtcgaaaacctagatttttctgtggtcagtgacgacaggattcgtcatacaaaccaggtagttttttagctttggtgacggaattttctgatattcctgcgtacaaccccatacatatcactcgctggcaaattcctcataagttttaaagtcaaaaaaacggtctgtcatttcaggcgataaggactgtagacgcccgccaatcatggcagcatcaacggcgtaaaatatccgtttaaccctgtcccgtaactgcggttcggggaacaagtacaccacaccagcccagccattttgggtaatttggttcagataaatttcgacgatgtcgcggtagcgtttcggggatttcgccacccgttccacttccaccgcccagatgttcccgtccttgcgcattagtccgtcagggtatttctgccctttttccagcttgagattgctggtcggtttccattgatacccgtgatgtctggccgcaaggcttaaccgctgtacatcaaatcggtgtgccagtgtgctgagggtgatttttgacggttcaaacgctttcagcttaaacgggtcatcatggtcatccaagaccatgacagccccgtgctgggtaatgccatacacgttaaaaggtctgtaaccgcctaaatccactttttcggtgctcagtaaccctttggcacacattcggtttaacgtcgtgtacaccgtactggtcgccgtataattcagtaccctgctcaggatttccgccgttgaatagatttcatctttcaggaaccgcaggatagcctgctcgttatcctgtttttttgccatgcgctctttataggagcggataaaattatcgccacccattgtcatcacgactctctcggttaaagtgtgtctgtgccacagactcggtaacagcctcttcacgttgcggtatttctccggcatattcagggaaggatgaagctgaaaaatgaaaatcaggctgcttgagggtggggtattcggttaatgcaatctcccgtcgcgcggctttaatcggtttgctatacgcaatccgcgccagcccgacaccaatcatcacggccgcgccatcgggcaggtgctggatagtgttggtgtcgatgagttcacgtttttctttaaatacggtggtttcggtgctcatcagttcaacattgccggtctctgtggtcacgttgcgccgttcactgtcgaccagtatttgccccgtttgcttgcttgcccactccgccactttgtaatctttcatgcggtagatccatttaatcggcgtgttgtctatcaccgtcgcttggactacttccggcttcatatcggcaccacactgaccaaagtcgccgagagactggtgtgtcagcagaatattacagttcttgtcacgtactgtgccgagggcttccagactggattttgaaagcaggtacttaacctcatcgagaaaaatattcacgtgcgtagtttcatgaaaacggtcgcgctcctcgataatctgtaagcaacgcacaaacaacattttttgcagcatgatcaccgattcatcacgcagagagccgacaacatacagacaaccgccattaaggataaaatcctttaaatcaatcccctcatgggtctgtaaaacggacaacgagcacaattcctgtaacagcgtcataaaaccactggcggactccctgaccttttgtggcaaacgttgcgccgcttcaagcagggctgtgacatctgtaccgtgttcaaactgggacgacaacaaacggacagcctggcggtcattgtcacggtaaaaatccgcattatcgccccgccgtccgagactgaagcccgagaccagtaattcattgagctgataagaggacaggtcacggaaaatattcagttgtgcaggtttaccctggcgtaaatccagcagtaaaaatttatcagactgccctttgagaacgtgcggggcaaattcatcgttcttcggatcaaaaacgatgaccgtgtcattaaacattccggtacactgcgccagagcacaacaggccagcacacctttaccactgccgactgatcccattatctgaacattggatttcacccatatcttgcgcgggatgtagatagggtggcgtttctcgtccagtccgaggaatacggcatccttggccgccgccgtattaaaataatcaaccggattaaaatcaggcacagacgcaaattgcagtgaacgggcgtcagaaagttcgcccgttcgccctttgtgcttattccgcttttcaatgataacgcggttaatgtctgcatcttttctcgccataacgtcacggataaaaataaagtaaaccagactcgatacaatcccccctgccaccagagaacccgccagccagaacgccggataaaaacggttttcactcaacaataactcaaacgtgactttgtcattgatgataaagcaggcaaaaactaacaggagataagctaaggcagttaaaccaaacaacgcgctcaccaatgacataaatagccgtgcaatccagcgtcttgcataaatacgtttggacggattatccagattcgctttctgacgccacactaacgggatggttttcccatcacccgttttgttgtgcaattgcgcttttcgaatcgcctcactgctcacacccagcagactataagcatgcaatgtccggctcaaagtaaaaaaaacaaaactaaaaacaaacccgcaaacagcaacagccagccagtccgcttcaatgacagaaaacgcgaacggatacgctttcagaacagaatacaacgccgatgataaagacatactccccctctttttggtgaaattctcgcgcccctgcgtgagaaagaggctcagaacgccccagcgtgataagcctcggtttcatactttcgcattgcgtccagcttgcgaaagtacacaagaaacagtctgccccagcagatttttcgctgtgccataaagcacaacgaaccggccccagccggtgagagaaaaacacaaccccagttgtgatttttcggtgggctgcgccccgtcaaagtgaatgccagtgagcgcatgaccaaaatgaaaaacagcgaagcgttaggtgcgttcagcggcgtagtttttgattttggtcatgcgcgagcatgacggnnnn

SEQ ID NO: 16841 - DNA, 33259 bp, Xenorhabdus bovienii
cttactgtcctcggcgtgctcacgtgcaggcatattgctgtactggcgcgcataatcgattttatggaagtgcgggtttgttattgccggtgtgacaatgccaacggcgcgattaacgtcttcgtcagttggtacgcgatcaaggtatttattgaaagtcaatgcgccgctcagtgatttttttcagttgcttaaccacacgaaaaacgtctttcacgctctcgttatccgctgacggcatcgtttcaccgtcgatcatctccccgtcaatgaacaatggaatgctgtcaataaatgcgccacggttgaggaatttgttcacctcggctgtagtgatgatcgggtatgccttgactaatccgaacaggattaccgccattgccccatcattccatgagcttttccctttgccgtttcggatggcgacaatcagtgcatcctgatgtctcaggcccagcaaatcgtaatcaccgaccacgatgtagtgagtgctcagtgcttccagattcacaggctttgcgtggctgttgtggggcttatgtggtttatgctcctttcgtgctggtgtgtttgttttgaccattgctgtcgcttccgcttctgacatccctatttttatcaatgcggcaacaactcttgctggtttccatgcaatcaacttcttgtgttttgcgataatctgttctgctttttcttttttgataatcattctcatttatccaaaaaaataggggggttcttatttagtacttttcgtaactgccagtttttttggcttttccccactttgataattattctcacttggctgttttttcatgttcagccctagtgatcccctaacctccgttccacagccagaagacacagccattttcggtgttacctgccagctcctacttcgaagcaccccctgatttgggcttgtcctctggctgtgctttcggggctaacatcggcttctctgtataacccttcatcgatctgtaattctttttgaaaaacagccggagccatgtgttagcagccctagcccctgtgttatccctacgatgcggcacaggatcttcatcccgccgaagtttgtagacgtatgcgtatttatcccttgcatactcccttgtggttgagttcatcgcggcaagaatcttttgaatccattccgtgtctcccggatgatgaatttcaggcatcactacgtagtggatcgggtatgtattcacgattgggattggcctttctgcgcatcgggtagttgttgaatctttgcgtgttctatgcgcaaaattcctaaagtgaaacttaagttaagttttgtttaataaataaacgatagatatcgtctatcctagatagatgatggttatagtttgagcactaaaaaatcggtacagtttgcgaacctcttaatgaggcgtacaaattgataagaggctacccaataattttgggttggttatgatttagcctaccaacaagggagttgattgatagggactctccacaagggcggagcattcattgtaattttataaaaagtaaaatagattattttgaaccgtattgaagccatagcggatcgcaatccaaggctttagaaatttctaaacttaactaccacctactgaagtaggtgggttagcgcacttcggtgccgacgactgaaagtcgtcgaaccacgcacctcgtaaacgcgcataggtcaaagaattaaagtcaaagtcaccgtctaaagaccgtggttttaaacctttcatatggaaaaataaactacaagcagccgtcgagattgcagaaaaaattgaagcgtcattagctccaatcatcactgcaactcagaatgaagccgaaccggatgcttatttaatatgtcgtggtgtacatcgtcaaacgtgtaatttagctcagcggttaaaggatataaataaagattatattatggagagtgtaattgatacatgttctaatttagatattgaattagagccagctaaaaatgcaatcgaaaaatcaagatcactattgagcacaatgattgatgtctgtggagataatgacgacgcaaatttacttcttattgcgatagatttagcctttgatgctggcaaagaaatagcacgagtcagaggagtagaatactcatgaaaatacttaaacccatcgaaaccgccactaatcaagagatcgttattgagccacgtgaagtctatgtcgttcgcggttctggcaagacttatctgagtgagaaaggcgcactgaataaactggcttacgttcgggcacaagagcagttcaacgccgacgaaaggccaagcaacttccctgccgaagaagtcattcaggaagacggcacttctgcattacgccgtggaaagatgcgacctgaatttatggaacgacatgctcaggtattggaagaactgaaagtcgctgttagacgagaaagggaaaagatagccctacggaaaaagtattcaaaagcaatgaataaaattaactcattacatgaaacaatatctgagttagaaatacaaatagccgaattagaataataataaaaacaacaaaacaaatttaattacagcgccattgctggggactcgcttactccaaaaacggagaatataaaatgacacaatcaattttgcttgaaagaaagcgaaaggcatttatacatgccaaattggatgcattacaaaagaagcacggctctcactctgtatttgtaaaagaatctggcgttaattgccgactggatttagacgaggaaatattaactctcgctttaattaagttctttgaggatgaactggacgaacaccaacataaattacatgaacttataaacacatatgacagcttttacaacaagttcggaaatttaaccgcagaaggcaatgagtttatgaatgaaatattaaaactcattgcaaagaaaacagaacccataaatggagataacaatgaaaaatgaaacctatttatattttgctgaaacagccatccagaaagagaaagaagagaagtatgaccttgcagctttatattggggaaaagccaaatatttagccgctgatcttaagcatcgattatgggcgcaatataaccaagagaataacgaagaaagacacttattacataatagctataaacaggcggcaaatgatgactacatacgaacaagcaaagcaattagcacggattttagaactccaaggcttctttcgccgtgcggccaataaatggggtgaggctctttcattaacccaagagcacaaacaagaacaagaatgcaccaagaataacctgcgctgtgttcgacaagcaagaataactattcgggaggggttgtaatggtaaaaaagaaaagaagtaaaacacaacaaggcttcatgggaatgactatcccccaaggaatgcaattaggaaaagacgaagaacgtgattatttaaattcaaaaaaatatatcgccaatttctcaatagaaggcgaattcctaaaagtaccacttaatagagctatgcgacgccatgcaaagaaaatgaagattgaacttaaggaagcagaataatgagcaagaaaaacgaattagtaactatcgattcaaacaagctgccagtaatcgaatggcaaggcgttcgtgtcgttaccactgaaacgctggcgactggatacggaacggaaccaacaaacatccgttccaatattgctaatcatcgcagccgctttattgagggtgttcatgtattcactcttaaaggtgataactttcaatcatttaagaaccaaggcaataatattgacttggttaataaacatgcaaatcaaatcacccttttcacagagaaaggtgcggctcgcatgtcgaagattcttgataccgatgaggcatggtctttctttgaaaagatggagtcagcttactttcaccagaaaaaatccgcaaccaatccccctgccttgcccggtgattacattgcagctctggaagcattgctgacaactgaaaaagaaaaggtcgtcattactcaagaacgtgatgaagctcgccgtaccaaatcacagatcagtcgcagtcgtgaggctcaggcactcggcaaactcagcgctgccacccgcaaatgcagagagttggaagaacgtctgggcgaaagcacaaaacacgcaacagttacggctgtgcagaacgccacagaaaaagaatacaactacgccccactccgtaaatggtgccgtgaaaacaacatcgaagttgtgaaggttcccgatacccgatatggacatgttaagtcatggcctgccgaagcatggctggctatacacggtgttgatctcaagaaattatttggcaagaagtgaggtgatgaaaatggaaagaacaagatatgttgtgacctatttaggtgattacccctgcggacatcgccacccactaagcatttctatggtggctcgtgatgctgctgacgctttcactaaagcacaagaaacactcgcattcactgatgatcgcctgacatcaactaatcacaccctcttctctgtcatgcctgagagattcaacgaaagcatgcttgctgacatgcacctgtgcccaaacgcggaggtgaagtcatgatcatcaactccaatttattacgtgccgcattggtttgtgtggctaaaaatgacccgcgttattacctttgcggggtgcacatcacccccaaatatctggaatcaacaaacggtcatgtggctttacggttggagcatggcgtgaacacacgccgtaaagctatcgttcagttttacgggaagatccccaagaaagcagaaaccacagaactgcatttcaccaaagaaccttatgccgtacaccgagatgttaatggggcgcgagtgggatttaccgtcttatcaatactggatggacgctttcctgacctaagccgcatcatcccaaagaaagtggaaaatgttattcctcactttcaggctgagttcttggcttacccctacaaaatgtttgaagccgattcagctttcatcaccgtttccctgtatccatccagcatgacagacgcctgcttaatgaagtttggcgacaacatcaatcagcgttatggcaatcctctgtttgtcgtcatgccattccgggtgtaaggagatcgcaatgagaattgaatatctcgacaagggcaatacggcacaaatagtcattgccagcttcatcaccgaacgcagcaaacacaatcgttgtgttgatgctgccctgttagccacacctgttcgggcttcttcttccggtgtgtttttcagaagaacggttatcacaggcaaagccaatcacatgatacgtgcttacaagaccatttgtaaggaggctgacagtgacagatagggcaaacgggtctaaattatactgacgtaaaccctcccgttagaaccttcagcatataaccattatcccatccagctttctggcgcttggttttcacacccaccttaacggttttctcatttttcagtaggttaagggctattttattcattaatgccatgttttcagcggcatgaccacttctcagacgctggccgtcttcaccaaaactgacgtctaactgccagtgcagcttcgtttcaatgtgccaataactgcgtatcgcgcacgcgataaagtccgccgacttatcacggtgactggtgataaagtaacgtctttcataactcgctgattttccctgctcttcacgccaggactccacaaccgcaatgccgcccagcgtatgccactgagggtgccgagcccgcaaccaaccgatatcgttaaccagccacaaccgacgctcttcaatacggccatgatcgccctccgtgcactgggttttggcgtgagatattcccgtaaaatcgttcgccagctgggtttctaaaaagagtttgatatcatcatgaaactcaccctggttgctttttaacgccagcacataatcggcttggttctcgacaatctggtcagcgattttgtactggcagcccatcgcgtcaatcgtgatggtcgaaccgccaatatccagtagcgccaacaatttggggatcgcagtgatttcattcgatttgtccgagactttcacctgaccaaagcagagttgattcgcgactgaccaggcgctgaccagatggagagccggtgcgccattggctttgtcgagcgttccccgcaatgttttgccatccaacgcaataatgtcatcggagattttggctaagctgcccacccattgggtaaaagcgtccccaaattcttggggatcaagccgatttatcacatcgttaaaggtgtcgtgactggggatgccattgggaagatccagaaactgccgaaaccaatcttccttggatttaccgtattcttcaatcgcattgaaaccttcgcaaccgcagatcacggcacaaatcgaaatggttaaaatatcgatgagggcatactgtttagtgcggttgacacgcggatcagtgaggtgtccaaaggcgtgactaagcgtggttgcttgcatggcagtttctacggttatcatggtcagtatgcgaattataaatcacaaacatcgactcatgccctatgtttatgtgccgaatgcgtccagttaatcggattggtcaatttagacccgtttgccctgcagtgacagataagcatcgccagatggcagacattgacgatgtgcttgttaaggcaacattccacatcgacgacggcacggatcaaacacagcggctcattcatatcatgaggcgtaaccaacatcttcatgagggcatctgccctcctctgccacccgcaccaaaagtggcagaagtgaagttaacaccggtgaagaaagcgcgtaataagcaaggtaaagaataatgactaataaaccacttactatcgaagtgctggaagaattcggacaatgtgatcttaccacactggcagagatgaaagtgtcgtagatgccatgctggcaaactgtattcgcaagggaatagttgaatcggtcaatggcatgtattccctgacagagcaaacagcacctaataatatgaatgttaaagaaatagcctctaatcaggcagcaccaacaaaagttgaggtattgagagggttactctctgaacgtggagaaatgtcttcaactgaacttgcgaaagaagcaggcttcccagtgaacaatatcggcgggttactgggaaaagatatagaaaaaggtgtgataggcatgcataagagggatgggcgtcgtttctattattgggttgcgtctgtttgtcttcctgttcgtcatgttgagctgattaagccggagattgaagtgggagtttcagaaccacaaccaatgaagccagtgattgagtccagtgactttatcacggttccgagtagttctgcactgaaaagagagttgcaacaactcgatcagcgtctggacgtacttcaatccgaacggcagcaaaaggccagcattctagaccttatttatgaactggaagacctattgtctgtgaaggcggtgagccatgatcaataactccttccacctgactcaaatcatcgcctcggtttggggcgatccttctgacatcaccgatgcaatctggcaagcaggataccgtaaaccagaacggggagaaaaggaaatcgccgagcttattattgacgttatggacggggtgcctgatcaggtgccctactctgaaaggccgaagaatctgaacgatattctcacaacggatctgaacaacattatttttgatgcgacatggagtgagacagcaacaccagcaacggtggctaagatgattttggagaacgggtatcagaaaggagatgagtgatgagagagtcaccttatatcaaaacaaaggaactggcagatcgatatggcgtaacatcgcacacgataaggttatggtgcagtaatgggaagcaaaaaagagaaggcttcccaaaacccaaatttaaatctgaccaacttaattttctacggcaggatatttttgattgggagggcgggaaacaattttagtcagcttatcccaccagcgttcgtatgcctctctctgctcattcaggtaggtgtgcttatcgtacacctgccatattcccggcagtttatggcctaccataatttcagctatatgaggcacagtcaactcagaaacgccagtacgcatcgttctgcgcaaattatggatggaccaataggtataagaatcaaagtgagaagccatccctttattgagcttcgcgacaatgtctctatgcgacccatctgaaaaggatttgccacgtaacacagtgaacagatattcactcccataatttaattttttgcctgttcaattaattctttggcttttggaataatcggcctaataataggtttcttagttcttcttcctgttttatggtttgcgggagggataatccagatatttttttcataatcaaaatcattaactttagctttcaataactcagcaatacggcatccgaataataaatacaactttactatcagtgcattgcgtagattgtatttgggagcattgataagacggaaaagaatcacccgctcttcttcgcttagtgttctatcccccacattcgtatcaacatccgtatttatgtcctgacctcctaaatcacttgatatcacatcagatagaggagtgttattagtcattcctcgccgaacagcccatcgatgcgcagttttggaatatgtcaatatccgcttaccgattgctggtgattgtcttgtgacgccttcgattaaagtcagccaaataggaagttttacctcatcgtggggtagttcaccgaattttgggaaaacatgaatctcgaaagtgcgcagaattgcatcagcattaacttttacatcctgcatagtcgtcacccaccattctcgtataagcccttttacagttactgcattcaaagctaactctttgcgtacacgcttaacaattttgggattacggtgttattctagttccccacggtaagaggttacagcgtcacgagcatcttttagactggttgctgggtaagttccgatatcgatcctatccctttttcctccccagcgataccgaaactgaaaaatcactttacctttcggggtaacacgaacagataagccatctctgtctgatttggtaatcattttttcttggggtttgccattggtagaacgcagccatgaatcagtaattgccatatcactttcctcaaaaaataatacagcttttaatgtagtttatatacacattcatgtacgcatttatcatgacaccagatgaatgcttgtgaatattgatgactatcagtgattagctccactattagaaaacaggtttattaccaaaacacccatgataatcagcaacattcctattattgcaggcaaatccagtttttgctggtataaaaatatagctgccaccgagaccaacacaatgccaagccccgaccaaatagcataagcaattcccaacggaagcacttttacaacctgcgataatgcccaaaacgagaagcaatagcctatcacaacgacaatagaaggcatcaagcgactaaacccatccgatgcctttagcatcgttgttgcgatcacttcagaaatgatcgcgataagcaaataacccaatccattcatacctgttaccaatccataagagacaaaatggtgtctcataccaaaaacccgctgaatctaccataatttcaaatataacgctttaacgaaaaaaaggatttctattaccaaatttttcataaatcttaatccatgcttatctggaagacttttttaccaactctgattgataatcccttttcatccgctatcattgcttccttttttatgttctccgccataataaactgatttcagttttttaaaggtcttccaatccattgctaaacaggcaaccagaaaaagtaaagaacaatcagaaatgaatagccagaaaaatcaatataatttcaataaattacaaaaacgcctgcgtcgtgacgcgggtcaggccattgtagacttcaaaatgatcgaagaaggcgatcgtattatggtctgcctttctggtggaaaagatagctatacgcttctatccattttgcagaacctgcaaaaaagtgcaccagttaatttctctctggtggcggtgaatctggatcaaaaacagccaggattccctgaacatatcctgccagcctatctggaagaactgggcattgagtataagattgtcgaagagaacacttacggtattgtaaaagagaagatcccagaagggaaaaccacttgttcgctctgctctcgcctgcgtcgtggtattttgtaccgcacggcaactgagctaggggcgaccaaaatcgctctgggccatcaccgtgatgatatcttgcagaccgtatttttgaatatgttctatggcggtaaattaaaaggcatgcctcccaaattgatcagcgatgatggcaaacatattgttatccgtccactcgcttactgccgggagaaggacattgagcgttatgccgaagccagagcgttcccgatcattccttgtaatctatgcggctcgcaacctaacttacagcgtcaggtcattaaggacatgctacgtgactgggacaagcgttatccaggacgaatcgaaactatgtttcgtgccgtgcaaaatgtggttccatctcatctcagcgatcttaatctgttcgatttcaagagtattactcatggcagtgaagtgattgatggtggggatttggcctttgatcgtgaagagctgccctcgcagccggccgttgaatcagatgagcaacttgattttcaagcggatcgtctggatgtggtcgaaataaaatagcgaaaaaaatagccgatgtaaaaactgacatcggcataattatggtcaattattctgtacaaaactcaatttgagaaaaactacaattatggagcacaacgttcatcacccaacgttgtattcacctgcgaaagctataatgccttaattgtaggatctaattattgatatatctcaaacaagataacactaaccgttcgattttgagatagtagctcggtttgaggatagtggtctattaaatcaccacatatcccttacatttttatttagttccttataaccatttggttcgtctcaaccaccaagcgaaaatagttatcagtatggacagcaagaaacaaaatatgccgaatccaaaccgatactcattgccaggtattccaccaaggttaacgccaaacaaacctgtcaaaaaggtcgttggcaggaataccatcgtcagcaaagacatcatataaatgcggcggttcatcgcatccgccatcatggacgatatttcatctgcaaggactgctgtcctcgctatgctgccatcaagatcatccagcccccgcccgagacgatcagctatctcctgcatcagacgacgatcctcatcattcatccaaggtagccgttcactggccaaacgcagaaatacgtcacgctgcggtgccatataccgacgcaagacgattaattgtttacgtaataacactaattctccgcgtccggggactttctgctccagaatatcgtcctcaaaccctattaggctatcatgcagttcttcaataaaatcgttcatttcatcggtaatggcccctgctatttcaaccagccaatgccccgtactcttggcaccaacgccattatgtaaatcatccatggcttgatcgatacaacgaactttccggtgacgactggaaataatcattctgtcattgatataaatgcggaacgagaccaagtgatcaggacgtgcattttcattgcgattaactgtccgcaaggtgatcatggtgccttcgccagtgcgaagcacttttggtcggatactttcacctgacaacccttctttcactgaggtcggcagcaaagccgtactcatgatccatcgctggctggcctgatttttataatcaaggtgctgccagaatggctgctctgctgttgcggcttcgtcttccccaaatgccatgatacctcccttaccattcaactggcaggaatacacagcgtcggaatctttaaaaactgagccataaatcgtttccacatctgctcctttttagtgcttgatgatgtacatactatgactataggccacgtcttcaggattggtgatcgggtatccttttagccacgatttgatcaaacggccattggtatattgataaataggagcaattggcgcttgttcggtaattattttttctgcctgattataatcacagtttctcgtcatttcatcagtttcctgactagcttcttttatcaatgtgtcataggcagaattgtggaatttagcgagattgccactatgcgttgaggtcaaaagagataaaaaacttgatggctcattgtagtccccagtccaagatgctctgacgacatcaaaattaccggtattacgattatcaacataggttttccattcctgattgactaatttcacctcaacacccagtttctttttccactctgaacttattgcaatagcgatccgctggttattttctaagttgttataaagcagagaaagttttaatggattaccgaagccatatccggcttctttcaataatgtcctcgcctgattatccaattcctgttgggttaaaatttcctgccggcttttttctggctggaatccagcagtgacatcaggtgtaaagcgccatgcaggtttttctcccgttcccaagatttttcctgcaatcagtttcctatctatcgtcatggaaagcgctcgcctaacgcgaatatcattggtgggtgcccgctgtgtattgaatgcgtagtaatacgtacctaattgatccggcgtgaatacttctcctggaatatcccgcaatagtttctgatacatatttttagggaaagattcagtaatatccaaatcctctgccagataacgcttggtcgcatgggattcctgattgataggtaaaaaagtaacttttttcaatacggtatttttatgatcccaataataagggtttggtgtcagaacaattttttcatttacaacacgtcccgtaagcataaatgcgccattaccaaccaaatgaccgactcttgtccaatcattaccatatttttcaacactctgtttatgaacgggataaaggctaaaattggttgtcatattgggaaaataaggaactggacgatctaggctaacttttaatgtatatggatcaatcgcttccactcccagtttttctgatggtaatttgccatcaataatttcttgtgcattctgaatgcctgataaagccgcaaaccaagaaaaagaggatgcattagcaggattaaccaacctccgccaactataaacgaaatcagatgccgtgaccttgtcaccgttagaccagcgtgcattctgccgtaatgtaaatacccacgtctggttgtctgttgtcttccaatcaatagcaacaccagagataggctctccataagcatcctgattcaccaagccttcaagcaggtcacgcagcacttgtgcttctgtcaagccaaaggatttaataggatccaatgatgcaggttcatctttcaattgacgaaccagttcctgacgggcgtcaagttgagttccagtaggtacattagcggcagaaacagaaaaagaaagtccagtcatcagcaatacagagggaagcaacttaaaattatgcatgaatttttgccttgtgagtctaataattatcctaaaaataaattataaaacattgttaattaaaggagggcagagtatttctgaatatcgcgtctattttggtgggcaagatcgcactcttcctttacactgataacgcagtttacttaatcgagggataaaaaccatgacacaaacagtcaagtttcaaggtagcgatatcaccattaatggagattttccacaggtaggccaaacagcaaaagaattctcactggtagccaaagatctcgccgatgtgacactgagccaatacgcagggaaacgaaaggtactcaatattttcccaagtattgatacaggtgtttgtgccacatccgtccgtaaattcaatcaagttgccagcgaactgaataatactgtcgtactttgcatttcagcagacttaccttttgcacaatcccgcttctgtggtgctgaaggtttgtcaaatgtggtgatgctttctacattgcgtggtggtaaatttcacgaagattacggtgttgcgataagccaaggtccattagttgggttaactgcacgtgccgttgttgtcttggatgaaaataaccagattatttatagccagctagttgatgaaatcaccaatgaacctgactatgacaacgcattatcagtactaaaataaaataatattacttttgttttccaacatggcaaaacaattgttttataaatagaatttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtttctgggcggcaagctatttgtgattgccgccaacttatcttatcagtacaccaaaaaaatcctcatttcagtaatgataactgacaaaatacacagaaatcatacaacctaatatctcccataaaaataattttaaatcaaaatattaaaaaccacctatttcttaaattcattattttattatttggaagttatttctataaaaaaaattaatatcaataaaatttaattgaaaaataattaacattatgaaatagttcattccaattagtaatattaattacatggaattccagttttttgtttgggtccttccactaaaggcgaaaccttattaccatcaatatgaatgagttttaggaagcacacaccgcctcaacatggaaaggtacaccttggctatggtgaaggataatgtttcacctacaggtatcgttcaagcaaggtgagtttcaatacacaaattagatctgtgttcaggagaacattcattatgcagaatactcataataactactccagtggcgagttttctctatctcatgcacttcctatagggtattgtttcaacgaatttgaaattgaagaagtcattagcgaagggggattcagtattgtatatcgtgcatgggatcaccgactgaaacgcactattgctattaaagaatatatgccttctattctcgttgtacgtcgtcaggatctaaagctaaatctacgcagagcaagtctcaaaaagagattccagatcgggctacataattttatgcatgaagcccatttgatgacctgttttaatcacccctgcctgccacgctttctgcgtttctggcaacaaaatagtactgcttatattgcaactccattttacagtgggatgacattaaaaaaattacaaacgaaacgcccaaagatcatcaatcaaaattggatttataatatgttgtttcctttgcttgatgctatcgatacgctccaccaagcaggatatctgcactgtgatatttctctggataatattctgattcaagatgatcagttacccatattacttgatttaggctctgccagaaaagcaacggaacgtttgtcagatgaaaaggaagtgaccataagtcctgggtttacggctgttgagcaatacaccgccaacgaagaagggcaacaaggtccttggacagatatttactctctaggagcggtattgcataccttgattgtcggaacccctcctccagtcagtatcgtgcgaaatattgaagataactatcagccattgagtaagctttgtcctgcgggatattcttcatcatttttacatgtaattgaccgtactttgaaaataaaactatcagaacgcccattgtctataacagaactaatgacgcagataaaagcgtctactataaagacatgtcgagtccctgtattatcttatacccgaccaaacacctttacggcttacgttcctcccgtaagttcaaacagcgaataatcgtcaggtaatcctttcatttatgaagtccgaaaattagccccatcagataaaatatttgatggggctaatacttaaaaacagctaagttgatgaaaattactcatcatcttcatgttcggccatctgttttttcccgcttaaactatattcacgtaatttattcgcgatggctgtgtgagaaactcctagccgtttagccagttttcgggtgcttggataatgacggtaaaggcgaatgagtacagaacgttcaaaacgtttactaatctcatccaaagagcctgccaaaatatcgtcactgaatgcaacctctgtctctaattcaggtaactgaatatcctgagggtgtaactggtgaccttcaaactgagtgagtgcccgataaatagcattgcgcaattgtctgacgtttcccggccaatgataactacacaaaaagtgttccagttcatgagcgagtttaggcttttccaacccctgttcttcagcaaagcggataacaaaaaaatccgccaacggcatgatatccgcctgacgttcccgcaaaggaggcaatgtaatagtcaatacattaagccggtaatagagatcctccctaaattcccctttctgcaccaactcgaccaagtttttttgagtagcgcagataatcctgacatcaactttgacttcattatcttcaccaacacgacgaaacgtcccatcatttagaaaacgcagtaacttgatctgcatttgtggcgacatttcaccaatttcatccaacagaaccgtgccaccattagcctgctcaaaaaaacctttcttaccttccagtgcattcgggtaagcccctgcggcataaccgaacagctcgctttctgcaacatcatccggcatggaagcacaattcaatcctagaaaaggctgttttcttcttgaactccgcaggtgacaagctttggcaaattcatcttttcctgttcctgtatcaccaatcagcaataaaggtgcatccagcatcgctattttacgtatctgctcaacgacatgaaccattttcgggccgacagcgacaattttgtcaaaagcactgtcatcactcacagtaaactttttactcgatggggcaagagcaacacgcgtggtcgaacgaagcataatcacagcccccacacatttaacagactgattttcatccgttaattgcatgggaataatatccatgcagtaatcttgacctttgatgactaaatttgccgaatgaggttgatgatgttcactctcaagccagcggaggaaattgtaattactgatgaggtggccaatatttttttgaccaattctctctctgttgagaccaaataatactaaagatgccggattaaccagatcaatgtttcctttcatatcaatagaaaaaatgggctcaggaacagactccagcaatgtccacattgccctgtgctctttttctgacggcataaaagcaaccgtcctgacatctattaccccgttaatacggcgaatttccgccatcaataagcgaaaggtgttgaaatcaatttgagtaaaattaaggtaaatacgacgtgcaggagaaatctcaattcctttcaggtcaatatttcgtaaaaccagtaaatcaagtagctcgcgagtcaacccaattcgatcctgacaagtaacttccaatcgcatttattccgaccttatttacacgatgttcataaccgtctgaaatgttacccgttaagatgcaatagatgaagccccctgtcagcaaaagttgacgataaaacagggcgtcaaaataacgtgacagtaaccactatttgattactgtgctgttctctgttctttttactgcacttttcatcttcgtcggtaacgtgcttttaagctgagtcatcaactggtggcggaaatcccccagttttggcttatcactatcaatccacggtaaaggacgacacagttccattgccttgatacccaagcgtgccgtcagcaacccagcaccaataccttgagcggcacgcgccgaaagccgggcagcaatgtcctgtgacagccaatccataccaacttccctgaccagctccgatgcacccgcaaaagctatattcagcaagactaatcggaacaggcgaatacggctgaagtagcccaattcgatcccatatagtgccgcaatgcgattaataaggcgaatgtttcgccatgcaataaaggccatatccacgatagccagcggactgacagcaatcattaaagctgattccgcagccgagcggctgatctcctttttagcctgaacatccaaaacgggctgaacaagtttgctgtacaacatgacgatttcacggtcattgtgagtcttatgtaccgcagcctgccaacgttgcaatgccggatgttgctgcccgatcccagcctgctccgccaagttctcgcaaaattgacgccctttacctataccgtgactttgcaataatgacttcgctatatcgcgctcttccgttcgttgacgcaaacgataaagacgccgccattcgcttattacagtacctatgcctgcaaaaacaatcatactgcctgcggcggccacacccagcgaaatccaatcgtgttgctgccatgattggtatatccattgaataaactgcgcaaccacactaatacccaacaacagaaccgcaccggaaaaaacttttcgccaaaaactacgctttggtttcagagcggcattgactgcgccttcaaactcgctttcttgctcttctgcttcccgttcaggcgcgactggacagaactcattttcctgtccattgaattctttctgagatttcaatgagggttccgactgtgtttgtaaacgatcgtcgaaatcaattctcggtttcaagggatcagtcatgttagtttatctcccaataaaaactccatcgcactgtccatgcggatgtggggtaacggtgtatctacatttacttgttttggccgaaaagattcaaaattaaacccttgtttttgccagaaatcactgttcggtaaacgctgtggcacctctcccgggaaaaacgtcagtaatttatcatctgacaaccgatttcccttgatagcggggattttttcaccatcgtgaagcacgataccactttcagtagcctgaacagatgctaaaccaacacaatccatgctgatcccttcaaaggccgcattctgccacgcttcctgaactaattgctgtaagagagatatgaggttaacgtgttgatcagcggtcacgtgatcagacttgcttgctgcaaacatcaatttatcaatgcaaggtgaaaataagcggcgaaataaggttcgcttaccgtaatgaaaactctgcatgagctgtgccagagccagacgcatgtcgttaaaagcctgtggaccgctgtttaatggctgcaaacaatcaaccagaacaatttgtcgatcaaaacggagaaagtgctctttataaaaaccttttacaatgtgatcgcagtaataggcaaatcgttcccgcaacataccaatattggtatgtttatccgccttggacagttgtggctccccaattccgttaatatccggccacggaaaaaattgtagcgccggtgcccctgccagatcacccggtaatatgaaacgacccggctgaataaaatgcaacccctgcgttttgcattgatgcagataatccgtataagcctgtgcgattctggcaagcaaattttcatcggcaggtgctagaggatcgcactgttggcataattcgagccatggtttagcccaatctgccctttcccctttcagcataccgttcatctgtcgtgaccatgccagataattctgttccagcatcggtaaatccagtagccattctcccggataatcaacgatttccagatacagggtggaagtttctttaagataacgaagcagggaatcttcagagcgataacgcagagccagacggatttcactcacgccctgtgttggtattggccaataaggtggtgtgtcgtgcaatgctgcaatattttcatcataagcaaaacggggaacaccaaaatcccgttgaggcacccgcttcacaccaagtaaacgtccatcccgcacagcagaaaacaacggcaatctagccccgttgtggacatgaagaagctggttcaccaaagaagtaataaatgccgtttttccactgcggcttaatcctgtcaccgccagccgcaaatgacggtctactccacgattaacaagggatttcaattcgttttgcaaccgtttcatgtttctcctaaatggaataccgtgactcaatttatatccggccgggtaacatcaacagaattattgccaaaatttggcatcctcactgtcgttactggccagatttcatatttatctatggtttagatgctattacataaagcttgccacggtttaaagctgacgaaaacggctgcgcacactgtaggtatcagaggtgatatagcgttccatctgacgcaggcgcgcttcacttgctctcagttggtaatcaacttcatccagtatcttttgtcccgatggccccttatttacgccctctgcctgatatcccgctggcgcgggatccataacaaaggtcaagataatataggtcaataccgtgaagccaaataatccaaagaacaacgataataccgtgatggtacgcatgagcggaaccggtacattaaaataactcgccagcccagcacaaactcctttcaccatcccctgctctggaagacggtaaagtttccggcggtaagtattcgacattatgattgtctccagtttggatgctctgcatcaagtatctcttccagcgttttaattcgctcctgcatatgccgtgcattctctgccaattgccccaaacgctgaatttcattgctccctaactgaccccgactctggttactatagtgcaaccacaaccagatgggtaaaacaaaaagcacgaagaggatcagtgggattccaagaaatatatagcccattatctttccttaaatggtgagtcaatgattagtcattgtgaatctttgacactcattttagctttcaaggctgccaattgtgcactaatttcgtcatccgcttttaattctgtaaattgctgctccagtgatttctgtttgcccagcccaatagcttccgcttctgcctccatatgatcaattcgacgctcaaactgttcgaaacgtgccatagcttcatcaattttaccgctgtccagttggcggcgtacttcacgggaagatgcggctgcctgatggcgcagggtcagtgattgttgtcttacacgcgcttctgtcagtttgttttccaattcagtcacttcccctttaatacgtccaagggtttcatccagaatagacagttcgtttttcaacgcgtcaatcaaattgctgattttctgtttttcaatcaaagcggcgcgagccagatcttctttttctttacttaacgccagttcggctttttcttgccagccttctatttgattctcaccaataccgatacgacgcaaaagctgttttttctctgccaatgtgcgggccgatgttgaacgaatttccaccagcgtatcttccatttcctgaatcatcaggcggatcattttctgtggatcttctgctttatccagcagggaagagatattggcgttaacgatatcagcaaaacgagaaaaaatacccatagtcataaacctctttcattagaatgtatgtatgttatgtctgtgtactgttaaaacggatacacggtaagacacttaattaaatacaagatacatgccaactttcacatcttacttatccagttgaattatttgatataatttctctttaactttttagcactatggtttatcgtggttaaattgacctactattggcgaaaaatactatgcatcaatttattgataacctattaggcgaagcaaactgttttattgaaattctggagcaagtctctgcacttgcaaaattaaataaacccgttttggtgctaggggaacgaggaacaggcaaggaattgattgcacgccgtttgcactacctttctccacgctggcaaggctcttttatctccctcaactgtgccgcacttaatgaaaatttgctggattctgagctgtttggccatgaagcaggggcatttacgggtgcacgttccaaacatcaaggacgttttgagcgtgccgatggtggaacgctgtttcttgacgaactggctaccgcacctatgcaggtacaagaaaagctactgcgggtaattgaatacggttaccttgagcgggtgggaggtaatcagtcgctacaggtggatgtacgattggtctgtgcaaccaacgaagatctacctgccatggctgcccgtggaaaattcagggctgacttgctcgacaggctggcatttgatgttgtccaaatcccgccactgcgccaaaggcagcaagatatcatgttactggcacaacactttgccattcagatgtgccgagagttgaacctgtcgttcttccccggatttaccgatgaagccaagcaacagttacttacttatcactggcccggcaatattcgtgaattgaagaatgtgatagaacgctctatttatcgacacagagataatgaaaaagaattagataccatcattatcaatccctttgcatcatcacaaatattttcttcacaaatgtctattcctgcgtgtaatcataatgaagggacgccttattcccttcccagcttaccttttgatttaagacagtggcaaaatgacagcgaaaaacagttgattatacaggcattggaaaaaagccagttcagccagaaaaaagcggctgggaaactcaacctgacctaccatcaactacgtggattaatcaaaaaacaccatatcaacattcatgtcatggattaaaagggaagataaagggataaaaaaatagccagcacccgagctggctaataaaaacactggaagcaatgtgagcaatgtcgtgctttttctgagaaaacatatttagtatcacaagatgtctctccaaagcacgatataaatgataatgtttctcaatgcgatttgcaaagtgttttattgagaatttttctcattatagtgatctactcgttgtttttgagcagaaagcgttaattaagttacaatgcacaaactcttttttatgattgatgttttatatgcgctatttgatttactggatcatattattgttttcagcatccacactggctgctgacaatgctattccagaaacgactaaagctactcacgaagcgattcctgccgacacattgaataatttatcctatgtgtcggctgccttgcggcagaatggttttatttattgcgttaacggcaatctgagtacttttaaccctcagatggctatcagcggcctgactgtggatactctggctgcccagatttatgatcgtctcttaggtgttgaccctctgacctatcgtttgataccagaactggcttcccgctgggaagtgcgggacaacggggcaacataccgcttttacctgcgccataatgtcgctttccaatcaacggactggtttacgccaacccgtaccatgaatgccgatgatgttgttttcagcttccgtcgcttattcgacaaaacgcactattaccattatgtcaacggtgggcattacccctattttgatagtttgcaatttggtgattctgtattgagtattcaaaaaatcgataaatatacagtcgaatttcgccttaatgcacctgatgcgtcgtttctctggcacttggcaactcactatgccccaatattgtctgaggagtatgggcagaaactgcataagataaatcgacaggaacaaattgattggaagcccgtcggaacagggccattcatgctggaagattatcgggcagaacaatttattcgacttatccgtcatgataaatattggaaaggcaagccacacatggaacaggttgttatagatgccggtgccggcggcacaggcagaatttctaaactgctgacgggggaatgtgatgtattggcctatcctcccgccaatcagttcagtgtgctgcatgataatccaaacctgcaccagacattacgctcaggtatgaatatcgcctatcttgcgttcaataccagcaaaccaccgctggacaagctagcagttcgtcaagccattgcgtatgccatcaataatcagcgactgatgaaatccatctattatggcacagctgaaacagctgcctcaattttaccacgcgcatcatgggcttatgataatagtgcggaaatcaccgaatacaatcccgaaaaatcacgaaaaatgctaactgagctgggattaaatggattagaactgacattgtgggtgccaacggcttcacaatcttataatccgagcccattgaaaatggcagaactgattcaggcagatttggcacaggttggtattaagatgtctatccgtcctgtcgaaggccgtgctcaggaaaaccaactgatggataaaacccatgacatgactctagcaggctggtctactgacagtaacgatcctgacagttttttccgaccactattgagttgtgcagccatcgcttcccaaaccaacctgagccgctggtgcgactcaacctttgatgatgcactccatcaagccttattaaatcagcagcttgcatcacgtattgaaaactatcatattgcccagcaaatccttgcccagcaattacctgtactaccattagcttatccaacacgattacagatatttcgttataacattaaaggattagtattgagcccgtttggcaatagctcctttgctggagtctaccgcgtacaggaaacgaccacgcctactgggaataaaaaggaaagcaaatgattatttatattctgcgtcgtttgctgcttctgcttgtgacgctgttttttctttcattaatcagtttcagcctgatgtatttcacacctcatggacctttgagcggtgcatcactgactgacgcctatgtgttctatttccacagcctgttacagtgggattttggcatttccagcattaacggcgaacgcattattgaacaattgtacggcgtttttcctgcaaccatggagctttgtattctctctttttctatggcgttattaatcggcattcctttggggatcattgctggcgtctggcgcaacaaaaaggcagatataatcatcagtacatttgctctattgggtttttccattcctgttttctggctggccctgctactcactctcctcttttcactgtatttgggatggctgccagtctcaggacggtttgatttactgtatcggatggagcaagtgacaggttccgcactggttgatgcctggctgtccaaggagccttatcgcaatgagatgatcgtgaatgtcattttgcacatgattttacccgtcatcacactggccgttgcacccatgaccgaagtcattcgtttaatgcgcaacagtgcagaggaagtctcggcatcaaactatatcaaatcggccgccactcgcggactatcacgattgacgattattcggcgccatttgttgcataatgccctgccccccattattcctaaactgggattacaattttcaaccatgctcacgctggcaatggtaacagagcaggtattcaactggccgggtttgggacactggctcatcatcgccattcgccagcaggattattcagccatctcggctggcgtgatggtgatcggagctttggttatttcagtgaatgtgctgactgatattattggcgcgatagctaatcccctgaagcataaggaatggtatgcccttagataatttctaccgtgaaaagaaaatgccttctccactgaaagtcatctggcgttttttctatgctgatatactggcaatgacgggcttttatggggtactgattttaattgcattaagtcttttgggtgggcaaattgccccatatcaacttgatcagcaatttatgtaccagcttatgcccccgtcatggtcacaccacgggaatgtcgcctttttccttggaaccgatgatctcgggcgagatattttcagtcgtttgctgattggtacgtcttccacatttggagcggcattaattgtgactgccgcagcggcaattgctggattagctatcggtagccttgctgctatgacccatgggctgaagtctgctgtcttgaaccatattcttgagacgttactttcaattccctcactgttactggctatcattgtcgtggcttttgtaggagccagtctgcaacatgcaatgattgctatctggctggcattactgccaaggatagtacgcacaatttatactgctgtacacgatgagctggataaagagtatattatcgcagcacgtctggatggtgcttcaaattatcgtattttgcgctatgccgtctttcctaatattacggcggcgatagtcagtgaattaacccgcactctctctatcgctatccttgatattgctgcgttaggctttctcgatctaggtgctcaattaccctcacctgaatggggagccatgctgggaaattcattggaactcatttattctgccccttggaccgtcatgttacccggtgctgccattacgctcagtgtcttactggttaatttactcggtgacggcctgcaccgcgccattaatgcaggagtcgaataatgcctctactcgatatccgaaatctcaccattgaattcatgacgtcagaaggccccgttaaagtggttgaccgtatgagtatttcactgacagaaggtgaaatactcggattagctggcgagtcaggatctggtaaaagtttgattgccaaggctatctgtggtgtcacgaaagacaacctcagcgtcaccgcagaccgttttcgtttcaacgacattgacttattgcgcctgacgttaagacaacgtcggaaagtaatcggacacaacatttcgatgatttttcaagaaccgcagtcatgccttgatccatcagaaagtattggcaaacagctcattcagtccatcccgggctggacctataagggccgctggtggcagcgattcaattggcgaaaacggcgtgccatcgaactgctgcatcgggttgggattaaagatcactatgccatcatgcactgttatccttatgagttaacggatggagaatgtcagaaagtgatgattgccattgcactcgccaaccagccacgactgctgattgcggatgaacccaccaacgcaatggagccaacaacacaagcccagatattccgcttactatcgagcctaaaccagaacaacaacatgacaatcttgctgattagccatgatctgcaaatgatgagcaaactggtcaagcgcattaatgtactgtattgcggtcaaacagtggaaagtgccacacccgatgaattgctagtgacacctcatcatccttatactcaggcacttattcgctcaattcctgattttggcaatccattgcctcataaaggccgtttgaatactctatcaggggctattccatcactggagcatttaccgataggatgccgcttaggacctcgttgtccctatgcccagaaaacctgtattgaaaccccacgtttacggggagttaaaaatcatgtcttcgcctgtcatttccccttgaacatggaggaacagtaattggttgaaacattactggaagttaaaaatctgactaaaacattccgctaccgaaccggactgtttcgccatcaccaccttgatgctgtaaagcccgtgagctttactttgcagcccaaaaaaacgctggcaatcattggtgcgaatggctccggtaaatccacgctggcaagaatgctgtcaggtgttatcgaaccaacttcgggcgatatcctgattaataaccataaactggcctatggggattacagctatcgcagccaacgtatccgcatgattttccaagaccccagtacatcattgaatccccgtcagcgtattggacagattctagatgtgccgttgctcttgaatacggaactttcttcttctgagcgagagaagcaaatcaaccagacattacgtcaagttggtttgctgccagatcatgcctactattatccgcacatgctcgcttcaggtcagaagcagcgcgtggcattggcacgggcgctgatattgcaaccgcaaattattgttgcagatgaagcattggcttctcttgatatgtccatgcgttcccaaatcattaacctgatgttggagctgcaagagaagcacggcattgcctatatctatgtcacccaacacctcggcatgatgaaacacatcagtgatcaggtactggtaatgcatcagggagaagtggtagaacgtggcaatacagcggaagtactggcctcaccattacacgatattacacgtaaactgatatccagccattttggcgaaccactgtccgccgaagcatggcggcaggatatcacctaatattttttactgggcgtgttttattcactgctcggagcagcgtgggaaactcaccacatttttctccagcgtggtagaatcgtccccgtttattaacaacaaataccctagttatagtaagtatatatttttgttactccacaatataactctggtgttgaccactaagaacaataaggatactgctatgggtttcatgaccggcaagcgcattctcattactggcgtcgccagcaaactgtctatcgcttatggaattgccaaggcaatgcacgatcagggagctgagctggcttttacctaccagaatgacaagttgaaacttcgtgtcgaagaattcgctgcatcattggattcgaacatcattctgccatgtgatgtggctgaagatgaaagtattgacgcattattcgctgaactaggtaaagtatggcctaagtttgacggcttcgttcactctattggttatgctcctgctgagcagcttgatggtgattatgttaatgccgtcaaccgtgaaggtttcaaaattgcacatgatatcagcgcatacagcttcgtcgctatggcgaaatcatgccgtaacatgttgaatcctaactcagccctgctcactctgagctatctgggtgcagaacgtgcaatccctaattacaacgtaatgggtctggcaaaagcttctctggaagctaatgtacgttatatggcgaatgcaatgggtgctgaaggtgttcgtgttaacggtatttccgcaggcccaattcgtacactggcggcatctggcatcaaggatttccgcaaaatgctggcacactgcgaagcggtaacacctattcgccgtactgtaacaacagaagatgtaggtaatgcagccgcattcctgtgttctgatctagctggcggtgtgacaggcgaaattctgcacgtcgatggcggtttcagtatcgctgccatgaatgagttggaattgaaataatttcaataactcattgatatcttaaaataagcctagtgataactgtatttctgggcttatttctttcccaccatctctgtatcatcttcatctatcctcatattgttctaatttacactttacttggaatgctgcgccgacagataccacatccaatttattaccagttaatgtaagataaattgataacataaaaacttgactggtgttctttcgttttcctgcatttctatattaaggacttgattaaggagcaacatatgaaactgtactatgcaccgggagcttgttcactctctcctcacattattctccgcgaaactgggctagatttcagcctcataaaggtaaatttaaaagataaaacaacagaaaatggaactgattttttcaaagtcaatcccaagggacaagttccagcactggttctcgacaatgatgtcattctcacggaagggtctgcaattgtgcaatatattgcggatcaaaaaccagacagaaatctaatcgcgccagcgggtactttggaacgctaccaacaaatcgaatggctgagttatgtcgccagcgaaatacatcaaagcttctgagcattctctccagcaatggaggcaccagagagctatcgttcgattacccgacagaaattactgcaaaaatttacttatcttgatggtattttgtcaaaacgctcgtatattgcgggcgatcattttacagtcatagatgcttatctcttcacaacctgtggctggacacctgatataacactggatttgtctgaactcagccatttgagtgcctatctgcaaaatatcagacagcgcttacatgttcaagatgctttaaaagcagaagggttaatttaaatctgagaattgtcgcttccggtgcgccaaaaaaataatttaagctaccggaagcataacttcaccgacaatcttgattgtcagccaatttgcacagctctgaattgatgtgttggagtgaccatcttatcttgagcggcaatgatctgtagctcatattcccctctctcttgagtctccagcatcacttcgtagactgctgatgcaacatgttccagcgccacttgtaatgcttcatcggttaatgatgtacttttcagtaaattgacgagcaacaaaccactcgttaaatcaccaacacccacaggttgacgttcacccgtattaatcaatggacgactaatatgccaactatgttctttagtcaccaaaagcatttcaaagcgatctgctcggtagcctgcacgactgaggtgtttgactaaaacaatatctgggcctttttcgcataatgcgcgggctgcggatatagcttgttctacattttcgattttccgcatgctcaacgtttcaagctccagtaaattaggagcaatgatatcgctgatgggtaatgctttttcacagaggaattcagcaaccccaggagcgacaatacaccctttttctggatgtcccatcacgggatcacagaaataccatgcttcgggattggcttgcttaacctgttttacaatatcaagaatatggtttccctgttccgcagaaccaatgtaaccactcagtacagcattgcaggaaactaatttatcaatctcaccaattccctgggcaatttcagccaaatgctctggcggcataacacaaccacgccattgaggatattgggtatggttggaaaattgaaccgtattcaatggccatacgttcactcccattcgacgcattggaaaaacagcagcactgtttccagcatgaccaaaaacaacatgagactgaattgaaagaacatttttcatgataaggcctaatttattattttatgattcatgagcggcttattaacaagtcgaattatttaagggcaacattgctgttgcccttaactttgtttttcactatgtctttaactacaactacgtctttatgaattatttccagttgataaggcaataatgctttttaccacgacgtaacaaagtataacgctcaaacaaacgatcgctggccgcgaacgtatattcagcatcggattgtttttcaccattgatggaaaccgcattagaaccgatcatggtacgagcttgaccacgggaaggtactagcccagcagtgaccagagcttgttgcaaatcagcgtctttttccagttcaatcgctggcataccatcttgcgccaattgagcaagatcttcttcagtcaagtctgcaacaatgccagagaacaggctatcagtaatgcgcttcgccgcagcaagaccggcttcaccatgtaccatatccgtcacttgctctgccaatacatactgagcgcgcggagccttaccgctgttcttatcttcttcttccaaagcattaatctcttcaatgctcataaaagtaaagaacttcaggaagcgataagcgtctgcatccgcggtactaatccaaaattggtagaatttatacgggctggttttctttggatctaaccaaacagcaccaccttctgtcttaccgaatttagtaccatcagatttagtgatcagtggcactgtcaaaccgaaaacttgtttctggtgcaagcggcgcgttaagtcgatacctgaagtaatgttgccccattggtctgaaccgccaatctgcaattcaacaccatattttccattcaggttagcaaagtcatacgattgcaacaggttataagaaaactcagtgtacgaaataccaacatcatcacgatgtagacgctgctttaccgcttctctgttgatcatctgattaacggagaaatgctttccgatatcacgcaggaaagtaagcacatccatttccccaaaccattcatagttattggcaatttccgcacggttttcaccacaatcgaaatcgaggaatggtgaaacctgtttacgaattttttcaacccactctttaacggtctcttctgtatttaatttgcgttcagttgccttaaaacttggatcaccaatcaaacctgtcgcaccacctaccaacgcgataggcttatgcccggtcagttggaatcgttttaaacacagcaagggaaccagatgccccaaatgcaagctgtcagcggtaggatcgaagccgcaatagagagaaaccggaccttgcgccagcctctctgctaacgcttcttcatccgttacctgggcaacaaggccccgatcttgcagttgttttatcaggttattgctaaacatcaatggctccatcggtttgtatactttacctatataatgacctatataagtaactcgttataaattgcgtgctatagcataaaacgccagtaatttaagtgccagtattaaaaacagtaattaatctcttagggtgcaaggcgatcaatatgccattcttcgccttcccgctggcataagaagcgatcgtgaagacgatacgcgcctccctgccaaaattccacagaatcgaattcgactttaaatcctccccagaaactgggtagcgg

SEQ ID NO: 16842 - DNA, 26315 bp, Xenorhabdus bovienii
ccacaaaaagccagactctcgttatcatagtaactcatcccctcttccaccatttctgtatcgaactggagttggttagccctaatcatgatttctccctcactcatcaataatgtgtattcatgaccgatcaattgccattggcgctcactgcctttgatgcccgccagtgctgaagttattttatccaatacactcaaatcacctttaacttcttcattcaaccaatgaccaatcgcttcatgatccatcgaaaaagaagttgtaacgtgacccgcaatatcctgcgtaaattcatattccatcatgcaccccactatattgttgatatcaaccacatctggattttaaacatttccgcagctctcacctcagagacagtccacaaactgacacaaaagctaccataaaaaaaggaggcatctgcctccttattttttgcaatatacttttttatacagccgtttggaagatcacttcatccgctttttcggtgtactggttcaattgatcaaaattgaggtagcgataagtatctgctgcggtttcatcgactttgtccatgaattgcagatactcttccggcattggcaggcggcccagcaatgaagccaccgcagccagctccgcagaggccagataaacattcgccccagcgcccagacggttagggaagttacgggtggaagtggataccaccgttgctccatccgcaacacgcgcctgattccccatgcataatgaacaacccgggatttcgacacgcgccccactcttgccaaagatgctgtagtaaccttcttccgtcagttgggcggcatccattttggttggtggagcaacccacaggcgagtcggtaactggcctttatgttgatccagcaatttgcccgcagcacggaagtgaccgatattggtcatacaggaaccgataaagacttcatcaattttgctgttagcaactgctgataacagacgcgcatcatcaggatcattcggcgcacataaaataggctctttgatttctgccagatcgatttcaataacagcagagtattcagcatccgcatcggcttccagcaattgaggatctttcagccaattttccataccgatgatacggcgttccagtgttcggcgatccccataaccttccgcaatcatccatttcagcaatacgatattagattgcaggtattcagtgataggcgctttatccagcttgatggtacaacccgctgcagaacgttccgcagacgcatccgccaattcaaaggcttgttcaactttcagttctggcaggccttcaatttcaagaatgcggccagagaaaatatttttcttacctttcttctcaacagtcagcagaccttgctgaatggcataataaggaatggcatgaaccagatcgcgcagggtaatgccgggttgcattttacctttaaaacgcaccaatacagattcaggcatatccagcggcattacgcctgttgcagcagcaaatgcaaccagcccagatcctgctgggaaagagataccaattgggaagcgggtatgggagtcaccacctgtacccaccgtatccggcaataacatgcggttcagccatgaatggataatcccatcgcccggacgcagcgataccccaccacggttcatgatgaaatcaggcaacgtgtggtgtgtagtcacatctacaggttttggataagccgcagtatgacagaatgactgcatgaccagatccgcagagaagccaagacaggccaaatctttcaattcatcccgtgtcattggcccggtggtgtcctgagaccccaccgaagtcatcttaggctcacaatattcgcctggacgaattcccgtcgtaccacaggcacgacccaccattttctgcgccagtgagaaaccgcgttcacttttctcaattgcttttgcctgacggaatacgtcactgtgtggcaattccagtgattcacgggctttcgtcgtcaagccacggccgataatcaacggaatacggccaccagcgcgcacttcatcgagaagtacatcagttttcagcccaaaggttgccagcaattcattggtgtcatggtgacggatttcgcctttataagggtaaatgtcaatgacatctcccatattgagattggaaacatccacctcaattggcaacgcgcctgcatcttccatggtattgaagaaaattggtgcaatttttccgcccaatactacgccaccaccgcgcttgttaggcacaaatggaatatcttcacccatgaaccacaggacggaattagttgcagatttacgggaagaacccgtacccacaacatcaccgacataggccaaaggatggccttttttgttcagttcttcgatttgcttgattgggccaacggcaccggcttgatcaggctcaatgccttcacgagcattcttgagcattgccagagcatgcagagggatatctggacgtgaccacgcatcttgtgcaggggatagatcatcggtattagtttcaccagtgaccttaaaaacggtaatggtaattttttctgccagttcaggacgctccaagaaccacttagcatctgcccatgactggataatttgtttagcatgagaattgccagcttttgctttttcttccacatcataaaagctatcgaacatcagcaaagtatgagaaagcgctttcactgagattggagctagtttttcgtcatcgagggcatcaatcaaagcgtggatattgtacccgccctgcatagttcccaataattcgatggctttttcccgcgtaacaaggggtgaggctgtctcacttttggcaatagcggcaaggaaaccggccttcacataagcggcctcatcaacaccaggaggaacacggttggtcagtagatctaacaggaaatcttcttcacctttaggtgggttcttcagtaattcgaccagcgctgctgcttgagctgcgtctaatggcttagggacgatgccttgagctgcacgctcggctacgtgcttgcggtattcttctagcacgacttactcctcgctctcattgtcattttatatacccggctgtctgcacccggtaacgatcatcaaagaacaaccatcaagggtgtcaggtcagaggattttactcgcataacttcaggattatgtcgagcttcgggcgcttagcataccaaattttgaatggcatgttaattcattcacataaaagtaacattatgccatgataaaatgttagataacgagacacaaagagagtattacagttttatataccatttttttctacttaagcctgaaaatgcctccatttctatctgttatatttccctgttatattttctgagtcagcggggctttcaaatctgctaacagactaggctccccttacagagattttcaccatgaaatacagatgaaaacctttaaactccgaacaatacaataaaatttacataaattaaaaacggccccctgaataggagccgcttggaacaaaaatttaatatactgcgaaatctaaagaattatttctttttctttgccttcggatttggcaaatcagtaatgctgccttcatacatttccgcagccataccgattgattcatacagtgttgggtgagcgtgaatagtcagagcgatatcttccgcatcacaacccatttcaatagccagaccgatttcacccaacagctcaccaccgttagtgccgacaatagcaccaccgataatacggttgctttctttgtcgaaaatcagtttggtcataccatctgaacagtcagatgcgattgcacggcctgacgccgcccatgggaaagtggcggtttcgtagctgatgcctttctctttcgcttctttctcagtcagaccaacccaagccacttctggttcagtgtaggcaatggatggaatcacttttggatcgaagtaatgtttcttaccagagataacttcagccgcaacgtgaccttcgtgaacacctttgtgtgccagcattggctgaccaacgatatcaccgatagcaaagatatgaggcacgttagtacgcatttgcttatccacatggataaagccacgctcatcaacttcaacacccgcttgacccgcgtcgagcgacttaccattaggtacacggccgatagcaaccagaactgcatcataacgctgtggttctgctggcgctttcttgccttccatcgttacgtagatgccatcttctttagcttctactgcggtcactttggtttccagcatcaggttgaatttcttgctgatgcgtttagtgaacactttaacaatatctttgtccgcagcaggaataacctgatcgaacatttctaccacgtcaatctgagagcccagtgcatggtaaaccgttcccatttccagaccgataataccgccgcccataaccagcagacgttccggaacagttttcagttccagtgcatcggtagaatcccatacgcgaggatcatcatgtggaatgaatggcagttgaattgggcgtgaacccgcagcgataatggcattatcaaaattaatcgttgttgcgcctttctcgctttctactaccaaagtgttagcgcctgtaaatttaccaatgccgttaacaacattaactttacggcccttagccataccgcccagaccacctgtcagctgggaaatcactttttctttccagagacggattttgtcgatatcagtttgtggctcaccaaacacaataccgtgttgtgccagtgcttttgcttcttcaatcacttttgcaacatgaagcagcgctttagatgggatacaaccgacgttaaggcaaacaccaccgagagtagagtagcgctccaccagaacagtatccaaacctaagtctgcacaacggaaagcagcagaatacccagcagggcctgctccaagcaccactacctgggctttaatttcagtactcatcatgacctcttaattgtttgtccggcgggtcagacgaaaaaaaaccatattccaccgggacgtacacaccgcgagcagtttacagaattgtaaataacctgaaaagcgcgttaacgtgacagaaatcccaacatgctagatgtaagtctaaaatatctgtcacgatcgtaatcataaaggatagtaatcatcaggccggttactcaccggccttcatattacatcgccagacggcggatatcgctcatcacttcattaatataagtgatgaaacgtgcaccatctgctccatcaatcactcggtggtcgaaagacagagacataggcagaatcagacgaggaacgaattccttgccattccagacgggtttcatagaagaacgagacagccccatgattgccacttctggtgcattcacgataggcgcaaagccggtagtgccaataccacccaggctggagatggtgaagcaacccccctgcatgtcggaagccgtcagcttaccagcacgcgctttcttggatacttcagccagttctcttgacagttcgatgatgcctttcttgttgacatctttgaacacaggaacaaccaggccattaggcgtatcaaccgcgataccgatgttgatgtattttttcaggatcaacttctggccatcttcagagatagaactgttaaagcgaggcatggcttccagcgctttcgccgccgctttcatcacgaataccagcggagtgatcttcacgcccagctgtttcttctcagcttctttattctgctgtgcacggaacgcctcaacttcagtgatatccgcttcatcgaacaggttaacatgagggatcatgacccagttacgactcaggttagcaccggagattttctggatgcggctcatttcaacttcttcgatttcaccgaacttgctgaaatcaattttcggccaaggcagcatacctggcatgccaccacccgcagcagcagtaggcgctgcttctgcgcgtttaatcgcattttttacgtaagcctgaatgtcttcgcgcaggatacgacctttgcgacctgtgcttttcactttcgccagattcacaccaaattcacgcgccagacgacgaatgacgggagtcgcatgaacgtaagcgtcattttctgcgaattcgttcttgccttctgctggctggctagccgctggagctgctttcaccgattcaaccgcaagagatggtgccgctgccagtgctacggcaggagctgcgcccgccacttcgaataccatgatcagagaacccgttttgactttatcgccaacggcaatcttgatttctttcacagtacccgcgaatggtgcagggacttccatggaagccttgtcaccttcaacggtgatcagggactgctcttcagtgatggtgtcaccaacttttaccatgatttcggtaacgtcaacttcatcaccaccgatgtcaggtacgttgacttcttttgctgctgacgccgcaggagccgctgctactggagctggagttgccgctggcgctgtaccagaacctgcaacttcgaataccatgatcagagaacccgttttgactttatcgccagccgcaatcttgatttctttcacagtacctgcgaatggagcaggaacttccatagaagccttgtcgccttctacggtgatcagggactgctcttcagtgatggtgtcaccgacttttaccatgatttcggtaacttcaacttcatcaccaccgatgtcaggtacgttgacttctttgctttcagccgccacaggtgccgccgccagagctgctgctttctgttgcacaggtgcagcttctgctgcaccctttgcggactcaaaaatcatgatcagtttgccggtttcaattttgtcaccaactgcaactttgatttctttaaccacaccggcctgtggtgatgggacttccatggaagccttgtcaccttcaacagtgatcagtgactgctctgcttctacggtgtcacccgctttcaccagaatctcggtaacttcaacttcatcagcaccgatatcaggtacgttaatttcaatagacattaatctttacctcttatgccagacgtgggttaactttttctgggttgatgttatattttttaatagcttcttcaacgactttcacatcaacttcgccgcgtttagccaattcacccagagcagcaacaaccacgtaagaagcatcaacttcaaagtgatgacgcaggttttcacggctgtcagaacgaccgaaaccgtcagtacctaatacgcggaattcgcttgcagggacgaagttacgaacctgctctgcgaacagcttcatgtagtcagtagacgctactgctggtgcttcattcatgatctgcgcaatataaggaacacgtggttcctctgatgggtgcagcatattccaacgctcacaatcctgaccatcacgcgccagttcagtgaaggacgttacgctgtatacatcagaaccaataccatactcgtcagacaggatcttagctgcttcacgaacatgacgcaggatagaaccagaacccagcaactgaactttacctttcgcactgtcaaaagcttccagcttatagatacctttacggataccttcctctgcacccgcaggcattgctggcatgtggtagttttcgttcagtgtagtgatatagtagtagatattttcttgtttctcaccatacatgcgctctaaaccgtcatgcatgataacagccacttcataagcgaatgctggatcgtaagagatacagttaggaatagtcagagactgaatgtggctatggccatcttcgtgctgcaaaccttcaccgttcagagtcgtacggccagaagtaccgcctaccaggaagccacgagcctgttggtcgccagccgcccagcacagatcaccgatacgctggaatccgaacatagaatagtaaatgtagaacggaatcattggcaggttgttggtgctgtatgaagttgcagcagccagccaagatgaggcggcacctagctcgttgataccttcctgcaggatctggcctttggcgtcttctttatagtatgcaacctgctcacggtcttgcggagtatattgctgaccattcgggctgtagataccgatttgacggaacagaccttccataccgaaagtacgtgcttcatcagcgataattggaaccagacgatctttgatcgacttattcttcagcataacgttcagtgcacgaacgaaggcgatagtagtagaaatttctttggattgttcttccagcagtgagctgaagtcttccagtgcaggaatttccagtttttcatcgaagtttacacgacggcttggcaggtaaccacccagcgcattacgatgctcatgcagatatttggactcttcagagtctttatcaaaagtgacgtatggcagtttttcaatttgttcatcagacacaggcacattgaaacgatcacggaagtgacggacaccttccatattcattttcttaacctgatgggcaatgtttttaccttcagcggtatcacccataccataacccttgatggtctgagccagaattaccgttggttgacccgtagtattctgcgcttgattcagtgcagcatagactttcttaggatcatgaccaccgcggttcagagcccagatttcatcatcagtcatatctttgaccaatgctgcggtttctgggtaacggccgaagaagtgctcacgcacataagtgccatctttggacttgaatgtctggtagtcaccatccagagtctcattcatcagttgaaccagtttaccgctagtgtctttacgcagcagttcgtcccaacgctcgccccacagaactttcagcactttccagccagcacctgcgaagataccttccagttcgttaacgattttgccgttaccagtcactgggccatcaagacgctgtaagttacagttgataacgaagacaaggttgtccagtttttcacgagttgcgatagtgatcgcacctttggattctggttcatccatttcaccgtcgcccaagaaagcataaacggtttgttgagacgtattcttcagaccacggtgttccaaatatttaaggaatttagcctgataaatagcagaaattgggcccagacccattgaaaccgtagggaactgccagaaatcaggcatcaattttggatgcggataagaagacaggccattaccaccaatttcctgacggaaattgttcatctgctcttcagtcaaacggccttccaggaaagcacgtgcataaacgcccggagaaatatggccctggaagtaaaccaagtcgccgccatcattttcattgcgagcgcggaagaaatggttaaagcaaacgtcgtaaaaagtagcagaagactggaatgaagccatgtggccgcccagatctagatctttcttggatgcacgcagaacggtcatcaccgcattccagcgaatagcagagcggatacgacgctccaaatccagattgccagggtaagcaggctcatcctcaacaggaatagtgttgatgtaatcacgacttgcaacacctgctgcaacgctaactccacctttgcgggccccgttcaaaacctgatcaatcaggaactgagcacgctcaacaccctcttcacggatgaccgattcgatcgcctgtaaccaatcgcgagtttcgatcggatccacgtcatttttcaaaatatctgacatggtgtattccttatctgttatctatttctaatggttgttttggagcctatcttctggtcataccttttgacgttttgccagtcatgaccggaagataggccctgctatatgttgccgctaaaactcttgaataaagagttgacgaactgtacagacgcagcagccaagatctgtacagccaagattatagaacctaccccatccgggagttttaattgtcaatgacgcccttgaggataggcatttattcctgatgttgctggagccggcgtagtgagcgctcacgacgagtatgctcacgagtcagatccaataaaacttcttcaataaaggccaaatggcgatgcgaagcctcacgggctttttccggttctctcgccatgatcgcacgaaaaatctctgccctgtggttactgacagcggctaacatttccttgcgggtatagatgaattcgaagttgcgtcggatattttgttccagtatggggatcatacagcgcagcaaatgtagcaataccacgttatgggcagcttcagtgacaacaagctgatattgcaggacagcatctgattccgctttaacatcaccgctttgctgggcttcctgaatggcaaagtggcttttttcgatgcgctcgaaatcttcatcggttcccctaagagccgcataatatgccgcgataccttccagcgcatggcgcgcctcaaggagatcaaattgagattcttgattatctgcaataagccgggcgagtgggtcgctgaaactttgccagagattactctgcacgaaagttcccccgccctgacgacggaaaagaaagcccttggcttccaatttttgaatagcttcgcgtagtgaagggcgtgatacctcaaactgctttgccagctcacgctcaggcagcagcttttctcccgggcgtaacgagccttcgagaatgagatgttcaagacgctgctcaatcacatctgataactttggttggcgaatcttgctataggccatatctgctgtaagccattcaatgagtaaatgttgcttcggactagtcatgataactgggtcagatcaactggatcgtgatcaattcagcctcagttaatcgggctatagtcaattggtaataccaatttagaatacagggtcttaaagtaacaaagtattcattagctgtctataaagaccttgagctaaatcataaaaatctgcaaattttaacaaattattttaatttttattaaaaaattataaccaaaaaggattttcaggtaaaaaaatttgatggggtttaacttttaaaaacgtatagataggcaaactgaatcgttacagtgagagatataatttatatttattcatatactatatatattaattcaattaaatttgatagatgagtaataatcaataatggttaataggtcaaccaaattaacttggttccctctctccaaacacctgaccaaaaaaaattcccgccaacgttatccttaacgtcatgacgggaattggcctgtgaaaaatgctacattaatattaataatcctaatatagataattcctgaatagttaaaatattccctaggttggcatttctattatctacgttttatatatgtccataacattatttttattcctgggaggatggtatcattctaatgttttgttgttttttattgatagatatttcattactctattactctatattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagtttattagttttagtgtttacatatcgtcatatgtttcaaatttagaaaaatatttccatatagaaaaaaacaattagaccctattataaataggcaggcatttctattttaatctgaataatccagactatttatcaattcatgtatccatataaaaaagagaaatcataatatttagaaaaataacacttcatcaataaatataaaattaatcacttaaatacaaatcgcagtgaaaaaacagttattatggagcaatgttcatctaattattttcactatataacatcataacacataaatttaaataataaataaacaaagctgacaaaaaataaaatatattattaaccgaatgatttaaaaagaaaggaatcttaaaaccagacccctttcacatttatatatccttcatcttccaacttattgttttgtttgttatttttctggaggctttcattcccccagtgactctttttcattcgttaagctaatgctccatagatcgtcaacaatgcaacaataatcacaatagtcaatgtcgcctttttcgctaacctaacagccgcaacaggagtttctattggattaagatgaggttccttacttaaggcaaactgagccaattgacttaccaccttatattgcgatgtccgaagatcactgagggatgcaacccaagctggcaatgctttttccccatgccctaataaagcataagcgatccccgccagacgtgcaggaacccaatctagacagtgtagcaaactatcaaccccagtttgtgcacgttgcacagccgttccgtgttgtgccaaccatccttgataacccctcaagaaaccgtacccaattaagattgcagggcctaattttcccatcactaccaaccagaaaatcggtgcaagataataacggaaatttatccagatcaatgcattctgtatctcacgcagccgctcatcttttgtggtatcaggtaaagttccctgtatcatcgtcaaacgggcaagatgattattttgctgatccagatcatcaagacgtacagctcgaagatattctcgatagtcataacgcagagaccctgcaccaatacacaacaagctgatcataatatacagcagaattcccggtacaccaaaaaccacatcactcaaaacatcaataagtttccaggtcagtaatgcgaccagcagggtcatacccaaactgctccataatgaaaataatttcattatggcaaacaaaggggacaaatagcgttccaactgccaatggtcgcccatcttaaaaacacgttcccatgccagtactaacaatagaataaagagagtcattcaactcgctccttcaatagttgccgataatgttcccaataaaaataaggccctgggtcggttttcctacccggagcgatatcactgtgccccgtaatattattgcggatatcaggaaagtgacagataagcagttgggtaacttccgccaatctgaggtactggatttcactaaatggctcataatccgtcccttccaactcaatacctatcgagaagtcattacatttctcatggtcacagtagcaggatacgccagcatgccaagctcttttatcaaaagggacatattgcacaatttctccatcgcggcggattaagcaatgagcagaaacacataatccctttatctcattaaagaacggatcttcatctgaattcagcgttcccataaatagctgatcgatataaggcccgccaaacttgccgggaggtaaactgatgttatgaatgactagtaatgatgggatttcaccttctggacgcagatcataatatggagagattaccttccttgcaccatcaatccacccttcatgcagcttcattcttttactctcctcaatatctcaacagcaatattcccaaccaagtggaatggcaccactcaaagtgtaacaggttagcattttcaatcgagtactatttctggcgtgtttttcatttgcgaaccagctcgaaaattcctctgtaaaaaatgtaacgaatagttattttttcgagctatttccataactattactgaagctatgttatttttctctgtttttgtcatccttatgaacgccgacatctatcggggatcatgcgccataccatgagaaaacacacaaaggaggaagaatgaaccaacaagggtttacattaatggaattgatggttgttatggcaattgtgtctatccttggcgcaattgctattcccagttatcagggatatatccaaaaagcagcattaaccgatatgctacaaactattgtgccttataaatctggcgttgaactttgtcgttttgaaacagaaaactacaaagactgtaatactggccatgcatcaatcccatcaggtcataatagccgctatatcagcaccgttacggtaaaagacggagaaataatcatcgtcgggcaacaaaatctcaatgggctcactaccaccttaaaaccaacccaagataccaaaaccggcgttatctactggcgtaccatttgtgatactaaaaatgaatctttaaaattgaaatgtcaggaaacttttaaattttaaacagttaaattttaaagctactctattttcaaacatattatttcgaaaaataagattttcaaattgcttcagcattaaaggaatatagaaaatgagaaacaaggaaaatatattaatggaaagggaaatcaatgaactgtgtcaacgacatcaggccattattataaaaagagagagtcataccatgactattgcctgtagcaaatcacccaatgaagatttcattgctgcattacggtttatttctggctcaatcattaatgtagatatttggccaaaagcaaaaatcgaatctatgctgacacaaggaaattcattggtatcttgtacagaaaatcactgtgctgaaaatgatgatgaggaacattatcgtatcgaaaaactggatgttccctattccaatcacagtgaaatacaaacaaacgatgcccattctgaagatatggacacgccagttattcaattaattaatcaaacgatatcaacctcaatacaaaaaagagcctcagatattcattttgagccttctcaacgtggctatcggatacgtattcgggttgatgggatcctgcatgctgtatcatcaccttctccccaaatgaataccggcattccagcccgcttgaagatcatggcaaaactcaatattgctgaaaaacgccagccgcaggatggacaatttgactggaatgatagcaaaaacagttatgcgatacgtatatcaacattgccaactctacatggagaaaagattgtcctgcgcgttttaaataccatacaccagctatcgctggagcaacttggcctgccagagcctcaattgcaacttttaaaacagaaaatccacttaccgcaaggtatgatcctagtgacaggcccgacaggaagcggaaaaaccgtcacactgtatagctgtctgcaatatttaaatcaggcgaagaagaatatctgtagcgtcgaagatccggtagaaattcccttaaatggcatcaaccagacacccgtaaacaacaaaattggcctcgattttgccaaagttctcagagcattattacggcaagatcccgatatcattatggtcggtgaaatccgtgacaatgaaactgccgagatatcgatgaaagcagcgcaaacaggtcatctggtcttatcgacactgcataccaactcgacaattgatacgttatcccgcctgcaaaatttggggatttcaggctataccacagcatcgtgcgtgaaattgattattgcacagcggctagtacgtacactctgcccccattgccgccagcaagataaagagcacactgtcatcaatgtcgacagtggcgctatttctataaagcaacctattcccatagaacaagccgtttcgataaaacaacccgattccgtaaaacaatctatttctataagacaatggcttgcggttggctgtgaacactgtttttctggctattatggcaggacagccatctacgagtttcttgagatcaagccaaccctccagcaggccctgtcagaacactcgattgacaaccttccacagttgctcgctgcacaacagcattcaactcttttttccgcagggctggtcttggtggaaaaaggcataacgacactggaagagatttatcagattacaggccaggaaacagcatgaaaatggaatatatttatcaatggcaagcggtcaataaaaaaggaaacattgtaaaaggagaaagcatcggccagagcagacaaagcgtatttcaacatctgagccaccttgatttgcaaccttataccattaaatgcaaaaaactcattcattacagcgaaaaggaaatcgcttatcgcttacatttcattcatcaattaagcacattactggcatcaggtatccccctattaaaggggcttactctcttattacaggaatgcaaacaaatgctttggcgatgtgtattaacagatattattcaaaaaatcagtcaaggtgagtcattttccacgacactgggacactatccccggttattttcgcccctgttccgccagcttatcgcggtaggcgaagaaaccggccaacttgaaacctgctgtcaattgattattaaccgattggaacaacaaaatatattacgtaagaaaatccagaaggcttaccgttatcccttgatcgtagcctttgtaactattcttgtcattttactgatgctgatttttgttctaccggaattcaagcaagtttattcttcgtttgatgcctcactgcctctcttaacgcagtgggttttatccgcctctgatttcctgattaatcacggtgtattgcttctggcaatagcctctctattgataatcagttacctatggctgcgccatcaatttcccacactgcaaacaagggaaaagatgttccttctgaaactccctctttttaaacaactcacgatttatcaacaaaccaaccagatatttcatattctgtttatgacacaaaaagcaggtctaacactaacgacagggctggaatgtgctctgaacgcgactcaccaccctgtattcatggcaggggtaaaaaatctgtacaggcaaattcagcaaggcatacccatgagtgatgctttaaaaaaagaaatgtactttccaccattatgtcagcagtttgtcatgataggtgaagaatcaggagaattagaattatttttggggaatctagcggcatggtatcaagaacaatcaatcagccttgctgatagtctagttcaattacttgagcccgtactaatgctgataatggcagtgattgttggtttattattgctggctatgtatctgcctgtttttcagttaggtacaatactaacgtaacagttcatttacatgttccactacctctcttcggggatcgtaaaagcaggaattatacccgtttgtttatagcccatctgactcccttgagttacaatttaaatatgctatcagaaatattttaagggatagaatgagttatattattgcactcacaggtggaattggtagcggtaaaacgactatctctaatgtattttcatcccttggtgtcccacttattgatgcagatattatcgccagagaagttgttgctccgggctcccccgcattgcagacaatcgcagagcactttggtgctgacatattgctgccggatggcagtctaaatcgcgtccttctgcgccaaaaaatttttgcagttccaacagaaaaacagtggatcaatgcacttctccacccgttgatacacacagaaacccaacagcaactaagccaagtcactgccccttatgccatttgggtcgttcctctgttaattgaaaataatttaatgcatttggcagatcgtattttagttgttgatgttccccctgaagtacagatcagccgaacaatgacacgtgacggagtgagtcgtgagcaagtcgagaacattctggctgcgcaggccaaccgtcatgaaaggctggaaaaagcggacgatgtcatattcaaccatcacaatgagcaggatatcatctcccgtgtggtcgaattacaccaacagtatttgaaacaagcagaatcagtcagacaggaaaatcgtaatgagtgatgcaacctctactattatctttgaacacccacttaatgaaaaaatgcgttcatggttgaggattgattcttcactgcaacaactggaaaaacagcggcatctagattcatcggcgagttgcctcgcgtttttccgcacgattgccgaattaatcgaaatactggaacgcggtgaagttcgctctgaattattgaaagagctggatcgccaacaggcaaaactaaagcaatggctcggttcgcccgacgttgacacggctatgatccacatactgatagagcaactcaaggaacggagcatcgccttgaataaggccccacgtctcagccagcacattaaagaagatcgtatcatcagcattgtgcgtcaacggcttagtatcccaggaggatgttgcagttttgacttgcccactttacacctgtggctgcatttaccacagtctgtcagagataaaaccgtcaactcttggctggacggtctgcgcccattacagcaagcactggaaagcattctggggctaatacgccaatctgccatattttccccaaaaatcagccataacggtttctatcagggaaatgctgatgaatctgacttattgagattaaagttagatgtcgtactggatgcgctggtctatccgcaaatatccggtcacaaaacccgttttgccatccgctttctgccgatggatagcgaacacggtgttgtacctgcgcatttgtcatttgaattagcctgctgttaacatagccttcaaatcaagcaggagaaaatcaagatgtctgaagtattaaccgtcgcatgcccgacttgcgctaaaacggtaatatggggagaaatcaacccatatcgcccattttgcagtaaacgttgccaactaatcgacttaggcgaatgggccagtgaagaaaagaaaatcgccagccaggacgacagttcagaaaacgatagctggagcgaagaaccagatcggtaataaccatcaaagtagcgccgattgtattcggcgctaccgttaattatttgttttttttaatgagatccgcttttgttcagcaaagccactatgctgcggtttgccggcggaaactcatcagcgatcaattcggtttgcaaaacccaacgggaaggttgcccctctttaccaaatggctcatttttccattgatccacaaggtaaaaatagagtgtgatgtttctgtcagaaaattcatgagtgatggtttccaccaattcacaatgggttaccgtgatccccacttcttccttcaattcccgaatgagtgcctgctccggaatttctccctgttcaagttttcctcccggaaattcccaaaagccgcccatatgtgagtcagcatgacgctgggtgataaaaatctcatcattggtatttttaatgatgccggccgcaatatgcagatgttttttttccataatagtttttcttgcagttgattatttaatcaatgtgattatttcttgcagactataataaacagtcatatgagaaagaaacaggattaatctcacgagagccgtaatcacgtcttatcactttttgccaagcttcacccgaataaaagcctattatgtgaacacattctggtaacggtatctgagattagccgacaaataaaatccgacttagaaagtataaaaccatactttaaaaatcaaggaagcatcattcatgcaatatgcaggtcaaccattgatcgaagcaaagcaaatcgcctatcaattttctggtgaaatcattcctctgttttctggtattgatatgtttttgaacgcggaacaacacgctttggtaggtcgtaacggtattggtaaatcttggctagcatcaatattggctcggcaaataccaccgacagaaggcagtgtgaaccatttctgcgatgttagatatctgtcacaaggtctaacatccttttcaggtaatgcggctgagatgttaggactaactgagatcatgaatgccaatgaacgcattctagcgggcgtcggtgatatgacagattttgatgtcatggaaaatcattgggattggcaatttcaaattgaatccctattggcagaaggagaattgcgctctgaagtattaaaccagccttttagttctctcagtggtggagaacagactcgtctcagactgctggcactaaaacatcagggagcggagtttatgattttggatgaacccagcaatcaccttgatcgacaagggcgtctctggctggctcaatggctgacaactttcagtggcggtattttactgattactcatgacccacaattattacaacatgtgtcagttgtctacgaactcagtgggttagggctatgccgcagcacaggtggatgggaaacgtggttagaaagtaaggaacagctacggttaagtgtacagcgcgaggttgatcagactcgtaaaaacctcaaacaagccttgcttgataagcaaaaagatcgagaaaaagcaagtaaaagacaaagccaaggtaaacaacgacgggaaaatgctaatcaaagtaaaatcattcttgatcgggaattagggcgctcagaagccacgctgtcacgacaggctaagcaacatgaggaacgattacagcgaagcgcttctctggccacagatgccagaacaaaactggaaatcatcgctcctcagtcaatcgtagttgctgcgccgcaaatagcgactgctccattactttatctgcaaaatgtcattttgccttttggctcaagctctcccatcagtttaacaatgaatcatagggatcgcctcgctatcacgggaaaaaatggcagtggaaaatctaccttgctaaaagtgatggcaggtttattccctgccaaacaaggcacttgccgaataacaccttcctatcgtctgatggaccaacacttttcatttcttgataaaaaccaatccgcactgcagaactttcagttacagtcacccggttggcctgaagatcgctatcgtacccggctggcacaactgcgcattcgtggtgaagaagtcttgaaaccggtaggctatctgagtggaggagagcaactcaaggtcgctcttgcctgcttgttttgtgggccttatgctcccgccctcctgctgctggatgaacctgacaatcatttggacattgaatcacgcgaactactccaaaaagcgctgcatggttatactggtgcgatggtgctgatttcccacgatgctcagtttattgcaaatattggcaatatgaaggaattactattgggtggcagcgaggattctcttcataaaaaaacctcaaatcattctctgagaaatgaattttgagggttttatccaatcagccaacgacaatgaatcgctggctctttattactgatttttattataaactgccgtggcaatgcttaaattttttgcctgagccacatgggcaaggatcgttgcgtcccactttacgtgcgccactcgccatctgtgcttctgtttctgacatcaaagcgccttgctcaacttcatggctcaaatgctgtttctttgccaaacgttccgcttcttcacggcgctgatgttcaagcgcttccacttcttccggtattctgacctgaactttactcaatgtgctgatcacttcatatttcagcgattccagcatattagcaaacatggcgaaagattcgcgtttatattcctgctttggatctttctgtgcatagccacgcaggtgaataccttggcgcaggtagtccatcgcagccaagtgctctttccacagcgtatccaaggtttgcaacatgatgcctttttcaaagttacgcatcatttctgtactgacgatttcttctttctgtttgtaaacttcaatcgccttttcaagaatacgttcgcgcagcgtttcttcgtgcaattcaggttctttgtccagccactctttgatcggcatatccagatcaaagtcgtttaccagacgttcatgcaaaccttctatatcccacatttcttccagagattgtggcggaatataggcatcaatagttaccttgaagacatcttcacgaatgctggcaatggtttcgctgacatcactcacatcaagcagatcgttgcgttgggcataaatcgcacggcgctgatcgttagcaacatcatcatattccagcagttgcttacgaatatcgaagttacggctttctaccttacgctgggcattggcaatcgctttggtgacccatgggtgttcaatcgcttcacccggctgcatgccaagtttacgcatcatgccagtgacacgatcggaagcaaaaatacgcatcaaggagtcttccattgagagatagaagcgcgaagaacctgcatccccctgacgtcccgcacggccacgtaactggttatcgatacggcgtgattcatgacgctctgtaccaatgatatgcaaaccgcccgctgcaagtacttcatcatgacgttcttgccatgcagctttgatttgctcgattttctcttgggttggttcttccagtttggcgatttcagactgccagcttccgcccaacacaatatccgtaccacgtccagccatgttagtcgcgatagtaaccgtgccagcctgtccggcctgtgcgataatatccgcttccattgcatggaatttggcattcaggacgttatgttcaatgcctgctttggttaatgctttggcaatgacttccgatttctcaatcgaaattgtccctaccagtataggctgaccattattggtgcgctctttaatgtcttcaatgatcgcatcgattttttccgcttcggtcatgtagaccagatccggcaaatctttacggatcatcgggcggtttgtcggaacaacgatagtatccagtttataaatagaactgaattcaaaggcttctgtatcggcggttcccgtcatacccgccagtttttcatatatccggaagtagttctggaatgtaatagaggccagtgtctggttttcattctgaatttcaacaccttcttttgcctcaaccgcctgatgcagcccatcagaccagcgacgtccctgcatggtacgccctgtgtgctcatcgacaatgatgacttcaccatctttgacgatgtaatctacatcgcgagtaaacaaaacgtgggcacgcagcgctgctgttacatggtgcatcagcatgatgttggtcggtgaatacagtgattcgccttcatccatcaatttggcaccaaccagcagttcttcaaccagaaccagaccacgctcagtgaggttaacctgacgtgttttttcatccaccgagaagtgaccttctccctggaatgcctctgaatcctctttttcttggcggatcagtttaggaatcagtttgtccactttgatgtaaagttcagaactgtcttccgctggtccagaaataatcaatggggtacgggcttcatcgatcaggatcgaatccacctcatccaccagcgcatagtgcagtttgcgttgcactcgctcttctgggctaaacgccatgttgtctcgcaggtagtcgaaaccgtattcattgttggtgccgtaagtaatatctgcggcataggcttctcgttttgcaggggctggcatgtttggcaggttaataccgacggtcagaccgaggtattcaaacaacggccggttgttttcagcgtcacgctgtgccagatagtcgttcacggtcacgacatggacaccacgtccactcaaggcattgaggtaagctggcagtgttgccgtcagagttttaccttcacctgtacgcatctccgcaatacagcgttcgttcagtaccatcccacccagcaactgcacatcaaagtgacgcatgccaaatacacgcttactggcttcgcgtacggtagcaaaggcttcaggcaaaattttctccagtgattcacctgctttcaggcgtgcacggaattgttctgtttttgcttttagttcttcatcggagagcttctcaagatcaggctccatacggttgataatctcaaccgatttacgcaaacggcgtaaggtacggtcattacggctaccaaaaatcttagtgagtaatttaatcagcataattaatacatctcagataaggccaaagttgcggccaaccaattgtgtcttctagactgtccaagcaaaactgtctcatcaaaaaacaaaaagtaagacaggcgagttaaagcaaagataaatggttagctgttggccccgcgcgaattccctgagttttagctacccagagtgccggtgtgtgggaatcaggaagaatagtcgccgtaatttcaatatcaaggatggattcaaattgtgacggtgcttgtatcagcatagcatgcaacgtatccagcataagctgttgcatgcatggagaagaaaatcgaatgctttcttttgctacttcgtgttggatagggtcagtaatagaaaaaacaaaagaaagccgacgaataacgttgcgaacagcatgttgctgccagtaattcaagtgattcgaaggttgacgctggacactttgtaattgaaataagtgatcaaacgaggaaaatgcctgattttggttcctttggctggaagaagtattactatggggaaggctttctgtcgttccagctaaaacagcaggaacaccaattcctgtggcgaccatgcccagtaaaaggtgagaccaaaaataacgcctaccaaattgtcgccaaagatttaaaatactcattcacccttcattaataaatactggaactgcctttattatgcgagatagccgaccacaatcactggatacgctgtttgaagacgaggcagctgtcggtaaaagccctcttcaaatcattcaacaacatgctattgcacttttgaaactcaaccgtgccattctcagtttattgcccgcacaactacatccatggtgcagggtcgccaattatcgcaaacatattctggtactggaagcaggaaatgccagttggatgaccagacttcgctatgaagtgcccgttttgctttcgacactgagaagcgaaattctaccatctttatcctctatcgacatcaggattaatccatcattaatggtcaaacgtagtaataatgcgcaagacttcgcaagatcgtcaacaacagcacctaataatgataatcagaatttaccaaagcgccaattgagccatgaaagcgcagaaacattaatgatattggctgaacgcagccctgaaaaattgaaaaggaaattagagagattggctgcgctggccggagagggtaccagtacagccaaaaagaagcgctagcgctgaataaaaaacatcagcgaaaaaaagcgtgatagataacataacctattgattcatcacaggaatgttctcagcacactttttggctactatgccatcactgtcgatggagcacggaaagccagcggcatttcagcttcatcttcaaacgtgacaaattcccaagcactttcatgcgccaagactgcttgcagcagcttgttattcaatgcatggcctgatttgaacgcagtaaacgcgccaatgatgttatagccgcacatgaacagatcaccgatggcatccagcattttatgacggacgaactcatcttcaaaacgcagaccatcttcattgagtacgcggtagtcatctaccacaatggcgcaatcgaaactgccaccgaggcacaggccttgggattgcaagtactcaatatcgcgcataaatccaaaagtacgtgcacggctaatctggcggacaaacgaatccgcagagaaatccaaactataacgttgtgagctggaatcaatagccgggtggttgaagtcaatggtaaagtccagactaaaaccgtgatatggcgctaattcagcccatttatcaccatcttctacgcgaactgcgtctttcatgcgtacgaatttcttcgcgacattcagctcttcaatgcctgcatctaacagcagaaaaacgaacgggctggcactaccatccataatcgggatttctggtgcatcgacgtcaataacaatgttatcgatacccagacctgctaacgccgcgttcaagtgctcaacggttgaaattcgcacattgtgttcatttaccagacaagtacagagcatggtatcacgcacggatttagcattcgccggaaaatctaccggtggattcaaatcagtacgacgatagatgaccccggtattagccggcgctggacgcattgtcagcgtgacttttttaccggtgtgcaaaccaacgccggtcgcttgaacagtccgttttaatgtcctttgtttgatcatcattatatctcgcaatgttacccatcctgcc

SEQ ID NO: 16843 - DNA, 48297 bp, Xenorhabdus bovienii
tgtcagcctttttataaagatagctcgatatagatataaaagaaaaagtggcatctgccaagacaccactttctattatcgcatgtggatgcgaatcaaactcaatctactgagtcgattacatgcttaacaccaaccctgtaattgccgcagataagaagcttaccagcgttgaaccgaacagcaatttcagaccaaaacgtgcaacagtattcccttgtttctcattcaggcctttaatagctccagccacaatcccaattgaggagaagtttgcaaaggaaaccaagaataccgacagaataccttttgaacgttcgctcaattgtgctgcaatatcttgcagaccctgcattgcgacgaattcattggaaacgagtttagttgccataatgctgcctactttaaaggcttcatcgctaggaataccgatgatccatgccaatggatagaatacatatcccagacattcttggaaggagataccaaatatcatgtcaaaaatcgcattgatagccgcaatcaatgcgataaaaccaatcagcatggccgttacgattaaagctatcttgaaacccgccagaatatattcgcccagcatttcaaagaaactttgcccttcgtgcaggttattcatttggatatccccttcgctctcgacagagtaagggttgatcagtgacagaacgataaaggtactgaacatgttaagtaccagtgcagcaactacgtattttgcatccagcatcgtcatgtaagcgcctacgatagacatagagaccgtagacattgccgtcgccgccatcgtgtacatgcgacgctcagacattttacccagcacatctttataagcgacgaagttttctgactgccccagaatcaatgagctaaccgcattgaaagactccagtttgcccatgccattcactttggacaacacagtaccaatcacacgaatgataattggcagcactttaatatgttgcaggataccaatcagagcagaaatgaaaataatcgggcaaaggacattcaagaaaaagaaggccagtttcgcttctatcataccgccgaagataaagcgggttccttccgctgcataagacaacaagtggacaaaaaggttatcaaaccctttgacaaaccctagcccaacatcagaattcaggaaaaaccacgccagaacgagttcaataacaagcaactgaatgatatagcgaacccgtatgtcttttcggttattactcgcaaaaatcgccagaccgccaataacaactagagcaaggataaaatgaaaaatatgagacataaaaagaactccagacatgacgaagtacaaatttataattgcattttatgtaatgcataatagtaaattgtgattattatcacaataattcactatgtaaacggaaataaattcccatttagcaaactcgctcacactttagtcaggaacgtgttggctgcaatttgaaatctattgggtatatttattcacctaacagacgaagcatttcttcttcatcaatgacttctattcccaattccgtggctttgactaatttagaacccgcagcttcgccagcaatgactaaatccgttttcttggaaacactgcctgtcactttcgcgcccagcgctgtcagcttatctttagcctcatcccgggataaacggcttagcgagcctgtcaaaaccacaatcttaccagcaaatgggttaccaactgtgtctgactgcagcgtttcaactgattcccagtgaattccgatattgtcaatgaggtcatcaatcacagtctgattatgcagttcgttaaagaaattcacgacgtggctagcaactacgccccccacatcctgcaccgcgattaatgcttcagtatctgctgctcgcagtttttctaatgtggcaaaatatgaaaccaaattaactgcggtcgcttccccgacttcacgaattcccagagaatagataaaacgagcgaatgtagttttcttggatttctctaaggcatcaatcacattctgagcagacttaggccccattcgctcaagacccgttaattttccagcggtcagacggaaaagatcggcaggtgttttgacatattctttatcgacaagctgctcaatgatcttttctcccataccatcaacatccatggctcgacgggaaacgaaatgtttgagcgcttctttacgctgcgcaccgcaaaacaacccaccagtacaacgcgccacagactccccttcgactcgctcaatatccgagcgacaaactgggcagtattcaggaaaaatcacttcctgactttcggctggccttttatcctgtacaacactaacaacttttgggatcacgtcacccgcacgacgaataaccacggtatccccaatacgcagccccaaacgttcaatctcatccgcattgtgcagtgtggcattactgactattacccctgcaacttgcaccggctccaaacgtgcaacaggtgtgatagcgccagtacgtcccacttgaaattcaacgtcacgcacgatggtcatctgttcctgagcagcaaacttgaaagccgttgcccaacggggcgctttggcaacaaaacccagcgtttcctgtaattcaagggagtccactttgataacaacgccatcaatatcaaaacccaatatcgggcgctgctgctcaatgttatggtagaaatcgatgacttgctgagttccttggcataattccactttgtcactgactggcaaaccccattgtttgaactgcatcaggcgttcgtaatggctcgtcggcaattctccgccttccagaacacctacgccatagcaacaaaaggtcaatggccgcttgcccgtgatacgaggatcaagctggcgcagtgatcctgcggctgcattacgtggattagcgaatactttgttgcccttacgacgcacttcgtcattgagtttttcaaacccgccctgctttatgaaaacttcaccacgaatttcaacacgagctggaatattattcccctttaggcgcagaggaatggcatgaatagtacgaacattggcggtgatgttttcccccgtcgtgccatcaccacgagtcgcagcctgtaccaattcaccatcttcgtacagtaagctaaccgccagtccatcgagtttcaattcacagcaaaacaccaaatcccgactatctttcaggcgatcgcgaacacgcttgtcaaatgccagataactttcttcatcaaaaacattgtccaaagacagcatcgggatctcatgacgaacctgttcaaatgccgttaatggtgccgcaccaacacgctgggttggagagtccgccgtaatcaactctggatgttgctcttccagtactttcaattctcgcattaagcgatcatattctgcatcagggatctctggcgcatccataacatgatacaaatactcgtgatgacgcaatgttgctcttagtttgttgattttttcgataatattttccataacttctcaccagacatgaaaaacccccggctagcgggggcttggtactaaaaaagaagatttattcgcaggcattgagcgtattgcgaatacgcgccttatagtgttcgatcatttgtggcgtgagcatttttcgctcaccatccaacacaacgccacccacatcagaagcaatccgctgtgctgcctgcaacatcagtttaaagttctgattagcatcaccatatgatggcacaagcataaacatggaaattccaggggtgctgaaatcgtccatgagttctggattgaacgagcctggttttaccatattagccagactgaacagcaccgctccactgcccgccgggttcaaatgacgatgaaagatattcatatcaccaaaccggaagccagattgcaaaatgctttgaagcagtgcttcgccatcaagctcctgaccatgatgggcagagacatgtaataccagcactgtttcttttttgacttgctcaacttcgcccacagtttcattttccaatacgttcagctgttcttccacaactgccgtattgacaaccgattctgctgcctcagcactctgctcagtagactcaaataagctaagctgtggctcttcctgatattcctcaacggtttttacttttgcccctggtgctccaggttgctgatttgaaagcaaaggatcaaaaacctcatcaagcgctaccgctgataactcaggtgcagagcgtttaataacaggctcttcgcgatgttcattacgaggcttgactgactcttgaacatgcgattttgacgaattatcaaacagttcatcgccatcattatcgtcgagctcttcctgacgctcctgtttatgacgtttaactgggcgatcacgaaagagtgacgaacgctctttgcggctggtccacaacccatgtaatagcaaagctattatggctatcgcaccaacaacgattaatatcagacgcaaatcctgcatcattgctatctctgttgtttaaattaattgccaccacggcggaatattctttagataagagtatttgtcaaatagcacaagtgcaagtctctacatacttttcttaccataaaggagatataccctgttttttcggatattttttacacacaaaactactggtcagtagaaaatcctgcctatatcataccgtctcaatcatctaggagagaataagaaaatatgacgaattcgacaaaactgccaaaacatttgagcgggtttcattatattgcacaaggttggcatctgataacccgccccggcatcaagagattcgttttattacccttactggccaatatcttattgctgggtggttcattctggtggttgtaccataaactggatggctggatactatgggcgctcgataaaataccagattggatgcaatggctgagttatttactgtggccactggctgtcgtctcgattttgctgatttttacctattttttcagcatgctggctaattttattgcctcaccattcaatggattactggccgaaaaattggaagctgaattaactggcattccagcgccgaacactggcatggtcgatttgataaaagatacgccccgtattttaaaacgcgaggtagtaaagatcctctactatattccgcgtgcgctcgtactgctgttgctatatttcattccaggtattggtcaaaccgtcgctcctgtcctctggtttattttcagtgcctggatgttggctatccaatactgcgattatccgtttgataatcacaaagtcagtttttctactatgtgcagtaccctgcgacaaaacaaaattgacaatcttcaatttggtgcagccgttagtgtattgactatgatcccggtagtaaacctgttcattatgcccgttgcagtctgtggagcaacagccatgtgggttgaccgctatcgtgctcaacacgctttacaccataacccatcccattaaaccactttttcctttttaaataacaccatgccctgatgtatcaaaaatacaccggggttttgtgttagccattacctttaattaactgtaaccatcacggcgcagaaataactatataaaatcataaatggcggaatagttattcttatcataaacaaagtaaataatataaaaaatcaacgaatattcttttatataataagaatagacttaaactctatttccataaataagatgttagcgtatggttatctgatgtttaagggtatttaaggggcaatcgaataatgagcaaaatttatgaagacaattcgttgactattggtcacactccactcgtacgtttaaaacattttggtaatggccgcattctggcaaagatagaatcccgcaatccaagtttcagcgtgaaatgccgaatcggtgccaacatgatttgggacgctgaaaaacgtggcatcctgaccaaagataaagaacttattgaaccaaccagtggcaacaccggtattgctcttgcttacgttgcggctgcccgtggctataagctgacccttactatgcctgaaaccatgagtcttgagcgccgcaagctgctgaaagcgctgggagccagtctggtgctgaccgaaggcgcgaaaggcatgaaaggtgccattgataaagctgacgaaatccgtgatagcgatccagaccgttatattctcctacaacaattcagtaatccggcgaaccctgaaattcatgaaaaaaccacaggcccagaaatctgggaagctaccgatggcgatatcggtgctttcgttgcaggcgtagggactggaggcacaatcacaggggttgctcgttacctgaaaaatacacaagccgcacaagtcactatcgttgctgtagagccagaagattctcctgtgatcagccagaaacttgctggtgaagaacttaagcctggcccacacaagatacagggaattggggctggtttcatccctgataacttggatttaacattagttgaccgtgtgtttaaagtcagtaatgaagaagccattaaaacagcgagagaactcgctgaaaaagaaggaattcttgctggaatttcctcaggagccgctgtcgctgccgccgtcaggttatctcaggaagacgaatataaagataaaaatatcgtggttattttgccttcttcggctgaacgttatctcagtaccgccctgtttgccgacttagccaatgattaaaaatcactctgacttttttcaatttcattgacaaaaaagcaccttaagggtgcttttttgtgcatcagatcaaagtttaaaactttcctagatgatttattcaagtagctttagtatttaaccagtaattattttgatgcacgaaattaatcgctgagccagaatgaaaagcaccatccaattcaacaaatactcggatagtgtgtattaacataaaaccaacaattgaatgcatcgagtgtgttaattttttgataatgcctaaatacaccttatttcattatcaatttaacggttgtacaagccaaagcgggttcagctacactagctttagaattttctagggcttatcaacgaatatttaagttattgaggaaatactatgttccagcaagaagtcactattactgcaccaaatggcctccatactcgccctgctgcgcagttcgtcaaagaagcaaaaggtttctcttctgacatcactcttacttctggtggcaaatctgccagtgcgaaaagcctgtttaagctgcaaacgctgggactgactcaaggtactgctgtaacaatttccgctgacggcgaagatgaacagcatgctgttgaacatttagttaagctgatgggtgaattggaataattgcccgcttaataaagccaatttgtttcatttcaccgagttccatccccagataaataaaatctggggatatttagagcctcccccttgaaggcttaatggaaggtaatcacccgcagtaaggtcatatagtatgatttcaggcatcttagtatcaccaggcattgctttcggcaaggcattattgctgaaagaagaccccatcattatcaatcagaaaaaaattactacagaacaaaccgaacaagaaatttcccgttttaaacagggtcgagacaaatcttccgtacagttagaaataattagaaaaacagccgaaaaaaatctgggtgcagaaaaggctgagatcttcgaaggccatatcatgttgctggaagacgaagagctggaacaggaaattgttaccctgattaagaaaaatctggcaacagcagatgccgctgtttattccgttattgaagatcaggctaaggcactggaagaactagacgatgaatatttgaaagaacgtgcggctgatgttcgcgatattggtaaacgcctgctgaaaaatattctgggtatgccgattatcgatttaggcactattgaagaagaagctattctcattgccaatgacttaactccatcggaaaccgcccaactcaatctggacaaagtgctgggtttcatcactgatttgggtggccgaacatcccatacctcgattatggctcgctctctggaattacccgcaatcgtcggtactaccaacgcaacaactcaaatcaaaaatggcagttacctgattctggatgcggttaataaccagatttatgtgaacccgtctaatgccgaaatcgatcaactgaaaaaggcaaaaaacgagtatctgtcagaaaaaacagaactggcaaaactgaaagatttacctgctattacactggatggccatcaagttgaagtttgtgccaatatcggtacagttcgtgatgtcatgggtgcagagcgcaacggcgccgaaggtgtaggcctataccgcaccgaattcctgtttatggatcgcgatacgctgcctactgaagacgagcagtttgaggcatataaagcggttgcagaagccgttggcaaccaagccatcattatccgtactatggatatcggcggtgataaagatttgccttacatgaacctgccaaaagaagagaacccattccttggctggcgtgcaattcggatttgccttgatcgtaaagaaatcttacattctcaattgcgtgctatcctgcgagcctctgcatttggtaaactccgcgttatgttcccaatgattatttcagttgaggaaattagggagctaaaagcagaactggcgttgctcaaaaaccagttacgtgatgaaaacaaagcatttgatgaatctattgaagtcggcatcatggtggaaacacccgctgctgcaaccattgctcatcatcttgcaaaagaagttgacttttttagtattgggacaaacgatctaactcagtatactcttgcggtagaccgtggtaatgagctgatttctcatctttataacccaatgtcaccagcggtgttaagcctcatcaaacaggttattgatgcctcacacgcagaaggtaaatggacgggcatgtgtggagagctagcgggtgatgaacgcgctacgctgttgcttttaggcatgggattggatgagttcagcatgagcgcgatatcaatcccgggcatcaagaaaatcattcgtaatactaattacgatgatgcgaaagcgctggcagagcaagccttatctcagccgactgcacaggaattgatggatttggttgacacctttaccagagaaaaaacactctgctagctacgtcagccaaaacaccgtcccattaaaacaattaggagaagattcatgggtctgcttgataaactgaaatctctggtttcagatgataaaaaaaacagcggcagtattgagattatcgccccattgtcaggtgaaatagtcaatatcgaagatgttccagatgttgtttttgccgaaaaaatcgttggggatggtatcgcgattaaacctgccggcaacaaaattgtcgctcctgttgatggcaccattggtaaaatcttcgaaactaaccatgctttttctatcgaatctgatagcggggttgaactgttcgttcattttggtattgataccgttgagctgaaaggtgcaggctttaaacgcattgccgaagaaggacaacgagtacagaaaggcgatctggttttagagtttgatctggcatttctggaagaaagggctaaatcaacattaactcctgttgttatttctaacatggacgaaattaaagaattgtctaaagtgagtggatctgtagttgtaggtgaatctgtcatcatgcgtatcaaaaaataacagaaaaatcatcgggaacacgttttccgctcttttcctgtttgcagatcctgcttatttgcggatggttgatgaatcgccactgttttatcaggtattttaccgattaagcctaataatacaggggcgatttttttgtggtttgctgctcagtcaaaaaacgacgtttaatgccaaataacatatacccaaagggggtaggcgtttaattaaataccccagtagataaatacctgtcaccacgatcacagacaatcgctacaatgaccgcccctggatttttagccgcaatgcgcagtgcccctgaaacagcaccgccagaactgacaccacaaaaaatgccttctttctgcgccaatagccgcattgtcgtttcggcttccatttgcgtgatatccaaaagctggtccaccaactcttttttgtaaataccgggcatataagcgggagaccaacggcgaataccggggatctggctattttctgcaggctgcaatcccgtagtgtgcactttatctgattgagatttcaggtagcggctcactcctgtaattgtccccgtcgttcccatactggaaacaaaatgcgttatgcgcccctgcgtttgctgccagatttccgggccagttgtattaaagtgcgccagtgcattatccatattattaaattggtcaagaaccttcccttctccctcttgttccattttctgcgctaagtcccgtgcaccttccatgcctaattctttactgaccaaaatcaattctgcaccgtaagcccgcattgatgcctgccgttcaagactcatattttcaggcattaataatttcaatttataatttttaactaccgcaatcatagccagtgcaatgccagtattgccactcgttgcttctatgagcacatctcccggcgcaatttctccccgtaattcagcctgctggatcattgaaaatgcagccctgtctttcacggaaccagcaggattgttaccttccagttttacccaaatttccgcatcaacactttcagtgagtcgttgtaatttaaccagcggagtattgcctataaaatcttccaagcttgccacagcattacctaattcatatgagagtagacaacaaaataatcatattcagaaaactgtagcaagatcttaaacaaaaaatacccgctcccccaaatgacgagagacgggttgacggtaataaaatatagttaaatcaagctgattcagcgagtctgagcacttttaatgacaagtcacctgcatacagtctagctccagtaccccccataaaatactgatttcccctaactggaacgggtgaattaccctgccagataaccgataagaggtcttttccccaccccaccggcaagacagacaacaaagaaaaatggccacgcggactgatttccacaatttgaacaggtaaaggacaagatgcagtttgttgggtactaagagtcatttcccatgggcggaaaaacacgtcaacattcccctgatgtaatggtgtcacattcaatggaaaaatttttcccccaatccataattgggaacctttgatttcaccgtgtaattgattgacctctcccatgaattcaagcacaaaacggctttctggctctcgccacacctgttgcggcgtaccaacttgctcaatacacccttgattcatcaccaccactctatccgctacctccatcgcttcttcctgatcatgggtaacgaatacactggtaaatttcagttcttcatgaagttgccgtaaccagcggcgcaactccatgcgtacctgtgcatccaaagcaccaaacggctcatccagcaacaggatctgcggttccactgccaatgctcttgctaatgccacacgctgtttctgcccaccagacagttgtgacgggtaacgatcagcaaggtgggataactgaaccatatcaagcaatgccatcaccttactgcggagcgcctcaccactcaggcgttgacgacgtggaagcacagtcaaaccaaaagcgacgttatcaaaaacgttcatatggcgaaatagggcgtaatgctggaatacaaagccaactcgccgatctttcgcatgcactcgactgacatcctgaccattaaacttcaactgccctgcactttgctgctcaagccccgcgataatcctcaggagagtcgttttaccagaaccggacgggccaagtagtgcaaccatttcaccagattcaatacctaatgaaatctcactcagtatctggactcggccaaaagacttgttgattttactgatttcaatactcatatcttgctcctgatctcccgttactggtggcttaagcgccactgaacagcacttttgaccatcagagtgataatcgccatcactgccaataaagccgcagccgtaaatgcacccacggtgttgtaatcctggtacagcagctcaacctgcaaaggcagcgtataggtttcaccccgaatcgcccctgataccacagaaactgcgccaaattccccaatcgcccgagcattggtcaaaacgatgccatatagcaatgcccagcgaatattcggtaatgtcacacgccagaacatcttccaaccagaagcgcccagcaatattgcagcctcatcttcctgactaccctgacttaacatcaccggcaccaactcacggacaacaaatgggcatgtcacaaataccgtcaccagtaccatacccggccatgaaaacattaattgaatgtcataagaacccagccagctccccatccaaccattgacaccgtaaaacagcagataaagcagccctgccacaacaggcgaaacagcaaacggaatatcgatcagtgtcagcaataactgcctgccgggaaactggaatcgagtgactagccaagcggtcatcacaccaaaaatcagattgatagggactgtgataagcgcaatcatcaccgtcagccagatagcatgcagcatatcgggatcaaaaagattctgtttaacgagatcgaaccctttcgaaaaagcggtcaaaaaaatccacattatcgggattaccagcatcagagtagaaacgagtatgcccgtaccaatcagtacccattttccccagttgatagaagagcgctgtgccactgtgtattcagagaattcagtcatcaatgccccccgatccgtttaccaaaccgactctgcaatatattgacgctaaacagcagtaacaacgatgccgcaaggatcaccgaagcaatcgcgctagcagccggataatcaaattcttgcagacggacgaaaatcatcagggaaaccacttctgtttgccatgcaatattgcctgcaataaaaatgactgccccaaactcccccaagctgcgagtgaaagagagtacggttccggccatcaatgcgggtgaaacttcaggcaggataactcgccggaaagtctgccagcggctagcgcccaatgtctgcgccgcttcctcatattcggtgccaagttcttcaagaacgggctgcactgtgcggacgacaaacggtaggcttgtaaatgccatcgcaactgcaattcccagccaagtattcactaccttgatgttaaaattgctcagccaagcgccataccaccctgttgcagagaacagggtggccagagttaagcctgccacggcagtcggcaaagcaaatggcaaatccatcaacccgtcaagcaaactgcgaccaggaaagtgataacgagtcagtatccacgccatcaacatcccgaaaaccatgttgaacaaactggccgcagcagcggccagcaatgtaacctgataagcggcaacaacctgcggatttacaatcacctgccaatattgagcccatgtcatactcgaaagctgtacggccagagcgcttaatggcaataacaagatcagacaggtataaaacaggctactgcccaaactcagcccaaatccgggcagtacgcgtttaccggatgccactaacatcatttatgtccttccgccaataactgatccaacataccgcccgtgttgaagtgtgttttcatcacctgcggccagctaccgaattgttcttccagacgaaacagtctggtttcaggaaaacgaggtttctgtgcttccatgacgtttttatcatttacacgataattgaagctcacaatgatctgctgcgctgcggggctataaaggtaattcaaataagctttggccacggcttcagttccatttttgcgaacatttttatcaacccaagtcacaggaaactcagccaaaatatctaccggaggcacaatgatttcataattatctgcaccatactgtttacgaatgttattgacttcagattcaaaactaatcaaaacatcgcccagactccgttcaataaatgaagtcgttgcaccccgccccccagtatcaaataccgctacgttttgcaaaagacgccgcatcagttggccaactttcaccgggttctgctcattttgctgttggaaagcgccccatgccgccagataggtataacgcccattacccgacgttttcgggtttggaaaaatcaacttcacatcatgacgcaccaaatcatcccaagtatggatctgtttgggattatctttgcgaaccagaaaagccatagtggaatagtaaggtgaactgttacttggcaggcgctgctgccagtcagcaggaataagattgccgcgatcatgcaggatctgaacatccgtaacctgattgtacgtcacgacatcagcccgtaacccctgtagaatactcaatgcctgtttggatgaacctgcatgggattgcttaataattaatttatcctgtggatgctgtgcattccattgtttttcaaattgagggttcaaggtagaaaataactctcgcgaaatatcgtaagaactattcaataatccgacagcataagcgttggcactataggcgctgataagacccaaaagtgctacggcaaccaacccgctcaataatttattgtttattgccactgttttcatccaacaccttacccgtcacgcctattcaacaacgatttcttcatactgtatccagaatatttataacagggtagtttactatcccctgttttatataccgagtttttatgagaaatgatgaaacgcgataagctataggaaatgtaggggttatcaattcaaaagataatatataaacggatgaaaagagagctctgcttcatcacaaactctctttaaagcttcgtcaagatttccaaataatccgcgaaattttccaatttttcaggacatcatcagaaggcattaacccttctgggccatcccacgttccggtaaacacgtagctgatatgctggctttgcggtgcaatacaaatcacggttggctgcgtagtgaaatcacaggaacgatgacacacaccaaacgctttgtcatacagctcggagaaaggcgtgcctatttttgttccccacacggttttcgccccgtcatccaacacatcaatacgatcaaccttccccttagccaaaccagataattcgatttttacctgattcccctccattccctgaatgatgctgacgaatttgccattttgagtttccatcccactgcgcaggcggtatttgcctttcaagccttgttcaatcgcagattgaaccatgtctgtctgtttattaacttccccaacaccttgttcggagacgcgtaaggtactgccaaaccactccaaaggtgataacgaagaccatgaaaattctgatattccagcacaggcacttaataacagcgaacctcccaataaactactaacggctacaactcgctgtttcgacaataaattaaatacaaaaaatttacccattactgttttacctttatatctattgacgggttatgtaaaccacactcttaaaaaaacattcatttgtgaatatgaaacatttcatcaacaaaaatgccaaaaaaacaagaacgatacaacattgacgataggttgacacaatgatcgataacatcactttcatctaaagaatgatgttacggtagaatatgatgaatgaaaaggtgattattgcggtatttattatctctttaagcgtatctgtcatggcgagagcctcagatcaaaaattggttttgccttctaatattcatgacaagttgaatcacactacaaatcaggaaaaaatcacgatatctcaggaaaataaatctcatattcaatctccttgtcgctttattatatcagaagggaaaccagaatctcccatccatgatcattatcaactatatcgagataacgaaggaaaaattcaagttagaattatctctagtatcggagataatatccccattacgtcaaagaaattatttactttgcaaaataaatatcagaggtgcttgagccattttataataaagataattaatttagtactgtataattcaataacggccgaataaaataatactgttcagccattttatatttaatcaataatcagacgcttacaaaaaatagtattttcttgccccaaataatcatattccattttttcacacatacaaatcgttgcatcattttcttctgaaaccagaatcaaaatactcggacaacctctcgccaataattttttttccaaacgggatatcagagcattagcaattcccctgcccctgaattcagggtgaacgcttagataataagcatgtccacgatgcccatcatagccgcccataactgtaccaaccacttctcccgcaacttcagcaactagaaataaatcagcatcatgggttaacttacgctcaatatctacttctggatcatcaccgggattaatcaaatcacagcgttcccaaagtgtggtgacggcctcaaaatcatcttgccgaaatacccgaatttccatagttagtcagcctatttaataaacggttgaatcaacgttaattatcactacttttattttggaatcaatatgaaaatgcgtttactgagactaacaggtatactgtctatcgccataaactaacccaaatgaaagcagaaatgaatatacctaatatatattagtttcatgtttcggtgtttgtcgatgtttattatttttatataaaaatcaaataattaataatccaatcaactgtatattgttccagtgcttattgacgttttcctactattgcagcacactacgtataaacatttgtataaatatattgggtgaacatggctgccgaactaaacaagctcagtgacaaaaaacttaaaaccctacacggaaagaaaaggaacaagattgaattttttgccgatggtgctggattaagtgcaaaagcatctaaagctggtggtattagttgggtttttacctaccgacttgatggtaaaaagttaaaccgccttaccattgggcgctatcctgatatgcccctcaaacaagctcgtgaaacacgggacaaatgccgtaactggttggcctctggtaaagatccaaagctgcaatttaatttaacgatgcaggaatcattaaaaccagtcactgtaaaagacgctatcgaatattggatagaacactatggcagagaaaaccgagtaaatattgatagcctcattcgtcaattaggaaagcatatttatccccacattggggaaatggcattatctgactgcgaaataatatattggctgcaatgctttgataaaatgaaaaaagaagctccggtggcttctggtggcatacttcaattgtgcaagcaagccctgaaattttgccgggtaagaaggtatgcaattagccatgtattggatgatttaacaattcaggatataggaaaaaaacagaataaaggccagcggtatttagaagataatgaacttggtcaattatggaaatccatcaatgaagatatttacctaccttattatattaatttattgaaaattttggttgtatttggttgtcgaacacgagagatcaggttatctaaatgttcagaatggaatttagattccatgctgtggactgttccaaaggaaaatagcaagacaggtgaaagaattattcgcccgatacctgaatgtatgaaactattcttagaaaatcttatttatcaaaaccataaaaatgattacctattaggtgcatttaaaagcactgaaacagtatcagagtatggaacaaagatatggaaaaaattaggtcatgtggaaaaatggtctttgcatgacttaagacgaactttttccacaaaattaaatgatatgaaagtagctccacatattgtagatcagcttttaggccatattttaccgggcgtcatggctatatataataagagccaatacctaccagagaagctagacgccttaaacatgtggtgtgagcgactggatgtattgtcgggtaattatgagaatgtcgttgtattaaaaatagctcaataatggaaattaatgagtttaatgatgagtgtgatcattgtggtatatacgtaacaaatattgctttcttttgtaatgatttattttaagtaaaataccctcacaaaaacaattaaacagtgagggtaacatgactattcaatacagcattcctacacctgaagaacgccgcaatatcctttccgagtatggcgaaccttatgatcgccttatacgtgaaaaagaacgccagcacattacctctatttccagaacgtcagcatggaaactggaaaatgaaggccgtttccctgcccgtaagccattaggtcgcaattcctgtgcttggttgctcagtgatttgctgcattgggtacgtaatccgccaacagtagaaaacgtaaataacccgtatagccgtaaacgtaccaattaaagaataacatcatggaaaaattaactgccttaattggttgcgatctaactcactctaaaatcagcttaatttttgggaatcagtggattaatggtaagtactagctatagaggttctttaagattaaacagccatcaatttgagagacaaccctctttaagagggttaattgattattcttgctcagatgatgctttggatttgcgctggcggcgtttaatttcacctgtcatagccaaaattatgaattgtgcggtactttcaccctcttctttaagtttttccattgagtcaacaagttcatgcggtacacgtgcttctaatttttttgactttgcatttattgctttcgttgccatatctgtatccattagtagttggtggctgacagtatacacaaaaaattttcatgaaaaaggattgacgtggctgacacttaaaaataacatagtggctgacaccttgagtcattcaaggaacaaaaacagcgacgccccgaagtgcggtaacactctcgaggcgtctaaccaaaacattatcggagctaatgctatggctgacatacagtctaaccaaactcgcctaaaatttacattcctaattgcatccggcactcagcggctggctggtatgccctcactgatcttcgtatcacgtcaggagacacaccatgagtaataaacctatctcattaaaacaggcgctatatcgcgcaagtctgggtgtttcactcttcacatttattaccaaaaaagccaaagatgaatgcgaaatcaacttaaataatctgattgcactggcgggcgatattcatcaggaggttcaccgagctttgttgaaacattctccacagcctcttgtgaataaattattaaattgcgttgtgtataggaaatccgacccattagatcaggcctcgtttcgggcgggtttatgcatctctttatatgagatcattcttgaacagtctagccagcactgttccgaagaattacatgatttgctttcactggcctgtgatatcaatcaggaagtttactattcgctttatgcggctgttaatggcgaggacgagtgatcatgagtcagggaaatagccgtccgttagatgttattcgtgcagtgaagcaatccgccgccaatcactggcaacttttgttgcccgcctgtggtattgacgttccgttaaagggtaagcatggtgcttgtccgatatgcggcggcactgaccgctttcattttatagatgataaccataacggcgactggcattgccgccaatgcgatgagccgaatcatggtgacgggttggatttagtagcgagaaacaaagggattacggtctttgcagcggctaagctggtggctgatgtgctggcaatgcctttgcccgaacccaaaaccgtcaaagaacaaccgcgagcagctaagctgattgctgaacgcattgtggcactggtcgccaccgctgttacgggtgaatctcaatatctagtgaaaaaggggctgcaatgccccaatcaacggttattgaaagatggttcgttattgctggtggttcagacgctggacggcacaattaccggagcacaaaccattaagccgaacggtgaaaagcgccttgttgcaggtactcaaaaaaaaggcagttttatccccgtctccaaaattaccagaacaccggacacaatcatcattaccgagggttacgccacagccttaactgttcgccaattgcataagggagtggtactggcagccattgatgaaagcaatttatcggtggtagccggactggtgagagagcggtggccagacaccagaataatcattgctgctgataatgactggcacgggcaaggcgaacgagacaaaaacggcaggctaaaaaagaacgttggcaaaatggcggcagagaaaaccgctatagcgattaacagctgggtaacgctaccgccaacggaattaaaagccgactgggatgattatcgccaacatcacggcattgagacagcaaagcaggcatttaataacgggttatatcaggttggggagaaaagactaatggaagcagaagcagtggtgatccaagaagcaaagcccaaaaaggccaataacaatctggcacaaatggcagccagtcagcgcggggcgctggtagttgaacgctacggcaggatagcagtcaatcctgaaagtgatatggtttaccattttaacagtacgacatggcagaccgtgtcggataatgagctgcgccgcgcaatggtggcaatctttgaccagcacgaaaccccttacaacccgaatgggatcaataacgctatctgtgccatgaaattacaggtgccggttatcggcgaacagcggcaggatttaatcgggtttcgtaatggcgtgtatgaattatcgacacaacaatttaccccgcaccagccggaacactggctaatgaaccataacggcatcacattcaccccgcctgctatcggtgaaaacctgccggatcacgcccctgatttttaccgctggttatcccatacggcggggagcaatgaaaacaaaatggcacgaatcaaagccgccctgtttatgatcctggcaaaccgttatgactggcagctatttattgaggtcacaggtgaaggtggcagcggtaaaagtatctttacctatattgcgaccttgttagcgggagaacacaataccgccagtggcaatatgagggcactggatgaggcgagaggccgctatcagtttgtcgggaaaagcctgatcacgctgcccgatcaggttaaatatgttggcgagggggcaggcattaaggccattacaggcggtgacctgattgaagttgacgggaaatatgagaaacagttctcaacaattattaaagcggtcgtactggctaccaataatgagccgatgagcttcacagaacgcaatggtgggattgcccggcggcgggtgatatttccgtttaatattccggtcaaagaatccgagaaagactcgcaattaccggagaaaatcagccgagagctgcctgtgattatccggcatttattaacggagtttgccgaccagaataaggctaaaaagctgctacaggcgcaacgtgattctaacgaagcgttaacggtgaaaagcaattcagatccgttgtatcgcttttgcggttatctagtgtctgtcaatgatgcaactggaatgaagatgggcaataagaacatcagcccacgcgcaccgagattgtacctgtatcacgcttatctttcttttatggaagcacacggctttgagcgaccactcacactgaccaagttcggcgaatcacttcccaaaattatgctggaatatcgcaaggagtatcggaaagtgcgaaccaataaaggttactcttataatgttgaattatcgggagaagccgaagagtggctgccgtccgtgcctgagttacgaaacagttaagcctgctgtatagaacttttggttttatgtctacattccatgcaccattttaaatatctatctgtatttaaaagaaaataataggtgtatagatattttttagctatacactactatacattctcttcattaatataaaaaatgggtgaacaggagatacagtcaatgaatatcatattaattgcggcaaacccagatgtggcaaggcgtccagtgaatcatgcagagggtgcacagcggagaaggtgaaaaagatttttaggggggtacctttggtaggaaaataaaaatatctttatgttttgatatatatcaaaacataattaaaattagcagattaaatagtcgtttttaggtcatgctcccaatagttagattattgtagtaaactttccattttttattactggtgagatatggctaaagttgatgtggtttgtcgttattgtcacaaagcagaggaggtcaaagggcatggaaaaggaagcagtgggcacccgcgttatcactgttatgcctgccgtaaaaccttccaactgaattacacctatcaagcctgcaaacccggagtgaaagaacaaatcactgatatggcgataaataacggcgggatcagagacactgcacgtgttttgaacgtcgggatcaataccgtgcttcgcacgttaaaaaacatgaacccagacaagtaacaacacggcctctggcaggaagtgagattcacattatctgtgaaattgatgagcaggggtcatttgtcggcaacaagaagaatcaacgcgggctctggtatgcgtgggaaccaaaccagaagcaaatcatcgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaactattgggagcatgacccgtttttagaggctatctaatgaaatatttcttcatatcagaattatcaaaatcactcaatgtaacgtatgttagtatcattgagtgataatattttagaaccctatattatattttttatcgttgttattttgttttatgataaattatgaatatgactattgacaggcagataaatagctatatattttatgactataaaatagcaagcaaaaggaaaggaaatggctaacattatttacatgaccttaaacggcaaaaagcaagggctgatatcagcaggttgttcaacctatgattcaataggtaataaataccaagaagaaaataaagataaaatattggtttattctgtagatcacgatatcagtagagaacagaatgtaaatcatcaacctataataataacaaagccaatagataaatcatctccattattaggcgttgcaatatcaagtaatgagcatttagattgcctgcttgacatatataggaatagctcaacaggaggattagaaaagttttactctatcaaattaacaaatgcaactataaaaaatatctcaagccactaccccaactcactaagccacaatgatatgcaaccatatgaaagtataacaatttcatatgatagcataacgtggacacatcacatcgctggtacatcaggctacagcataagagaagagaatgtattttaatttttctccactaaaaacaaaatggtacgctcagtatcattttgttttatacttataatggtattatctttacgccagcgttcatctttccaatacttatcatagtattttataaaacccatgttttcagtgtattttattaattctgccagacgactcaattttacatttgaaaatataatttcgttagtcatggtattattaccatcaggggagtcataatatataatataatcatttgaaattaaaggtacactcttaatctcatcaaaggtaaatgagtaataataaataaaatttctttttgtatatgataaattaacattcgctaatgatgcaaaaaaaagaataacgccaatagctaaaataaatataactatacatatacgtatgaaattactcaaccgcaatcccagcatattctttacctatattaatccagcttgcatcttcaataagaattacgtcatgaccagtttttatatcgcttataggcgttattgtatttaaaaaactaggcaagggaacattataaggaattgtattatttggatacttttcagggtcagggaataataatggcttaaaagatttatttttatattttcctatatccccgtagtaatcccatcgtttatatgctttttctttacttactacccctacttgaggtaaataattaataccgttgatagcttgataaaaaccgaataagttagaaatcaaatcttcaccactatagccactatctgaaattaaagtaaaaggaaaggaatcttgatatgattcaaatgaatgagttgtatacatcataatagtaagagcaactctttttttatcatgtaaagataaacctcttctaactctccatcttgtttttatagatgttcctaggctacgccccctgcccatatattgaacatacctaacaataaaatgcgatttattagtagtttcatcccccaaagcaagagagagcattaacttccttgcatcatcaccgttagcatgccctaaatctaaccaccctaatttttctgtataaaccaatcgtccatcttttatatcagatcttttagtcattagaactcctgtaatttagttaagtgtgccataaaatcttagacgtatgacactaaacaaaataattagtagaataattttaacaaaaatcagctattctatcctcacactaacctcctgtagaatatgatgatataattacttactaaattagtaaatatcaatattttcgtaagatacaatcataatcttagactataaacatgattaattaatagtatagagtattttcttcacaaaaaattatgtgttaatttttaacatatcagtaacaaggtgttttcaaatttatttttatagtaagtaatatcatcttaaaactgtaacctttatttaattacttaaaataaattttactcagtaatattacacttgattgatttttaagttaactactctgatttggtttttaaaccaatgaaataatatgaaaaagatactgattatttttatttttttactttatggttgtgggaatccaacgccaaaagttttaccaaaatcagaagttcttcctgatgctgtgataaacgaaccatatcaagcatcaattaccatcacaggaggcgcattaaatgaaagaagcgtttgggtaaaaatttatcctattgactcaggactaacatggaatccaaaagaaagttctttccaatgggaaggaaaagaagaaataagaaaagattatcatcatataaatataacaggcatcccaaagaagacagagctgataaaaattgaagtggtagggtttactttgggtacaatgtacccagggaaagatttcgataaaacctatactataaaagtaaaaaacaaatagctttagtagaatggcaatttaagtcgctatttttgtatgctcgctcaacataacaaggattctttcttattatttttcatggtgttaaaaattattttttgcaaaaataaattaactacaaagacaccatgaaaaaactactcgaattacgccagcaaaaagccgatttaacccatcaaatgcgttcccttctcaccaaagctggagatgaaaaacgctcactaaccaatgatgaagccaaacagtttgacgaactgcgcaaccagtccgattccctgaatgcggaaattgcccgttatgaaacccttgccgatgatgagcgcagtcaggcaggtaaaacccaaccaacccgcgataacctcagcaatgacgaactccgccattatattctgaccggagaaacccgcaccttgtctacgggcgttccctcagagggtggctataccgttatccccgaactgaataagcagatcatgcagcaacttacctgtgagtcagtcatgctccaaatctgtaccatcaagaccacacgcagtaacgaatataagcagcttgtttcggttggtggtgcagcagtggcacacggggaagaaggtaagtcacgcggcgagacaaccactccgaaaatggaagaagtcagtattaagttgttccctgtctacgcttatcccaagaccacccaagagattatcgattttagcgatgtggatatcttaggctggctgacctcagagattgctgataccttcgtcgataccgaagaaacggatcttgtcagcggtgacggcagcaaaaaagccaaaggttttctggcttatccccgcgatacgaaaagcgacaaggtgcgtgattttggtacgctgcaaaaactggaagttaccacgcttgaggccgatagcctgattgatcttaagttcctgcttaagaataaataccgcaagaatgcggtgtgggtgatgaactccacgactgccgctaaggtgcaaaagctgaaaaacggtaatggggattatatctggcgggaacgtttacaagcgggtgatcccgatatgttgctgggcttacctgtccattatcttgaatttatgcccgatggcgtgatcggtctgggcgacttcaaacgcggttatttcattgttgaccatgaaacaggcacccgtacccgtcccgacaatatcaccgagccgggattttataaggtacacaccgataaatatctgggcggtggtctggtggactccaacgcaatcaagatccttgaagtgaaaaccacttcgaaataaacgaaaggggcgaaagtccctcgttgggagtccataggatgaataacgattttgaaattcgcaccgcgtctctgtctgctgctgataaaaagctggtgggctatgtgattaagtggaacagcagatcccacgttttatgggatgaatttattgaacagtttgccccaaatgcttttagcgccagtttaacttcgggtgttgatgtcagggcactgtatgaacatgaccacatgaacctgttaggccgtaccacgtccggtacgttacagcttgccgaagataccaccggattaagcttcgagttaacgccgcctgatacgcaactggggcgcgatgtgctgactttggttgagcgcggtgatatctccggtatgagctttggattcagggcactaaaagatcagtgggatgtcggtcaaacaccctatatcagaaccgtcttggaagccgaactgcgggaaatcactgtcaccagcttacccgcctaccctgaaagcggggtggagattgccagacgttccctgaatgccgttaagcctaatcatgttgatttgcgtcattactggctgcaactgtccgaggtgtgattatgtggccttttaagcgaaaagacacggaaacccgcagcctgagcatggatgagtttctttctctggcgggcgtgtctaacaccaaatcgggcgagcatgtttcaccgtctacagcggaaggcttacccgcagtaatgaatgcggtcactgtcattagtgaagcggtggccaccatgccttgttacctttatcgggttcagcaccagaacggcaaagaatcccgcgaatggctcagtaatcaccccgtagattatttgctgaatgagtgcccgaatgactgccagaccccgtttcagtttaagcgaaccctgatgcgtcattgcttactcaatggtaatgcttatgcggtaatcgtctgggggcgggagggtcagccacaatcgttgcacccttacccaccgtcagcggttgtaccgcaacggttatccgatcatcggtttgcctacaccatcaccgaaccttatagcggcaaggtgaaaaccttcctacaggaagaaatcctgcatttacgctatgccaccgaagacggttttcttgggcgctcgcctgtcaccatctgccgagagacattgggcttggggctggcacaacaacgccacggagccagcatcatgaaagacggcatgatggcggcaggggtaattaaatccgctgagtggctggatggtacaaaaggcgctaaggcactggaagcgctcgaacgttataaaggcgctcgcaatgcgggtaaaactcctattcttgaaggcgggatggaataccagcaattaggcatgagtaaccaagatgccgagtggttggcttcccgtcgcttcacgattgatgatatcgcccggatgttcaacgtcagcccgatctttctgcaagagtattcgaacagtacctacagtaactttagtgaagcgtcccgcgcctttctgaccattaccatgcgcccgtggcttgccaactttgagcaacaaatcaaatcggctttgctggtggcgtcaccaaaaagcggcatccgctaccaagtcgaatttgataccgccgaccagctgcgagccaatccgcgcgaacgcttccagagctatgaaaccgcgattaagtcaggggtgatgtgtccgaatgaagcccgtgaacgtgagggactctctccccgtgaagggggtgatgaatttagtcaggcatggaagcaaacggtagaaatcaagaaacaaccggagggcaaggaatgagggcaggcagattgaggcatcgggtgattatccagaaatccgagcagtcacgcgccccgtcagggcaggttattgacaagtgggtggatgtcgcccccgtctgggcggaagtgagggcgattagcgggcgtgagcgtttggcatccggtgccgtgttctctgaggccactgtgcgtatctggatgcgttaccgtgatgacgtgaccaccgccaatatcattctctataacggggctaacaccagaggaaccgcttttgacattgtggcggttatccctgatgcgaaatacacccgcttagagttgctgtgtaaaggcggtgttttctaatggctgaaatccctttaaatgaaatcaaacagcattgccggctcgatgaacgcgacacgcttgatgatgccttgttaatgggctatgccgaagccgcgctggaagtctgccagcaacatattggcaagcggtttgataacggattggcctttacccctgctatcaaggtgggctgtctgctttatattggcttgctgtatgaaaatcgggagatggtgacagaagcagaacttaaagaagtcccttttaccatcaagtcattgtggtctgtctatcgtgatgtgggagtgtattagatgccgtggcaacctttaaggcgctgtagttatccgaattgccgtgaacgggtgaagtcaggccactgtgaacaacaccaacgggaagcccgacggcagcaggacaaacaacggggaacccgaacccaacgaggctacagtaaccgatggggacgctaccgactgcaatacctgaaagccaatccgttgtgtgtccactgcctacagcaagatatctatgcctctgcaacgattgtggatcacattatcccgatacagggtgaagctgatgtgttgttctggcctgaatccaatcatcaatcgttatgcccgccctgccataaccgcaagaccgtacagacagatcctatcaccaaagcgaagcgcaaacagggtatctatcaggaacgggaaacagaagcggcaaagcatcgcggttggttagtcgcagaataataactaaatgaaatagtgggtgggggtatcaaaaatgacaaacgcgcttctcagcggaaccgaccccctcctcaaatttttacgcacggcactttttttgaaaataaactcacaaggaagacagaaaattatggcaagggcacccaaacccccgacttatcttaatgacattgccgccagtcagtggaaatccaaggcaaaaatcttaggcgaacgggaagatctgaccgccgccgactggaacaacttagaactgtactgcgtcaactatgccatttaccggaaagcggtggcagaccttgatattcggggttttagtatcgtaaacagtcagggcagtgaaagccgtaatccctcattgagcgccaaggctgatgccgaaaaaatcatgataaaaatgtcgtcgttgcttggctttgatccggtttcacggcgtaaaaatccgatagaaacggaggaagaagacgagttagaccgcttatgaatgcatgggagcagtatgcttttgatatccaaaacggtaaaatttcggcctgtaaccgactaaaacaagcggtgaaacgctactataacgacctgaataacccgctttatacgtttgattctgaggtcgtggcgcgttttattgctttttcctgtctctgtccgcacgtcaaaggccatttacgcggtaagccgattgtactggagccgtggcagcagttcgcctttgctaatctgttcggtttcaaggtaaaagcaaccggacgcagaaagtaccgtagcgcttatattcaggttccgcgcaaaaatgcgaaatccaccgttgccgcgatactggctaactggttcttggtgatggagcaggagcagcaagatatttacaccgccgccgtgagccgtgatcaggcgcgtatcgtgtttgatgatgcccgccagatgagtttactttccaagccgctcaaaaagcggctatctatccagcaacataaagtgacctacccgaaaaccaatagcttgttaaagccactggcagccaaagcctctaccattgaaggaacaaaccccagccttgccattgtcgatgagtaccatttgcaccctgataacgcggtgtattctgcccttgaattaggtatgggcgcacgtcccgaaggtgtcctgtttgccattaccacggcgggcagtaacgtgatatccgcctgtaaacagcattatgattattgctgtcagatactgaatggcgaagagcaaaacgcatcgttattcgccctgatctacgaactggacgacgagaacgagattgatgatgaaacactttggatcaaggctaaccccaatctgaatgtatccgtggacagtgccgccttgcatgacaccatccagaaagcgcgtggcattccctcgcaatggacagagatgctaaccaaacggttcaatatctggtgtcagggtgaaacaccgtggatgggtgaaggcgcatggaaagcctgccagacagactatgatgaaaacaacctgaaagggctggagtgttacgccggactggatttatcctcaacaggggatatcaccagcgtgtgttacacgttccctgtggataatgaattgttattactgacccgccattatttaccggaagcccagttacagaatccggccaacaagaaccgggcggtttatcgtcaatgggcacaagcaggctggatacgtaccacacaaggcgattgcattgattatgaccgtattcgtgacgacattctcaaagatagccagcactttgatatcaagctggtgggttttgatacatggaacgccacgcacctaagaacacaattacagggagcagggctggacgttgaacccttcccgcaaacctatatgcgctttagccccgttgccaaatctgccgaggtgttcgttaaccgcaaagttattcgtcacaatggcgatccggtgctcgcgtgggcaatgtccaatgtggtgatggaaacggacgccaacgctaatatcaaaccgaacaaaaagaaatcggcaaacaagatagatccggcgattgcgttcctgatgagctttggcacatggcagagtgagcatgaagagtttgctttcggtctgagtgatgagcaaaaacagcgattggctacctttgatgggatttagttaacaaattaattttatttcttccaaaatggttggaaaagttaatatttgttgatacggtttcttctaattactgttactgtttgatgtaataaagattcaacaatgcacggaataataaggagataaatgagaatatgacagaaatcacatgtataggagatttccttcgtgtcgttaaggagctttctccacagaataaaagcgttttttatagaggccaaagaaattcagaatatggtattaattcaagtataagtcgattgttaaaaagtgttaagttaaatcctatttcgattaaaagatataatactattacaagggtgttttatgatgatgaaatttccaaatatcatttggcaagtgaattatattccactttcagggagaagcatatagtttatcctgatgtgaatatcattaacggctatagtatgaatgatattgatcttcatgtaactgctcagcattacggattatcaactagagtcattgattggacttatagtcctttaattgcattatattttgcaacagagaaaagaaaaaataatggaattaaatacgaggatgatagtaaagatgcatcagtgttcatgatttggaatgaagaatctaataaactagatgtatgttctagcgataatttcttaaaaagaatagaagcagagaaaaaaatccataaaaaaatatctaaggattgtgaaagtttttatttaactcaccgttataaaatttataatatgcacgatgaattagaaagatatgttgatgagttatataataaattaatagattatacgaatcatttagagtttggtgaaacaataaggttaaattcaacagatcatttaattgatcttgtcgagtgccgcgataatttaaatgctaatgaatttattgagaaaatattttattttgcagttcgattttttaatcaatcatataattattccaggccgaacgctaccatagacatttttaatgattataacactatcatagagccgctgccaattaatcaaagggtaaaaaatcaacaaggagttctaatgttttgtaaaaaagttgaggacgatgtttatccttcaagcaaattcaatgaaaaaaatacaataaatcatatcgatgatgagtcattatcggaagtttccaaaaatgctggattattgaaaataatcataccaaagagtagtatcaagagtataagaaaagagctggaactgtatggtttctcgaaagactttgtatatcctgaaataatgtcttttactgaatatatgcaagagaagatcatatcgaagcatagcatttgatttttttacagctagaaagttacctttgattaataacagagccttaacgcactagctgaagtataacgaaaaaagttaaacatttatactgattcgcttattgaaccagataaaccaatcagttaaagtagccccgccattagcaaaatctaatggtcagggcttcgcatccctgagctaagaacactggtaggatgtttctaccagtgaccttgttcaccctttcaatggtgattcaggcaggggaggcttcggcctcaccggaatcttagcccggtaatgcgaaccttgcttgaatcgccaccatcaattttatcaattaatggaaagggtagcaggaatgaataacgttagaaatgactggcatcaggccgacattattgctgcattacgtaaacgtggtacaaccttagccgcagtctcccgtgaagccggtctcagttcatcaacattagcaaatactctcagtcggccgtggccgaaaggtgaatggattattgctaactatcttgaaatacatccttctgaaatttggcctagccgatattttgatatgtacggtcagcttattgcgcgtaaggctcgagacaaatcataaaaatagcagcccaccacttgaaaatcaccgggaagatagccgtaacggggtatcttctcactagcagtaacactcatcattgtcacctcaatagctcccgacgaagtgcgctgcaacctctcataagttcagaacgtttagcgtactgacctctttttattgagcacaaattcactcttattctttcttttcttccacattgttcttatcttatgttttgtttataggtttgttcaacgttttatgtataagcaattgtataaataaacaaaaataaacccgttaaaaaataatatttacctaaacattatcaataggttatgctttaattatgaatatacctaatatatcccaagttaaggattttttcctctcattacaggatgaaatctgcaaacaacttgagcgacttgatggtcactccaattttatggaagagtgctggcagagggaagaaggcggtggtggtcgcagtcgcgtattaaaggcaggcaacgtttttgaacaggctggcgtgaatttctcccatatcactggggcttcacttcctcaatcagcaagcgcccaccgccctgaattagcgggtcgtagctatcaagcaatgggcgtttcccttgttatccacccactcaatccctatattccgaccagtcatgccaatgttcgcttttttattgcggaaaaagaaggtgaagcaccagtgtggtggtttggcggcggttttgatctcactccttattatggcttcaacgaagatgccattcattggcatactgtcgccaaaacattatgccaaccttttggcgataatgtttatcctgattataagaaatggtgtgatgattatttctttataaaacaccgtaatgaaccacgcggaattggtggattattttatgacgatttaaatacccctgattttgaaacttgctttaactttacgcaagccgtcggtaatggttttttggccgcatatttgcctattatagaaagaaggaaaaatataaactggggagaacgtgaaagagaattccaattatatcgccgtggccgttacgttgaatttaatttagtttgggacagaggaacattatttggcctgcaaagcggtggacgcactgaatcaatattaatgtccatgccgccattagtacgctgggaatataatcattctcctgagccaaactctccagaagctgaactttatacctcctttctaataaaaaaagattgggtatgataattaaaaacaggaatatcggataacgcctgtattcctgttctatatcagacactaataatttaatttattatttttcattggcaataccctgacataaaaaatcaatatttaccctagtgactaactcaattattatagttagtattcaaacgtgtccaaaaaacacaaacacaacatctaataataaaggggataatcatgaaaaataatgaaatcaacagatatagcttaatccctccatttgttttagaacatatctctaatgattgtgatgagcgctctaatcaatatgtattaaaaacattagatcatgttcatcacttaatgaatatctctattggagaagatctcttacaacaggaaaatgaagtagaatttgatgatgaattaaatcgaactatctacgatgcagaacatgaagagatatttccaggtgataaggtagcgcgacgcgaaggtatgcctgagagtgaggatattgctgtcaatgaagcctatgagtatctcggtaagacccatgaattctacaaaaaagtttttggccgtaattcactcgataacaaaggaatcaagctagtcgcaactgtacattatggtcaaaactacatgaatgcattttggtctagaaaacagatggtttttggcgatggcgataaaagtggaaaatatttcaatcgcttcacttctgccattgatgttatagctcatgaattaacgcatggcgtgattgagagtgaagcaagacttttttatgcttatcaatctggcgcgttaaatgaatccatttcagatgtgtttggcattatggtaaaacagtatttcgataaacaaaaagccagtgaatccgattggcttatcggaaaagggctacttggatctaattttaatccagacaataaaccggatgttgccttacgtacatttgtaaatccgggaacggctttttccggggataaacaagttggtcatatggatcaatataaagagctaccgtttacaaaggacaatggtggggttcatatatattctggtattcctaacagagccttttatctactggcagtggaactaggtggttattcatgggaacgggcgggtaaaatctggtatgaaactttactcgacgaacgtttatcttcagatgccaattttgatgattttgcagaattaaccattaaaaacgctgaaaaattgtttaataaagaagtttcagatatcgtgaataattgctggagcaaagttggagttatcattccaacaaaataattaacaccaacatcaatataatcattaatacaatatcaattattcttaaacagagtaagattaagataatcctataataaacaagaaagggctgaaaatagccctttcttatattcatagctcaatacattttagatttataccgcatttgcattaatatattgattttaatcaaaaatataataatataataaatttacatttctaccagtgactaacacgattattttagctaatatctaagtaccctaaagcagatacacataacaacatacaaactggctaatattatgcgtaatagtaaaatagacaagtacaatatcattcctccctgtctactggaatatattgccaataattgtgatgaaaatgacaaggaatgtgcgctaaggacgttagaacatgttaatagtctaatgaaaaattcagctaaagaagaaaaggtttcacagccggaaaataatttatcagttgataaaaaaagataactaaacttgacgatttacaataatagaaatcattacatattaataaattgaattagttttggctgaaaaatgataataaagtttcattcaggcaatagtaatgaaattattttattaccttacaaagaaccaaaaaataaattcataagatagttaaaaaattaactaaaccagtaataataaagggctaaaatagccctttatttcatacatatttgttttaatatttagcgctttttcaaatgcgccattaaacgtttacgcttacgaagctgtgtagccgtcaaggtatttttcttatctgcataagggttagacccttctttaaactgaatgcgaataggtgttcccatgacttttaaagagcggcggaagtagttcatcaagtaacgtttataagaatcaggcaaatttgtcacctgattgccgtggatcaccacgataggtgggttatatccccctgcgtgggcatatttcattttgaccctgcgtccacgtatcatcggcggctgatgatcttcttctgccatatgcatgatacgagtcagcatggaagtactaacgcgatgggtagcactttcgtaagcttccagaatcgagtcaaataagttgccaaccccactgccatgcagtgcagaaataaagtgaacacgggcaaaatcgacaaagccgagacgcaaatccagcatatccttaacgtgatctctgtcttcctggctcatgccatcccacttgttgaccgcaataaccagagagcgcccactattgagaataaaaccgagcagagagagatcctgatcagaaatcccttcacgggcatcaactatcagcaaaacaacattagcatcttcaatggccttaagcgttttgataacagagaatttctcaaccgtttcggttactttgccacgtttacgaacccccgctgtatcaatcaggatatattcgcggccatcacgctccattggaatataaatactgtctcgggtggttcccggcatgtcataaacaacgactcgctcttcgcccagaatacggttggtcaatgtggatttacccacgtttggacgaccaacaatcgccaatttcagcggtaaagtggtaggatcaaaagctgcctccttctcttccccttcagcagcttccaattcagactgctctatctcagcccaataagctgcattggcttcttcttccgttaattcaacttcttccgttttctctttttcggagaatggcaacaacacatgctcaatcagttgtgtcacaccacggccgtgggaagcggcgatggaatatatatcccccaaccccagtgagtagaattcagggatagcagtatcggtatcaataccatcggttttattcgctaccaaaaaggtggctttttcacggctacgcagatgttttgcaatcccgtgatcggctggcatcattcctgatctggcatcgaccataaacaggactatatccgcttcttcaattgccatcagagattgcgcagccatatgcgtttctacgccatcttccgtaccatcgataccaccggtatcaatgatgatgaattcctgcccttcaacttctgcccgtccatatttacgatcacgggtcaaaccagggaaatccgctaccagcgcatctcgggttcgggttaaacggttaaataaggtggattttccgacattcgggcgcccaaccagcgcaacaacaggtatcatttttttgatgcctcataactagatgtaaatcgatatcctgctgaaagtgatccactcgaagctccactacaacagatactaaaaagacgaaacggctcctgttactgtcagcacaggagccgtgttattccgtgttgcgttaaaacacgtgatgaaattagcgggtatacaggtaaaccttaccgtccttcgcctgtaccatcagcttatctccggcaacaaccgggcgactcaacaagccagaaccatcaactttatgctgagccacaaatttaccatcagccatattcaaccaatgcagataaccttcagcatcaccaacaaccagatagccattgtacatttccggtgctgtcaggttacggtgcaataaatcgctttgcgtccacagtgttaccccgtcacttttacgcagggacagaatacggtcgttttggtcaacaatgaaaatatggtcattcgtcacaaccatctcattcacagaaccgatatcgcgtttccagataagctggccggaacgcatatccattgccaccaaattgccattataagcaattgcataaataatattattagaaatgaccggagtcatatcaatatcattcaggcggccgatttcagttgaacctgtcatctgagcaatacgctgctgccaaatcaattgtccttgtgacatcagaaccgcactaatacggccattatcaccaccgacaatcgcagcaccataggctacggctggagcagattcaccacggactgacaatgaaggtgtatccatattgactgaccagactgcggaaccattggtttcattcaatgcctgcaacagaccgttacccgtgtggattaacacaaggccatcactcaccacgggacgtgataacgcttcacccgcaacgtttgattcccattcaactttaccgttagtggtatccagtgcgatgacttttgcctgttctgtaccgacatacaggcgctcacctgatacggtcaaaccaccagaaagcaatgcaggcaagcgggatgacagaaaacctgctttttccgacaggtctgtggcccacagctctttacccgtatctacttcaaatgctttaacgacaccggtgcgatcagcaacataaaccgttgaaccctgccaaacaggtgacaagtgagaataatattgcccaacaccgcttccaactgatttatcccaaattacacggggattgaattgattttcaaccttcggcagcggtgacattgctagcgtatcctgttcgcttgaacaaccagccaacagaacagaagcaaccagcccaaccaagagtgtttttcgcagttgcattaaagttagctcccttagctggataaattattaagtttaatttgaatactacttttcaaaggctgtgggccatcggcttccagccccctggaataggctgcacgcgcacccgcaatattcccttttttcgtcagaatatcaccacgaatgttctcaacggctaccagccaacctttccccttgacctgttccagcgttttcagtgcagcatccgttttatcttctgcgaattgaactcgagccaggcgaatattggataaagcctgcatatcctcgtctttggctttgccagcggcggccagcaagcgcttttctgcctgagccaaatcattctgttcaacagcacgctttgccaaatccacatcagccatgacaccatagatattattcgtttcattagcgaatttttctgtggcaacaacgctttctttcgagcccgattccaatgatttattcaatttctcaaacgtcgccgcagtaccctgcaactggtttgtctgatgagactgccagtaatgccagccagccagcgccccaatgcccagcaccaagccaacagcaagatatttaccattgttggcaaaaaaacgctttatcacatcaatttgttcagtttcagtggtatagacttccacagagtctctccttagcctaacagttcgctcaaacgtgctgcaatcgcttgttgtgacaacgtctcttgttcaccattacgtaaatctttcacagtgatattacctgcacgaatttcatcttctccaaggatcagggcaactttggcaccatgcttatctgcacgccccaactgtttcttgaagttgccaccaccatgattggtcatcaagcgtaattcaggcaattcatcacggatctgctccgccagaatcaatgccgcctgctggctaccttcaccaaaggaggagagataaacatccgcaacaggccagatctgcaacgaactcaggattgacttcctgaactaacagaaccatacgctccattcccattgcaaagcctactgctggtgtagatttcccacctaattgctcaaccaggccatcgtaacgaccgcccgcacagactgttccctgtgcacccaatgcagaagttacccattcaaagacagtacgattgtaataatcaaggccacgaaccagacgctggttgaggtgatacttgatacctgcgctatccagaatccggcacaacccatcaaaatgttcttttgattcggtatcaagatagtcaaacagtgccggcgcatcgttaagaagagcctgaatttcaggatttttggaatccagtacacgcagcgggttggtatacatacggcgctgacagtcttcgtccagcttctctttatgctgttcaaggaacgccaccaaagcttcacggtaattcgcacgggcgtccagtgaaccaatggaatttaattcaagtctaacgtgttcagcgatgcccagttcacgccaccagcgagccgtcattaaaatcatttcagcgtcaatatccggcccttgcaggccaaaaacttcagcacccaactgatggaattgacgggagcggcctttttgtgggcgttcgtagcggaacattggcccaatgtaccacaagcgctgttcctgattgtacagcagaccatgctgaataccagcgcggacacaacctgcggtattttctgggcgcagggtcaggctttccccattgcggtcgtcaaatgtgtacatttctttttcgaccacatcggtaacttcaccaattgcgcgtttaaataacggggtctgctctacaatcggcgtcctgatttcactgaaaccatagcctgccaacacacgcttaaccgtagactcaacacgttgccagatgaccgtttcagcaggaaggcaatcgttcatgccacgaatagctgggatattttttgccatgttttatctcttattaatatttctacaatagcgtcgattataaaagcgaatgctcgcggggttcaatcagcaatcagaaacaatactggctcatgataacatgagccagtatcaggtatattattcatcaagctgattgacattaatccggttactggcatcaaggatcgtggccttggcacggatcttcgcttcaagttgatcaatcaaattattattgtcaaaacgctctttctgacggatgccatcttcataaaaaccgcttttattttttgcaccagtcacgccgattgttgaaacttctgcttccccgggaccattcacgacacagccaataatggaaacatccatcggcgtaatcaagtcctcaaggcgctgttcaagcgcattcacggtgccgataacgtcaaattcctgacgggagcaagtcgggcaggcaatgaaattgatgccccgcgagcgaatgcgtagtgccttaaggatatcaaaaccgactttaacttcttctaccggatcagccgccagtgaaatacgtaatgtatcaccaatcccttcagacaacagaagacccagaccaattgaggatttcaccgcacctgcgcgagcgccccccgcttcggtaatacccaaatgcaatggttgatcgattttctgtgccagcaaacggtaagcaccgacagccagaaagacatctgacgccttgacgctcaccttgaattgatgaaagttcaagctatcaagtatatcaacatgccgcattgccgactcaaccaaggcttctggtgttggttctccgtacttttcttgtatatccttttccaacgatccaccattgaccccaatacgaatgggaatattgtagtgacgagcgcaatccacaacctgacggatgcgttcttcattgccaatatttccggggttaatacgcaggcagtcaacgccatattctgcaactttcaatgcgatacggtaatcgaaatgaatatcagcaacgagaggaatattgacctgctgtttgatggatttgaacgcttccgcagcgtccatggttggaacagaaacacggacgatatcaacacctacacgctccagcgatttaatctgcctgactgtcgcttctacgtcatttgtccgtgtgttcgtcattgattgcaccgcaataggtgcgccatcgccaatgggcacattaccgacataaatacgtgtggatttacgtctttttatcggtgattcattatgcatttttacattactcccctacatccctgtattttgtttataaaaattacaactatgctgtggtgaataatacacacaggcgaacttgaatttctattcaatattcgcctataaatgttcgccaatttgccaaaatagttaattattttctggcagtttcagttgggcaatacggttcaccttgacaaaacgagtcatgtccacggtttttccctgaaactggatatcaaccgccgcaggtgcgccaattttcagcttataaggcaaggcacctgaaagtttcagactgctgcctttatcttttgtgcccatgaacaaagtcttaccattggcatccgtgatctgtaaccagcatcttgccttaaaattcatcaccagttcatcactgttaaccgcactgatattattcacatcagccgatgacgtattcacagcagaatttggtgctgtattagttgtcgctggtactgaatttacaaccgattgattgcccggcgatgatgcattgctgtttgctgccggatttgctaacgctggagaggtttcttcctgagcggccgcgactgagttatcatctttagcatggtcagatagttgacctagatctgttgttgaagtgcccaagtcactttcatcgccttgcgcctgggcgttataagcatcagattgtgttgtcattgaagctaagtctttttgctgcgcggtgtaattctgccaccaccaccacccagtcattcccagcagcacaatgagcacgccccacgttattttcatcaaccaaccatcacgttttttccgcttttttcctgacgaaaagctttgcatcggggaaactttcccagccttagcgggcatttgtttatttaatgtgcttaaaatatcggattcagggactcggacaagtttcgcataagcccgaatatatccacgtaagaatgtcagggcaatatttgactgcgtattatcttcttcaatatcacgaacagtggacagtttgagacacaaacgatctgccacagtttgctgagaaagctcaagtttttcacgagcctggcgcagaatctgacccgttgtcagattagcttcttctgggtaagtttcagtcttcattagctaagggcactggtactgttcaggttaaagtatttacgcaaattaatttgatagaacatccaacttaatttgtgcagcgaaatcatttcatactgcgtcgaacgcagaaaatcatttatcacaagtgtagtgacttgtgttgtttcccgtgaccaattttttagcctcttcatcccgcttttgttcacagagaaaagcagcataatgacgtattacagtatcatttcctgccgcatactgcatggccattctataatgctgatcggcagctttgggttgacctgcataatattcatacagcgccatacccaaatgcgcttctgggtggcgaggtttcgccagcaaaaccttttgaaaatgatatttggcagccgataaatttcgctccgctaaataggctttccctagctgtaatcgagtatctattgcgacgacctgatgaccgtgatgcggggaacgttccgcacaacccgtgatcaggccaaaacaaactatagaccaaattattgatttccgtatcataccattttcatttataaggttatgttaaacttcaccagatttttaaccatcaatcgcgattaaacaaacaaattagactggttttacctgaattggttcacctgccagacgttttttcagtgtccgttttgttctatcaataacatcaccagcaagctgcccacatgcggcatcaatatcatcccctcgtgttttacgcacaatagtcgtaaaaccgtatcccatcaggactttcgaaaaacggtcaatccggctgttggagctacgcccataaggtgcccccgggaacgggttccatgggatcaagttgattttgcttggtgtatctttcaggcattccgccaattgatgtgcctgttccacgctgtcattgacgtgatcaagcatcacatattccaccgtaacccgcccttgattggcattggattttgccaaatagcgacgcactcccgccagaaattcttcgatattgtacttgcggttaatcggtacgatttcgtcacgaacatcatcggtaggtgcatgcagggaaattgccagtgcaacatcaatcatatcgcccagtttgtccaatgcaggcactacgccagatgttgacaacgtcacgcggcgtttcgacaacccaaagccgaaatcatccatcatgatttccatggccggcacgacattgtttaagttaagcaatggctctcccatccccatcataacgacattggtgattgggcggcgaccactggatttcagcgagccaatgattttagcggcacgccagacttgaccaataatttcagaaacccgcagattacggttaaatccctgctgggcagtagaacaaaatttacactctaaagcacatccgacctgagatgaaacacacaatgtcgcgcgctcatcctctgggatataaaccgtttcaacctgttgatcaccaacagtaattgcccatttaatggtgccatctgcagaacgctgttcttctgccacttcaggtgccttgatttctgccacctgctgcaatttcgtcctgagcactttattgatatcggtcatctgctcaaagtcgtcatagcaatagtggtacatccatttcataacctgatcggcacgaaacggtttttctcccatatcgagaaaaaattgacgcatttgtttacggttaagatcaagcagattgattttgccgtttttcttttcaggagtgacagatacagcggcagttgaaggttgtacggtttcgttaagttgggacatttttacatcgcctcgttgttacactttcggctctgtgctgatttaatttcagcactaagttttgattcggtgactatcaattcaataaccactatatgcagtgataattgagtattgagataaaataataaacgccccactaagtcaaatcagtgaggcgcgacattgtacaaactttactgttcagatgctacgagtaactgaatatcagtggcgggggaagatttcatcatcactgaaaaaataagcaatctcacggtttgcagattcaatggagtctgaaccgtgaaccgcattttcagtaaagctatctgcgtaatccgcacgcagagtacctgccagtgcattgtccggattggtagcgcccatcaggtcacgatgacgctgaaccgcattttcaccttccagagcctgtaccacgattgggccagaagtcataaattctaccagaccatcaaagaaaggacggcctttgtgctcagcgtaaaaaccttccgcctgctcgcgtgttaaatgcagcattttggctgcaatgattttaaaccctgcactttcaaaacgggcatagatggaaccgatagcatctttcttcacagcattaggcttaataatggaaaaagtacgttcaatcgtcattggataacctctttggcactttcagcgatgattcattttaattttttattctccctttgctaaaacagggagacgaaatttatcctgtacctgacaggaataaaaataggcgttgattataggaggagactttctgcttgcctacaaaaaacataacattttattaaaactttcttagcgaaaattatcattttttagcataaatcacatttttactatacaaacactttaagacaaagcgagttaagctgttttttacaccaatccagaacattggagatcacttactttctgccaattcgtaccatcctgcccgattaattctataaaataatgcctattcaggcgatgaaatcccaaataggcattctgatcaagatcattgattcggcgttttaatgcagttccaattacaaaacagtctctgttacgcattgaataaaaggtttaatctcttcatttcttttcttatccagtggctttttacttccactagagagtttaaactcccctttgaactgcttattgacctcttttgttgtcttatcagatgtaccaataatactaatggtatatttatgtccttcaggcaataggtgtgtacattttctcaacgctccttgattacctgattgtttattctccattttattatcaacaccttttgctgatgtatctgcaaaagaaacaggaatataaaatagccccagcaataaaaaatatgaaaaaattttcatcttttttcctcacgatttaaattaatagaaccaccgacatgatttactgattaatcatctttgaattccaatatatccccaggctgacaatctaaatattggcagatggcatcaagagtagagaatcgaacccctttaatttttcccgttttcagcaaagaaaggttttgttcagtaataccaatggcctgtgctaattctttagatttaacctttcgttttgccatgagcacatctagagtgatataaattgccacaatatctcctatataatgctcttattttcgtcatatatatcacatgcttggtaaagaatacgcgaaatgacagccaggcaaaccgaaataaaaatagcaacaagatggctagggcttagactcaatgagaaaaagcgctgacccgctggcgctcccatagtgagccaaacagttaataaaggttcaaaaagaatatctaacatagcccagatgatgaccccccaacctgcatattccaaatatttcaccgtattcttggaaaaataatcacctttccgataattgccgaataactgatgaaaagcccagagactccctcccaaaaacaataatgggattgtcgatataaatattccactggtcagtttccacgagctaagagtattctcactaaaatgcaataatattctatttgtcaacgaaaatcctaacccatatttctctaatattaacttggctcca

SEQ ID NO: 16844 - DNA, 11253 bp, Xenorhabdus bovienii
tttttggtacacgttctggatgtggtttgaaactgttctatgagacacaaacagtctttccgctatgtctttagtcgaataaccttgcattatgtaaaatataatttcccattcccttttactgaatatttctgatggaggggtgaaaattaaggatgtttggatatttattttttttagcttttcaagtgttatagtgtctaccggtcttccatggaaaatagtccccctgcattcacctgattcgtctattaatgggaatttgtcaaaataccatggttgcagataatcgagacctttgaaagggtgaatttcgatagacgtaactctgtctaataatgattctacttttctatcatgtttttgaaattcatcttgaaaatctgatgttgttgaaggaagttcaccatcgtaatatcctcctacgtcgtatcctttgggcagtgaaagtaattcattgtatttattattagcatatataaattttgagttgttatctttagcaccccatggctcattactaatttcccaaaaatttattagggcgctaataattttttctgttgaacagatcatatatttttactcctgactttcttgaatgtttttttagttagttctctattttgggacactataatttttatattattttttcaagaatatatattttttcgatgaaatccaactaatcccttctccaaactgacccccattgagaaccagacatgcgaagaggagcgcaagctcgcggtactgatacgggcagagaaaacagcagaaagagccatgaaggggtccgcttggaaaacggaaaaaattccgtcacgactgaaacccgacagattcaggacgcgtaatatgctgttatggtaaataagttgcacatacttctattatgtgttgtgcaacttatagttaattgcaataatgacatttataacttgcactgcaattttcataaggaagaatcttatgacaacagaaaccatcgatcattcaaccttgcaccgtctggttgaagccggcgctgtccgcgcagcacacgttattgggacttccggcggctgggcgttaacggttaaatatggtctgactgaacgccttttggctgcacaacgcagcaggcaggtacggttgtttaaaaaattggaaacactggtcggttacctgaaagacatcggtattgcgcaattcgatgttgatgcgtccaactattccccagaaaaccagccccggcaaactcgaccagatcggtcggcagcactgaaacgcgcacatgaggcagtttcttatgatgattggttcagggaacaggtacaaacatccatcgacgatccgcgaccggcagtttcgcatgaggaggccaaacatcactttgccgcccggaaagacgctctgcgtaaggagtcgtgatgcgtctggaatggaaacccatggctctgactgaccgggaaaatattatggactatatcgcccgtgataacccagcggctgcgattgccttggatgatgagtttgaggcggcggcagagcgggcgtgtactgagcctgagatgtataaacccggtcggctgaaaggcacgagagaagtcgtggtcaaaccccgttacatactgatatatcaggtagagggggaggtactggaggttttacgtatacttcatgccgctcaacaatggccacctactgagtgacggaattttcggcggttccgacgtacaatcccttgatggacgaaaaagatattcaagcctacctaagcgcagctaaaaatgaaaatgatcctgaatacttattaacagcattaaataatgccaagaaggctcaagaatcacataatcaataacgtgagtagtcttgttttatcgatatctggaaatattacgcttcctcgatgttgtcgcttcgctccattttgattagtaccacattggggcattaggtttttattgggtaaacttccgaacagtcgaaagatattcatcagctcgatcgaactctagctctaacagatttaaattaagctgattattagggtctcttttgtagctttctaatgcagtgttaagcttggctctatgttttcttagttcatctttgaaaggctttgcaagctccatatacatatgtttagttaatttcctgatgcaggattcagccctagccacaggatgctgatcaaccttgtaaatagcaccaacttccgtaggcgtttctgtcatcttcttattagctaagggggttgcctcctctttgattgtgtcattaagttcttgtttaatttcattaatttgagcttttgttacctcgacagaatcaagtttattcaatgcatcatcaataacattattaatttcttcactcttagatttaatcattctcatttcttcaaaggagataaatctattgtgagcaactttattccttaagtctgataaacgattccaagaatcctctattttctcttgagcatcatctctattcttgtgaacatcagcatcagttttgaaatcttggtaaaaataacgttgccaattacttttcggtataaattcagttagctctgatatttttatcatatcttcctttttcgataatattctatgtacgtcacttgtttttaatgtgctgtatttctgaaaaaggaaaacagatagttgtttaaaatcagtctcagataaaaatgtatttatattctttgtgtttttttcatattctttatttttaatagaatcaataacatcttgaggtgtattggaagaaacccatcctaaaccaactttcgatgtcataaatatagttattagctttctcattttattttctacttcatggatatatttatatccttcggcagagaattttgatgataggggttttccgccggaaccgccggaatttccgaaaagctaaaacgtggaataaaataacctgtacgtaagaccagggctaaccggacagtaaaaaagtagctatttcttgcaaaaaaatctgattactacgtttcatatggttggtacgcattaattctcattgatggaaccttaatcgtacatcctaataatgcgaaacatgtataaaaaaacgtcagattcatggcatcggaatttccggcggttccggcggaaaacccctgataaatcatccctaagtttatctaatcgagaatggttaaaactactactaataatttttatgaattcttgattcatgctgttaacaatcgatttatcaacataatttgttattgccgatttattacttaacgtaattagaaaatttctatcgctctggtttttagcttttattttttttataaaaagatcgaactccatatctttatgaatgataattgtgttgttctcgatttttttgaatgtatattttttgtttaattccaacgacttaactaaatcttcttctgattcaattatttcaatatcttcagagagaatcaaaagatactctgatgtataaatcccactgctcatgacatctccattcacataaaaaacagcatacgacctacttaccagcccaaaaaatttaatgtaccagatttataggttcttctaatcccttttatgttaaacgggcgagttgagttactaaaacagcccgttcataccatcaaaaagccctcaaatcgattttaagacacgatccccccatgaaacgcccaaattcacgctgaaagattagaacggttttggtggcctctgagtgcattttaaacataatgaaaattggcaggaaaaacgacatgaaatcactaaaagacacaaacttgttttgtgatttttagtgatttgaccaaccgagtaaaacgagggcggttgcatttttaatggtgaccggaaacctaaaagatgaggtaaaaacaataacaattcgtttttgttttaacagccaactgcaagttgaggcggttattacgagatgaaatcggttttacggacttttcgatccgatttctggatcaccataaaaccgcctaaaaacgattttgagcggtttttggatttcaggttggcagactagtgtttaaagagaaaaaatcgcacagtgaagctcgtaggcgttttttatgcccattagggcatggggagcggcacttaaaggttgaaaggatcatcgacgatcaacccgctgataacagagggggactgatcaaggagcaagaatagcctttcacactgttaaacagtgagcgaagcgaacccataggcacaggctgtaaagcaatacgatagttagatggtcgaagacgaaagaatctgacagcaacaaatacttaaataagacttcatgagtggcttctaggggattttttgctcgaacaacatagagggagttatttaaaaacgccgtagggcaatttaggggagcagatttgctgcgacatccttattttgtgatcgatctgacaaaatttggcaatttatccacagggcacaccctttttaacttgtttttcttgtttttatcttgttttcagttcttttttcttttttaaattcaaatatttaaatatagataggcaatgcttttgacggtaataggcaatgcttttgacggtaataggcaatgcttttgacggtaataggcaatgcttttgacggtaaaattcacagtaaaggcaatgtcttttaaaagaacattgcctttactgtaggtaataactatattttatacattacctatacgataaagagatttttatatgagtcatcttgttgcttacaaatccaatgcactgatagaagcgagttataagctaacattgcaggagcaaagagttttattgatgtgtataggaaagctcaatccgcaagatgaagtaccagagaaaacttttaaattaactgctaatgagttttatctcgctttccctgacatgggaagagaaaacgcagaacggcgcttacaagaagcaatagatcgtctatgggatagaactatattaattactagaaaagatgaaaaacgtgaaataagatgggttcaagaaaaagctaaatattttagcggagagggtacaagtgaaatagttttcgcagactctattatgccttaccttacccagttaaaaggacaatttacaaagatagctatcaaaaatgtagctgctttgaaaagaacatacagcatccgaatttatgaattacttcaacaatttaaacaaactggcgatagagttatttttttagaagatttccgttctatgttgggactagaagataaatacaaaacatttaagtcattaaatcaactggtattaataccagccataaaagaactgaacgaaaagagtgatttaattgtttctgtagatacagtaaagaaagggcgtactgtaatagcccttcactttagattcaaagaagacaaacaaataaaaatggcgatttaaatcgccatttttattttaaattaactaatgcgagtaacaaaatgaatttttcatccatacttttttttaaatgactattgaaaatttaaagttatatgttaatttatctttctcatatctaaaagactaggatggtaattttatgtcatatatgatttatttaactttaaacggcaagaagcaaggtttaatctccgcagggtgttcaacgcttgattctatagggaatcggtatcaaaaagggcacgaagatcaaatacaggtactcagcctgaatcatgcaatttcacgccagcagaacgtgagtcaccagccagtacagttcatcaaaccaattgacaagtcatcaccactactagcaatggcaatagactccaatgaatcactgaatggcggttttattttttatagaacaagccaagcagggcaattagaattattctatgaagtaaaaattacggaagctactatcacagatatttcctgtgtatacccacattctataaatgatcatgatatgatgccatatgaaaaagttacattaaactataaatctatatcatggaatcatataacggcaggtacatctgcctatagtatatgggaagacagagttttctaaaaaaagctaagcatatattatacatatgcttagcgacacatttctggatatttcacatatttatttagtgatccaactgacgttttttcacaaacaatatatccttcctcctttaacttcgaatccaaataccaagaaaatggaaaacttaaaaataaaaaaacaaaaaaaataatagtgagtatttttattagtctattattaagcttcatggattttgatgtaacactataataaaaagcgcatgagaacatatataaaaaaatcggaaatccagataaaatagcaatggatttccaagagaaatttatttcatcttttccattaacgatagataaaacatcatcaaaaataaacacactacaaaatatcatagctaaaattaaagaaaacgaacctattataacaatggttttattcttattatccataccatcctcttttccatcataataaaattaccattttaattttatttcctgacaagggaaaccaaatggttgcacacatggtctcggatacttagcttccaattcatccattttacgcaaatggtctatcagcgctttacttaacccatatttattatcaatataatataatagagacccaaccaaaatactagccacaattgccgtggcagctacagcaagtgcataagtacccgcagctaaaaacattccagcagcagctgtaactacaactccagccaataatccagcggctgtttttgccgcatccatggttatatttccatagaaattataaatatcatactcatctctaaacgcaagttctaataatcgataacccgctgcgacaaaaacaactttcctagttccatcgatgaggccatttttcatcccttgtgttcctatacccatatctattattttccaattattcactttatatttagcagcggttaaaaattttctaacacctgttgatccggttaactttatgcttctattaccgtatctatcaacaaactcagtaactttaactccaaaattactactgagttcttttgacaatttataaaaacctttagcatcaataatattacctgtaaatgatgtaacaatatccatacataaataaccagcttctttccatgatgaattagggtttggcccacatatatttgttacaaaatatatagcttcttcaaacgttaaaaaaacataaagatcttcattgtcatttaaatttttttgaagttcattttgaagttcagaatatcttttttctcttattaatttgctatcacttaaaggtactaatgttccattttcaaaaccaatagaaccatccataaatgctctttcaaattcatttctactcatttgacaccccataaaattacataacatgataatttattgatattttgtctaatatcttatcggactcagctattttttctttagattttctgaattattgggaagctgatcaagtttatctgtcggggtatgacactgcgttttaagttcctcgaccttcagccggcacggttctggccagttccctgaacttccgttgtgcgtatctaaccgaataaccgaataacagtttaagtgaataaactatttatctctttctggtattcgcttatattttttaggcaatgaatcccaaccaaaagcaagacgagaaccatcatcgtcaccctctgaaacatcatcaccaataatcatatcctggtctgattcctgttccagtttcaaaacatctttcaatgcaccgccagtagcaacaaatcggcgtttatgggtttgccgtgttagttccaaaaaccacgccgaatcagcgaccatatcagaaggctttgttgagtatttcaacgtctcagacaccgccccgcgaataagctcagccgtcgaactggccaacgactccccttctttgatacgcttaggtgtaagggctcgcgtttgaaattacgtgggctcgcaatcagcgcgattttcggctcacgctaagtgataatgagcttgcaatcagcttgccgggcttgcattccatcgttacgggctcaaattaactgcaaatgaaaaaatcgtctcgtttggatctagatgccgaatgtagtgcgtctcgaaaatctggtttaaacccttatgaggcggtgttattgtctcattgtcctgtctgttttgggtatacccatacaatccaatagattggtttaagcggaaaatttcatttgcagttattgtgagccggtcgaaatgaaatgcgagccaaaaaagataaatgcaagctcatttgcagttaatatgagccggaaggtattttcatttgcaattaatgtgggctaaaaaagcggataaatgcaagcccgctatattttaaatgcgggccgctacacctatcactacaagattgaagaagccgcctttgaaacaacagatcatctttataaccaaatcaaaggcggtagtgtctcatttaaagagaaaacgtataaaaaagtaggtcggagtcggaaaaagatagcctcttatactctgcaggccaatgatgaaaaaaaggcttggtttgatgcggtgaatgcaaaaacagcccgtttacgtcaagaggctgactttcccattcgcccctcattcaaaatcgaaatgctggattggtgccgctgtgtctctatcgtggcaccgattgagatccgcaatgttgaagagcttcacaaactggttgatttggttcgccgtctcctgcaaagggaaacaacgttagacaaggagttccttgattatacgtacggcaaggcacaatggattgcagaaggcctgacggaaagtcaaaccaactctatagggttcctccggtccccctatttaaacgctaaaagccctgactgtacaaatcagggcttttagggtactgcgaacttaagatttaacattaatcaacttaactgacttcgtactgctttcggtactacttaaaatgtactcgtttattacagataatattgggtactaagaaactagctacatcctcccatatactgactggttggtttatacaacgcctactaacctcagaacaacacccaaagaaaaagtaggctaaactggtacattccccctcgcgatataaaatatttgatgcatggccttactttcgttgcgttttttttacaatatttctttaacgaaacgcaacatcaataaactaaaaaatcagggcattatatcatcgcgttatcgtacacaccctgcgattgtagatactgactacatagccttaaagcattatcgagcgagtttgttacttatactcaactgcgattaccccatacaaaaacacttcgtagcctttatcgcaaaaacactgaacaacttattaaaaacacgtgcttaaaaaccttatatataaacagcaaactatccatgccccgctgttgaacgctaatttacggttttttttaaggctgtcaatacttttttaagaacatgtttttatatcaatctgaacatcaagcggtgtacaccagacaggctatcaataattggttagacagagtgcttctcgccggatttcctgataggggttcagttgaagaaccctcgaaaatgacgaatgccatagtaaaaaggcaaaaaaatgaaacaacaaaataattttattgggattatacgccggagaaactacagacattaaagaccattggtgatcaactgattgcagaaaacgaaagaaagccgagccagcagaagcaataaccatgacgctcaggaggatttatgaaactaagaaaaatgactttcggacatttaagcgactgaaattgaatacaaaaaaaatacatttataacaattagttaaaacagatgtcgcattttacatgcagcgcatctaaaataggttccctggtattggataatttatatttgtatattgcacaatggctttattatgattatttttatgtagaaaataattttaattatgtattattctggctgttgtgaaaaagagtaaatattacttaatttaaagataaggatatagctatgattgatttcgcaaaattttctacagacggtgccaccaaagatgactcagtcggcatttctataaaacgtattatagaaaaagatggactgaatgcttatgcaacatttataagtgcgggaaagaaagtgggatgtcatagtcatagccaaggagatgaatggtatattatactttccggtgatggtgaaatatggacaggggatgtggtagataatgaaattattaatataaaaaaagaaaaattttcaaaaggctgtattttttgtattcatcaaaatacagcacatcaactggcatctcataacgatgttgaactgatatttttatgcccgaaatctcatttgtctcatgatagagtgggttttgaggatatctgtaaataactattcattaaagtgaatggacttcggttccctgaaaaaattttcagggacatagttagctatattatgctcataacagtaatcaacgaggctctttctgcaatttgtttcggttttttggtacacgttctggatgtggtttgaaactgttctatgagacacaaacagtctttccgctatgtctttagtcgaataaccttgcattatgtaaaatataatttcccattcccttttactgaatatttctgatggaggggtgaaaattaaggatgtttggatatttattttttttagcttttcaagtgttatagtgtctaccggtcttccatggaaaatagtccccctgcattcacctgattcgtctattaatgggaatttgtcaaaataccatggttgcagataatcgagacctttgaaagggtgaatttcgatagacgtaactctgtctaataatgattctacttttctatcatgtttttgaaattcatcttgaaaatctgatgttgttgaaggaagttcaccatcgtaatatcctcctacgtcgtatcctttgggcagtgaaagtaattcattgtatttattattagcatatataaattttgagttgttatctttagcaccccatggctcattactaatttcccaaaaatttattagggcgctaataattttttctgttgaacagatcatatatttttactcctgactttcttgaatgtttttttagttagttctctattttgggacactataatttttatattattttttcaagaatatatattttttcgatgaaatccaac

SEQ ID NO: 16845 - DNA, 69065 bp, Xenorhabdus bovienii
tatgattaagtgtcctctgtgtggtcagtcagcgcatactcgtagcagcttcgagcactcaagccagacaaaggagcgttataaccaatgtcagaacatcaactgtggagcaacgttcgtcagtcatgaaacgtttgtgcgttttattgctaagccaggtgacgtcgagaatgtcacgccacatccaagggcgaaaacgaagagacaacctcgtcagaaagctgctgcgccatgtcagaaagctgacgtacaataaataatgaaaaaggacattgttccagtttttgccaccgtaatggtggcttttttatggataatggactgtgttttgttctcgaatagagaaccttaaacggcattgaggccagagaacggcgagtgaaatgacaatcctcatgtaacgcctgcttgtcagagaagcaggcgtcaaagtctatgacagggttatttttgggactctgcctgtaagatcctttgcatctcatccttgatgtgtagtttttcttttttcaggcgcacaactttatcgctatagccggttccatttgggccttcaagatgtgatatctcgtggttaagtcggttatgtttttcaaacagggattggaaacggggattagattctttcagactggacactaaatcacgatattctggaaacataggacctcctagacgaaatttactaccgctcaatatgagtgtagcagcccattgtaagatcagatttgagagatatcacataaaaaagatcgggtaacaactttatatctttttgattattaataataatttataatatatctaaatgaataaacctctcatttaaataatagtggtaaaaatcagtcccttgccaaaaaagcataacttattcctatcgttgtacatgttatgattcaattccgttgttaaatatatcaagaggtgataaatgaaaaagtatctacttcctttagccgctatgatggtttcggtttctacttttgctcaggctgataagaaacttgaagatgtcgctccttatcctaaagcttcagagggaatggtacgcaatgtcattgaccttgcaccagaagaggatgaaggcgattacatggttgaactgatgattggcaaggatataaaagtagactgtaatcatcactggtttggtgggcaacttgaaacaaaaaccttggaggggtggggatacgattattatgtattgaataatgtcaccggcccagcgtcaacccacatgggttgttcaggacaaaaagaaaccgtgagctttgttcaagtgcagttaggcaaagatgcgcttatacgctataacagcaaattacctatcgtggtatatacgccaaaatcaatgacagtcaaatatcgtatttggcaggcattggatgatgtcgataatgcagtaatcaaataaattattgattaggtaacttaactaccacctactgaagtaggtgggttagcgcacttcggtgccgacgactgaaagtcgtcgaaccacgcacctcgtaaacgcgcataggtcaaagaattaaagtcaaagtcaccgtctaaagaccgtggttttaaacctttcatatggaaaaatcaacaacctgagttttatgaatatttaactcaggttgttatgtttattatattatcgtcataaagttttcggttaatttatctttaacggataatggttattttctaacattaattttcatcaagttgacaataaaaccgttccaaataagataattcttaaattatcatctgtgatattcgtcagtcctttattttctgcctgcggttccttgcatatatttaaaaatactaactaaactttgtttggattcttttgcattcatgcaaatatcattgaggaatcgtagaatgttcaaaaaattatcggcagagtttttgggtactttttggttggtgtttggcggatgtggcagtgctgttttagcggctgcattcccacagttggggattggttttgtgggggtatctctggcttttggtttaacggtcgtgacgatggcctatgccgtagggcatatttcaggagggcactttaatccggctgtcacattggggttatttgttgggggacgtattgcagcaaaagaagttattccttatatcattgctcaagtgattgggggaattgctgctgcagccgtactttatcttattgccagcggtaaaagtggttttgatgcaacggcaagtggtttcgcatccaatggttatggtgaacattctcccggcggtttttcattacaggctgccattatcattgagttggtattaaccgcatttttcctgattgtgatcctcggtacaaccgataaaaatgcatcagtagggtttgcgccactggccattggtttggcattaacacttatccatttaatcagtatccctgtgacaaatacgtcggttaacccggcaagaagtacggcagttgctgtttttcaaggcacatgggcgttggatcaactttggctgttctggctgatcccattaattggtggtgctatcggtggcttgatataccgtacgttattacagaaagattgatatcttgtcattttgaacagccatgcgattgcgtggctttttttatcatatttatggtaaatttttctacggttgacgcttttttaaaaggaaaaatgatggagcaaaatataacgtgggaacaaggtgaatactgggtcaccacggataaaacgaaacctcttcggtgggtgggctttatgaaaaattcggttttgagcctgtcagggtgcaggattttgtttggacgttagagaaaacgaaagcgtctgagtaaatgaaacggcaataatggtgatgccggcactggcaacccaaccagtgccaatcattatgacctccggtttaataaatttgatcatgtcatgtagtgtatcgccggcttcaacgtgtccaccttgactgttaatgaagatttttatcggatccgtattgacttcttgcagaatcaaaagttgagatatcacttttcagccagttgctgattgatttcttcagtgataataatggaacgtgatttaaggggtttattctttagagtggggattattgcgttattttcttctgttaattcaggatattcgctatgcatcatttctattctcatgtaataaacaatattaatggtataaataatatagctcttaaaaacgtttttatgttgaaaaaatgtatttaaagagtattagatttaatttatgtcataaaatcaaaaaaattgaattaatttattaaattttttagttattttagatgtttgtgatgttatatatttatcggcagaattcttatgaagatataacacgtgtaataaaataagatatatgcaatatatattgttatttgtgtaatatacgtgatgttgttgtgggttttatgttaaatatttgatgatatatattgtggtgaattgaatatgtgattttattatctgttttatcaatgagttatcaagaactcatcaagactggcttcttatgccagatgaatgacttgaaaaagtaataggctattaaagatgtaaagtcaaggctctcaatatgttcagcttaatttatatattaggttggttataccttataattttttgatatttccttcttttctattgtgggatttttattgaattatatattaagagtataacagtggacatttgatttatggagtctttacaatctgcaaataggcattgttggtagtgaagtgggtgtaataaattaggaaaaaaatatggaacatcttgacgtagaaaaggtgtcgagcaaaattttacatgaattgttgcaatatagacgccgtttctcagaatctgaacatacgattgaatatgaagaacagaaagtctctgaagttcagctaccacgcattcgtgcgtttgttgaacagggcaaagctgttgaatgtattcttcctgcgtttccgacaaaatcgccaaacccccgcaaagtactgggtacgatgcctgatatggcagaaaaattatcactgatttttctgaattctctgtgtcagcgcattcaactttattatccaccaggtgcaaatattgttatttgttctgatgggcatgtattcagtgatcttatccatgtcgacgatgaaaccattacccattatcaattggaaattgaaaagttgctgcatgaactgggtgcaaccaatctttcagtttttaatctcggcaatgttgaatcactaacccaatataccagcaattatgatcaactgcgtgaattgctggtgaatggctatgcttcttcggtagaagaaattaaggccacgcttaaagagagtgaagaagggcttcagctctatcgggcgatcactcgttttctctatgaagatagtctgttgccgggatatgacggctcgaaaacagccttgcagaaagatgcgcgtcagcgagcggctggcgttatccagcgtagttgggcgtggggaaatctgctggctgaacagtttccactggctattcgcctttctatccatccgcagcccgttgacagtattaaaatcggtattcatatgatgcctacccgggatgattggcttactccgtggcatggtgtcgcagccaatattaacggtcaatttgtgctgatgaaaagtgatgaagtgaaaaagatgcaggggaaattggtcgagatccgtggtgtccccagccattacatgattgaagccgtatctcagcaaaatcagcaggcagcaccattggctgtcgcttcgcaggaacagtaataagattgtctgaaaggcattcgccgttataccgatttttgagagagggcattatgaatatagatgaactggattgtcgtattgaaccgaacatgccttttgggcttctgattacgcccaatacctctgagcaggacatcactgcgctgtctgttgataccctgcgcgagctggcacgtacccacaagctggttgtattacgtggcttttcttctggttttacggatccggaaaagttgacggaatacactagccgttggggagaaataatgatgtggccgtttggcgccatattggatgtcatggagcgccctgatccttcagaccatgttttggacagcacccatgtgccattacattgggatggcatgtataagccgacaattccggagtttcagatatttcactgcgtctctgcacctgaggcaagtcaaggagggcggaccacgtttgttgatactgagcaattgattgttgatgccagtgatgatgagcgtcatgagtggaaaaacaccatgataacttaccgtacaagcagagtgacgcattatggtggagaggtggtttcaccgctgatttgtcttcatccagatggtaaaaaatgggtgatgcgttacaacgaacccatgacaggaaaagacgataaatatgctgaccatcatttgttgacgatccatgggttgtcaattgaacagcaaaaagaatttgaaagaaatctgcatggcagattgtatgacccgcgttatttctatgctcatcaatggcagtccggtgatttagtcattagtgataattttactttgctgcatggtagggaagcgtttattactcattctccccgacatctccagcgggtacatgttcatggaacaccagtttgtgagaatctcagtttccggactatttccaattcagattctggtgtagctgaagttgagttgaaggaggtttgattaatggctcgtattgttttggctgcgattgcaactccaggtcatgtttttcccatttgttccattgccaagcatttgatagggcaggggcacgaagcgacaatattcactggctctatttttcggcagcaggcggaagcgttaggagcaagtttcgtcgcctttgatcagcaggtcgatgttgattaccgtaatctggaagagaaatttcctgagagagggcagcatcctcccggaaatcatcagatgacacatgcccttaagcaattttttgctggccctatacccgtgctgtatcgtcagttggaacagttagttgaaggtgctgatttgctgattgtggacaatacgttctatgcggtactgccactgttacagaaacctgcccatgatcgtattcctgttattgcgattggggtgacaccgttgtcatggtcgactcgggataccatcttctggggaccgcgtattcctcctgaattgttgcctgctgatttgatgcgtgagcaattggtggatgaggaaacgggtcagttgattggacaggtacgggatgcattcaacacagcactgttggaagtggcatctcctcctctgacacaagatcacaatgatgtcgttctgagtcgagccgaccgtttcctgcaattggcaaccaaatcgtttgaatttcctcgtgatgatttaccggaaacggtggattttatcggtgcgctgggtgtcgaagtgcaggatgataaaacccagttggagtggtcagatgaaaacctgccgcttgtcttagtcacacagggaacgctggcgaatgttgatctcagccaattgctgttacctaccttgcgtgcattggcgacgctgccagtgcgtgtgctggcaattacggcgggaaggccagtcgaaacgttgggtgaagagatccctgacaatgccagagtggtggaataccttaactttgaacactggcttcctcgttcagcaattttcattaccaatggtgggtatggttctcttaatgcggccattcgtcacggtgtgccgctggtggttgctggtacgggagatggtaagttggaggctgtcgcccgtgttatctggtcacgatgcggtattagtctgaatacggatacaccgagtgaaaaacagttatatcaagcggtgactcggatactttcttctcctgaatggcattatcagtcacagagaatcaaggcagattatgatgctcataatgccttggaatcgatcactcgtcatgttaatgagttgattgctgaatcagcttgagtcattaatcgaagaaaaagtatatataccgaatggatttcgagttgcagcgcgacggaatcctcggaagcatagctaactatgtgaccggggtgagtgagcgtagccaacaaagcggcaacttgaaagacggaggctatttaaaccgtcacgaacatctccatgtctaagtggggaatattcagtgacggtttattcttgatcggaagttctgattcagggtattaatgcagagagatatcaggccttttcccgtacaccttcaacggaaataaccaattcaacttcctgagattttggccctaaattagccttaatatcaaaatccttcagtttaattttaccattagcttcaaaacccgtacggtatcccccccacggatctttaccttctcccattaatttggcattcagcgtcacgggtttggtgacaccatttaatgttagatcaccgataactgtgtatttctctcccttttggctgatctcagttgaagtaaatttggcttctggatatttttccgtgtttaaaaaattaggcttgcgcaggtgtttatcgcgctcggcatggttggtgtctacgctactcgtcttaataacgacattaactttgtctgttgctgggttttgcggatcgaaagcaaaatctccgtcaaattttctgaagctaccgtaaagccagctcatacccaaatgttggatacgaaattcaataaaggcgtgttggccaatcgtatcgattttatagttagcggctattgcagagcctgtactcattaataaagcgcctgcggtcaggccaattagcatcttttttaacatagtgattctccagaggtgatttttagtcagggtttgaagccaaatattctttttaaggtactatcgcggtcaataaaatgatgcttcaatgcagcaagtgtgtgcagcagggagagcactacaacaacccaagcgagataaaggtggataatgccagcggtatctgcttgtacgccctgttctgacagcgtggcagggatatcaaaccatccaaaaacactgataggttgcccgtcagccgtagaaataagatatccgctgcctaaaatgccaaacagagccagatagagcgtgaaatgaaccagtttggaactgattcgcgtcaaatgactgtaactggtcagaggttttggtggcggagaaataaaccgccagataatacgaataaccatgacaaaaaaaattaaactcccaatacttttatggagttctggtgcctgatgataccaagtatcgtaatagcttaatgtcaccatccataatccaagtgcaaacataccgtaaacagcgagtgcaactaaccagtggattaaaacagaaacatgaccaaagcgcgtggaagtattttttaaaagcataccgtttccttattcttgatcactgaaaactctctgtgaatataaatgagaaagtttaggtatcatagtagattaaaatgctatttgatttttacaaattttcgacaaataatttgtttaagaatgtcagattttatcaataatagaatcatattatgatcttgatgatgaaataaaaagcatttaattcatttgttgattgtgatttaatgttaggtgattaatatccataataattatgtgtaaaattaaaggtgatattatttaattgtattttttatattcatttttgtttttaacatattaattaaatgaataatgatcaaggtgtaaattgaaatttattcatttatccataaagtgacagttattttttattatagatcataatcaataataggaataacttattactaaatagattttgcgtgtgaatattatcaccttattaaatgattttttaaaaaaacagatgggtgattattatttaaattaagaaaaataaaaagcgtttccctgtatgccattgtttactcttagggcaagagattgtaatgtttttgcgtagtcacactctttgatcactatagcgggaaatacgatgtacacattgtggatagccaataaaaattattcttcttggtcactgcgtccgtggattttgctgaaggcgctggagatcacatttaacgagcagctcagttattttgaagatgataaaagtagttatgaaaaattcaaaacattctcacccactgggcttgttccttgtctggtagagggtgaaattaccgtttgggattcattggctattgttgaataccttgcagaaaaccacactcaggtttggccacaagatcgcatcgccaaagcgtgggcaagaagtgcttcggcagaaatgcattctggttttgccacattgcgccaaacttgcgcgatgaattgttcaaaacagtttgaatttagggaaatttcccttgaattacagtgtgatattgaccgccttgatgctctttggtcagacgggttaacgaaatttggcggcgaatggctggctggaaatacattcactgcggttgatgcgtttttcgctccagtggctttccgtgctcagacctatgggctgaaattttctgctattagtcaggcatgggttgatcgtatgcttaagcatccggcaatggtggaatgggctgaggcggcagcaaaagagcctgaaatagagcattaatgaatagatagatattatttgactcaataatatgcagggtacgttgtgtgccctgattaaaatcacctatttttggttgaatataatttattgagtgattattttaattttattaaccacctaatatggacaaaaaaaagctccgtattgatacggagcggaaatgggtaaaagtagctgggaaaatgtagtaggtagtacaggtgcatagtaatcctacgcaattaaacgcggattaaacaaaagagatgtagtgcagaggaagttcagtatgaggtttgttgaggggcaataacaaattatttccgcttgagagaatacctggtatggcccattaacaatgaatttttatcaaacaagtcataccaaatatcagtttttgtcattgagtcataccctatatttttttattggctgtgacctgatgagaaacggcatctcggatcacctccagcgaggcagggttctcaattaacgcaatgtcgttcggctcccgtccttcacaaatcgcctgcatggtgcgtcgcagcattttccctgagcgggttttgggaagctgggcaacaaaatagacccgcgccgggcgcccgacactgccgagctgtttatcgaccagctccatcagtgctttttccagcgctgcgaaagggtcagcactctggatttcccgcccttccttgagtaccgcaaaggcaacagcggcttgtccttttacttcatctttgatgccaatcacggctacttctgccacgtcttcatggctggcgatgcactcttcgatttcccgtgtgcctaagcgatgccctgagatattaatcacatcgtccgaacgccccagaataaaatagtaaccgtcgctgtcacggatgccccagtcgaacgtagaataaatctgctgggcaaaatgcttccagtaagtatttacaaaacgagtatcatcgccatagatggtctgaatacaaccgggaggcagggggcctttggctaccaacattcctttttcgttatcgccacattcctgaccagttagttcgttgatcagtttgacgttgaagccgtacattggaaaaccggggctgccaaaacgactcggccggtcatccaacccacgcgcaatcgccataatcggccagccggtttcggtctgccaataattatcaatgaccggaacgttgatggtttccgcaacccagcgggcggtatgttcatcaagcggctcacctgctaaatataatgcctcaagtgatgaaatatcgtattttgcaatacaatctgtgggatattttttcagaacacggattgcggttggcgcagaaaacattcgggtgacgcgatatttttccacgatctgccaccagatactcgcatcagggcggatcggcagcccttcatacatgatggttgccatgcctgcgataagtggagcatagacaatgtaagagtggccaaccacccagccgatatccgatgtgcaaaagaaaacgccgcctgctttgccgccaaaaatggcatccatcgaggtcgccagtgctactgcatagccaccgacatcacgctgtacgcctttgggcgtccccgttgtgcccgatgtatatagcacacaggaggtttcattggattccatccatgtgacaggaatgtctgcatcaaagtgcgtttgccgcaggctgtcgaaatcgatatcccgtccttccagccaatttattgtggccaaaccgcggttcaccatcaaaacatggcgtggtgtgtgtttcgctagctcaatagcttcgtccagcaggggtttataaggaataattttgcccccgcgtgatcccgcatctgcagagacgaccaacaccggctctgcgttatccagtcgtgtggcgagactgtgggaagcaaagcccccaaacacgaccgaatgaatcgctccgatacgggcgcaggcgagcaggacgaacagcgcttctgccaccattggcatgtaaaccaccacgcgatcgcctttttttacccccagcgagagcatcatggcagcggctcggttgacttcctgatgtaattctttataggtgaaaactttttcgctattggtttcggttgaaatggcaatcaacgccttggcatcgggttggatttccagccagcgatccagcgcgttgtagcatagattggtttgcccaccgctgaaccagcgggcaaaaggtgggttactgtgatccaatacctgtgcaaaaggatgttgccaatgtattcgccgagcctggtctgcccaaaaggcatcgggattatcaatcgaatgctgataaaaattttggaatgacataatctctcctggcgctatgcagatgagaggcggttcttgcaggcagaaccgccgatagcttcgtcgattagataacgtataaatcgagatattcgtttacgggcatgttttccaataaggtgcggtcaagggaaaccgacaggatttttcgttgctgagtttcaggaaattgccgcgctaggttggtactgaattttttcagtagcaatgggatgccgtctttgcggcggcgcgcatgtccaattgggaactcgactttcacttcgtcaagctggctgtcatcgttaaatgtgatggtcagagcgttggcaatcgaacgtttctcagggtcatggtaatcacgggtaaaatcgggatcttcgacacatcttattttttcccgcaaagcatcaatgcgtggatcggcggccacattattctcataatcggccgctgtcagacggccaaacaataatggaatggcaaccatgtattgtatgcagtgatctctgtctgccggattattcaacgggccctgtttatcaataatccggatacaggcttcgtgggtacggatagtgatttgggcaatgtcttcgacctgcttacctgccattttcaattgctggtgcagagtcatggccgcttctacggccgtttgtgagtggaattcggccgggaaagcgattttgaacagcacgttttccatcacatacgcgccataaggacgttgaaatttgaacggttgcccattgaacaggacatcataaaatccccacgtttttgccgttaatactgagggatatcccatctcgcctttttgcgccatcagcgccagtcgcacggcacgggaagtggcatcaccggcagcccaggatttgcgggaacccgtgttaggggtatggcgataggttctcagggattgcccgtctacccaagcgagcgaaacggcactcagtatttcttcacgcgctaaacctaacatctgggcaacaaccgctgtcgaagcgactttaaccaacaccacatgatccagaccgactttattgaacgcattttccaatgccagacagccttgaatttcatgcgctttgatcatgccggtcagcacatctttaatggtcaggggctgttttccattagcgaccgccgttcgggacagccagtctgcgatggcaagaatgcccccaaggttgtccgatggatgcccccattctgccgccagccaagtatcgttgaaatccagccaacggatcagggtgccaatattaaaggcggcctgaacaggatcgagttggaactgagttcccggtacacgcgcaccgttcggaaccacggtacccggtacaaccggccccaataattttttgcaggcgggatattccagtgcttccagcccacagcccagggtatccagaaaacagtaatgggctgtttcgtaggcaactggggatgttatggtgtagtccatgacataatccacaatatccacaatcacttgatcgtaatcagggcggttgttgacaacagaggtagacataatcaatccttcttaaaaatcgaataaaacatgaatacaaaaaacaccgcataaaaccgtgctacttgcgttggtcaatcggtgtaaacggcaggttctcagggccggtatagttggctgaagggcgaataattttgttatcaatgcgttgttcaataatgtgagccgcccagccagcagtacgggcaatcacaaacaggggggtaaacatggcggtaggaacccccatcatgtgataagataccgccgagaaccaatcaaggttcgggaacatttttttgttatcccgcatcacagattcaatgcgatctgcaatgtcaaacatctgagttgtgccggcttcctttgaaagatgcagggaaatctctttaatcaccttatggcgggggtcggagacggtataaaccggatgaccaaagccaataatgacttcttttctttccagccgggtaaggatatcggcttcggctttgtcgggagagtcataacgctgctggatttcgaatgaaacttcattggcaccgccatgttttgacccgcgcagggcgccaattccaccgataatagcggagtatgtatctgatcctgtgccggcaatcactcggctggtaaatgtcgaagcattgaattcatgttcggcatacaggatcagagagctatgcattgccttttcccatgaatcacgcggtttttggccatgcaagagatgcaggaaatgcccgccgatggaatcatcatcggtctcaacgtcaatcctgcgtccgttatggctgtagtgataccaataaagcaggatagagccgagggatgccagcaaacgatctgcaatatcgcgggcgccggtaaggttatgatcttctttttccggcaaggtacaaccaaagacagaaacgcccgtgcgcatcacatccatcggatgagcgaccgcaggcaaagtttccagtgctgatttgacgctgcttggcagaccacgaaaagctttcagtttggttttgtaagcggccagttctgcgcgggaagggagtttttcatggacgagcagataagcaatttcttcgaactcacaataggcggctaaatcgagaatatcatagccgcggtaatgtaaatcgctgccgttttttccaacggtacagagcgctgtattaccggcaatcatgccggacagggcaacggattttttcggtttaaatgttgcagcttcaggagatccagtcatcgtattctgtttactcatgagtatcacctctggtttttctgggaaaacagggcatccaatttctgttcaaaatcgtaataattaatgctttcataaagttcattacgggtttgcatcagatcgatcacatttttctgtgtgccgtcacggcggagtgtggtgtagacctgctctgcggctctattcatcgcccgaaatgcagaaagcgggtaaagcgcgatagcgacgtctacactacctaattcttcggtcgtaaagagaggggtggcaccaaactcggtgatattggccagtatgggaacctgcgttcttgcggcaaatacctgatacattttcagctctgttatcgcctcaggaaacagcatatctgcaccagctgcaatataagcctcggctctgtcgagagcggcttctaacccttccactgccagcgcatctgtgcgcgccataatcacaaaatgctcatcggtgcgggcatcaacggcagctttgatacgatcaaccatctcctctttggagacaatttctttatttggacgatgcccacaacgtttggcacccacctgatcttcaatatggatacccgcagcacccgccttaataatagaacgaacggtgcgggcgacattgaatgccgaagaaccaaagccgatatcggcatccaccagtagcggcaaatcgcatacatcggtaatgcggcgaatatcggtcagcacatcatccagcgttgagatgcccagatccggcagacctaacgagcctgctgaaacgccgccacccgaaagataaatggctttgtagcccgctcgttttgccagcaaggcatggtttgcattgatagttccgaccacctgtaacggagattcggcctctattgcccggcgaaaagccagaccagcagaagaaaatgccatatataactccattgttactaaaatgaaaccaaatagtatcgaattgttactttagcaagatttgtgccaatggttgaaaacgaggtggaaatcggagatgtgtaatagaaggtgttgatattttttgttttaaattaatggaatagcactatccgtgcttgttgcatgataactgtacatctattgggcataatgtatacttgtttcatattgaatcaataatgtttcatttttatttcaattctgaaaaatgaaacattatggtgaaattatcaaaaatcgaaaagagcaagaaaggggggaacaaatggcgtcaggacatacaggggagtgtgataacaacaaaccggttatctggacagtatcggtttcccggcttttcgatctttttcgtgatatcacgccggaatttgatcatcaggctgatatcacaccgattaatcttggttttgaacaggcggttcaacatattcgtaaacgtctggaaacggagcactgtgataccgtgatttgcgctggctcgaatggtgcctatttgaaaagtcgtttatccgtgccggtgattatcgccaaatccagtggttttgatttcatgcaggcactggcgcgcgcgaggcaaatcagcgcccggattggcgtcatcacttatcagaatactctgccagcattggaagaatttcagcagcgtttcaacttgcggattgaacagcgcagctatgtgacggaagaagatgccaggacgcaggtcaatgcgctgaaagccgtaggtatcaaggtcattgtgggcgctgggctgattaccgagctggcttatgaagccgagctggtgggggtgtttctctattctgccgatacgatccggcaggcatttcatgatgcgttggaaatggccagaatgaccaaactcaatctggtgtcgagttcgccttatcctacggaggataagttacgcattcgtcatacgctcaacgatattagaggtgattccgctgcggtggagcatgtacgtaacacgattatgctgtatgcccgttcgacggccacggtgttgattcaaggggaaagtggtacgggaaaagagctggtggcgcaggccattcatcatgaatacagcctgcgttatgggcagtctgtgggtaaacatccgcgtccctttgttgcagtcaactgtggtgctattaccgagtcattactggaggcagagctgtttggctatgaagaaggcgctttcacgggctctcgtcgaggggggagagcgggtttgtttgaaatcgcgcacagaggaacgctgtttctggatgaaatcggcgaaatgccattgccactgcaaacgcggttattgagggtgctggaggaaaaatccgtcgtcagggtcgggggatatcgtccgattgccgttgatgttcggatcatttgtgctacccattgtgatttggatacatgggtgcgagaagggagttttcgggcagacctcttctaccgcttgagtgtgctgagaattaatgtgccagcattacgtgaaagagggagtgatattgggctgctggccgtggagtatctgcggcgggcatttgcggcgcttaacttgcctgtttcatcgtcaagaatacgggaactttctgcttgtcatgcagcgctgcaatcttaccattggccgggtaatgtgcgggaactgcgtaatttgatggagaggattgcactctacttaagtgcccatcccgaacagacattgacacctgctttgatcttatcgctttcacctgagcggcagattgatatcggttcggtgaagagcaacgcgaaaacttccgagattgaacctccttcttcaatggcggtttcttcctctatccatgatattgtggcgagatttgcgggtaatcgacaggcggcggcagaatatctgggaattagccgcacgacgttatggcggaggttaaagcaagagccggggaaagattaaatggaaaaaccttattggaataggctccttattgactaatattgtgataactatcaccaatatgacatttttaaaatgcaacatattcctgtggtatccaacctgcttctccggactttttgtgagccaaaaaccagccatttagcgatttctcctccacattttaaccaatttattcgctggaatgataatgagtaattatacattgaattttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtccctacgaaacgtaaccagacgcacatagcaccattcactcattaacctacagaccatctgtggataatttggatcgcgtttctgcgtcgggctcacactgcacaatccccacgaaataaacgtaaacatgacgtaaaacgcactacaccgcacccgcctgcacgttttggatcaaaaaattatttcagttttaaaatccgacaaagggaaccgccagagcgcgccagcacaggcggcgtgagagaaaccgcaaattgaaaagtgtgaaaatattttcaggaaatttcagtttttggttcaaaagaggatcgcggggaaaattacaatgatatgataataaaaggaaaattctattttacgtgagaagtaagatcacgaagaaaggccgcattccatcatggaaatcagatagaaagcggctttgcagaataagcagaactgaaattattttctcttcttacatcaaggcaaaggagaaaattaaagtgcgcttaattcactaatcagtgtgggattacgttcaagcattttaagcagcttaagtgatgagccagaaggaatacggcgatgttgctcccagctttgaattagggaagcagaaacgccaacagcttcggcaaactcactttgctttaacccgaaggtttcgcgtaggttttttacatcaggcagacgatggcgatgaatattttcagcaggaacggaaagctctcctttttcaatcgctaccatctgattcatgctttcaaccagatcatcaaaaagttttttgtccatagtttctccgctgtatgaacattgccgcgtatctacgcggcgttgattattgcaatttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtactgatagctttaagtacttctttattcttttggggctaaatcatcttttttattcttagggtaaatcaaaagaagatagaaccttccagttttcgtgatggtgtagtagatgattcttactccgccactttttcccattccttctcgctgctagcgaatctttttacatcctccagtagcgctaatggtactaccttgttcatgattctttagtaagtgctcctgtagtcgtctgaattcatcatcagttaacaaatctgcccgatctctactaaacacgggggtttcgataaaaagtaggtattccataaaacacatccttgcccgtctatggaaaatattatattcgtactatgtacgattgtaaaagtaaaatcgtacatagtacgaaattttcatgtgtatggaaaaatgtagttgaccttccgaaagcaattcattatcatttcctaaatgaggcctagaaaccttaagtaagcggtcagaaccaaccccgttagtgttggattttttatgcctattttttaatggtagctttaaggctgccatctctccgaatcaatgtcgggagggcggcgaatacaacacccgaaaggggaataagtccgcagctcttactgctgtttctagcctcccgacaccacttaattgtggattttcctagaaagaaaagtaaggagtcagaaatggctaatctatcagtaaccccattcatgttcgaaaatcagcaagtacgtacattgactaaaaatggtaacccttggtttgttgctcaagatgtatgtgatgccttgaaaatcaaaaatagccgggatgccatcgcaaagcttgatgatgaaaagggtgtcgctttaaccgacacccttggtggggaacaaaaaataaacattatcaacgaatcaggaatgtactttctgacaatccgttgtcgtgatgctgtgaagataggaactctttcccaccgtttccgtaagtgggttactagtgtagttctacctacaatagaaagactggtaactatataagcaaaaagaatgttgcctttttggatcagttcatcatttgtccatgttgtgaacggcctgccagtattgtggggattaaatattaccatagagaaaaatcagagattgttgccttatgcaataattctcagtgcccaagcctgccatttaaagtagatctttcattcagtcactatttgcaagttaaggatgaaagcaggaatgtgagagatgtaaggcgattaataaatgggatgatttccactcagaagctaaaactggtgaatgccttaacatctaggtagtgtccattcgtgcccataaaaataaaatgggtgggctggcggaatttgatctagtttgttaactatataataaataacatatttatgttttggttgttggtcttttactactaaacctactaccaaaaacatttacgattgctttttaaccgaggaggctcttaggtatatgtttttatttttataaataacatttatacgtgtcccgttgtcccactgtcccttatgtatttatataatataaatatattatatttattatatagttatacttattttaaaattatgtactcagtaaaaactagggacaagggtgggacagcacctaatatatgcgtcccgaccttcgataaagccttcctcggaaatgcgcaacgtcttttgccagcggcaaacagccgtggagctgccgacagatttgtctgtagagctaagtgtggatctccacttaggccaaagcagtaattcctacttagggcagggagtgaaaaattcctataagtacgtttcttttctgcctggctactccatccattatggatttttcgtctagcttaatatcttggcttacgtgtctagtagtttgatgtggtttaggcttagttaatatttttctgtagttttgtgtagtgttatgtgaaaaattttgaatggaggcggctcgctttattactagcccatagttcattgaaccgttcggcagctcatagatgatccaatttttgaatcattagcataatcatgctgttatccgtagcgcaaatctacactacgggcattaggaaagggttttgattctacctaataggtatcatcaaattaaatcaaaggactaaggccggattccgccttatatatcacctcctcggattattccatcctagttttttaagttctgctttcaagaagtcataaacagcgacaacatccctttcatttgcatgtcgatcgcaaaaaattgaatatgcttctaatggagaaaaacgctttttgtagaaaaagtattttgccagagggtgcttcttttctgcgtagataggtttgtcggggcaattatattgcttatccatccaagatataaattggtctactgtcaggtcatagacttttttgtcaatttctagccaatagtggaagtcttcaccttttcgatcgcccccaagaacaattttaatatcgacatctgggaaaaattgctgtgcagccatgccgaagaataccgaagcaccttggcaagagtttatggggaagctataaaagaaagggatgtgcatactcttggccacatttccccttatccaccagcgatgatattatgtacttgttaactagtacatttgaggcggataaaaaaccatgtacagagacatgcaaaaaatactatcgcattggggcgggtgggtagtgcaaggccgagttaacattggctggaagtcggtatccgccgggtttgaaaacgcggtgacttataccagcaataacaagctgtcgtgcagtgacgatgacgggatggtcattgatggctgtgttgccaagctacgtaacgtcggtatgtctcaggaatgtgactttattgaagaccattacgttaaaggcatatccaaacgtgcaattggtcgcagttccaagctcagtgagagcgaggtcagaaagcgaatgctggtggccgaaagttttattcttgggtgcctggaggttctaaataagaattcataatgatgatacacccatttttaccctcccaggtttttgctgttgtaatgaagtgatttccatgaaggcttttacatgttcaagtaactgccccataaattggcagcaatggttttgtgtcacggtttcatgcagggattgccacaggcgttcaattttattcaaccaaggggaatagaccggtaaaaacaagagattaaatttaggattttttgccagccccgcgatgactttctgacttttatgaatgccatagttatctaaaatcaaggtgatcgtctttgcattaacatattgattattaagtgtatctaacaacttaataaataaatccgagttctttcttaagcccccgacataagttatttctttcgttttcgcgttgaggcagcccgcaagatagtgtttctggttctttccgggggtcacaacacgcttttgttgtcccttgaaacaccaatctgccccgatttttgggttaaggtcaatatccacctcaccctcaggggttacgcatgaaattttggtcggctaaaattgattaaataacagtgcttccatataaccgttatcccatcccgctgattttcttcgcgcactcaaactcaatttactattgatatctcgtttaacaatattgagtgccattttacgtaattgggcaaatattcttgtggcgacccgctctctcatccgtgaatcatcttctcggaaagtgacatccagtacccagtgtaaactattttcgatagcccaatgttttcgtattgcacctaactgaaaggcgggagaatcataacaactgcttaaataataacgaaagtcagaagtcaccgtgtcagaatagtgttcttgtcgtatcgtttctgttaccaggagagcttgaatatctggccaagaccttaagtgttttgcttctgatgtcagtggcagaacccatccgcgccgtctgacggtacgtccgtggctatcatcgaattcatcatggtcaagtttaaggtaaggtttttgggttatctgttgttgttgaaaatagttaaccgcttccgaaaaggttttcccctgattgcctttaagcgacaaaatataatcggcttcactctcgcgtagttgctgagcaatcgtgcgttggcaacctatcgcatccatcgtcacgagatggcctttcaatgaaagcatcgataataatgccggaatggccttaatttcgtttgattttccgtctacggcacattgacataagctaagccctttctcaaccgtgaatgcactcaccatatgtaatgcgctttggtcaattttcttatcaaacgaatgacgtaaacttttaccatcaatcgcaatgatagcccgtttttctgaagagaggtcacgagaaacccattgataaaaatgatgttcaaagaggctcgggtttaataaactgaaacagcgccggaaagtatcatgtgacggaataccccctttgagcggaagaaatgaactcagccaatcctttttgagttgaccgtactgttcaatatcagtccaggcgttagccccagcaatggcagcgcatacagcgatcactaagatatcaataaaacggtgtttgacctttccctgacaacgtgggtctggaaaatcagaaaagacatccactaattctttcattagcgtccctctaaaaatgaaagaattatccactaaatattttcatgcgtaacccctgcatcataacccggcgttgttctaaataggtggctcggttgtatgctgcccggactgagttcttttcaccgtgagccagcacagcttctatagcatctggcataaagccctgctcattcatcgcagtactgactattgaacggataccgtgcgcggtaaggatatcctgataccccatacgctttagagcggtatttgcagtctggctattcatgcaaatgttgggggtggatctgtggggaaacacaaattctctatgcctgctgataggcttcatgatttcaagaatatctaaagccggttggcataaaggtaccgtgtgagggcgatctatcttcatggtttgtgctggcacattccagattctgttatcaaagtctatttcagaccaacgggcttttaccgcttctcctgggcgcatagcagttaatagttgccactcaataactaaacgtgtttgtcgttctattcttgcaacggagagtgcttgcattaatccggggagttcttcgggtcggatggtagggttatgttttttctttggcttagggaatgccttgcttacggtagtaaagggattggcatcaataacgcctaaattcatggcgtagtctatgatctctaccgttctttgagtcaggcgtttgatggtttccagattgccccttgcttcgataggtttgagcacttccaccagcatgggcgctttcagatttgatattggtgttgagccgagtttggggaaaatattcttttccagtgagcgccagatatctttagcataatcctcgctgacagtggttttcttcacctcaaaccagcgggtagcaatattctttaaggtgttactgttctcttcatgtattgcggctgcttgctgttttcgccaatcaacaggatcaatatctttagccagcatcgcttttgcttcgtcttttagtctgcgcgcatctgccagtccaatagaagggtactcaccaaacgcaatcatcgtgcgcttttgggtgaacggtttgtagtatctgaaataccaaagtttaatgcctgatgcttttacgaggagttctaaattgtccccgtcacgatagatcgtatctttgggcttacccgttttgctatcaagcttggctttggcattggataccgttgtaggggaaagcggcgttatctttttaggcatcgggcacctctaaccgtagtagtaagtgttctctgtggtagtagtaagagttttccgttggtagtagtagcggtttattggtgtagttgggctgttactactaactttttacctctttaaccttgtactgcgtccctcggtgtctaagcgtccccgttatattttttatatttaaatcaattatttaatggtaattttttaagttttgggacgtgtgagaaaatatgtctgggacaggggtgttctgctgtttaaattttataaatcatatagttaaccgtatcgggacggtgggacatcatctttggcgaaaaacttaagtatatatatgtgtttctcttgtgtatttacgttttggtagtaagtgttttagtagtgtagacgacttactaccaaaattatcgaattaaaacgatacttaacgaatactaacgggcaataaaaaagccctaagtcgttatgatttagggcttttattggtactttaggtgtattccgacgctatccgaatactaatttggtggagctggcgggagttgaacccgcgtccgaaattcctacatcctcggtactacatgcttagtctagtctttacattcgcttgccagctgcggacagacacgccactaacaaactagcctgattggatttaacgcttcaaccccaggcagggcatccacgcgatctcttttgggtttgacctctcttgatccccgtcctaagagcagaggctagggagagagggctctaagcaggttattaagctgctagtgcgtagttttcgtcgtttgcgactattattttgcggcttttaacgaggccaaccgcccctcggcatgcaccttgggtttcgcgaatcccgtcgaatccagaatcagccccaagtatgttaaaagcaagtatatcagaatattggatgataatgccagtgattaacgccctgaattcttcattattctttctttgtctactttccactcacgttctttgatatctgaacgtttatcatgcgcttttttacctttcgcaacgccaattttgattttgctccaagcgttcttccagtacatggaaagcgcaacgattgtataaccttcgcgattgatccgaccatatagtgaatcaagttcgcgcttgttaaggagtaatttgcgtgaccgtgtcggatcacagactatatgggaagaagcgacatttaatggtgtgattgtggcaccaaaaagataagcatcaccatctttgagcaaaacgtaactctcactgatgtttgccttgccagcgcgcagcgattttacttcccaaccttgtagcgataagccagcttcgaattcttcttcgatgaagtattcatggcgggctcgcttattcatggcaattgttgccgaaccgggtttgtgtgcttttttctttgtcataatgcgttgtattatactgtatgcgttaatgaaagaaatctcttctgagtgatatttagcaataaatgcatatttattgttccaaacgccatcaggtttttatttaaccacatttaaatgatactattcagtgctgttacgttttacaggaaatgatatgccacagattagtcgctctgcgttagtgccttacagcgtggaacaaatgtacaaattgatcaacgatgtaaagtcttatccggattttttaccgggatgtgtgggtagcagtgtaataagccgtagtaataatgagatgacggctgctgttgaggtctccaaggcagggatcagtaagacgttcgtgacgcgcaatacgttatctgataataaaagtattagtatgcagcttgttgatgggccttttcgaaagctgatgggcgggtggcattttaccccacttagcgaggatgcctgtaaagttgagctacatctcgactttgagtttaccaacaagttgattgagttggcttttggtaaggtgtttaaggaattagccggtaatatggttcaggcttttacccaacgtgcgcgtgaggtttacagtgtctgatatcaatgtcgaagtcgtttatgctctgcctgaacggcaatatctgtgtaatgtgaaagtacctcagggatcgactgtcgaacaggcgattgtcgcatctggtcttttgacattacgtagtgatatcgatttgactaagaataaaatcggcatttatagtcgcccggctaaattgaccgatacgatggtagaaggggatcgtgtagaaatttatcgtccccttcttgccgatccaaaagaaatgcgtcgtaaacgggctgaacgagctaaaaatagcactcaataacatctattccgatatctatttattcgccagatgcattactggcgaataaataaaattccgcgtcttactgatcctctggcagagctttttcattcttgatatcagtcaacacaccattattatcaaaggtgagagtcaatgtttcttgtgtggccttcttatggcctggctgctcacggaatatgtagtaccaaatttgacttccaaacggatcggtcagcattggtgttcccaaagtgtaagcgacttgttgttgagtcattcctttgtggatttttgataccgcagccggtgtcaggtaattcccttgattaatatcaggacgataaacaactcgctcaaacatggagcaacccgcagtcagcataacaagtgatacggtagcggcagtcaacaatttacagcgcatagtaattacattcctttaggagtaaggccgtcgatgataataaacattgaagagattgaaaacctctcagcgttttacctatgacttcaagtatacaaaaaagttgtattaatttatgccgctaatagctcttttgcgttggccagtgtgttttttgtgacttcattacccgccagaagccgcgccagctcttggagtcgggcttttttgtccaacaattgcatgtgggtttctgtttcttccccgtcggtttgtttgttgacataaaagtgttgatgcccacatcctgcgacttgcggtaagtgtgttacgcacataacttgggttgattctcccaattcacgcagcaggcgaccaacgatcgccgctgttgggccactgataccgacatccacttcgtcgaagattaatgcaggcgtttccatttttttggctgtgatgacctgaatagccagtgccatacgagaaagttcaccgccagaagcaacttttgccagtgattgatgaggctgtcccgggtttgttgttacgttaaactcaactttgctggcaccatcaatatttaaatgctcgggttcaaatgtgaggtcaatggtaaaacgaccatgaggcatggagagttgatgtatgctgttggtgatcagttggcttaattctacagcatattgttggcgaacctgatgcagcttttctgccacattgagcgcttgttgataatgtagtctgacgagttcactgagatgggcacaattatcttcctgctgggagagctgatgctgctcttccaaaagttgttggtgcagggcaggtagttcttctggagcaacgtgatgtttacgagccatgctgatctgttgtgaaattttctgttccaattcaaacaggcggttagggtctaattccagtagatcactgtaatgacgtaattcatcactgacttcattaatttgaatggctgcttcttctagcatgttaagcagttcgttgaatttgtgatccatgctggccagttcagtcagttcgtttcgtgcataattcagaaggctgacaatgttctgttcatcattatcatttaagatctggagaacgttctgactgacagatagaaactgcccgcaatttgccagccgcttatattcgctatcctgctcttggtactcacccacttgtggtgccagttcgtttagttctttcaagtgatattcgagtaactgctggcgagagcggcgttcaagagcctgctgttgaaatcgggcgagtgcctgacagctttgccgccattgttggtaagcctgcttcatttcatgttgcagttcaaattggccagcgtaaatgtccagtaaacgcctttggtgacgattttctaaaagtaattggtgggcatgttgcccatggatttggatcagatgtgaacctaattcacgtagctgggaaagggggacagccgtgccattgataaaaccacgggagcgcccatcagcggtaatcgtgcgccgcaacaggcactcattgtcgtcatcacgactttcatcaagctggtgggcttcaagccatttacgggcagaaggcgcatccgccagtgaaaaacgggcacagatgtcagtacgggtagcaccagcacgaaccatattggcttcgcctcgattgccaaggcataagcccagagcatcaatggcgatggatttacctgcgccggtttcccctgtgattgctgtcattcctgagcggaaatcaatttccagttcgcgaacgatagcaaaattactgatggttaactgagtcagcatcgcgctcctcctacctttcctgtatataaaaacatgtctgtactttcacacagtataaactggttctttatacagtaaagtgggaagcctacgtttttagaacatttttttcgaccaacccagcttcgtactcagtgtattgaaatagttgtaatctttcgggtgtatcaagtgcaggttatattcactgcgtttgataatgacttcttcactgtcctggatcggtaacacgatctggctatcacagcttacttcatagtcattgctgttccgggagaatttcagacgaatgctgctttcgctgctgataacaagagggcgcgctgaaagcgtgtgtggaaacatcggtaccagcacaatggcgttcaagtttggtgtcaatattggcccaccagcagacaacgagtaggctgttgagcctgtgggggtcgcaatgattaagccatctgagcgttgggaaaacgcaaaacgctcatcaatataaacttcgaagtcaatcatgtgagcgactttgcccggatgcagcacgacttcattcagcgctgtactgcgccgtgatttctgtccttttttcgtgacttgagcttccagtaggaaacgtttttcgtctcgatattctccattgagtacttcggaaagctgctgcaaggcattatcgggatctaaatccgtcagaaagcctaaattgccacggttaatgccaatcactttgatgtcatagcgtgacaatactctggcagctcccagcatgttgccatcgccgccaacaacaatcaccagatcagctattttgccgatttcggtcaatcctccagtctgaacaccttttaaactaatgtctctagcaacttgtctatccatgatgacgtagtatcctttggataccagccagtgataaagcatttcatgggtggccagcgcttcagggtgacgtggacggccgacaataccgatgcatttgaattcgttattcattgctgttgtttccttcagcatatggttttgccctcacaatatgattgttcccttgaatccctcgttttgatccccataataagcgggagtagcgcaaataatacaaaatacgcggagatattcatgagtagtaaagaccaaaaagtacctgacgagcaagtctcagaaaatacagaaaatgtatttgagcaacaaatggatgcagaaaaggcagacacgccagagactgagagcattgttgacccgcgtgttgccgagttggaagaacaactaaaacaggctcaaattggcgaacgcgatgcaatgctacgtgctcgtgctgaagtggaaaatatccgtcgtcgcacagaactggatatagaaaaagcacataaattcgcactggaacgctttgccaatgaacttctgcccgtgatcgacaatctggaacgtgcactggaagcggttgatcgttctaatgacgcgctgttgccaatgattgaaggcgttgagttaacattgaaatcattcactaatgctgtaggtaaattcggcattgaagtggtgggtgacactaatgttcctttcaatcctgaagtacatcaggcgatgactatgatggaatccgatcagcatgaacccaatcacgttatgttagtgatgcagaaaggttataccttgaatggtcgtttattgcgccctgcaatggttgctgtttctaaataaaaattacgctatcccgtgattacaatgccgccatacacagggcggcatttttgtggttattctattgtcactcaggcagtgtgggataccaatcaattggcgccaatccttgagcttccagcaggctgtttgcctgtgaaaaatgcttgcatcccagaaaaccgcgatgagctgacaaaggcgaagggtgtggtgctttcaggacatagtgctgttgggtattgatgaagtgtccttttttctgggcatgggaaccccaaagtaggaaaatgacgccgtgacgatgttcattgattgccgcaatgactttgtcagtgaaggtttcccagcctaaattcgcatgtgaatgtgcattgctacgttcaacggtcagcaccgtattgagcagcaatacgccttgctttgcccaactgaccaagcagccatgattagggcggctaaacccagcaatatccgattccagctccttatacatattgacaagagaaggtggtgcaggaataccaggctgtactgagaaggccagaccgtgggcctgatttgggccgtggtaagggtcttgccccaaaatcacgacttttacatcggacagttcggtatagcggaatgcattgaaaacatcctgctgtggcggataaatcgtctttccggccttacgttcattggcaacataggtcaatgtgtcaacgaaatagggctgtgtcttttcatggccaatgacttcgtgccatgtgagagatgcgggcatcgcgaatccctttctatatgattgtcagataggcttaagcttaccgattcccttcgcatagggaaaccctctgatcttcatctgaagctaattgataggatgaaattctgattttataaattatttttaaaatttataaaaataattttgtgtttttctctcataaaaaatcatttactgatattcctttcattatatatgggtattaattttgttaaataaaaattaaatttgttattaatgtgttgcagatctctgccgatagagagtttaggtttgttaattatgcctaacctgaataatctgtaggagatttttatgactttatcaataaatagcagttttttcagtgaattagggatttattcattacagggaagtccactgcagcttcaatcgagtcctccggtcaaatcaccatctgacaaggctgatgtgactcactccacaacacaacccacaacagttccgctttcagaaaatacccagcaaaataataatctttaccaatcattggttcgcgatcggcatctaagtgccatggcattacctgaattacatgccaatgatattgcaggaaaacattctaaacgcatcgattatgatctgtcactggtcacccgtgatgtttaccgtatgaatagcatgggaattggtgattatgtgcgtcttacgaaagatgaaatatcaaaagcgggcattgatcctgctatcttggaggatagttcaacaggatttcaggcaggcgtttatcgaaataagggcttatatatcgtgtcatttactggctcgaacgaaatacaggatttcatggcaagtattcgtcaagggcttggatttaaagaagagcaatatggtcaggctgtaaagttggcacaggcagcgttaaaaggatttggtgaaaatgtcattttcacgggtcattcaatggggggaggattggcatctgtggcggcgctgacaacaggaaaacccgcagttatttttaatgctgccggagtgtcagattcgacattgaaaagtatgggattatcaccgaaagcaagtcgtgaagtggcagaaaatgggttaatccggaattatattgttgaacatgactggcttgataacctgcaaaaaaccttgccaattccccagcccatgggaaataaaattctgcttgaatatgagtacgaaccggaagggatattggattccatttttgcctatcggtatgcttttcactcattcaaggcgcattttatggaagccgtgcaggaattgctgaccgtccataaaccttggttgaataaagcaggtgaaatgatagctgctactgaggacagtatgcaaaacaaggctattcctatgcaaaaacaggctttgaatacatgggggatgaatatggatgaggccaaaatcagcgaacagttaagggaagagcgtcatcaattggtttcacaacagcttgagaagcattattcagtataatattcgtacaaatggaatgacgagtaaggctgaatccattgtttctgtttgtcagagatgataaagcgggctgtttgcccgcttttgccagtgagattaatcgttggttggttctgacgtttctggtttggagtcaccggaaggagtgcggcgttttccaatatttttactatcgcgatgacgaactttcactcgtgttttcttcgcttcttcttctacctttttcttctctttacgtttctccagcactttcttagaaggcttatagctctttttctcactgggtgctttagtttgtggacgcagttcatcaacaacccgtactttcaatggttcgttgagataacgggtgactttgccaagcagtggatgatcgtgagattcaaccagtgcaatggcggttcccttacggcctgcacgggcagtacgaccaatccggtgcagataaacatcggcagtacgtggtaaatcaaagttaaagacgtggctgatattttcaatatctaacccgcgggacgcaacatcagttgcaaccataacgttgactctgccatcattcagtcgcttgacggcatctgtacgtttggtctgcaccatttcaccttcaagaaaacaggcctgaatgcctgccttatgtagataatcgacaatttcacgcacgcgctcgcgtttgcgcacaaaaacaatcgattttgttacatcaggttgctgaagaaggtgacacagtaaggcggttttatgctccagattatcggctcgataatagaattgctgaatttttttgcgttcacgacgagaaggttctgcatcgatctcaacaggatcggttaacaggcgctctgcaaaatcacggatggtttcgccttctaacgttgcggaaaatagcaacgtttgtttgcgccagcgtgtctcaccggcaatggtctcgacatcattggcaaaccccatgtccagcatgcggtctgcttcatcaaggatcagcgtttccaccgcacggcaatcaaaattttcttctttgatgtattgcagtaggcgtcctgtagttgcgacaacaatatcctgattctcactgaacacttctgcgtgattcatgtaagcaacaccgccagtgattgtggcgacatccagattagtatgagcagcaagtgcttgtgcctgttctgcaacctgcattgccagttcgcgggtaggggtcaaaatcaagatacgtggtgggccggattttttacgtggaaaatccagtaaatgctgtagaactggtagcaggtacgcagcggttttgcctgtgccagtcggtgccgagccaagtacgtcacggccatccatggcagggggaatggcttcagcctggatcgctgtcgggcgttcgtagcctttttcgttcagtgcattaagcaggcgttcatcaagttcgaattcggaaaagtttgtcgcagtcatcatatacctctatttgggtcgccgattataaacaggttaggcgtattcttcatcctataaaaatatcctgtgggcaggtcgcttttatccgtgggctataagatttatgctatgacccattttaatttcaatagatatgattcatgggattgatacataaacccgcttttcgctgcggtggttttacatttaaacagttttttgttggacatgataaatgtgcaatgaaagttgggacggatggcgtgttattaggcgcctgggctccggtggataatcggaaaaaatgtctggatatcggttgtggcagcggtttggttgccttgatgatagcacagcgtactgatgatcattcggttattgatgccgtggagctggatactcatgctgcgagacaggcaatcgagaatgtgcaggaatccccatgggctgatcgtgttaaagtgcatcagcaggatattcatgattttactcagcaaaaccacttgcaatatgatttgatcgtgagtaatccgccctattttgaacctgccaacgcgtgtaggaatgaggcacgtagtcaggcgcgttacacgggatcattgacgcatcgtggattattggattgtgttgaacacttgattaaggccacagggctattttgtgttgtattaccctataacatcggcgagacatttgagcaaatggcggcagaacgggggtggtttactcatcatcgtgtcaatattcgtgataggcaggataagccgctgcatcgcttgttgctggcattttctcgacaagggcaggaaactcaggtgagtgaattgaccattcgtgtctcagatggcgtatattcaactgagtttcgtcagttagtaacagatttttatctttattattaataaggttactatcaatggagtaatgatgtgggttttattacgcaatgaaatgaatcgttcttttttcttgtcttaaaatcgtattccctgggaaatagagactatgatttgtactatacataaaaggtgagatacgaaataacaggtggttgtaagataaaattacgatcaaagttgaacttcacacaaaatagagactcgaagtcatgcttgttcgggaagcaaggcatcatggctggcgtaattaagtataaatgtggagttttacctcaggagagtgagcctcggatgagcgagcagttaacggatcaaatgctggtcgaacgggtacaaaagggcgaccagaaagcatttaatttgctggtgataaaatatcagcacaaagtggcgagcctgattgctcgttacgtacctcaaggtgacgttcctgatgttgctcaagaggtgtttattaagacttatcgtgcgctttattctttccggggtgatagtgctttttatacgtggttgtaccgtattgctgttaatactgcgaaaaactatttagttgctcaggggcgtcgcccaccatccaatgacttggatgccaacgacgcagaaaattatgatgcgtcaagctcattaaaagaaatttcgaaccctgagaacttaatgttgtctgaagaactaaaggaagtggttttccgtaccatcgaatcgctcccggatgatttgcgggtagcgattacgctcagggagttggacgggttaagctatgaagaaatagccgacatcatggagtgtcctgtcgggactgtccgttcacgaatcttccgggcaagggaagccattgataataaagtccaaccgctgatccaacagtagtgggacaaaacaatattgaagggtactttggcatgcaaagagagaaactttccgcattaatggatggcgaagctcttgatagtgaagtcgttcgtttgatcgctgaagacactgtgatgcagaaacagtgggaaagatatcacctcatccgtgacacattgcgtggtgaagtaggtgatgtattacatttggatatcgcgagccgagtcgcattggcgcttgaaaaagagccgattcatatcaatccagccgctattccagaatctcagccaaaacctgaaacatggcagaaaatgccgttctggaacaaaattcgcccgtgggcgagccagatgacacaagtcggcattgctgcgtgtgtatcattggcggtgattattggagtccagcaatataacagcgatggcagtgttgacgcggatacacaatctgatacgccagtcttcaatacattgcctgttatgggttccgcttcacctgtcggtttagctgcgcctgtagatgatgaagctttaggcagtgatttgaacatgcaagtgcgggaaagcaataaacgcattgatgctatgctgcaacagtatgaactttcccggcgcattcattcagaacaaaaccagaggctgccaccggctgataatactcagtctgtgggagcaaaaatacaacaggctccacagcaataatgaaacgtatctgagaagttaatgaaacatatttgttttttcatcttcttgttggcgggtagcctgttcaatcctttgaaagcctcggcgcagcaaagcggcaccgaggctttgttacaggatatgggaaatgccgtacaaactctgaattatgagcttgctttcattaatttagagcgagaacttctgatccccctgcgttaccgccatgctattatcgatggtcaacccattgctcaaatcatacagatggatggatcgcgccgcgaaattatccaacgcggtaaccaaatcagctattacgagccaggcctggattcttttagtctacgtggcaaccacattgtggattattttccaccgattatttttgcggatttctcgcgattacagaagtactatcgcttcattgatgcgggcagtacccacgttggtgatcatcctgtgtactttgttcgtatcatatcgaaagatgaaactcgttataattataacctgttgattgatgcaaaaagtcatcttcccttgctgattgatctgttggacaaggatcataatattgttattgagcaattccgtgtggtgtcatcaacagtgaatgacagtataaaaaaagatctgattgctattgtcgatttgaaattaccaccaatgctggctatttcgccgtctgaaaaagtgaaattcgattggcaggtggggaaaatgcctgaaggtttcaaagaaatttcccgtaatagactcaaactagcagaaacagaatcgttggaatccatcatgtatagtgatggactgtttcaattctctgtaaatgtggcccatgcaggtaaagaagtagtcaataaacaaccatttcgacaaggtcggcgaacggtttatactttggtcagaggtaaaaataccattgcaatcgttggcgaactgcctttcgcaaccgccaagcagattgtagcaagtgtgacgtttacgggagatcattgatggttaaagaatgggcgacggttgtccgttggcaaaaaggtcgcgcactattgcgttatggctcatcttcaggttgtggcagttgtcaggccaacgccgcctgtggctcttatttattggaaaaactggggccaaagaatattcatcagttagaactggaaatttcccaacctcttcaacctggtcaaaaagtagaagtaggtatacctgaaagtagcttactgcgttcagcaatgttagtttatttgaccccattattagggttgttcttagggggcttgctcttccaatactgggtaactgaccagttatgggtagttatgggaggcgttatcggcggggttactggtttcttctttgcccgcaagatagctaagtattgggataatcagcaagcgtaccagcccgttgtgttacaaattggtttacctcctgatacgattaaggttctacagcaggaataatctgctttaccattaacagctctcactttctggtcatactgaaaaccacaggcatgactaggttttcgcaggtttggcatgtagaatacgcctctttggccagtggccaaacctataaactgtcgctttatgtccatctgtgtgtccataggcgaatgattcagaaatattaaggcaaaaaaagtttaataatgaagcaaatacgaaatttctccattatcgcccacatcgaccacggtaaatccacactatctgaccggattattcaaatctgtggggggctgtccgatcgcgaaatggcagcacaagtactcgactcaatggatctcgagcgtgaacgcggtatcaccatcaaggcacaaagtgtcactcttgattaccagtcaattgacggacaagtctatcaactaaattttatcgacacgccaggccatgttgacttctcttacgaagtttcccgctctctggctgcctgtgaaggggctttactcgttgttgatgcggggcagggtgttgaagctcagacgctggctaactgctataccgccatcgaaatggatctgcaagttgttcctgttctgaacaaaattgacttgcccgccgctgaaccagagcgtgtagctgaggaaatcgaagacattgttggcattgatgcgacagatgccgtccgctgctctgcgaaaacaggtgtgggtgtgcaggatgtcattgaacgtctggttaaagagatcccgccaccagagggcaattccgatgcaccattgcaggccttgattattgactcatggtttgacaattaccttggtgttgtttcgcttgtccgtgttaaaaacggtacattgcgtaaaggcgataaaattaaagtgatgagcacgggacaggtatataacgctgaccgtctggggatctttacaccgaagcgtatcgaccgtgatatattgaactgtggtgaagtaggttggttggtctgtgcgatcaaagacattctgggagcgccagtcggggatactctgacaactgcgcgtcagccagcggacaaagcgctgccaggtttccaaaaggttaaaccacaggtttatgcaggtctgttccctatcagttctgaagactatgaagcctttcgcgacgctttgggtaaattgagcctaaacgatgcttcattattttacgagccagaaagttctactgcactgggctttggtttccgctgtggcttcctgggcttactgcatatggaaatcattcaggaacgtctggaacgtgaatatgatcttgatctgattactactgcaccaacagttgtttatgaagttgagacagtcagtgatgatattatttacgtggatagtccatccaaattaccgccattaaataatattaaagaactgcgtgaaccggttgcggaatgtaacatgctgttaccgcaggaatacctcggtaatgttataacgctgtgtgtggaaaagcgtggtgtacagactaatatggtttatcacggtaatcaggttgcactgacttacgaaatacccatggctgaagttgtgctggatttctttgaccgtctgaaatcgacttctcgtggttatgcgtctctggattataatttcatccgttttcaacactcagacatggtacgagtggatgttttgattaacggtgaacgtgttgatgcgttggcattgattactcatcgtgagaactcacaatatcgtggtcgtgagctggtggacaaaatgaaggagttgatcccgcgtcagcaatttgacattgcgattcaggctgccatcggtgctcacattattgcgcgtgcaactgtcaaacagttacgtaaaaacgtacttgcgaaatgttatggcggtgacgttagccgtaagaaaaaattattgcagaaacagaaagatggtaaaaaacgtatgaagcaggtaggaaacgttgaactaccgcaagaagcgtttttagcaattctgcatgttggaaaagataactaacaaggttgtaaggagtctaaatggctaacacttttgccttgatcttaacgttagcaacgttaatcaccggtattatctggtgtatagatcggtttaaattcgcccctgaacgcaggaaaaaacttgctcagattcaggaacaggcagcaggtgcggaatctcaggaagctttggctacagagattaacaaaccttcatgggttgagacatttgcatctgtctttcctgtgttagccattgttttgcttctgcgttcttttgtttatgaacctttccagatcccttcaggttcgatgatgccaacgctgctgattggggatttcatcctagttgaaaaatttgcctatggtttgaaagatccaattacacagacaactttgattaaaacaggtaagcctaagcgtggagatattgcagtttttaaatatcccgttaatccgagtctggattttgtaaagcgtgtcattggcttgcctggagataaaattgtttacgatgacataaataaagaacttcaggtttttcctggttgtggttggaatacggtgtgtaagaatttacctgttacttatcgagatatgttcccaagtgaatggactatcaaagaggatattactcctgaaggcgcacctatgagaggggtttatccaattcctatcgaagaacaactgggatcaaacagtattcgccagggggaacgggttgagcgtttaggtaatgtgtcacaccacattttgactgtccctggagcatcaaatatcccgtttttcagtcagccagggttgccacttggaacttgggttgtccctgaaggtcattatttcatgatgggcgataaccgtgacaatagttcggatagccgggtatggggatttgtgccggagaaaaatctggtagggcgagcaacagcaatctggataagttttgaaaaacaggaaggcgagtggcccactggcgtacgtctgagtcgaattgggggaattcactaatatttatatattagcgaagcattaattcatctcacagtgtagaatattctgccaaacgagatgactggctttctagaatgatggacattttaggaagccagtgcaaacgcaacagttttgtagggtctatccccacaggtctgttgcgtgtgcttttttgatgaattctgactgaattggtagcacatgaactccataataattaataggttacagcgtaagctgggatatacctttatacagcatgatttgttacttcaggcgctcactcatcgtagtgccaacagtaagcataatgagcgtctggaatttcttggcgactcaatcctgagttttgttattgccaatgcactttatcaccgttttccccgtgttgatgaaggggatatgagccgtatgcgggcaacactggtgcgaggcaatacgctggctgaactggccagagaatttgagttaggtgaatgtctgcgtttggggccaggtgagttaaaaagcggtgggcatcgccgcgaatctattttagcagatagcattgaagctttgattggggctatttttctggatagcgatattcagacaattgaaaggattatattgagttggtatgaaactcgcttgaatgaaattagcccgggcgacaagcaaaaagatcccaaaacacgtttacaggaatatctgcaagggcgtcatttgccgttgccatcatatctggttgttcaggttcgtggggaagcacacgatcaggaatttacaattcactgtcaaatcagtggatttgaacaacctgttagaggagtaggttccagccgtcgcaaggcagaacaggcggctgcggaacaagcattaaaacaactggagcttgaatgagcgaagaaaaaaactattgcggatttgtggcaatagtcgggcggcccaatgtcggtaaatcgactttattgaatcagttactgggccagaagatatccatcacttcccgtaaaccccagacgacgcggcatcgtattatgggtatccatacggaaggggtttatcaagccatttatgttgatacaccggggcttcacatagaagaaaagcgtgctattaaccgtttgatgaaccgtgcagcgagcagctcaattggtgatgtggaactggttattttcgttgtcgaaggtacacactggacagcagatgacgaaatggtcgtgaataaactgcgtaatttgcattgcccagtgatattggctattaataaagtggacaatgtcacggataaagccatccttctgccccatatcggttttctcagcaagcagatgaatttccttgatgttgtgccgattagtgcagaaaaaggcatgaacgttgatactattgccaaaattgtgcgtgctcatatcccggaagctggacaccatttcccagatgattacattactgatcgctcacagcgttttatggcatcagaaatcatccgtgaaaaactgatgcgttttctgggtgatgaactaccttattctgtgacagtggaaattgaacaattcgttaccaatgaacgcggtggttacaccattcacggtttaattctggtagagcgtgaaggccagaaaaaaatggttattggtaataaaggcagcaaaatcaagacgattggcatagaagcccgtcaggatatggaaaagctgtttgataataaagttcatttagaactgtgggtaaaagtgaaagcgggttgggctgatgatgagcgagcgctgcgcagcctcggttacatcgacgacttataaggttgatttgtggacggctggcagagagctttcgtacttcatgggcgcccttacagcgagaccagtttactactggatttctttactgaaaatgaagggcgggtacgtgttttagcgaaaggtgtacgccgtcgtcgctctcatttgaaaggttgcctgcaacctttcaccccgttgcttgttcgttggagtggacggggtgaaatcaaaacattgcgggatgctgaccctatctcattagcgcttcccttgacaggaagtgtgctatacagcggtttatacgtaaacgagctattatccagagttcttgaacaaggcgcggcatatcctgcacttttctttgattatcttcaatgtttacaagttcttgcggcaagtgaatgcacgcctgaatatgctttacgtcgttttgaactcgccttgctaaccaatatgggatatggagtagactatcttcattgtgcaggtagtggtgaacctgtgtcagatacaatgacttatcgttaccgtgaagaaaaaggctttattgccagcctggttgttgatcacttcagttttactggtaatgaactaaaagcgttggcagccggtgaatttactgattctctcaccttgaaagcagctaaacgttttactcgcattgcgctgaagccttatttgggggggaagcccttaaaaagtcgtgaattatttcgccaattcgtacctaaaaaaactgatacccctaatcagcaaaatgaaaattaaaatgtgatttttctttatgatggcaagtgtatactttcttgaatcttatgttattacaggagttaaaaatggctgaggtattattaggtattaacattgatcacattgcaacggtacgtaatgcccgcgggacacagtatcctgatccagtacaggctgcatttgttgcagagcaagcaggagctgatgggatcaccgttcacctgcgtgaagatcgccgccatattactgatagagatgttcaactattagcaaaaacgattcaaacccgtatgaaccttgaaatggcagtaaccgatgaaatgattgatattgcttgccaaatcaaacccgttttctgttgtttggttcctgaaaagcgccaagaagtgacaacggaaggtggcttggatgtattagggcaaaaagtgcatattgctgctgccgttaagcgtttatcggaagcaggtatttttgtttccctgtttatcgatgcagatcaccagcaaattgacgctgcggctgaagtgggagcgccatttattgagatccacacaggcgcgtatgcagatgcagaaaatgatacccagcaggaacaagaatttctgcgtattaaagaagctgtgacttacgccgctggtaaaggcatcaaagtaaatgcaggtcatggtttgacatatcataatgtacagcgtattgctgccttacctgagatttatgaattaaatatcggtcatgccatcattggccgtgccgtattcagtagtttgcctgctgctgtggccgatatgaaaacgttgttgcgggaagcgcgccgttaatggctattgttgggttaggcacagatatagttgaaatttctcgcgttgaggaaattgtcgagcgttctggtgaacgcttggcaaaacgtgttctaagtgacagagaatggcaacaatatcagcagcataaccaaccgattcgtttccttgcaaagcgatttgctgttaaggaagctgccgcaaaagcgctgggaacaggtattcgaaatggtctggctttcaatcagtttgaagttattaatgatcccttgggaaaacctacattaaaacttcatggtgaagcagaaactctggctgacaaactgaatgtaagatccctgcatgtcacattagcggatgaacggcgttatgcctgtgcgacggtgatattggaaagttgattttagatcttatctgcatgatgtaagagcacgaacttatcccacagttgctcttcagtttcttggtggtcagggttaagaataatagtattggtgatcgggcagacggactggcaggttggtttttcatagtgtccgacgcattcagtacagcgttctgagtcaatttcataaatttctgcgcccattgtgatggcctgattgggacattcaggttcacacatatcgcaattgatgcagcgtttggtaattaatagcgccatttcagaaaaatatctatttatatctctggttcttcagtgtcgcgcaatgtaacacaaaatcaaaaaaatccccaataattataggccttcttccaactaagttgttgtgaatgattgtgataatatctttcgattctgtgtgtctctggagtttttgtcatgaaactaagctcttttacggaaataatattaccggataattatcacactcaagattttttggcttttcatcacagagatgaaaagggtgtttctgaaatagtgcaacaaagtcgaatgaaaaagggaattatttggcacggaaatccggctttactgactgtatctattgataaacaccgggcgcagatccagcttgaggttgatggtgatgacgcacatcaatcagagaaggctttatccacactagcttcacatatgctgggattgttgcagcctgttgaagaatttgaatctatgtatcaagctgatccggttattggcgagttggttaccaggcaggcggggttacgaatttatcagtcagcaacaccttttgaagcactcagttgggcaattattggtcagcaaattagcttaaatgcggcaatttctattcgtaggcgatttattcaggctattggcgttaaacattcttcaggattgttgtgtcatccgactcatgagcaaataattcagtgttcagaacacgatctacgccagtgtggtttttctgtcagtaaagccaatgcgttgctgaatgttagccaattaattgattcggctgagttaaaattagccataacagaaggtgaaattaaacggcttacggataatctgctcgccattaagggaattggcatgtggacaatcaattacgctttgttgcgcggatttaattatttaaatggttcactacatggcgatgtggctgtaaggcgcaacctccaatatttactcaagcagggagacaaggtcaacgctgagcaaacagaagcatggctgtcagagttttctccttggaaggcacttgtggctgcacatttatggaggcagcagtccagtagtgggtattgatggggaaacatcaataccactctaatcctttgtaaggtgttttacgtaatgtattaaggcgacttgcaagggaaccaacatggatttcaagttgatgtccgtcagggtcgagaagataaatcgattctcccttaccaacggacatggggagtaaaccctaacaggtttatatagaaatcgagactgtgctcaagatttgaggttgtcagtgtcagatggttaaggtctgtcagcatggatagttgtcctttaattttcattcattgagaggttttggcgatgttatttttttcaccatttgaagatctagctcaacaacttttgcctattgcagtagaaggtgatgatggcgctcatgatattgcccatttgcatagagtatggcgaaacgcgaagagaatttgtgaggttgttgaatctggaaatttacagtgggtattggccgcagttttattacacgattgcgtcagcgttgaaaaaaatgatcccaatcgacatcttgcttctcatatggccgcagaaaaagcggcattgatactgaaaaatttagggtggggtggagaagatatcgctgctgtttgccatgccattgaagctcatagtttctcagccggtttaactcccagaacattggaagccaaaattgtacaggatgctgatcgattggattccattggaatggttggtgtagctcgttgtttttatactgccggccgtatgcgctctgcactgtatgattttcacgatcctctggcaaaacaccgtgaatataatgacactgcttacacgcttgatcatttttataccaagctattcaaaatagaatctggctttcaaacggaaacgggcaggcaaatggctcgtgagaggacagaacgcatggaacactttcttgaggcttttttgaatgaaattcaggttacataagcaaattgagatgagtgaatcaatattaatgactaatagttataattagcgagattttcataagtaagagaacctgtagtgacagagatatatagtgcagaaatatatagtgatgaatactggatgcgtcgggcaatggaactggcaatgcaggcacaatctcatggcgaaattcccgtaggggctgtactggttgccgataataaaattattgcagaaggctataatcatccgattaccgagcatgatcctactgcccacgcagaaatcattgccctgcggcgtggtggaatcgaattgcagaattaccgtctgttaaatacgaccctatacgtcactctggaaccctgtgttatgtgtgcaggcgcgatggtgcatagccggatacagcggctggtatacggtgcaagtgatatgaaaaccggtgcagccgggtcattgattgatatcctacggcatccgggcatgaatcatcagattgaaatcactggtggcgtattggcgcaagaatgtgccacgatgttgagtacgttctttaaacaacgcagagaacagcataaggcattgaaaaaattaaaaatacaacagcaggaaacgccataatcggttattgctaaggaactttttgagattacgtcggtgttttgacttccggcgttttttcattaaccacggctttatttccttctccatctgaaagaggcacgatgaccttatctattggtgtttcatgctctgctttcttgctgcgtttatttttcgctcgcaagtacccttccagactctgataataacgccgaatgttttcgacatagcgatacgcttcatagccacgggcatagccgtatgttgtgttggtatagaattttttcttgcttaacagatcaaggcgagatttgatatcccgccaacggtcagggttacctttttgttctgctgtgagttttcggacatcgagaatatgcccataacccatgttataagcggctagggcgaaccagatacgttcatcttcaggaatggttttcggcaaccgctccatcagataatgcagataagccatacccccttttacactttcctccggatcaagtcgatcactgatcttgacccattctgcggtcgggcgagtaagcatcatcataccgcgaacgcctgtgggcgaggttgcctgcgggttccaatgtgactcttgccatgcgatggctgcaactaactgccagtcaagtgagccagcgtatttctcaaaaataggctgatatatcggtaatgtactattgatagcgcgaatgaatgaaatagtatcaaaataatcgaattggtagatatgactgaaatatttttcttccagctgtggtatcacatcgttttctgacatctgattgaaaaaatcgagcatggcagagtaaaggctatagtcatcactgcgcttcaaataccaagtcagaggacgttccccatttacttcaaaagcaaaggccaaattaggatgaatacgctgttgcagggaaaaactgatcgaatcgctgatcgtatagtcaattttaccttcggacacctgctcaagtaattctcgtgtattatcgcgtgatgtatcttcccaagttaaattgggataagactcttctttatattttttcagttctctggcatgggcagatccctcagtgacaaccagtgtgccatttaaatcgccaaacgtgcgtgggcggggtgtacccttacggtaaatcaattgctgtgagactgagtagtaggcagggccagtgcgtgcctgatctagccgttcctcattatagataagaccagcagccagaaaatctgcgttatcgttgtctaagtcatcaaaaatctggttaatattagtgcgaaaatgaatgacaagttttacgcctagatattcagcaaaccgtttggctaattcatagtcgaatcccgttgcttcatttttgctgttcgcagaaatcagaggggaactgatggtactaatccgaagctctccccgtgccagaatcctgtttatctgctcctgctgtttgttgggccaactgatattgaggccaatgattgcagcagagaggagcgcgataatgacgatgacaaaataatttatcttgatattgctcaaatagttatctcttgtcagtgcggtaggttccgtatgaaatgtgaaatatagcatggttaaatttccagtaattgagcattttgcgtaacaaaactgggatgtgcaaccttattgaatcaattttgaaattctactaattgtattattcgattgaataaccgtcacgcaaacggtttcgtcaaaggaaacattcctttataatgtcggtgtttccccctgcggcatcagtcaggctttgcttctaagatgagagaacctattactatggaaattctgcgtggatcgcccgctttatcagcgtttcgtattactaagctcctttcccagtgccaagatcagcagcttcccgttacagagatttatgcagaatatgtgcattttgcagaaattcattcgcctatcacaggaaatgagcgggagaaattaaatcggttattaaaatatggcccctttttggatgaacatgaacctaaaggtcaactattgctggtgactcctcgtccgggcacgatatctccctggtcatcaaaagcgacagagattgtgcacaattgtggcctgaaacagattgcccgtttggaaaggggaattgcctattatatccagagtgatgaaatgagcgatgggcagtggcaggagctgtctgcgttactgcatgatcgaatgatggaaagtgtgttcactcaacctgaacaggctgaagctctgttttctcaccaagagcctgcaccactgaaacagatcaatatcttgcagtcagggcgtgctgcattggaatcagccaatattgaattaggattggctttggcagccgatgaaattgattatctgatgagagcctttcggacgttagggcgcaacccgaccgatgttgaactctacatgtttgcgcaggcgaactctgagcattgccgccacaaaattttcaacgcagattgggttattgatggtcaggaacaacctaattcactgttcaagatgatcaaaaacacgtttgaacagacgccggattatgttttctctgcttataaagacaatgcagccgtgatggaaggttcgccggttgggcgctttttccccaatcgtgaaagtggtgtgtatgattaccaccaagagcctgcccacatattgatgaaagttgaaactcataaccatccaaccgccatttctccttggcccggtgcggcaacgggatcaggcggggaaattcgggatgaaggtgcaacagggcgaggtgcaaaacccaaggccggattggtcggtttttcggtatctaatctgaaaattcccggatttgaacaaccgtgggaagaagatttcggtaagcctgatcggattgtcagtgcgctggatatcatgctggaaggcccgttgggaggtgctgcgtttaacaatgaatttgggcgtccagcgttgctagggtatttcagaacttatgaagaaaaggtgaattcccataatggcgcagaattgcgtggttatcacaagcccatcatgttggcgggtgggatcgggaatatccgtgaagaacatattcagaaaggcgatatttctattggcgcgaagttgatcgtactgggtggcccaagcatgaatatcggtttgggtggcggtgcggcttcctcaatgacatcaggccaatctgatgcggaactggattttgcatcagtgcagcgtgacaacgcagaaatggagcgccgttgccaggaagtgatcgatagctgttggcaattgggggataaaaatccgatcctgttcattcatgatgtgggggcgggtgggttgtcaaatgcgatgcctgagttagtcagcgatggcggccggggtggtcgctttgagttgcgtaacattctcaatgatgagctggggatgagtccattgcaggtatggtgcaatgagtctcaggaacgttatgtcatggcagtggcaccagaacaacttgcactgtttgaggacatttgtcgtcgtgaacgtgctccgtatgcagtgattggagaggcgacagaagaacgtcatttgctactgaatgacaatcatttcgataatcaacccatcgatatgccgctggatgttttactcggcaagacgccaaaaatgctgaaaaatgtggtgacactgaaagcgcagggtcataatttggaacgcagaggtattgatttagctgaagcggtaaaacgagtcctgcacttaccggcagtggcagagaaaacattcctgattacgattggcgatcgttcaatcactgggatggttgctcgtgatcaaatgattggcccgtggcaaattccagtggcggattgcgctgtcactacggctagtttggacagctattatggtgaagcgatgtcaataggtgaacgtgcgcctatcgctctgttgaattttgcagcatcggcgcgtatggcggtcggggaagcgctgaccaatatcgcctctgcttatgtacaagatctgaaacgggtgaaattatcggctaactggatgtcagcatcaggccatgccggggaagatgccggattatatgctgcggtaaaagcggtgggcgaagaactgtgtccggcgctgggattaacaattcctgtcggcaaagattccatgtcgatgaaaacttgctggaaccaaaacggtgaagagcgtgaaatgactgcaccgctttcattggttatcactgcatttgcacgggtggaggatgttcgttacaccgtgacaccagagttatctaccgatgatgacaacgcgctgctgctgattgatctggggcaagggcaaaatgcattaggagggacggcactggcgcaagtttatcgtcagcttggtgacaaaaccgcagatgttcgcagtactgagcaactcgcaggtttctttaatgcgattcagcaattagtttcagaacaaaagctgctggcctatcacgatcgctccgatggtggcttgttggtgacactggcagaaatggcttttgcgggtcattgtgggctgcgtgctgatatcagtgcattcgatgaagatattttggcagcactgtttagcgaagaattgggcgcagtgattcaaattcgtcagaccgacagagaacaggttgaaaaactgctggctgattatggcctgagcgaatgcgtacactatttggggcaggctcaggcgggagaggatttcgtgatctccagcaacgatatggacgtctatcgtcaaaatcgcagcacattgcgcttatggtgggcggaaacgacgtggcagatgcagcgcctgcgtgacaatccagagtgtgctgaccaagagcatcaggcgaaacaggatttgaacgatcccggcttgaatgtgaagttaaccttcgatccggcagaagatattgctgcctgctatatttcgaaacaagtgcgtccgagagttgcagtattgcgcgaacaaggtgtgaactcccatgtcgaaatggcggctgcattccatcgtgcgggttttgacgctgtggacgttcacatgagtgacttgctgagtgggcggattacgctggatcaattccagacattggttgcctgtggcggcttctcatacggtgatgtactgggtgcgggcgaaggttgggcaaaatctattctgtttaattcacaggtacgggatgattttgcgaactttttcgcaagaccggatactttagcccttggtgtatgtaacggctgtcagatgatctccaacttacatgaattgattccgggcactgaacattggccgcgttttgtacgtaatcgttcagaacgctatgaagcacgtttcagtttagtggaagtggcggatagcccttcactgtttttgcaaggaatggctggctcccgtttgccaattgcggttgctcatggtgaagggcaggtggaattcaggaatagccagagcttggctgaattggaaaaacaccagcaggttgcattacgttttgtcgataactatggtctggcgacagaaaactatcctgctaacccgaatggctctgtgaacggcattaccgctgttaccagccttgatggacgagtgacggcgatgatgccgcatcctgaaagggtattccgtactgtcagccattcttggcatcccaaagagtggggggaagacggcccatggatgcgtattttccgtaatgcgcgcaaacagttgggctaatttctttcgttatcattcttcctttggtattagtccctgaagatttaccagggttttaagctaagaatcacaagacctgctttacgcgggttttgtgatttagcaatgaggagtgttgcttacaaatgtttcgtaagccctcactgcaccagttctgcaaaagaatgctgcggctatggtactcactatgtgaactcacataatcatctatcgtacgtgccaatagaaactggagttgatgcaattcaattgaagtgtctccatattgcaacaatggcctcttaatctgtctcaaataagagacatttaatcatatgattttattgataaaataattttatatggttaagtgtcataaattggcgacaaaaatacataattgatatcaaaaaatattcatcacaaagccgagtgtatgaggatgttatttttattttcaataaaatcaatctattagtgtttttatttgaaagttggcatgcaatatgcataataaagggcagttgctcattcaactttttatgtaggtccacaattaggtggaaatatgccacataagcccagaatgatgccgaagtaaggtgcctaccgtccaacttaatgatactcgccttcgggccttatcaaactacgggcgacacgtggagtgaggcaccacctacatgctcatcaagcagtatgaagggtactcactggcgggatagtagataagatactatcccgccgtcattattacagataactcctgtccatcgtgttcatgtaggcatccgtttgtatatgcacccgcatagctctcaacaatccactattttcaaaaactagaaaaagtaacaatagaattcatcatctggtaggcttttttctccgcctcatgtcggttagcatcaatgtaattacaggttatgagatgatttctttgaataaatggcgtttatttccccgttcattgcgccaattggtgttaatggctttctggctggtgctattgccactcttagtactggcttatcaggcttatcaaagtcttgatcaactcagtactcaagctgccgaaattaaccgcacgactttggcagatgcccgccgtagcgaagcgatgataggcgtagcccttgaaatggaacggagctaccgccagtattgtgtattgggggatgccaggcttgaaaagctctatcaacgtcaataccgacagtacctcaacatgcttggcaatcagatgatgatgctggctaataaggaatataccgagaggtttaatcaattactgtccggtcttgccaaaatttcctgtagtaatggcatgccagaaccggcggcaaacaagcggcttgaacaattttccacagccaataatctcctggtgcaagaaacccgtaatatcatcttcattcgtggtgagcaactacaaaaagatattgcagacaaagggcagttatttggctggcagagcctaattttattcctgttgagtgcttttttgatcaccctttttacccgtatgattatcgggccggtgaaaaggatcgaaagtatgattaatcggctgggggcggggcaaacattggataatcagattgaatccttccaggggccacgggaattgcgatcactggcgcagcgtattatctggctgagtgaacgtctgtcttggcttgagtctcagcggcacgaatttttacgtcatatctcccacgaattaaaaacgcctcttgcgagtatgcgtgaaggcacagaattacttgcagatgaaatagcagggccactgacggcagatcaaaaggaagtggtgagtattctggacagcagcagtaaacatttacaacaactcattgaacagctgctcgaatataaccgcaaattggcagatagctctgtcgagcatcagattgtatctttaaaagaaattgtcgatagcgtcgtattgtcacatcagctgccagcacgtgcaaaaaatattaatactgaaattcaattggatacatctttttgttgggcagagcctaaactattgatgcgagtgattgataatctctactccaatgcagtgcactatggtgctgaatccggtaacatctggatttccagtcggcaagtaggtaaaaatattcagattgacattgctaatacggggacgcctatccctgaattagagaaaagcatgattttcgagccattttatcaaggaaagctgcaacgcaaaggcgcggtcaaaggaagtggtcttggcttgagtattgcgcaagattgtattaaacagatggggggagaactgcatctgatagaacccgaatttgctgacgtatgttttcgaattgaactgccattaaccgcagagaatgactaaataatatgtataacaggtttacttaccgttttatgacgaagacggagcagcagaatattgtgattcaaccgatgaaaaaacctgctgtcatgcagcattttcttgagcgggcttcagccctgcgtttccgtgccataatactattgtttattccctacttgctggcaggatgcgccgaaactaccggaaatgatgagttattgacaatagcccaagctattatgccagaacagcgggttacggattaccgacttaagggatgtgatggaatatgggatattgtcaaaccagcggcaatggaaaacggtctttattggttgaaggtgatggattgcacggatcgattatcctcgctggaagctcgcgatgctgccaaacgttttacgccgactgcaccgactgattgggggcacgttttcaaacagagtatcttgatgagtcgagccactcctacgctgactgaacgtcgcaaaattgtagaaaacctcaaccgatatagtccacaatctccgtccgcattgcggccactactgcaattgtggcgcgaacagcaatatttgaagattaaccttgcagaagaaaggttgaaattccagcgactgcagtttgatagtgacagtaaaattgatcgactgaaagaaatacgggcacgtttggagcatgatcttcgttcaatctcccgcaaactggaaaacttgactgatattgaacgccagctttcctcacgcaaacaagatcagagcagtgttgccacatcgggtgaaaccgagcatttaggtaacgtagaatcctctgagcaattaaagccggaagccaagccagaaatgaaccagaaaaccgaatcagaagccaatctcccagaagaaaaaggagctgaataataatgaccgtgcgcaatcccgcccgtcttcttttagttgatgatgatccaggcatactaaaactattgggaatgcgtctgaccagcgaagggtttcgtgtcacgacggcagagagtggtcatgaagcgttgcgtctattggcgaaagaaaaagcggatttagtcatcagtgacttacgcatggacgagatggatggcatggcattgtttgcggaaattcagaagcagcaccccggtatgccagtgattattctgaccgctcacggttctattcccgatgctgttgcggcgacacagcaaggtgtatttagtttcttgactaaacccgttgatcgtgacgccctttataaagccatcgatgctgcgttggaactgtcaaaaccggccatagatgggcagtggtgcgaacagattgtaacgcggagccccttaatgctgcgtttgctggaacaggcaaaaatggtcgctcaatcagatgtcagcgtcctgattaatgggcaaagcggaacgggtaaagaagtgttggctcaagctattcatcgggtaagccctagagtgaagaaaccttttattgcgatcaactgtggcgctttgcctgagcaattgctggagtctgaattattcggccatgccaaaggcgcatttactggtgcggtcagcagtcgagaagggttgtttctggcggcgcagggaggaacgttattccttgatgaaattggtgacatgccactggcactgcaagtcaaactcttgagagttttgcaggaacgcaaaattcgtccattggggagtaaccgtgatatagacattgatgtcagaattatttccgccactcactgtgacttaccaaaggcgatgcagcgcaatgagttccgcgaagatctctactatcgactgaacgtcgtcaacatgaaaattcctgcactgaatgaacgggctgaagatatccctttactggctaatcacctgttacgtgcatccgccaaacgccataaaccttttgtccgcagtttctctactaatgcgatgaaatgcctgatggcagcaagctggccgggcaatgtacgtcagttggtcaacgttatcgagcagtgtgtcgcactgacgaccgcaccggtgatcagtgatgcactggtcatgcaggcgctggaaggggaaaacacggcattgccgacatttgtggaagctcgtggccaatttgaactgcattacctgcgtaaactgctgcaaatgaccaaaggcaacgtcacccatgctgcccgtatggcaggacgtaaccggacggaattttataaattgctggctcgtcacgaattggatgccaacgattttaaggaataacttttctgccactccagaagttcttacactggatataaattatatagagatacactgtcttgataagacagagagatgaattatggcccaggagagccgcaatctatgagtcgtactcttaatatcgttcttgcccagctaaattggctggtgggagacattgaaggtaacagcaaacgtatgttgcagacagtacaggaacagcaggaaaaaggtgctgatctggttatgttttctgaattggcgctgtcaggctattttcctgaagatctactgttccgtgctgatctgcatcaacgttgccgtgaacaattggtacgtttgcaggaggcaagctctcaggtcgctattctggttggtcatccgtggcaacaggacggtaagacttacaacgcactttctctgttttggaaaggcgaagttattgctcgttatttcaaacaattactgcctaactatggcgtttttgatgaagagcgttatttcaaagcgggtgatcaaagctgtgttgtaccattcaaaggctataatcttggtttattaatctgcgaagatttgtggtttgatgcaccaattgacgcgttgaaacaagcaggagcggatatcattctttcccttaacgcttcgccttataaccgggaaaaaccgaatattcgtagcacattgattcaatcgcactgtcagcgaactcaattgccaatcatctatctcaatcaggtggggggacaagatcagctgatctttgacggttgctcgaaagtctttgatgcaaatggcaaaattacccatcggatggcggcttttgaagagcaggttgagcagtgccgtttcaatgagatgaatattgagccaatggcaaatttgatccctcaattgtcgccgcttgcacaaatctacaaggcactagtgctttctgttcgtgattatgtgcagaaaaattgttttaaaggtgcattgctgggtttatcaggcggaattgactctggcctgacactggcgattgcggtggatgccttgggtaaagatcacgtacaggctgtgatgatgccattccgctatacctccgaaatgagtattcatgatgccagagaacaagcggaattattgggtgttgaatttgatgtggtatccattgagccgatgtttgatgcgtttatgacgcaactcgaaccgatgtttgcggggacagaaaaagacacgacagaagagaatttgcaggcacgctgccgtgcagtcattctgatggcgatgtcgaacaaacgccgccgtctggtactgacgaccagtaacaagagtgaatcggcggtagggtattcgaccctgtatggcgatatggcgggtggctttaatgcattgaaagacgtccctaaaactatggtatttgcactgtcgaaataccgtaatacagtatcccctgccattcctcaacgtgtgattgatcgaccaccatccgcagaactggcacccgatcaactcgatcaggatagcttgccgccatatgacatgttggacgctattcttgaaggatatgtagaaaaagataaatccgtggctgacttagtggcagaaggttttgacgaagccattgttcgtaaggtgatccggttggttgatatcaacgagtataagcgccggcaggcacctatcggcccacgtattacagagcgtgattttggtaaagacaggcgctacccgattacttctggtttcgggcgtaaaaactggtaataacaggaaaacttcatgaaaaagattgatgcaattatcaaacctttcaagctggatgatgtgcgtgaagctctggcagaagtaggtatcactggtatgaccgtgacagaagtgaaaggatttggtcgccagaaagggcatactgaactatatcgcggtgcagaatatatggtggattttctgccaaaggtcaaaatagaaattgtggtaccggatgatattgttgatacctgcgtcgaaactatcattcagactgcgcaaacgggcaaaatcggcgatggtaaaattttcgtctttgatgttgctcgtgttgtgcgtattcgtactggtgaacaggacgaagaagcgatttaataaaaacggctgaagtgataacgggcgtatgcagtaaagatacgccctgaatggtttatcacttaatcgagtataacaccgcgttaaagtactttatgtgggccaaaacattcataatgaatatgttgtttatcaatgccgattgccaagagctgttgggcgatatattgcatgaatacgacggggccacagaaatagaattgcataccttcctcagagattgaatctttcacgacagataaatccatgagtcccatatgctggtaatctgcgccttgttgatcttcgtttcttggctcacgataccaaacttgagtatgcagattgggcatagattgagtaatcgcattaactttatctgcgaaagcatgataaccaccatgttctgcggcatggaaccaattcactgtaccgacatggtattgattatgcagatgttgcagcatactcatcatcggagtcagcccaacaccagcagaaatcagtgtaacgggtgtatctggttggacatcaaggaaaaagtcaccgcgtggtgctgccagtaatatggtatcgccttcctgcacattatcatgcatatagtttgataccttgccttgtgcttcacgtttaatagcgatttggtagctgtggctgtttggtgctgttgtcagtgaatactgacgtatttcacggttttcaaaagcgggagtgtccaggtagatgcctaaatattgtcctgctttgtaatctatgaccttacccccatcagcgggcacaaactcgaagctggtaataacgtcactctgtggttgcttcttgttgacacggaattgacgtaatccacgccagccgccttcctcagattcacctctttgataaatctcttcttctcgattgataaagacatttgccaataccccgtaagccttaccccatgcattcaggacttcatcgcctggatgaaacatctcatcaagtgttgccagcaggtgagtgccaacaatctgataatgctcaggctgaatattcaggctggtatgtttatgagcaattttttctacggcaggtaatagcgcctgtaaattatcgatattggaagcgtaagcacaaagagcattgaaaagcgcttcacgctgagctccgtttaactggttgctcatgttgaaaatatctttcaattcaggattgtgtttgaacatacgttcataaaaatgtgcggtcagttttgggccggtagaaacgatcagtgggatggtggattttacggtagcgataacttggctatccagcataggaagctcctgaatttttctcaaatagcgttgaaatttataacatgcattttaaatacaacttatggcttttggcaatgtttttaaatagagaaaaaccagtagccttgatctaagtcaatcgagaggagggtttgtattactacaaggtctgactaacgtcacaaatatgattatgggtgaactatcggctgagtatgtgtcgtggctataaacaatcgtttgcgttagggtttttatcaagactattccgcagggtgagattatgagcgtttactttttacccacctgttcgaaaccaacttccaatacctgtacggcataatctacctgcatccaggttttcttctgttttctgcgtgtactgagctgggacttttccttgcgcagtgtattgagtgctatatgtctgatataggctatgttttctgccgcattctcccggtaaatccggcaggtatcttcatttatcgtcacatcgagtacccaatgtaagctattttcgataagccaatgactacgaattgcctgtttgaattgttctttattgagcgcagccgaactgatgtagtagcgatattccagtgattctttccctgatttatccattcgatagcctaatgcgacaccgatgcgtttcaaccctttccattctggaaactgctgcgtcagctttcctgctgggagtccatgatattcacgggcttcggtacggccatgagcgtattcaaaatggacatcctcctgtttgcttttctctgccgtgctttcagacagcctttgtatgaccgcttttgccaatgtggggtgattgtctttgaccgccagtaaataatcaccgtctttctcaactctctgtcgggcaatctttgtctgacagcccattgcatcaatagaaataagacagccacggatatcaagtaaggccaacaactcaggtattgcggtgatttcgttcgattttgatgatgttctttgttgccccagtaccctcttgttttctatggcaaacacactcaccatagggatggttgaacgccgctcttcacggtgataagaggcgcgtaatgttttaccatcaattgcgattaaactgccttcagtgagttgattcaccgtctgcatccagccgataaagcatggctggaattgacgaggttcaatacaggaaatgatccgggcaatcgtgtcatgcacagggataccggttttgagcagccctttcttttgaaagcctttaaggtgaccgttgccgtagtcttcaatattctgccagccttcggctccggcgatgacgggacaaggtacaaacggttaaaaaaagaatatcaaaaagggatattggattttaaatgacggccttctgtcttctatttgaccgaaatgcagtgaaaatgcgtcgatatccatagggattctcccgaaaaggagcgtataaaatcatatctgttcttattggttaaatcgggattttgttaacaattttttcacgatcttgccctggtctattccgttagataaaaacggtttatactgtatgatattccgaccctcaggggtattttttagagatgtagctgaattaggaaaagtatgtaaataaatttaattaattatttcaaaaggaaataatatggctaattcgatatatttaacaattaatggctctaagcaaggcttaatttcggccggttgttcgacttatgactcaattggaaataaatatcaggaaggacacgaagatcaaatttttgtctattcgtttgatcatgatatatcacgagatcaaaatgttagccatttacccgttataattacaaaacctattgataagtcatctcctttgttaggtgtaactatttctgataacgaaaaaattgattgtgttttagatttctatagaactagtcaatccggtggagctgaaaaattttattccataaaattgcgaaatgcttttataaaacatatatctgttcattatcctaattcattaacacattcagatgcgcaaccttatgaaaatattactatttcatatgaaagtataacgtggcaacatcatatagccggtacttcaggatatagtatacatgaggatattgtttattgatatgaaacaataacacataatgttttgttgcaatttaatttaaatgttatgtgttaatttctcaatattgagaatactccacactaagtgtaatttttttctcgtctgggttttccgttatgtatattgttcggtaatgatcgttagaatcttgccatttttctccaaaatcatttttttcaataaaaatatagccaattgatttgacatactcttctatttttttcttgtttttagtatttatataggtaatttcattaatttgtggtgaattaccatccatagatctatacattataatgtaattatttgatattctgggtgagttttttatttcatctgtcgtgaagataagatattttatataattctcctctgtataattttcattggcagtaattagtatcaaaaatattgataatataccaactatgagtataaatagaattagaatgatggaaaatattatttttatttctttttttatgtttaatatcatatggttatgaaccaaaatttgaaatcagtgccatctccatttatgatttcaaatttatctgtagtgaaatatttcataggtgatattgctttcatgaaacctggtaattcaacataatagggtctggcattattaggtaatttatcaggatcaggaaaaatcaatgggttaaatgatctgtttttatacttgcctatttcaccataataatcccaacgtcgtaaagcatcatttttgcttactggttttattattgaaaaataattcataggcttaaccacgcgataaaaacctaataaatcagaaataaaatcttcactactaaacccactgtctgtataccaattgaaaaaccatctgctttgatatgattcaaataaatatgctgttttcatcatcatagtgagtgcaatactgtatctgtcttgtaaagataatcctttttttactctccatttagtgaactttgaagttgcaaatctaccgctaaatgctcccattgattgagtatatacaacctcataataaggatgattatctttatcaccagattccatattggcaagaattttcctaatatcatcacctctggcatgacccaaatctatccaacccaataattcggtataaactaatccacttctttttgaacctgctaatgatccatcgattatgtctttacgtttactcatttgattatcacctatttaaattgttactttattttttggataatagtgccagaagtggtttactaatcttacttttggctgtgtctaatggaattttaaagagattttagggctaaaatattgtctgtttttgacaattattcagtcaacatctcaatatcaactataagaagaaaccgtctggttagttttgcttgtaatgctgtaaacatttatcggttaggtattttctattgttaaatataaaagctttatgtttaaggagcaattggagaagaacatgaatttttctcaattaatattaatattgatatttataccactctattgacgtgaagctgacaatttatatagagattaaaagcttatcatcaaacactgctacattctgtgttgatggaaaagcgatttgtatcaccataaggtctgactaaggtcacaaatatcaataacaaattggaaatcagtaactcgtatgaccagatacccagtcctgataccttgttgccatctgcatgcaatcgtttgcgtaaaatatcctgtcaaggctatctcatttgataaaaagagtttacactgtgtgacattctggccctcaggggtatttttttagagatgtagctgagtcaggagaacctaatgttaaagcgtgaaatgaatattgcgaattacgatcccgaactgtggcaagcgatggaacaggaagttcgtcgtcaggaagaacacattgaactgattgcttctgaaaactacaccagcccaagagttatgcaggctcaaggatctcaactcaccaacaagtatgcggaaggctatccgggtaagcgttactacggtggctgcgaatatgttgatgtggttgagcagcttgcaattgaccgtgcaaaagaactgtttggtgcagattatgccaacgtccagccacactccggctctcaggcaaatgcggcagtatacatggctctgttgaaaccaggcgacaccgttttaggaatgaatctggctcatggtggtcatcttactcacggttctccagttaacttctccggtaaactctataacgtagtcccttatggtattgatgagagtggcaaaatcgattacaacgatatccgctctcaggcacacaaacatcagccaaaaatgatcatcggcggcttctctgcctactccggtgttgttgattgggcgaagatgcgtgaaattgccgatgaaatcggtgcctatctgtttgttgatatggctcacgttgctggcttgatcgcggcaggtgtttatccaaaccctgttcctcatgctcatatcgtcacaacgacaacgcataaaacactggctggcccacgtggcggcctgattttagcgaaaggcggcgatgaagaactgtacaaaaaattgaactcttctgttttcccaggtggccagggtggcccgctgatgcatgttatcgcgggcaaggcggttgcactgaaagaagcgatggaacctgaattcaaaacatatcagcagcaagtggctaaaaatgccaaagcaatggtcgatgtgtttttagagcgcggttataaagtcgtttcgggtgggactgaaaaccatttgttcctgctggatctggtggataaggatattacgggtaaagacgctgatgctgcattagggcgcgctaatatcacagttaacaaaaacagcgttcctaacgatcctcgcagtccatttgtgacttctggtatccgcattggtactcctgcaattacccgccgtggcttcaaggaagcagaaacttgcgaactggctggctggatgtgtgatgtgctggataacatcaatgatgaagcgatcattgaaaacgttaaacaaaaagttttggcaatctgcgctaaatacccggtttacgcataatttagaataaaaatatcactaatactaagcccgactcataacattagttttgagcgggtttttttacatttaaaaaatggggggtttgatggttgttccatcgacattttggctggggttaagttatttcacttactttttttcttttggcatctttttgccattttgggcggtctggttgaaaggagagggaattgagccagccatgatcggaatattgttgggagtaggcttggttgcccgtttcctcggtagtatgttcatttcacctacggttaaagatccttcaaaattaatcattgcattgcgattattgtcactattggcgctgctctttgccattggttttgcgtttggtagccattgggcatggattttctctgtcatgataggtttcaacctattcttttcgccactggttcccttatcggatgccttagcgggaacgtggcaaaaacagtttacttttgattatggcaaggtgcgggtctgggggtctattgcctttattatcagttcttcgctaacaggtatattgatgtcttccaatggcatcaacttctcaatcagcaatttagaattgagtatttcttttgacagaataaataattgggttggaagcaatctgtttggccatcaccctatcattcttgccttcttgattttcagcctttctgtcatgttactgggtatgatgttaaaaccatccattatgcctgcgggtaaaatcaaagccgtaaatactcatacggtatcgtttaaagaactgctgtctgagaagtctgtatggcagtttttattgtgtgtcaccttattacagggggcgcatgcgggttattatagcttcggttccatttattgggaaaatgcaggctattctccagcaactatcggttatctctggtcgctgggcgttgtgacagaagtcattatttttaccttcagtaagcagttgttccgtcgttggaatgcccgtaacttactgttgctctctgctatttgtgggattctccgttgggggctgatgggcacatcaactgaattgccagtgctgatcatcatccagctcctgcattgcggaactttcacggtttgccacttggcggctatgcgttttattggcgccagaaaagaaaatgaaattattcgtttgcaggcaatttactccgggttggcgatggggggaggtattgccgttatgagtgtgattgctggcttcttatatgaatatatgcaaaatggcatctattgggttatggcgttagtggcatttccggtgcttttcctgaggcctaaagcagaagcacgagtgtatccattacctaagtaaccataaaaagggcaccagatggtgccctgaaaataacattgctcacatagtcattattttaataataaaatcagcgctttaatgcttcacttaattcttcacgcatttcagacagcatgtctttaacgatacgcgggctacctgcaacgatattaccggagttgatataattgtgacccccgacaaaatcggtaacgatgcaacccgattcacgcaccagcaattcgccgcccataaaatcccaaggcttcagaccaatctcgaagaaaccatctacacgcccggcggcaacatacgccatatccagagcagcagagccagtgcgacggaagtctgcacagcgatcaaataatttgcccagtattttaatataaggggtagtgtgctgttttgccttgaatgggaaaccagtggcaaggatagtgccatccagatcacgggcattggtgccacgcagacgataaccattcaattgtgcgccttgaccacgggctgagctgaacaattcattgcgcattggatcataaactacagccacttcggtacggcctttgatgcgcacagcaatggaaacagcaaaatggggaagacgtttaataaagttggtggtgccatccagtggatcgatcacccagtggaaatcgtcttcttcacctaagtgctcaccgctttcttcagtgataatggtgtgcttaggataagacttacggataatatcgatgatcagcctttctgcttcacgatcaacattggttacaaaatcgttgctgcctttttggctagcttcgacggcatcaggtgtttcgtagcttttggcaatgtaattgccggctttacgcgcag

SEQ ID NO: 16846 - DNA, 82820 bp, Xenorhabdus bovienii
ttgatgaaattatggaagcttcagacggtatcatggttgcccgtggtgatttgggtgttgagatcccagtagaagaagttatcttcgcgcagaagatgatgatcgaaaaatgtaatgcagcacgcaaagttgtcatcactgcaacccaaatgctggattccatgatcaaaaatccacgccctacccgcgctgaagcaggagacgttgccaatgccatcttggatggcactgatgccgtgatgctttccggtgaaagtgcaaaagggaaataccctatcgaagcggtttctatcatggcaaccatctgtgaacgtacagatcgcgtcatgagcagcagaattgaaattaccaaagcccaaaaactgcgcgttactgaagcagtctgtcgtggtgcagttgaaattgcagaaaaactggaagcacccctgattgtcgttgcaacctatggtggcaaatctgcaagatctatccgtaaatatttccctaacgcgcctatcctcgctctgactaccaatgaaatcactgcccgacaattgctgttggtcaaaggtgtttccacacaaattgtcaaagagatcgcctctaccgatgacttctatcggattggtaaggaagcagcactggcaagtggtatggccaataaaggtgatgccgttgtaatgatatccggtgcgttagtaccaagtggtacaacaaatacttcttcagtccacgttctataaatttgcaccacgcccaatcatgaataagctgcccagacattgggcagtcttgttagcgatgttaataactataaataagatccaaatttggtttatatccaaatggatctttttatatttctatgccatatcattatcattatcattatcattatcattatcattatcattatcattatcattatcattatcattataaactttataacagttatacaattacagtgagaaaatttatccacaggttccagtacaaaaatacttactgtttttatctatttggatttagagcaaacattcactatatggcaataattctcattaattcattggtagcttcaatgctttctctgtggttaaaataactaaatagactatgtaccttctctatctattagtctaaaacatcaaaaatggaatgcatatcacgtaatcatagagattgttctgattaaatcgccgaataagccgctaatttattgcagttatctaaaaattattgtcttattttacgattaaagagcagtagatttttttttcagtagcaaaaatttattctctttataaaaaagtttgtgtaatacttaggtagctacttggagattaacttaatctagagggtattgtgatgaatggtactaaagttgtatttggggcagtaattctggcttccactctgttagcgggttgttcaagtcgcaactaaagttgaacaacttgccactcaggttaacactctgggttctaaagttgaccaattgagaaatgacctcagcgctgttcactctgatgttcagtcagctaaagaggaagcagctcgtgcgaataagcgccttgataaccaagtgcgttcctacaagaaataatcttgcagcagataacaaaaatggcgtaccaagtaaggtacgccatttttatattcgctgatccatttgttcatctcaaaaatcgattacaaataccccctaccccaagtcaggataatggttcagcctgataaatggggctaggctaatttaatggcggcaattcaactgggttaacaccataagtggcttcttcacgaatctcaatcggccttgaaacttcttgctcttcctgattggataaaacaatacctgtattcaccagcacaggtattcctgaacgtcgaataatctcttgatcaacaagaacagcgtctgtttcacgattattgatgaattttaccaatccctcagtgcgctgaatcggcctagtctgagggtcatcggtctgtttatctgacagtggctgatgaatttccacgtaacgcttcccagttggctccactgtatatttgattggttcattaattacctgaacacgggttcctcgtggcacgctataaaacaaatcctcaatatcatcggggcgcaagcgaatacagcccgaactgacacgcataccaataccaaaactcgcattcgtaccatgaatcaaatattctccacggccagcagccaaacgcaaggcaaaatcccccatcggattatccgccccagcaggtactactgttggcaaaataatccctcgactcgcataatctttacgaatattggtggtcggtgtccatgttggatttttaatcaactggctgacagacgttgtcatcgtcggtgtatcacgttcaagctgaccgatcccaatgggatagacgacaacataatttttccctttggggaaataatagagcctaaattccgccagattaatgataataccttgacgaggagtatcgggaagcagcatctgtgatggaataatcagcttggtgcctggtttcggcagataaggatcaacgccaggattagcctccagcatggccagcaaacctatttggtatttggcggcaatggcttccagcgaaagcccatcatcagatacaacatagatggcgttctcaccaatcaggcgactgttagttggtagcaatggatactccatcgcatgggctatattgatcgcaccacttaacgataacataccgatcaaggacataccgataaaagtcaaaaatcgcttcatatacacttcctgaaatgatgtttgaatgacaatggttaattaatagcccactttaagagactcttctatcacctttacggaaatcaaggagaaatccgaacaaaataaaaatacgcattcttccatgcacactatacgcgctaatgtcactcaatatacagtccagtaacccatcattagtgagggaagttcaaatcagcaaaataccaaacagttcctgtcaataaaatactgacaggaactgaactcaatgaacgggtgtcataagataaaatctatgacaagactgcggttgtcaggcgagatgtgcagcataactgttgccgttcattatagatgtcaatctgccagacttggtgagagcgcccaaggtgaacaggtttacaaacacctttgacaacacctttactcaccgctttgatatggttggcattgatctctactcccacaactttctgttcaccctccaaacagagataccctgcaagagaaccgagcgattcagccagcaccacagatgccccgccatgtaatagaccaaacggctgtttagtacgttgatcgacaggcattgttccttcaataaaatcgtcaccaatctgggtaatttctattcccacatgttctagcatgcacttgctattaaattgattaagcgcgttcacatctgtagtacgtttccaaatcacggtattatctccaataaggcttgtaatggatgtttaactacttgtccttctatgcgtttcacctgactacggcatgaatagcctgtgctgagacaacgttccagaacaagattgtccagcgccggagcccatgaaagtttatagataccgatcgagttatcaatattctttttttcatgaccatatgtacctgccataccacagcatcccacgctgacattgttcaattgacagccaaaatgacggaaaatatccgtccattgcttaccgctattgggtaacgctgtcacttctgtgcaatgccccagtaaataccagtcatagctggatgttgaaccgtcacgtttctcttgtgatggtgtctctggcagaatactcatgagccattcatgcaccaattggacgttaaagttaccccgtcgctcaccgaggatatctttgtattcatctcggtaacacagcaccagcgcaggatcaactcccaccataggaatattcagacgatctactcgattaagaaaattggctgtcttctcggcagtcttggcaaatttagtcaagaatcctttgacatgttgtgcttttccattaggtgaaaacggtaacagcacaggttgatatcctagtttttcggtcaatcgcacaaaatcagcgacaactttcgcatcgtggtaactcgtgaaaggatcttggacgataagcacatgctgcttacgttgagattgtgacagagtttcgagctgttccagtgtcgttcttgctgcatagtggtctgaaagctgctgttgcagtgttgggtaggaaagtagcggtaaatcaaccataccaatggtgtgctggctgattttctgtacccatggtcgtttcaaaaaaaagttaaatacctgaggcacctttgccatcaacggagtattgttttcaacattggcaacaatatgatcacgcagcggacgcagataacggctgtgataaagcgccagaaaacgcgaacgaaatgaaggtacatcaatcttaattgggcactgtgtcgaacaggctttacaggccagacagcctgacatagcctctttcacttcatgcgagaaatcatattcaccccgccacgcctgccaactatagagcgtcttgtcaatcagcccccgcaggctaggacgcgcttgatcaagcccctgctccaacaacttggggtccatcccctgctcagtcagaagccgcaaccattctctgaccagcgttgccctgcctttaggagagtgaatgcgatgttgacttaccttcattgaaggacacattgggcttttaacatcgaaattgaagcatagtccattaccattacattccatcgccccacgaaatgccgttctgacattaacagggatagtacggtcataagttccgcgcttggccgcatctaccttcatcattggggcgtcaatgtcaatcggtgagcagatttttcccggattaagacgattcagcggatcaaatgccgcttttatccgacgcaattcgtcatacaaaatttcgccaaaaaagtccggactgtattccgcccgaaaacctttgccatgctctccccatagcaagccgccatatttagctgtcagacgaacaatttcatcggaaatctgcttcatcaagatttcctgttgtggatcacacatatccagcgcaggccgaacatgtaagacgcccgcatcgacatgcccaaacataccatagttaagctgatggctatcaaggagctgacggaattcagtgatataatcggcaagatgctgaggaggtacacaggtatcttcgacaaatggaatcggtttggcggcccctttgctgttaccgagtaacccaacagactttttccgcatggcataaatacgctcaatatccactaaatgatggcaaatttgataaccaatgatgccggtctggttttcccccatcaattcatcaaggcgctggcaaagatcataaacctgctggtcaatttgctgttcatcattgccactgaattcgacgatattcagcccctgcatatctttatcagcgacatccgtaatcaattccttcactgagtgccagatgatatcttcacgcgccagattgagcactttggaatccacagtctcaaccgaaagcgctttggcttccaccatgaaaggagcattacgcagggccgaatcaaaggaatcatatttgacattcaccaaccgcctgacttttggcaatggcgtaatatccagtgttgcttccgtaataaaagccaatgttccttcagagccagtcaagattcgggtcaagtcaaatgtttgcatatcatcactgtaaacatgacgcaaatcatatccggtcagaaaacgattgagcttcgggaatttttcgacgattaacttccgtcgctcacggcaacgttcaagcaccgttttatagatccgcccaatgacggattcttcttgagcaatcgattccgcgaataacgtactcataggacgggtatcaaacatttccccacccaataaaacggcgcggacaccaagtacatgatccgacgtttttccataaaccagcgatccctgaccagaagcatcggtattaatcatgccgcctaacgtggcacggttactggttgataattcgggagagaaaaaataaccgaaaggttttagatattgattgagttgatctttgatgacaccggcttcgactttaacccacccttgttctgggttgatctcaagaatgcggttcatataacgggacatatccaccacaataccattattaagtgattgtccgttggtacccgttcctcccccgcgaggagtaaatgtcagggaataaaaacgttcttctcctgcaactctcgccagcagagcaacatcagcgctggagcgcggaaagataaccgcttgtggcaataattgataaatactgttatccgtcgccatggtcaatctgtcggcataactgctggcagtatcgcctgtaaagccaacttccttcagtgcagtcaaatattcctgtgccagttcactgacatggggggcttgtggtatacgtgggatcattggcttgtgccccttctctaattagtgtccacattgcttcatttatatactatcttggataaggtaactcagacagctttctgagtaggcaagctttcaacgatatcacaatctttatcaattttgagcaatctgtaaaataacgttatatttacttactatcgttactgccaacagtactttcaattgcaaagagaaataatttcatggaaaaatcgcaatcacgccaggatttacccaaactgctatttgtgctgttctttattctactgctcatcgcgacctgcttttgggtcttaagtccatttgtcctggggttcatttggtccggaatggtcgttattgcaacttggccattattagaaaaattacaacaacacctatggggaaaacgctggattgccgtttctattatgacattgctgctagttttattatttgttatcccgattgcattattggtcagtagcttgctggaaaacagcacgccattgattgagtgggcaaaatccccctcgacgtttcagttgcctcaattagagtggctcagccggattccagtcataggcgaagatttgtatattaaatggcaggatatgattgctgatggcagcaacattcttctcaccaaaatcccaccctatattggtaaaacagcaacatggttttttacccaagcggccaacgctggtcgtttcctgttccatctcgcaattatggtactgttcagtgttctgctttattggaaaggtgaacaggtcatgttaagtatccgtcattttgccatccggctggcagaccaacgtggtgatgcagtcgtactgctggctgcccaatctattcgtgcggttgctcttggtgtggttgtcacggcactggtacaggcaatcgccggtggaattggattagcaattgcaggcattccctatgcaatgatactgactgtattgatgtttatatgctgtgttgcccaactggggcctctattggtgctcgttccgtctatcgcgtggctttattggacaggtgaaacaacttggggaaccattctcgttatctggagcctggtcttgaccacaatggatggcgtgcttcgtcctttccttattcgacttggggcagatttgcccatggttttaatactcacaggtgtaatcggtggcatactttcattgggtttgattggactatttattggtcctgttgtattggccgtctcttatcgcttactgctagcatggatgaatgaagttcctaaacctgaaaataagacagaagacactgaaaaatacttcaaaaaagatcatatagaataattaaacagctgcgcgaaaatattattttttcgcgcaattatcatattgatgaatataaactcccagttttatcacaaatataaattcatacccaaaggttaataaaaaaaccatgtaatttgttgcaaaaaagttatatccctcgtttttcttttccaactcccatttattaagaggattcttaatgaataaactcatttattaaattagtattcttttcatcgaaacaaacgtttcctacgaattgctgctccagcctatacacgccaaaagctggagcgagtaacgtaataaatattgctgtgtgtagtctttgcctgtcagcccatgataggcttttttttttggaatttttactgttatccctcaattattcatccatgtcaaaaaagattgtgttacacaaaacaaaaaagcctgcaaatattccaacaggctttttaattcaggcctgaattattttctattaattgttttcagccaacgaaatccaggtttttaccacggtatctggattcagcgataaactgtcaatgccttctttcactaaccactcagcgaaatcctcatgatccgaaggaccttgtccacagataccgacatatttaccttgacgcttagccgcttgaattgccatggaaagtaattgttttacggcatcattgcgctcatcaaataactcagacaccacaccagaatcgcgatccagccccaacgctaactgagtcatatcatttgagccaattgaaaaaccgtcaaaatgttcaagaaactgttctgccaataatgcattcgatggaatctcacacatcatgatgactttcagcccattttcaccgcgtttcaagccctgcacagccaattccgccacgacagcttctgcttgcgttaccgtgcgtacaaacgggatcatcacctcaacattggttagccccataacattccgcacccgtttgatagcttcacactccagtgcaaaacatgcgcggaaactatcagaaacataacgacccgctccccggaaacccaacataggattttcttcatgcggttcgtaccgatccccacccactaaatttgcatattcattagatttgaaatcagacagacgaacaatcacacgcttcggccaaaatgcggctgccagtgtcgcaacgccttccgtcaagcgtccaatataaaattcaacaggattgtcataaccgaccattaacgcattaatctgttcctgcaattcgggcgtttgttgggaaaattcgagcaaagcacggggatgaacgccaatcattcggttaatgatgaattccagacgagccagacccacaccttcatttggcaagcaggcaaaatcaaatgcgcgatcaggattacccacgttcatcatgatcttaacatccagttttggcaattcatcgacttgggagctttggatgctaaagtccaatttattttggtaaacgaaaccagtatccccttcagcacaggaaatcgttacttcttgcccttctttcaggcgttcagtggcatcaccacaacctactacagcaggaatacccagttcacgggcgataatggcggcgtggcaggtacgccctccacgattggtgacaatcgcagccgcttttttcattatcggttcccaatctggatcggtcatatcagtaaccagcacatcaccagcctggatacgatccatctcactgaggttatgaataaccttaaccgtaccagcaccgatacgatgcccgatagcacggccttctaccaatacagaaccctgtgcgttgagttgatagcgttccatcacctgttgatttgagcgaacagtttcagggcgagcttgtacaatatataacttgccattattcccatccttcgcccattcaatgtccatcggacggccataatgtttttcaatcaacagtgcttgtctggccagcgcctctacttcgtcatccgccaaagagaaacgattgcgcagcacatctggcagatcttctgtacgtacctgctttccatgctctttactgtccgcataaaccatgcgtattctctttgatcccaaattacgacgcactatcgcaggacgattattttgcagcgtgggtttatggacataaaactcatcaggattcaccgccccctgcacgaccatctcaccgaggccataggcagacgtaatgaacacaacttgatcaaaaccagattcagtatcaatcgtaaacattacaccagacgatgccaaatcagagcgcaccatgcgttgcactcccgcagaaagcgcgacgccacgatggtcatacccctgatggacacgataggaaatggcccgatcgttaaaaagtgatgcaaagacatgcttgatggcgaccataacggcatcaatgccctgcacattcaaaaaagtttcctgttgtcctgcaaaagaagcatctggcatgtcttctgcggtagcggaagagcgcacagcaaaagaggcatcgggttcaccttcggacaattgtaggtaggcatcttggatatcgttttccagctgtaccgtaaatggcgtatcaatcacccaccgacgaatctgtgcgccagccttggctaattgattaacatcatcaacattggtttcatcaagcaactgataaatacgctggttgacgccgctttgttccagaaaatcattaaatgcctgtgcggtcgtagcaaaaccattggggacagacacaccaagttcagccagattggtgatcatctcgccaagagaggcgtttttaccaccaactcgattaacatcattcatgcctaattggttataccagagcacattgcatggggtgaggccattattggacattgaaactatcctttttacattcggaagtacaaatcggaaaattaaggctgttctttacagcgtaaaatagcctagcacattgttttgtcatatatggaaaggtgaatcgatcaacccagcaatattatttttttgcgggtataatcgggaatgttaaccatagttctagtttgtgataaaaacgattcagccaacaactccacaaatccgataatacaccgtcaacccaacaataaaagaaagatacaatgacagaaaaccatatctcccaaacacaggaaaatgaaactctggaacgcagtgtgttttttatttccgatggtacggcaattacagctgaagtactgggccatgccgtcttgtcccaatttccgcttacagtcacctcttatactctgccttttgtaaacagtaaaatgagagcagaagaaatcaaaactcagataaacgcgatatatctagaaacacagcttaagccactggttttttattccattatttcggatgaagtaaaaagtatcatcacaagcagtgacggtttctgtcaggatattgtccagacactggtggctccactgcaacaggaaatcgggctggaacccaagccagaattacaccgtacccacggtttatccaaaaagaatctggggcaatatgatgctcgtattgcagccattgattatgctctcgctcacgatgatggcgtttcattacgtaatcttgaacaggctcaagtgattattctgggcgtatcccgctgcggtaaaacccctaccagcctctatcttgccatgcaattcggtattcaggcagcaaattatcctttcaccgcagacgatatggacaatctacaattacctgccgccttaaagccctttcagcataagttattcggcctgaccatcagcccagaaagacttgctgctattcgagaagaacgacgtgaaaatagtcgttatgcctcattgcgacaatgccggttagaacttgctgaagttgaagcactgtttcgtaagaataaaattaactatttaaataccaccaattattctgtcgaagagatttcaaccaaaattattgacagtatgggattgaaacgccgcatgttctgatctcgaaaccccagcattttctacggtacttttttcacaatatctttgcacgatactttctcgtgcaaatgtcattattgtttgttgaatttactgggtgttgagttattgtgatttcaatcattacagacactaccttaatgtgaagtagaattcgagaaaatatatgcacaaaacagatgaattaagaacccgtcccattggtcgtttgattacacccaaagcacttgctgagcaatatcctatatcagaaaaaatcctgcaaaatgtgacattgtcacgcaagcgaattgaatccattcttacaggcaatgacccgcgtttactggtcattattggcccttgttcaatacacgatgttgatgcggctcttgattatgccgcccgcctgcaagtattgcgtgaaaaataccagcacagcctggaaatagtgatgagaacctatttcgaaaaaccccgtactgttattggctggaaagggttaatttcagatcctttgttagatggctcctgtcaggttaataaaggaatctctctcgcccgtaagctattaaatgatattaatgaactgggtatgccgacggccactgaatttctggatatggtcacagggcaatatattgccgatttaattagctggggagccatcggagctagaacgacagaaagccaaattcatcgggaaatggcatctgccctgtcatgccccgtcggatttaaaaatgggacagacggaaatacgcatatcgccatcgatgcaatacgcgcagcacgtgccaaacatatgttcttgtctcccgacaaagatgggcagatgactatttaccaaaccggcgggaatccccatgggcatatcattatgcggggtggtaaaaagcctaactacaaagcagaagatattgctgccgcctgccagaaattacatgaatatcaattaactgaacgcctgattgtggattgtagccacggtaactgtcaaaagatccatcgccgccagctagatatcgcgaaagatatcggccaacaaattcaatcgggttcaacatctattgcgggtgtcatggctgaaagtttcttggtagaaggtactcaaaaagtagtacatggagaacctttaacctacgggcagtccattactgatccctgtcttggctggcaagataccgaacaatttatcaatactctggccgaagcggtcaaaaatcgtacttgaatacttcttttatctgacccctgtttcttgcaagagttagatgaaattctaaaatatcaatataaatcaataaattaaatcataattataagcttcgaaaaaataacttgaagttagtcaaaattgaaacgataattattctcaatattagaatagttattgttcagatttgactatggaaaaattagcttactgccagtgctaccacgcaaatctcctgcaacagcagattcttcttgagctattcagtgatcccgtaaaaaacgattgtactggtgtgccgacagtcagaaattattgggataatcacgtaccataaaaattaatcggcaaaatggcttatgccattacgccagaccaaaactcgtagctttattcgaacaaataaaatcccagcaaactcgcctgatcaatatcgtggtgatgggttatttttgtgcacaaaacaccgttaaattatggagattaacctgcatgacctcaattaaattaccaaacctgaaattatcttcattaagtgtggtcattttgactgggttatcttctgctcacgcaacaacaattcctgctgaagaaaatacatcatccaaagatactttgactgtttacgcgactggcaatgaacgcgatagttttgaagcacctatgatggtaacagtcattaaaggaaactcggccaacaatagagttgcaggtaatgcccatgacttactgcgtaaccttcctggaattaacgtttctggttctgggcgcaccaatgggcaagacattagtatgcgcggttattctaaaaaaggtgttttaacacttgttgatggtattcgtcagggaaccgataccgggcatctcaatggtttatttctcgatccaagcctgattaaacaagtcgaagtcgttcgtggtccatccgccctactttatggcagcggtgcactgggaggcgttattgcctaccagacagttgatgcagccgatttattgcaagagggaaaaaatactggctttcgtgttttcagtcgtgcagcaacaggtgatcatagtctgggatttggtggtgctgcatttggtaagacagagcaacttgatgggttatttgcattcagtacccgtgatgttggcaatattcgctatggtaacggcctaaccggtcacaacgatgaaaccattggtaatatgctggcaaaagggaaatggaatatcaatgatagccaatcactcagtagcgaactccgctattaccgcaatcagtcccatgagcctaaaaacccgcaagctatcacagataatgctaaaaacgataacccgagagcggatcgcaccacgacacaacgtgatgcacaactgacttatcgactcaatccggcggaatacaactggctgaataccaaagcggatatctattattccgacgtcactattaatgcaaaaaccaaagagaaaggttttgaaggccgcaaacaagaaacttacggcgttaaattagagaaccgttcacatctgggtgtaaacactttttcagttcatcaattcacgtacggtggcgaagcttacaaacagaaacagaagccaaacggcaatacagaaagtttccctgatgccgatatccgttttgcatccggctgggttcaagatgaaataaccctgcgtgatttgcctgtttcactcatcgtcggtacacgttacgacaattacaacgcttcaaatgctaaatatgacgatatcagtgccaataaatggtcatcaaaaggcgctgtcagcattacgccaactccttggtcaatgttatttacttcctattctcaggcatttcgtgctccaaccatgggtgaaatgtataacgattctaagcacttccacatgccacccatgagaggaaagccgggattcacgaattactggaaacctaatcctaacctgcgtccagaaagcaatgaaactctggaatctggctttgggctacgtttcgatgatttattctccagcaacgatgagttgaaattcaaagccagttattttgacactcaagcgaaggattacatcacttccatcgtgacaatgccggatatgagatctacaacgtcaatcaatatccctaaaaccaaaatttggggttgggatgcttcaatgagttatgaatcaaattggttctcatggaatcttgcttacaaccgaacaacgggaaaaaacgaagaaacaggagaatctatcgccgacctcagtcctgatactctgaccagcatgctagatatccctctatctaacaccggtttttcccttggttggatcggtaaatttactcaacatactcagttcagaggggttaatggtgacaaaaatgagcgcggtcagaagctctctcaatacgcaggctacggagtcaatgatttctacgtcagttatcacggcgatggaaaattaaaagggctaacaacttctgtcgtacttggaaacgcgttcgacaaagaatattactcgccattgggtgcaccacaggatggtcgcaacggtaaactgttcatcagctaccagtggtagataacaacaaccccgtttttaatacgcttttaacacactatttttaaacgcagtttttaaggagccagcaattgtgaatcagtcactttatgaacgttacctacaggccaaagcggataacaaagctaaatatgcacgtgatctcgcggcttatctcaatgtcagcgaaggagaattattgcatagtcgtgttggtatcgacgcaaaacgtttgagcgttgatgcttctgccctgcttcaagaactggtaaccgtcggcgaaactaaagccattacccgtaatgattttgccgttcacgaacaggtaggccgttatgaaaatacgcagttcagcccgcatgttggtttgattctcaacccacgagaacttgatctgcgactattcttcgaccattgggccagcgttttctctctggttgaacccgccaaaaatggcctgcgtcacagtattcaattctttgaccgccaaggtgatgcgctgcataaagtgtacacgaccaaagataccgatatggctgcatgggaagccttgatcgaaaaatatcagaccgatgagaatccagctctggaaattcaacctgaaaaagcatctgagcacaaagaagtcacagaacaactgaaagctcagttggatgaagaatggcgtgctatgactaacgttcaccaattctttatgatgatgagccgtcataacctgaaccgtcagcaaattttcaatgcagtcggtaatgatctggcctaccgtgttgaaaattcatcactgactaaaatcgttgaaaccgcacataacgatcaaaatgaaatcatgatttttgtcggaaatcgtggctgtattcagattttcacgggcaaactggaacgtctgatgccttatcaggaagaaaattcccctcagaaatgggtcaacattttcaatcgtgatttcactttgcacctgattgaaagtgctattgtagaaagctgggtaacacgtaagccaacaacggatggttttgtcaccagtcttgagctatttgatgccgaaggcaaccaaatagctcaattgtacggccagcgtaccgaaggtacgcctgaacaggcacattggcgtaagcagattgccgcactgcctaaactggaatcagaaaaggaaacttgtatagtatgaaaaagtggcttctaacatttatgcttgccacctctggcaatgcattctctgctgagcgcattgtcacaattggtggtgatgtgtctgaaattgtttttgcactaggcgaaggacagcacgttgtcgcaagggatagtaccagccaaaaccctaaggcattactctcactccccgatgtgggatatatgcgaatgctgaattcagaagggatcctatccatgcgcccatcactggtgatagcaagtgaatcggcgcaaccatctctagcacttaagcaagtcgaagattctagtgtaaaagttattaaagtgaccagcgaagcctcgttagaagccgttcctgaaaaaattttgaccgtcgcgaaggcggtcaatcaggaaaaacgcggtgaaacgctgacctcccaatatcgacaacagttagccgaactcaacacgtcaaatattcccactaaggtgatctttatcatgagccacggcgggatcatgccaatggcagccggtcaacaaacagccgcagatcagattatccgtagcatcggtgcacagaatgccatgcagggatttaaaggatatcgtcccctatctcaagaaggtgttattgccagccagcctgatttgctgctagtcagtacagaggggctgaaaacgctgggtggcatggataaactctggcagcttccggggttgaatttcactccggcgggcaagaaaaagcaggttgttgttgtggatgaaatgggtctgcttggatttggtatccaaaccccagccgtcatgaaacaagtccgcgaggcggcggagaaagtgcaatgagtcgctcccgcttccccagtttcggcttgatggctctcggcttgttgctattcttgttagcaatcagttcagccaatatgggggcattgccactttcttttaaaaccctgtgggaatcctcattggatgacccacagtggcagatttggttaaatatccgcttaccgcgcattctgctggctattttggttggcggtgcgttggctgtgtccggtgccgtgatgcaggggttgttccgcaacccccttgcagatcctggcttattagggatcagtagtggtgctgcacttaccgtagcaatggtaattgttctgccttttacgctacctgccagtatcgcgttatatggccatattattgcggcttttgtcggcagtttgctggtttcattcctgatattttcgttaaataaatataaccacggtaatctatcaaaattattacttgccggtattgccatcaatgccctttgtatgtcgtttatcggtgtgttgagctatgtcagtaacgatcagcaattacgccaattttcgatttggatgatgggttcattgagccaaattgaatggccaacactgattatcgccgcatctctcattattcctgtttgtatactggcattcagtcaatcacgaaaactcaatctgcttcaattaggcgatgaagaagctcactacctaggtattaatgtccagcgcactaagtatcaattattattactgagtgccctactgattggatgtgctgtcgctttgagcggtgtcattggttttatcggtctagtgattccacaccttgtcagactacggtttggcggtgatcatacctggcttctgccaatttcagtgttgggcggagcatgtctgctgttaagtgctgatacactggctagaacattagtttcccctgcagaaataccagtaggacttatcactggtttaatcggtgctccctattttttatggttgattcttaaaccatcaggaggccgtttataatggaatcggtaatgtcggaaaatttacttgaagccagaaatctaaactatttcattgggcatcgtcagatcatcaacgatatttcactttccattcagaaaggggaaattgttgcaattattggccccaacggggccgggaaatctacgctgttacgcttattaacaggttatattccgtccaactcaggcgagtgcttgttaaaaggcgtcccaatctcccgctggccaacccagcaacttgcacgtatccgtgccgttatgcggcaatacagttctctttcttttcccttcagtgtggaagaaatcattgctatggggcgtgtgccacatgaaaacacccacagaaaaactgccattgatgaagcgattatgctgacagaatgtgaagagctgagacatcgaaattatcagcagttatccggaggggaacaacagcgggttcaactggcaagagtactggcacagctttggcatccagagccaacagaatcttgcctatttctggatgagcccacatcagcattggatctttaccaccaacaacacacattacggctggtacatcgcctgacacgccaacgtcctcttgctgtttgctgtgtactacatgatttaaatctggcggcgctctacgcagacaaaattatcctgttacacaaaggaaaactggtggcgtctggttccccgcaggatgtgctgcgtgatgatattcttaaacagtggtatcgggctgatttaggggttactcagcaccctgaaacctaccaaccgcaagtttatctccggcaataacaagtctcagcaaccctacggaaaaggcaaattttgttggtattcacaaaatttgcctaaacaacgagggactacagcggattttgctaaatttactgaataagcaattccacacttatatccatatacgatgagcttccgtaaacgttattctgattgcagtcggcatctccacaagtagcgctcttgactatatccggacaccctttaatcaccgtataccatcctccatcaaacccacgctcaaatctcaaagcacaactcatcgagccactagaaaccgcccactcaacccatttaggcctaagtgtacaagcactaaataaattatcgttgtcttgtaagtgggtactttgctggttgccaggctcaatccttatctgatctgcaccactatcatacatacagtcggtacttcgtttggctatcacgatatcatttacagaagaagagtaatttttaaattccatattatagtcagcagaaagaatctgttgtttttctgcattaaccattttctcatctgcccggactggggatatcaacaaacaatataaagctgcacaaaataatatattgataatcttcatgtcgtgctccctctgatgaaattactaaaaatatttcgtcaatatttttgattcgttattgcttcaccgttaatggagtactgagatgatagttactaatagcatacgaactatcgtgattctatcagctttagattataaagaattatttttactgctatacatcaaagataaacaggtgagcaagaggttttaatgtgtttctattattcccttacgcagggtaggaaataagtgaaatagatagattgcaattccgaccatgagaataaatttagtaaaatcaattaattatagtttttatctataaaatctataaaaatatcaccatttattattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattatcttattattaagaaaaatcatttgcaacattagaccaataaaaaatagctgtcatattaatattagcgcttatatctccttcaaggaaaactttcgggttacctggcctaagtcctcaatccatgccgtatcacgatatagatattcaaccgcctgacgacgaccaagcacactctcaccagaaacaacagcaaatgatccagcctgacagttaaagacttggaactagcgattgacaaatcgaccatcgctcgcttaagcaaactcgattgcattacagcctcatttataattaataacgcggctataatatcactgtgcttaaaaacaaatgaacatctgatccgcaccattaattaataaaataaaaaatgaacaacacataatgctgattaaattgaaatcgcacattttgcgtatacgattcaaaagaaattcttaaaatgtcccacacaataacgtaagttattatttatttatcggtatcttttcagcaaaaggcccacctatgtgggaggtaaatatgttagaaagtgtcatcaacgatattgtcagatggctagaaagccagcttcaacgtactgaaggtatcaaaatagatgccattgcacataaaagtggctattcaaaatggcatttacagcgaatttttaaggaactgaaaggctgtacactgggtcaatatgtgcgtagacgtcgtctccatgaagcagcaaagtctttgcatgaagatagcttgccgattcttgatattgctttgcaatatggttttagttctcaggctacatttacccgaatatttaagaaacattttaatacaacacccgctaaattcagggcaagtgggcagttacccgagtttaagactttcttacattgcgaataataaagacgcagtgtaataaaaaaatagcccaaatgctgtttcaaagccaaatttctaaaccctatttatagtaagtgtcacccttttatggtcaacttccctatcgttgaccatttttttgccttcatgccatgtcgggctattcactcatttcaattcgttaaccaaccagtgatacaactgctgtaattctttatccagtaaggaatattgttctctgatttgttgaatcacttgcccaactgcctgtggttgatacagtacatcaacaagcttttcagccaataactcgaatggcgcaggttccaggctatcagtgaaaatctggcaacgaccaatagttccgtgttcaatatcgacatgtagttcaattcctccccaacagaaacgggtatccaatgtatgactgaacgttggtgcctgaccaaaattccattcccaactgctctgcttggcaaaaacgtcagtaaatcccggtaaatcaggtaaggcctgcggcgaaatgagctctgacttggctacttcaccgaaatattcaaaaaatgcttcgataattccaccacacactttttcatatgtgatatcaggtaataactccgataaattcgtcactctggaacgaacagaagttatacctttcgcctgtaattttttaggatcaggattaagataatcggcaaggcggttcagatctgcattaatcaacaacgtaccatgatgaaaacctctgtctttggtttcgcgatacgccgaacctgaaattttacgctcaccttcaggggatgataaaactaagtcattacgaccagaaaccatcgcatggatgcccgctttttttaatccttccagaatgatttgagtggaaaccgttttattatattctggcttacctgccataaaggtaaaacaggtattacccagatcatgaaaaacagcgccaccaccactactgcgccgagccaattttattccatcctgttccattcttcgtgtattgcactctttccacggattttgagcacgtcccaccacgactgcgttggcgttacgccataaaaacaaaacgcgctgatctggtgacatctgtcggaaaatgcactcttcaacagcaagattaaaccaaggatcatgagaatcagacaacaacaggcgtaatgtagacatatttgtctccggcaaaaaacagagctttaagatatcataaagcactaccagatttgatggctaaagacggggttacatcctgcgggcttgccaaaaaacacgtcgccaatacacattatcaagggaagagcgtataacgcctttactggtcgatgcatgaatgaactcgtcgttgatatcataaatacctacatgcaaaccactctcgccactgcccgtcttgaaaaataccagatcgcccggcatcaaatcctctttactaatctgagtgcctaatttggtttgttcgcttgttgtgcgcggaaggtagatattaaaacgatcgtgaaatgtacggtaaacaaagccagagcaatcaacaccacgccgatctattccaccatatcgataaggtgtaccgtgccattgattaagctgctcttttaactgagcaatgaccataattggatcagaaagtgccgttcgcagtggaggcaaattggatttagaaacaggattggtacagccaattaagaatagattaaataataaaaacaaaaacctaaattccacgctaagcccccgccattacttactatcacattgaatttactggactgctatttttgctgattttcgtgcatttaagattattttaggctattttggtattaacagcacccccatcagcacccccttaacttaaggaacccggataggagaacttcaattatggcctactatagcatagaaaaacgcccccgcgcagacggtactgtacgttaccgctgtactgttggcgtcaaatctggcggtaaatatatttacagagagaaccgcacattcggaaaacagtctcacgccaaaacatggggagctatgcgggttgctgaactggagcaaaacggggttcctacgcagaacgataccaaagagttaacagttggtgaactgctgtataaatacatcaatgatccaaatctaggcatgaaagcaggaagaactaaaaagtatgcattgaatatattgctaaatagtgacttgtcaaaactaattctaactgagctttcaatcagccatattattgaacactgtaagcaacgacattccacaggaattactcccgccactatcaatcaggatgttatctatttgtcatcggtcttaaaatcagccagacccgtctatgatatagactacacctcaaaccccgcaagtgaagctcgttcacttttaactcaaatgggattgatcggaaaaggtcagcgacgtagcagaaggccagagcgagaagagttagaaagactaattgaagcactacgcaaacggagtggtcactggaaaagtaaaattccttatgaggatatactgaatttttcaatacttacctgtatgcgtataggggaggtatgcaaaattagatgggatgatattgatgagaaacagagagctgttcttgtaagggacagaaaagatcctagaaaaaaagttggtaatcatatgtttgtccctttacttggggaagcatggaatatcgttcaaagacaacccaaatctgatagtgggcttatatttccctacaatacgttaagtatatctcagggatttcatagagcgtgcattaaactaggtattgaagacctccgctatcacgatctacgcagagagggagcaagtcgtttatttgaagctggcttctctattgaagaagttgctcaagttacaggacaccgatctctcaatgtattgtggcaggtatacacagaactgtacccgcaatcattgcatgataagtttaatagactgatgcagcagaaaaaagacgattccaccccgactacctgaaatcactttgatcgaacttcggttgacaaaacagcgtcaaccaaatttaccaaatacagtcatttcgtcaaccaacctacccactggtttgctgattacattgatgggatatcacaccttaaagacgaaccaaatttggatttcaatgtttttactatgacagcttaaactcaagcgctcctgtgtgtgcaaaagcgtcaactgcaaaaaacttttcagttgtgaaaatctcacatgagcaaaaggtgttgaggaaatctcaatacctgcacaaacaaaaggtatggtggaaatcaccatacccaaggtgggatatcacaccttgcggcaaccgtggtgatttccaccctagttgattaactccttgatttatccgagggggtcactttgacccaaccattagggaaatcccaatggttactttatgtgctggacaaacgcaataaattcattgtgtttcaacgtattacttggacacaaggggctggacaaaacgagttaaccccttgtttctagctcactcttttgggcacaccccttattgagttgtgcaaagtccgattatcggacattgaattttgcataccaatattatcgtcgctcaaattataagcagactgcaaatatgcagcttgattagatatcaatgggttattgccaaaatgggcattcccacttaaatgggctttcaaatcccaattggtgaaaatataaactacgaaaatttcgtagttgaacctctaagagtgataactccttaagctaaaggaatccttgtagttaatttcacatctccgtttgaaacggaagcgtgccggcaccatgcaaaagttaaaggtgagaaatcccaccttttgctaatttattgattttgcttatttctgttgattgagaggttattctatataatgttgtttatgaaatctgccattcaaaaacaccacactatgataatggtcaagaccgcccttatataacttaaagtacttacttaacatggtattagtatcatcgtgtccatgttttgtataaaaattccaagtgaaactatctgagcaatctgaatcaattgtccccatatatgcttttaccagaatatctggcaaaaaaagagataattgcgaaccaaaagaggttatccagggcgggtatctacggaggtctggagttattcgtaaatattcttcgttgggagcaggattcgctgtttcacaagaaacaagccgaatattatgcaacttatcaacatctgtccatgttttgatagatagcgcaagttgtactgcgtttctgtactgatcatccatcactacttgtgatattccgtctatatggccaaaaccatgacaagctatggttagcctatttttcccttgcactttctggtgcggttcttcaaacacatatgagtcagaatatactttaattaacctcataactctcctctttgccactttgccaatagatacattgaaaactgtactcccctcaatgtaaaccttatcctaactaaatctttctctccctatgcaacataacattcaattacatagtgagagcggcttaagacttagctggtgcgaacaatattcaacccgcaattttctgcgggttcatatccacctcattcttccacttaccccagtctcacatcccaccccccccccccaacatccgcccacaatccacccaactacccgctattctcccctattggctatttattgatggctgaatgtggtcgttcggggtgttgactggactcaaaaaccaaaatagtagccaagagagttttttcttttctgacataatttgtgttgagattcatacaagaccaatcaattaaaacaaacaggggtattagctaatatattcgggctgttgaaacgggacagcatgtaaaacttccacaatatcaattttaacaagagaaaatataatgagtgaattagttagcactacagttcaaaacgacaaagcagtagcagatgcaaagaataaacagaaatacttactgtctgaagctcgggttgaatcaaaaaaacaattggatattcttgagcaacaaatgcgcttaaagcagctccaatgggacatgtattgtgtcaaattgcttgaactggatttttccacagcgcctgacatcaactggcctaaaaaaccagaataacaataaggggcatcaagcccctgcgttcacttcggcggctccggccatttgacatcgggggcggtagtgcaatccacccgattgagcaacacccggtatttgcgccatgcggttaatgcggatttctcggcatctgttgccatctccaactcaacggcatcctgtagcggggcaattttctcactggctgcggacagtaattcccgtcgttgatattcagcccgttctatcagaacttctttggggggaggcggggtatcaacccagaccggatagcccgtctcatcacagcccaacatttttccgctgggccatgaacccgaaaacaactcatgaacagcctcatcaacctcgacgccactctctgggaacgtgtttgggtaatgttcacgttcagctacaggccaaaaccccggacacggcggatcatatttttcattgttcacactaaaaatatattttttgctcatcattaatatcctaatgcaatgtagaggccatccagcgtttccgttccgccttttctaaacgtggcataggtcgcggatttttcggctagatagacgggttctatggttgttgttttggtttcccacggcacaatggcaacagggacaacaaatacacaacgatgggggaagggacgcagaaatttgacggttgccccctcaccatatttataacccccaaatcccccccattgaataatcagatccccgctcccgtcctgtgacgggatctgttgccagccgttatacccgaggctcgccagaaaataccccatactgggaatgtttgtatattcattgccaacggttctcagtgcagcatcccccaactctaatgctgttctgaacgctgatttgttcggtatatcgctaccgttttgagataatttcaaataccggctgtcaaaattcccgaaatctcccggctgaacttgtttaccgactcgcagaccctcacgaatatcacacccacctaatgtatcaatgtttgtgataccctgcccgcgcagataatggttaaataccggtgctgaatcattccccacgttatagccaagttgcgtttgcccatcaccaacaccattcccgtctgattgcgtcgagataacaatcgaaccggtgttcgttctgaatcccgaaaatttaaccggggccaacagctcacccccggaatttttatccagggcattatttgcccgctccacggttttcgttaaaccgaggttgtctacaaacttcggcttgttcggaatgtccgcgccgttctcgtttttctccagacgggtgttagcgttttcattaacctgattaattaatttttgactggccgctaacccactggaattacctaagttatctgtcaaaacaattttgccattagatattaattggaatattgcctctgataattgcgcatcattatttttatttaacttgatcccggctttagatataacgtttattatttctcgctggattgtattaaaccacgccgcgtctaatattgtcggtgctacccccgcggcgacattgccgttcgtgtactcaccattgccatcagcggtatttgtaatatcaccgattttttgcataataaatcctcactcagtgaagtgattaatagttgaattgaaattaatgactgattattggccgtaaccgaactgtaaaatggtgtgagacgggcttaatctattaaactgacattcgagtttttggtttccccatgaccgtaatgggtcgccacaataactcccaccggctatggcataattgatcgttgttgtcggggcattaattcgccagacaaatggccaatcctccccgttcagtgcatcaccacatgcagacatacctactctggcctgcctaaattccgtaatggtaattttgaatccgagttcagccgccaaaccgatgaaataggattttgactggccacccgtccgtaataattttgatacaacagatttctgtctcaatgagatgctgtcaatttccccaatagcgcaatcatcaggtaaccccagtgatttttcccattctgacaacataatggttgccgttgcggggaatgccccctccagcaacgaatgcgcatcctgatcactacggtgataactgtgtgcgatagccctaatggtggcgctcatcactgaatttgggtttcgcgtccatgccattcccgttggcagtaatccgttgagtgctgaggtatattcactgacgctatattgtttcatgtgtatttgacctcaccccgcacaggcaaatgtccgacagacaattcaatattttttgtcggtgacgtgataacaaaacctgccgttcctggcacatcggcaatcgcatactgcagatcggataccaatatttttcccgttccgtccggatttccactctcaaataacacattatcaatggccatcgtaatgcgatgagttatttcagtgcctgcatgagccagtccattgagagtgaaatcaatggttcgttttatcggagacaatacccaaattagcgcagtaacgggccgtaacgggtaaatataatcagcaacacgcaactgatcccctgacgcatgaacagcatagggttcatgtgatgagacaccatctgtaccaatagggaaaccctcccgcccattattgtcacacataatatacacgcccaccgttccagcacccgccgctctgggtttgacccaggcacgggtaacaccgggtacagcgagagcccactgtttatagtcatcatccgaaccaccctgaggtgatccctgataggccagtagcattctggaacgaaaatctgtctcactctctatatttgcgccgcccgttatcggtgaaattgccgttccctcaacatcgacaccggcaatactctggtccagtgttaatactgtgcctgaaggggcgttacccgcagcaccaccgcctgaattatcatctgtaacatcgggtaatatcgcgatgagaacagcatgaccccgtccatgatgaatacgcgtttcatcgacggttttatattgatagccatcacccctgtttaatattgtgccggcagaaataatctgaccctcaatacccgtaaattgatatttctcacagcgagcgggaaacgcaggtttttgaaatattttctttagggctgcccagcctgacaaccattcatcggttgcagtgaatggcgtggtttgtttcgctatataatccagatagccataatgcagatgtgccatccctgcatccatatcggccaacacccccatattagaaaaccgtaataatgggcctgtttcctgtaattctgactgcaaataactgcggttttgctcccggagttccgtcagcgtttttcgtttaaacggcattgtcccgctcccatacccagaaaaaccgaacgtcctcatcatcacggccgggacgctggtaacgaattatcatatttaggcgatttggccagacaatctgagtccgaatatcgatggattccgcaaccccatcgtccagcatccattgcagtgcctcacgcgcgtaatcctctgctgccagtgcgaccgctggggttaatttctgccggtgcagcagccacagacgggaacctatggggtaatcagccccgctatctccccaccaaccacgacgatcaacaccgtcaatgtcatcatcagacctggcctgtctgtcagtaaacaaactaataatcatggcggtttgcaggtcatcaccggtaaccagatcaccgcgcccaactatccagtcggcatgaatgcttttcacatcccaccatgaggcaatgtcactcatttaaccgtcgctcctgttgtttggctggttacggttgaaccgccagactcaacacctggcacgggatgcgtgtggttgttataggaatcacgtaactgttgcagggtggttttattgctgttgcagttatcaataatattgccagagacctctaataccggggtattcaacaaaaccttggttgacgcattaatggttgccgtagacgcattattgactgtgactgatttcccttgtgcctctactgtgatccccgattcagtcagtaatatatgcagtccccattggttataaatcacaacctcaccgggatttaatccctgatgccgatattgctgatgattgctgccaatcaccaccgcattggaacggtcaccacctaagaacgcgagaacgacatcggttcctgttggcaaccctgatgaaaacccaaattcggccatgcggttcgttttatccctaacctccatcgctgtttgatactgaacctgttggatggcacccttatcattacaggttgtgacccgccccagaccgagcatcatcatggcgcgacgatataaatttttaacttccataattacgcatctccataatcgtgtcatagaattcatagggttgaacggtaaacgccgcaggcggcatcagggttaattcagctctcgtgccatcatcgctattacggacataggatacctctgacaataaccactgttcagactccagtccgaaaacaggcagatgaatggggatcagggtgttgggctgccatagcgccccgctgatatcacgccagctatcgaccagcactttgaggactttggcacgcccatagcggcggttcatttcccagtcaatggcttcctgatgtcgctgatgggagtgaagtgtgctttcgataatggtgacatagttccggtagcgcatcttttcggcttcgggatctgttgcggtggcaatggtgactacgttatagccctgtccgtcagataattcactcaggccactaacattcatggacaggccgctgtactcggaaaaccgttcattcatggatgactgatagtccgtcagttcgatgtttttcccctgctcgacaccgctcgcggccaccttatcgccgactcgggtaaaaaataaattgccatccggtgtgtcgtaatacaacagcgccgaccagcgggtaatacggtcaatcacctcttgggaggattccccccagttcagagtaaactgaggcaccggctgcatatctgtcacatcagatgtcacttctatcccgtaccactgcgccagtttttgggcaatttgcaatgccgttgccgacgaaatcacgttctgtggccatttcgccgagcagtccactaaatcctgacatttactgcgacccgtaacccttatctggtgcgtacttttattaatggatgaattccagatatcgatatagccggtgataacaggctcatcccccaacagaacctgacagggttgacctgcctcgaccaactgtttttctttactgccgggataatagtccatcaatatcaattcaaaatcagagggcaaccgctcgataccgcgagtcacacgaatgctgtcccagccgtgaattatcctgccaccgataaccaatgacagatcatcattattttttttcatttacgtaacgccttgaatttaacgggcataaacgccggatgccggggattagtcgcctgaatcagttcatcactgcggcctgaatcctgataaatccggttggccacattcagcgatggcagaattgcgggcaaactaaactgagccagtcgacctgattccgcccctttcagttctgcactggtgacaaactcatatctcaacgacatcagagactgatagatgtcatccatacccaaatcaccggacatcaccaatgccgtatccagcgcatggcacacccgcctctgtaggtcattagcctcatgattattcgccggggtaaattcactggcaacctgagccattgccccggcagacaacacaaccagtaacaacaccgtcatttcggtcacatgacggtctgtggaactctgttgatatcgggtattctggaatgccgctaaattctcaaaaatagcaattttctcatccgtgctacctgctgaactgataatagaatcaacaacaccctgagccgcctgactgaactcttcaacggtcagcgaatgggttaatttatcgatagattcagaaatagatttacggcccatcaccactgcaactgtggtttttttaactatctccgcatcatcacgatactgagggtcccgtgaccgaattcccgtcgcgccggatactgtgccaccaattttcccacgctgataacgcccgtaacgctcgctacccaatgtcgttttgagcatatcgctcagattcgtcacctcgtccactgaccgggtaaccatgccaatccactggttagcggtcgccttgatgattttcatcccctgcacaaccgagcgaatttctcctctcacaaccgcaatatatttcgccaacgtcgtggtatatgcccgaaaccagttctgtttgatttccgtcgctgatttggtgctgtttgtgacggcaaaaacctgtaatccggattctattactgtcagtgtgaactcaaatacccgacaggactcggcgttttcggtcatacgaaggccgctttctgtcacgctgaccgtcagttcgcccagggtaggatggattagtgttcctgtagaacctgtttcacaagccgcgaccagatttttacgctgggtgataacatccggcgcgttataaaccagactatcctgaacaataaacccacgtagggtgatttttcgggttgcccggcctagatcctcaatccatgcggtatcacggtacgggtattcatgcaccgcctggcggcgaccgaatacgctctcaccggaaacaacagcaaatggcacaccacgaaatgaggcaggccgtaaatgctctgaccatttccatgatgagctatcaccacccagcaatgaagaaatggcatctttaataaaggccatgtcgactaccttaaatttggacgcaaaaaaaccgcggctaagcggcatatatgaaaaagccctgtgatagggctatttttgtgtggttatctcttcaacaagacacatcactggagttttatggtgtatcgtatgcgcatggtataaagccggagtgttacagattaacttctcggctttactcaccgcctttgaacagtcaaaacttgcagcattggtagttacagaaaccagaaaaaaaatggtgcaatttttttaacatccccatcctcacttctcggtatagaacaaagtaactaacaatccatacaggataataaaacatcctataatgacgtggttttgcttgcttgagactaatccaatgttatgaacggtttcaccataagaagaaacggtggtgcccatatttagggccgcaatcaaccacacaataccgacaagtaatacaaagcgcccaaatctatgcatttataacctcattaataatatgataaaaatcacattaatgaatgaatataagctattttcaaggatgctgcatagaggttgtgactttacctgcagattttgactggaatttttgacgttctccggtcttgtcattaaccaaaatgatctcaacttgaagtttatccctaatggcttcttgaaacgctttcgccatgccttttgctatttctgcctcagactcagcatcctgtctattgctgtagagtgatgggaattgttgattttgcccgttggagccatattgcgaacgttgattttgtaaataataatccgaccgcaatccagcccagcgaggatcatcaatagaagcataaattccattttttatttgttcctgactgtatggctgctgccccaaattctccatttttattatagcatttatcagcttttcaatcatggctgggttatgtaagtccatcttttcatttggactaattcctagctgtttagctgtataatcaatatattctttcgttttattgcctgctgctttaggggcatatataggaataacgtggtttaacgtattttgaccgcgatccccatgcagcattaactgtctactcagcgccgttatcccatcgtgaggcgtcgcaaatttcatatagacatgaccattaccataatctttgcctaccgcattaggggcatcagttaagtttccgggattattattgcgtattccccttggcttcttccctgtactctttaatggattagggtagttgggttcttctactatgggaaagtcaggcaccttttcaccaacatggcttggcttttcattcgggaaataataagcgtttaactttttgattaagtcttctgaagcatatgtcagcaaaagatctgtattttctttaaacgttaaggtttttctgaattctttatctttccgtgcttttttcagtaacgctaactggtcaccgccgttattaaatccgaatggattagcaaatgccgctgctcccgcaaaaaaaccatgaaccggatttttgtctttagcggtttctctcgctttgtcccactgaccaaagcccgtcagtagcatatcgtttttaaaatttctgaatgcgccagcggcgcgggcttcgatttcattgatacgctcgccaactttttctattctttcattatccttatcttgtatcgttagcccggatttatctgatttattgagtaattcctcaatcttaagtttgccctcttttttctgccctccatctctcaggaatgacaacgtattaccatctaatcctaaatgttcgcgtaaggtattctgcgtttcaggtacgatattattccattccgccgcgaggtttttcattgtctggtaaacgtctgcattaccgtttttattttttgctatttctacgccaattttattcagctcggcttttatggcgctatttctgttcgtgagggcattctgaagaacgggatagagtgattcgacagactgatcggtagcgtccattgaagcgccggtagagatctgcatagcaccggacatacgggtaaaatccgccacactcatccctgagttttttgcccgtgtactgcgggtaatggcgtctttgcctgcatccctcataccttgatacagttttgttgcgccatatcctatagcgcccaccccgccaatgatccccccgtattttttggcaagaccgccatattttgcggtgagttcacccacattttttagcggcggaataatagcgccgatgtgctgaacgttgtctttggcaaactgcgacatatcacgcaatttattactgacagagccgacattatccagcgtttcactgccgccaaatcgcagcccttcccgcgtagagtctaatacaggctgcaaccccttaagtctggcttctatctcagctaaagcctttgtcgcgttttcatcagcatgtaattcaaaatcaaatgcattagccattatttttagcctttataattcgttgcgcctgttcagcccaccaactcagtttcgatcgactcaggagccacgcatcctgtggcccccagtggtaaaaataggtgacatctgccgctaatcgtcgccaatgctggagtccaagtttcccgacaaaaaaaacatgagaaactccctgcactggttaaaatcagtgatggacattcgttttaatgcagtttcagtgactccactgaccaacgcgataagacatcgcatggcaggaagagaactattaagatttttcgcctgtacgtcgtaaaactgctcaacgtccatcaaacaaggctcccttaaatgaatttcttcataaatgatcttctgcgcgttgtcttcaatcggcgtgcttaatctgataacttttgtcttttccatcattgcctcttaattttcagtaaccgaaccgccttcccagcggacttcgaattcagcgtcttcgcttttgacttcctgatgattcaccgaccacatcccttcaccgatgatggttttaccgttgccgagttctgccacaatggtgacattggtctggttattaaaatcggcgaccgtggtcccgccactgtcacgaacccggcatgaaatgaatcctgggacgggcttctctttgtacccatgcacggaatccatacctgtcagcgtttcacgtgtcactgttgaggggctgtaggtgaaatcccctaccaccatgattcgaaagccgtcaacagtgacatacgctgtacccgccagcctgttagatgtattacccataattttctcttagttagttggttacagacggaactgattaagcagtgcaaacacgcgcaactggctaatcaatgtgccagtccagagaacatccaaacggttaggattgtgcgcgttgatttcaacccgcaacccctctgaaaacgccttcgaatcctgaacataaccgttgtattcgagtgtccggtactgggcgatcagttccgcacgcaccacattctgggtcacaatggcagaccccgccgcgaaccgcgtgccgtctttggccagtttcatgcgacgaaatttagaggtgatctgcgtgcgaatgtaacgagagacaaacgccagcaaaaacagcgtttctatctgcaaatagctgtcatcattatcgccatacgggtttttctgataggtcgtaatcaggttttccacctgtaccgtgccatcatccgcgaccgttacggtagatataccgctgtgcagcagattgttgcgttcaatcaggtcgagctgatccgctggcgcgagaacacccgcgacgggcaaggtttgtaatggcctgccggggtcgtttctgagtgacggcgcgactgcaccggtgactgccgctgaccagatgtagttgggtgtcggtgatttcgttacacccagcaatgtttcatgctgattgttgcggcgcgctccggcatccgccagttcaccataagttccgctgacgacactgatcgcatggccatacaattgttgctcccaggaccagcgaccgccaatatctgacaggaatgatttcatctcatccattgacgcggtgtcggtgtacggattgacgataaaatcaaatgatcggtcactcaggttagacaaaccgtttttcagctcgggggcgcctgcaccgcctgtcatgggagtgatcaccaatgccagtcctgccggagtgacctcgccgcctgcctgtccacggtaattgagacaaagattgatgccgttaccgtgcgcacctttatttctggcggttaatgtcaccgtgtcattcgccacagttgcggtcaccggcaacgagattttacggttaatcgcggtggccagtgccgccgcaatctgtgccgtgttatcggtggccataacggtgacctgtacgcgctgacctgcgatatacagtgagataaccccagcatgggtaggcagggatgagacttttaccagcccttttgcagtcagcaggttatccccgtctttcaggggcaatacccataattcagcggcggaatcattcgctaaataggccgcaaccatgccgtgcagcaatgaaccgtgaccatactgtgaggcggcttgttctgccgaagaaacgcgaaccgggatatccggcgttgctgtggcactatccagcatttgcccaatgatgagcgaacgctgggttgctatggcactgttcgccattgagttatcaaactcaacaaaaaacaggggcgttctgagattattgggaatatgggaaaaggggatcgccattattcattctcctgagaaggctttttgacgagtttattttccgtcacgggcggagataaacacacatcgccatcttttaaccgacgatgccaaaatagggtatccggcacctctgcaccagattcgggcaaaaattcgcccctgaccgggcagcgaacgagccgcccagtaacgggtttaacaaacatggggtttactccagattaatgctgattttgggttcgggtgtgtgtgctggcatcgctacggtcacgtcaataccgtccagtgggtgcgtatctatggggtaaaaatcctcctcaccctgatagtattcaatgtcgatatccatcaggagttgtgcgaaatgtgactcaccactggcatcaatatcgatttgcgaacgaatttcagcgtattgctgagtatttttcgtcaattcgtaactattaatgacagcccgttcgatttgttcccgcaacgcctctaatgccagtcctgccttctctacaccattatcaaactcaccatcgaacgcttcagttctgccggtgatcctgaccgtcgttaccgtattgaattgcggtacattacggcctaacgattttttatggtcaaacggggtctgcaccagaatgcaagggtagtcatcccctcgcgttgaccaatctcgcggggaatagacgctggaattcgcgtctgttttccccataagcgcctgtacaaccatattgcgtattattgatgcgttcattttttgtgtttaatcctgttgagttgcaaatgcgtcccaccgtgactgtccggctgaacgtcactcacgacaaattcagcattgatactgtacacaaacacccggtcttgttgctgtggcggggatttgaataccgcatcacgaacacccagcagcggtttagtggtgttgacactgctgtcaccgtccagcgactccacctgttgggtataggcgcgatcaaacacgcccataatgtcgtagggtttgcctgattttggccgccaattcacgcgctcgccaaactgttcgtgcaacggcgccagcagatgtttatcccagtcaatcggcatcaggcctcctgttggactctgaccccgtcctgaacggtgacggagttaccggacagtaactgggatttcaggtcatccagccgcatcacaacacccagttgaatcaggcgttccgcgtcctcgccagacaaataaatgacggagttttcagggtacgccacaccgtcatgctgaaccgtatttcctttcagcacgacccattcaggcacgtcttcatcttctggctcttccgggagtgtatccgggaattttgtcagagctggctctgactgaggtttttgcaggttctctgtcacattcacctgcaattcggtcggtaattcgcccaggccatcagtgactatttcctgttttttagccatatcacaccaccattgcacataatgccgcattcacccggctggggatgaccaacggtgcggattgcatcatcaggaaacgctgcgcgggatcttcctgtaaccacgatttcggcgcataggccattggtccatagctaaatgcggggtcaatgatggcaccaaaggcacgggttcccatcaggtcagcaccagacataatgaccgtcccctctggcagcatcggtttttctttaccatcagccgggtcgataaaccaatcgttgtacacccacaaatcaaattgcccccaacggcctttgtagacggcacctttctgcacctgtgtacccggattaatctggttaccgtacgggtttaatgccgggaacttaatggcactgtcggtcaccgtggtatccagacggaatgcgttccatgactgggtggtaaacaccaaatcggtcggcacggcaccggaattcttcagaatgcgctgtgaccacgtttcaatatcctgtgttggctggttattggttttacctgcatcgaccttggtcggccatttatcactgccgcttaaggtgacggtcaggtcagcagagcgcccgaaattgacgactttcgtttcgtaacctacaccagcaaccgtaatggtgccgcttgccagcgcactggccgccatccactctaatcggcggttaatcatatcgatttggtcagccagctcaaattggatatttaacatctcacgctccgcagcggtgtactgacccccgatgcgctcaccaatctggcggcgaatgggtttgcgtaaatccggggcgcgtttatctttgatgtacgccggtttaaagctgttggtttgaaatttacgcgattcgaccagtttgccttccaccagtggagagataaacggggccatacggcgcaaccccacatccacgtcgatagacacctcttcggtatcagattccacgatattcgggaaaaatttatccagcagccagttctggctggttttcaggttaggaacaacctgaactaacacgttagtatcataaatattcatgcgtttctcttataaaaaagacgtcacaacgcctgccggagccagcataacgacgtcaatcaggaatgggatttaggcttgttcgctgtcgcgcaggaaaatggaaaagtgccgtaattgggctttcagttctgggagtgtccagctttcatcgaaaatcacccaatgatggttaaactcgcccatcaggtaaacgccacccgtcacactgtcggcggtggtatcaacattgtctaccagaatcgcactggggatctggctgccattgtctgccccttttttactgaccgcgtattcccctgttgccgcaatgacacccagtaccgtaccgcgcttcagaatacccgctttggcaatcgttacgctgtcggtgacaatttgcaacggaccggaaattagctgatcaggcgaaaaaacagcctgtgtcatgcctggctgaaatgggttctgagagaagttttccattatttcgctcctttattagcgtcatataaactggtcattttgctcaccagtgcttcgggtgatcctgttgccggttgactggcatccggtccgacacgcacttgctgctcggtacgcatccggctgtccagtgatgcacgggagggttgcgactgcaccgtccccatcgctttcagtgtgctgatggcttcgctggctgacatgctggtattgagagccaaatgtgccgccatatccggacgaccggctgcatattggctgccaaagattttggcacagcgtttgcgttcagcgcgacggccttttttgacatcctcgtcttcttccgcgttttcatcatcctcgtcgtcttcggcatcagggtcgtcatcgtcatcatcttctgacttggcctttttcgctttttttgcttttttcgcctttttgccttccgtttctttatcgtcgtcactgccttccgcatcaggatcatcattttctgcgtcagtctcctccttatcctcttccgctttacgagacttggcttttttaccttttttcttttcgtcctgctcttcttctgacattttggatttcatgccaaatgacgggatcagatgagcaaatcttgttatagacatattaatctccaacttcgttcattaatgtttgaaatgcggcatcgggcgtggccactgcatcagccaaccccaactgaacaccatccgcagccaaaaaacaggccgcctgtgtgtcacgaataattttctcggaaacaccccgattgcgggcaaccgtactgacaaacagttttcccattacatcgatatcatcctgaatagattgacgcgcctcgtcactgagtttgatatagggattactctctgctttacggtcaccatacgtaatgattgtcaccgtcaaaccatcctctttaatacgctgagaccagtcacaatggataacaatcacgccgacagagcccacaccacctgtgcgggggactgtgattttgtccgcagcactggcgatagcataggccgctgaataagcgttctcattcaggatcgcatgaatgggtttgtcaccccgtgactgataaatcaggtcagccaaatcaaaacacccggccacttcacccccgggggaatcgatatccagacagatgcctttgactttggggtcattcaatgcggttaaaaatacctgtcgaatgccgtcataacctgtcataccactatacggccgcagatagcccagcttctgaaccagagtcccctgcacaggaataaccgctatcccctccagtacgtcgtaaccggtatcgcgcttgcgacgggaaaatgattcatcctcatcatcccagtccataccggcctgaattttagtgatacccaatcggtcggttaatgccgccatgaccacttccgcttttcgcgggtgtattgccagcggaacgttaaatagccgctgggctaagtggggtaagttcatcattcccctgatcctctgttgttttgttgttgcggtgtcggctcagcccattcaggcagtggaatgccccgctctttaaacgcttcaatttcacgcgcgcgctgatcgagcatctcttcccagtcttcaccggcgttttctgccgcttccatctccagcgtggagagtccggcattcatccccagaatcgcgcctttcttctcggccaccgggtcaacccatccacgaccgggtcccatccagcgcgcacggcaataagccgctttcgcatccagaaaatcaggagcgttgtttggcaggggcaatttttcaatatcgtgaatttcctctacaaaagcagaggcgataggttgagcaaaaccgacagcgaaatcatcacgacggcgggtcagggttttccacgcctctagcatggcggcacgcgctgatgagtagtttacgtctgaccagtcctgcgtaacctgttgcgttgaaagtccggtcgcagcagcaatatttcgcagtaccgcactttcaaatccgtcaaaattactggtaggtcttgtcgccgaaatggtgacaattttttcgtttgggaataaatgaggaatacgtgcaccattttgtaagttcaggcgcttatcttcataatattccgcacgctgtgtttgatatgcgctgagttcgtcaccactggaatcaacggtgtcaccgagggcggatgccaccatttgcgaatcatagggtgattcgatataggccccgaaaatcgcattgaggatcgccgcttccaactcactctggtcatacttaatcagcattttcagtcgttgaacgatgggcgctaagataccgataccgcgatgctgagcgccgcgctcgtggtcaaaatcatgcaccaccatcgggcggccccatgcggtttcgcgctgtactcgctgccacgtcatggttttcgcacccgaccaccagtcacccatatgggcttctcggatatggtaaccaatcggtgcgccgtcactatcaatttccacgccaccacgtatgttctgcatatcgaaattctgttgcgggttactgagccggtcggggtcgatgatttgcaccgtggtagcataacgtccgcgaccgggacctaatctgtcggtacggtactgcaaaatagccagcgcatccccgtcgagcagtttatgtcgaaagccgagacgcagcatttgggaaacggtttgttttcgttccacatcacaatacagccccggatcattcgcccacgaacgccagtgcgcttcgataactttgccgtactcatccgcccaggttgcatcaaaggcattattgcccgtgagtaatttaagcatccgataatccggtttaaatataggccggtagttcgcaccgatggcattatctaaaacgcgggtgatagtgccggaagcccagccatcattacgggccagatcgcgcatacgtgacacgatgcggtcgcggtaaatattaatttcattatccggtgaccccagcgccggttgccagtttgccagttggtcgctggatgagtcggcggcatcataaggaatgcgactgctgccggacaatgaattgaattttaatttcgtatttgaaggcggtaacggctcaccatcgggtcctaagattttaacgctcattagtatctcaccgtgattggtcgccgggtcgtgatccccagctcggtttgtattgcctgaatgagcgccaataaatcccccagactggtttgttggtacgacacggagcgcgtcccgtcgccttgcgtatacgaaaatgagacccctttcgttccggttgacagttcgatataggcttgttgagccgtgccgagggctgtttttaactgttcacggctcatgccggtcagcagactggttctttgacgcatagactctccttagggcaaaagctgtgacatatgcttccgtttgggcgcttcctccgttgattcaggaatgatggccccggggaagcgcagattggtttttatttccggttgtaccgggggtgcgattaaccgatcaggattaccgacgatgttgtctgccagcgcattcagtttcagccccatgtacatcaggccgcacaaagcggcataactataaacacgacagtcgagtgcttcattggcacgaccgggaatctgctcccacacgcgatattgttgaccgcctgatactttaatcaccgaccgctcggccaataattggctgaaataatgcaattcacgatcagccggaaagtgcatataagaaggagatgggtctgtattctctggcggctcaatgtgtaaccgaccacggatagtatctttagcagcattcacgccgataatgatcggtttaaaactggatttagaccgtgaagtcagacgcttggttggccacaccggggagcgtttaccgccccgtgccgattcccccttgatggcccaaatccgacgacccaagcgttcacgcgcaaaaccgtacactttctgtgtatgatggccaccggagtccatacaggccgccataatggtaaagccccgaccgtctgctcgacgccaaatttgtttcaggtaagcatccagacgggcccacggttcatccgtctccagatccccttcaatgacatcgtgcgctattgaccacgattcctcattccgcccccagccaacaacctctatttcaaatcgaccatcctgagtatcaatcccggccgtcagcaaagccactccgtccggtacttcggccgcccagacttcgcagcgctccagtaacttacgctcactgagggctttttcgccccggtcttcatagggttcacccaatacaaggttaatgaacgtctggcgcattaacggatcgtctttcactcgcaaccattcggcgaccagatatttccatgctgcattcgggaacaggctgtaacccgcccagatatgaaagcccgcatgaccggtgaacggtttttcagcccgccactccccgcctttgatcatgaggggtttgtcactgtcatgaataacgcagccgttatgacggcaaacgtaatacgcggtatccggcaatcccttgtcattgctgtctttatcccatttcaggccgtaaggggtatcaggaccgccccactccagaacctgaaactcgccacaatgtggacaggggacgtggtagtagcgttgatcactgtccttgaaggctttttctatccggctggtctcttttacggtcggcgtagaacccaagacaatttttcggttccagaatgtttcggagcgcttgatccccagtgcgatttggtcaccttccgccccggcaccgccagagggatacccgtccacttcatcaaataagatgatgcggcaagtgatacgacgaaacccacccggcgagttagcccccaccagggttaaattagccccgttggaaaactgcttcttaagaatggtctggccactgtctttggcttttgcctcccccgcaatttctttcagcacaggcgtatcacgcagcatcggcgcgatttcagtcttgctgtagtcctcggcatcctccacgcggggctgcaccaccagtatgggtgacgggtcgtgagacaaataatagccgacaacgtggtcaaggattttggtgtagcccacgcgtgccgatttcatcacagacacttgggtgacacccggatcggtaatggcatccatgatgccatcctgataaccaaaggagcggaatttccccgtctgggcgctgttctctttggacaggacggcgtatttattcgcccattcgcttaaggataaaggctccgggggacaaatatcagaacggcactgattcagtacaagggtaaagttttgccatgctgcattatcccccttgtttactgtgatcaaggctcaattcctccattgcctcgtagatgatttcctgtaaggccgcgacaaacgccgtatccgttgaggtggttgccagagctctcagccggggaccgtgttcaggggcgatagcgatcaatcgggtgcgcatccgagaatattcctgcctaacgacatcaatcatatcctgccacggtaacacctggccggatttcaggtcgtaatcgtactgggtcaagagcgccagatagttttccttcatggttctggcttcatccagtgtcatcgttgccccccgttcagtcagaatgcgctcgacaatttttgccggggtatcggggtctgggttgttacccgaagtgttaccttggagtgtgttaccctgtttgttacctttgctgttacctgctacttttttttccggtcgggtaacacttttccggtaacgcgcaatgttggcatttgatgcctcaacattaatatcgtcaccgtccgtaaccagccagccacgggctttccattgggtgaccgtcttgcgactgacaccgtgcaacttggcaaattctgactggttcatctgttaccctcgtgttacctgttacccaaatttcaaaagttcacagctagtgaaatatcgcggcgcgcaatgcccgtgatatataagatctcgggtaaggacccaaaaaattatgcgccgttaccatcgtgttacctcgcgttaccctcccactattacaccgaatatttaccatcgacgtggggtgggaccacggtcccaggtctcacgaccgaatcaaatcatccaatggggaacacagttcatcaggaatatcgatgtcctctccaatacagctggcgactattgcatgacacgctgctatcagtggtgtctcaccccaaccatcagcatcattgaataaacaatcaatatagtggctccctctgtatggattgaattcgttgtctttactgaatgcataccatttgtcaccagactgagccaacatgattgaatgctctgctatcaatggaccacactgcgcccagttggttgatggtttaaaattatatgaaccacgattagaaacataataactatcattgggcaatttcagccacgtacggccactgggcatgattttttctgtagcgccaatcgccaatgccaccgcccagtccaatgcctggcctgttaacccatatgtttttagtttcatgatttgttctcaaagtggtgttactttcgtgttacctgcaacaaaaagcagcaggaatggtcttattcagattgacgttgaatagtctgcatatcggataactgaaggccttttggtggctcaaattcattcagaatagctgacgcataaacatttgctttttgtctgttaacgggagcgtagtcttcatctatgcgcccgtttgtaacacgactgaataaaaccccttttgcaccaagctggataatccaagtgacggggtactcttcaaaaacgcgtgctcgtttcaggattaacttctccgtagcattgctaatgtcctgaccaaatgaaaccctagagcaatccaatgctattacccgatgctgctgtcgttgtgattcttctgctttctgataatgatataacagtttctgagaatgatatgacagcaatgatttcaggtcattttccgcaaaagtgtcggcttcagcctcacctttcaataatcgaacattctcaatatatctcagagacgcttcaatctgcgtattcaataatttcaattgttctatgtagttatgtgtcgtcatgtttgtcaccagataggattgtttgataataagtcacaaggtgggaccacggtcccaggtctctatctctttgttccgctagttgagtatgtcctcaaaatcaaggtctcctttctgcttgcaaccatacaccgtaccgcaagtcatatccgcctgagtatcaacaccgccgaccaatatacaatcgcacagcttgacatcctcatccgcttcatcacttccgctacctcgtttaggatcttctgtttcaagagcaataaaactatctctaatatttcgggcaagatattttgccctgtcatcgtcaatatagcctcgagatttcatctctataaatagtgcattggccaaagtatcccgggctgcttgtcgtgatgcttcagttaactcttcgaatttcataattaggttccttatatagggttgtgaaaaactatttagccgttctcatcgcatcagtaactatgcactggtatctatctgctgtgattttgactcaacactacatttaattgcagcacatagcctctggtgcaactcatgaaccatcagtgatgccaaactcggattaccctcgaatttactgagttctgatttcaattgattgatgatatttccaacctctgccgatgtaggcagtatcacagttggaattagttcatatttcatgggtttgtcttcttgttcaggtgggaccgcggtcccagttgctatttggccgttcgtatcgcctcatccaacgcctgactgatagcagcaggcatcaacgattgagccatttgttgcgcccgttcctgataaccgagcacgggatcaacgggtagagcatcaccaaaccgaatgagtagttttggcggacgctgcttcggtctctccctgcgagtgccattaggagaacgctttaaccgttttttccctttcttaactttcttagccttcttgcgctgccatacgccattaacatcattaccgtaccgcgttgttaattcgccgatgaacacatcttgtttaccctttaactgactcagcttgtttctgggcagattcccgtgtttgtttagcttgacgttcttggggttaagcagtgcagccccattcagcttatgcactccgccgacttcaaatggctccagataactggcagcggttggcatcacaaacactttcgcggtcaggttatctttgcgagcgccctgacttctgactgatttcactgtgaacgcagttgggttctccaatcgacgttctagcgcaaccttctgtgctttctctatatcacgcgcaacgctggttagcgcctgagccatagcgaacggaatttgttttctgattgctgccaactggttcgaaaggtcttttagattggccatgctcattccccaaacaaataacccggcgtactattgggctgtcattatttgaatcacctataatgaatttgctaatcacaggagttcatatgaaaaaattagcgatactgttagccgcattactttcgtttggtgcttgtgctaaaaccagagtcgatgtgtctaaaatttatgggaacattaaagttgttagctctggtgcggactataaggttaaggtcgttagctcgtcacccgacctgaaagtcaaaattgtcaccagttccgctaactcgccgggtaaatggaaaatggtaaattcattccctgattacaaaattcagttcgtaaactcattcccggactttactatcaaatacgtcgattcgttccccggcccgactaaatgattcatcttaccgacggagggtgttgcctgccctccatatagtaaaaaaccacccggaggtggttgtcataaagtgattggttatctaaaacgaggtcatggctccaataattagatattgcgataaacgtccccatttttatcggtgagatatggctaaagttgatgtagtttgtcgttattgtcacaaaattagtaaaagcgtgacctaaaaccaggtggtaccatccattcgataaatgcgggaagttgagaccaaaggaaacaggccaaacagaatgataaggcagctaccacgcctattatcgcgatacctacccgatcattaaatgagtaattttttatcttacaatccctgatccctgctatcaatacaaacaataacgttatcgtaataagaataaccagcggtaagaaggcagcacaaagcaccaaaaacatccctttcaacacaatcaaagctccttttgttcattagtcttattgaagtttcagtctactttatacttaggttactgtcagcgccctaagcatgggcaatatccgataatcggacttgggttctttgactacatagctatcacgactctgtgaatcatgatggcaatgcaggccgtctctccggctgtcacaccgcttcttctgcctacagcggatgttgctgataatgactgtctagggcattgattatttttgattccgacctgtacgctcgatgcaaagggaacatgtcatggctaatacaggcagacggcgataacccggcgcaaaggaactaatgtctgaccgctgagtaactgaattccctttctattggtaaaatcagcaaaccttgctcacctgattttccaaatgactgaacgcaacgagcctcaaagtctttgtaatccacgcagccgttagccagtatcgtgaccgctttcagttgctcctgtaccagtttccgggcttccggtttaaggtattgatggatcttgtccccgctacttttggctgcttcttttgcctccgcatataccgagtcaggcaacacaacctgatacacccacttggatgtgatcatcccaaacagtgacggggtgccgccaacatgacccttataaagcaaacctgacatacggctgagtgcctgataaaagggctgctgaaaacgcttttcccatgtggcgggcttatcaagaagaaaaatggcattgatgcgttggtcagtgaatgtgggttggataccacggatcaatacatctatttgttcatcacaccaaatttcgaagtcaacagacaaccagcgagcaaaacggatggcgagttttggatgtaaccatgtgcctccagttggaccacttttcactttcacaagtccgctctttttagcaaatctcagtatcttggctctagctgcacctgaacttattgctaacctcttgatttcgttaatctctggcacagtgccagaaataccaaatacacgaaaactaagagcggatatatattccagaacatcaatttgacgaagccatgctgtcggctccttatcaaacttcattgctatatcagtggcattgatccacccctcttcattaaagcgaatagggtgaccgtcatactcaaatggaatgatgttactcatcgggtatttccttatagaaaatcgaacctgctcacgtagaaagccgcccgcagaaatacccattaacggatttctcaggttcgactttctgtaaggctgcgttttattgatatgcgcggtgagtgcgcggaactcagatacaaaaatgccacccgcgttaactgatggcatgggggattcctttaaccactcaagggagtgggcaaagaaatattgactttagtttcagaggttaactaattattaaatattattcgcttgttattgggcagaaataggcttaagtgttgttgcgataatgttacttcaagcgaaacatggagagtcaaatgaaaaaattcattcttctttgcctagtggcaggcacgactcttttagcttcaatgcagacttatgcttatgcctgcatacccttggttctatatccccaagcatatataaactgtatagctagatgcggaatagagagtccactctgtatataataacaatcaagcaggagacaggatgactcctgcaaccccagtatcatttgctctgcggtggcaaggtgttcttttctatttcccgtatcgccttttccaaatactggatacgctgaaaaagaaatacagccagctcagcccagcaaaagccaccgcgctgatggaatcgctcaaatgattgagcatcaccaaattgttttcgatattcctcgaaagcggcttttgctatatccacgtcaatttctctagcggccgcttgttgaactggcgctttcatttcttcaccttataacattcagtgttaacgtaatcttgcaaatacttagtctgccgttcgttctccgccatcattcggaggagatcgtaataatcttgtcgagctgcttctgtaagttgtggggttcctgcgtcgcccacgctgccggagggagtggtttcatgcacgggacagacggctttgatgcgcagcttgcgacgaccagcggcaacatcagaccgaagagtgtcaatttcagatttggcattgtcgagttcccgaatgtgtttggtatcgagttcatgcagcatatcaatgtgcgtgttctggtagttgagggtgtcggtcagttgctggatttcggttgcttggcgcccattagcctctttctgtttctcatactcagtgctgtaatggtagcttccgaatgtggctatgcctgtggtaacaatcagaacaatgatcgtgtagtgggttagtgtgagtttcatgacaaaaacatctgttgctcagatgccctacgccgagtcagaccattcatcaccttaccagccgccttattccatcggggaaactctgccgctgcacctgcgtaatcaccggcattgattttcttcaacaaagtagagccggagaaattaccgctgccgcaattgaagataaaggagcacagcgcatcgaattggccttgtgtcagtggcaccttaaccaatcgctccagtgtagcgtaagcgggtatgaggtcatcgtgtaaaaaggcttcggcctgctgctcggtaatgacttgcccgggcttaacatctttcgtatggccataaccaattgtccacgggataccacctgttgccgggtcaggataggctttcagctttagtccttcccattgctggatgaagcccagacctttattgctgattttcatcagaagatacccccgctcttttctctgccgccttacgcagcaattgaccaatgaagtctgtacccaagtagccgatcaccacactgccgatgtaagccaagtctggattcagacccatgaaatttaaaacatcacgtatgaaccaggcgaacatggcacacataaaagcgtcgattgaaacctttacccagccgccaccgttatagcgaccgcgaaaaaatgccatcgtccctgcaagggttgcccagatgccttgctctcttaccgatatgagccagtctccgaggtgcatccagaaatcaggattctctttcatcttcatattccaccccatttgaacaatgggcgtccgtggggtgagctatggtcgcccctgtgagttgagttaataggatgccgaccgcaataggaaatacggaggtactgaaagtgattgcggcggcaaaattggcggagaatctcagattcgaactgagacaccgatttctcggctactagctattttcaagacagctcccttaccgttagggttagttctccaaaaagtaaaaaggccgtcattagatggcctttggattaatttatgtgctttgtgaaaattataattcacaatagtgaggttggagcgcctcataccactgacgcagtgttgatgctcttctgtttatagttttcatactcagagacaagcacttatctaacaagaactcttcggctgttttaggatcaatgccattaatattatttgcaccactccatgtgacccaagcccatccacaatgactggattcaaaacttcttgctgcaattcttaaacgccgatcttgagaagcctctgccagttgctgacctaacgcagttacagttccaccattactaatgaagccgagtatttttgcagcgtggatatagtataaaatatgtctatcatccaaccctgttgactgtagattaaggcgcttatcctgccattttaaattcactatctcaaaaaccttcgtgattatatttgcctgcggtacttgatacccgccaacaaactcactggcaagtttagccagagttttaatataaaactcagcatcagtctttcttatcattaatatgaggtcatcggtactattactttttaattcaaggttggaacttgtctctataacactttggaataaccccgttagcacctgaacatcgatattgcgttgtctaacaaagctagctatgtcgctgtgatgtaatataactgtattcaattcttttagtaatggttcaataccttccattttgtccgcttggaaagaaagagcaaaagagccaggtctccctgaaacaggcatcattacatctttttcatcaagagacttaagaatagagttgtaaagttcattaaaaatatcaaatacttttgaaacaccactgagaactaatggctgtgtgctatttgagcttttctttatatgtatctcatgcgttgagaactcaatgggtttacctagtttgcccgtatcaaggactggtgttaccccgctaatatataattgaggcttgggcagttttatagctgtaactatatctttgattccaatcgcaaaaatacagactcaacactatcatcatagtttctatttacctgataataatacttttgctcctgataaactaaagatgcataaatatctattttttttctttctaagtattcaagacgttctttagatataggaataactagccatttatcataatcataatcatcacctatccaatatacaataaataaactaccaacttcattggagacagagaaaaaacgaggttcctcgaaatactcataaatatttctcatgaataaagagcctaaatgagtatctcctaaaaatacagcgctcatttaaccaacccccttatacatgaaaactttttatgtattttagttccatctcctaaccataaagtatgatgagttgaatcaggttcgcctgtctttagcattttaccatcagttcgatctaccacacccttcgcaatgtaactgtcttcagttccttgcgggaacttttcaaatgcgttcaccgcagaagtttcatctgtaaaaacagaaattccatagcaacatttaagactcagtcctttgaatttatttagtcttttagggtttgattcatacatatttttaaaacaatcaacggttggaggtgatgttttcacaatcctgaaaaatgcaccttctgcgtcctgagcttctcttggagggactcctcgcgggtaataactcggaaatataacctcaagagactcgaccattgctttctgtgtattatttgccatatatgcaacccaaattgtcaatttaaaactgccaacataatggaaagaaccatttttaaatcaggtaatccattggcatcgcatcaaatatagcaaaacaaaagatgaataaatacactgttcaaacaaacagatagtatttttatactatgatgactaagcaaaaaactacatagtgttctagtgattgatcaaccacacaacatatattgaaaaatatccgagacaaaacaaaaaggccacaccggagcgcaatcttgaatttgaactagttggtctcgccaacaggttgagttatctatggggatcgaggtgttgaccacgccacccaaaatcacacttaacctattgatttaaaagtaatgtaggtgttgaccgaccatgatcggttatccggtgtttccggtgagttgaacttgtaatgatggcttatctcggcgatgcagtaacggcaggccgataattcagaatgaaattacgaataatcttttcaatgttgttacttattgagggaaggttatctcccaaatcaggatattgctgagttggcttaacaatataccttaccttacttctacatacagtaagttcagcaaatggcacaacatagaaaccatcacttttattatcattctttatggttactataaatagttgtcgttttatatcattccggcaactcaaccgcctgataaaaaattctttctgggaattggtgtcaaaaaacttatcgactatctctgtcgaggggctaatagtctgagcagatctggtatgttcagttctcatatagcctcctaacaccatgaaataaaataaatacttaattggatgtttgtctcaacaaaaagccccgcactgggcgaggcttagaattcgtagtgagtatagttacaagttcccactatttggagatattaagccaatgccggacaaaaagcaacggtttattttgtcatcttattaaatgcagcttcggcacgactttcttcggcataacacttactcaccagtttttcataaaagggtttccagttccgccgccatgtcctttcgttcaactctggtaagtaagccttgattgccgtataagccactgatgatggcactctgctgtaaccccgccctgagcatctagggcagattttatcaaccggtacgccctgtaatgcggtcttttcttcatcgactacgacaccccgccccttgcagcgacaacgacttgacagcttacctttcccgttgcacttctggcaaagttcacccacctgctctttttcaatccacggcgcaataatcacttcaccgtccgcgcgaataatgccgggatgtttttccacttctttcatgccgtagataagtcctttcccgcgacattccgaacactgacaagttgacgccgctgaacgggcataatcttcaaacgccatcttcgataagataaccagacagggccccagtttattccctgctgcctttgatatcagcttagggacagttcgccttgcatatcgggtcagttcttctacggtactgaacttgtcttcttcactgacctcattcttggcgaaaaatgccgccatcccgaacttggcttgtgatcccgccatccccaaagctgctgcggtatccatgcctttcattctgtccggtgcggtactggttgacgcatcactgaacgtcggtgttttcgggtgaaagtgttttaatgctgattcaagtttcataccgcacactcccccaccagattaagaataattttgtcggtcagctcacgatcatggaaccgttcttcttccagcacccacttacagacatcgatggcttcctgacggcttacggcttggatagtggccagttttccttcgagataaccttcccggtcatagatgtgatacctatcaccatcaccgtatccacccggatcaagttctttagcggctacattacgcatctgatataaccagtcccaataaagaaactcacgaacaacatcagacaaggtgcgcggttcggggagttgttcagcaaaccctttcgccgtcgtttggcgtaatttatccgtttcgcaaatgcgatcaccgtgcatacacccttctgcctgttctgtttcgttccagtagtagaaaggttcataaatgtctgacagctcccccaccagcattaatttctccggttcagtgagttccagtgtggcttcatagctggcaaaagacgccctcacctgactggcctttttgatttgctccttcgcactgtttatataaccttgtgggttatccatactcatagtgccaaaggctatctggaaaggatgtgcacccgatttcatcaggtagtcagaatatttctgctgggctgccttgggggtgattttcagcttcttcaaggcttcctcagcggcctcaaggtgggcgggttcattggtcttaatgactgccagtacccacaggtaagcatccacctgtttattgccggtgatcttccgctgaacaggtaacggtttcaccgtggccagcgccgtgctgtaacgaggctcagggatagtgaaaagggttttgtgtgctgtgttgtccatcattacgctgtctcccgcagcttgataactctgatttctaccttggattatttcgctttacatcagtggcgtttctgaaactttcccgtcctcatccattgggtagaaggcaatcaactcatactcccagccattatcaggagctccatcttcatacttaaaagagaaagtaaacaaataatctccctccatttttagttctggcgaggacagcatgaattcttctatctcttttaattcatcaatgatggtttcaccttccacataacaaatgaatgggtgaaattctttttggtaatgaacttttaatgtgatcgttctcatacatttgctcctttagtaaagcgtttatgaggtttgttgttgttctggcaaactctggccgcttcttcctgatcgaccgatacaaagtgaccattgcggaatcgctggtaaactgtaccgagctgcccgaacctgtttttcgttacaataatttcagcgtatggtgctgcgggggaattctcattgtacacggcatcgcggtacaacatgatgatactgtccgcatcttgctcaacactgccggaatctcgtaagtcagcgtttacagggcgtttattgggacgcgtttcaacattgcgggataattggctcagggctataacaggcgttttgaggtctttcgccagtcgttttaagctggaagaaatatgcgccacggccagatcattacgctctgcctttggcttatcaatcagccccagataatcaaccatgatgagagataatgccgggtgtgctttcttgtgacgccgtgaaattgaagcaatctgctccaccgtcaatttactggcatcaatgatccatacatccaagttttgtaatcgccccaaaccaacagtaacccaatcccaaccttcatcatccagtctcgcaggatttcgtaaaactgatactggcaggttagcggctccagccaactggcgttcgataatctgctgggaatccatttccattgagaagatcagtacgccgcgtttctgtttggttcctgtgattgtctggtttgcgactccctcagcgactttcagcgcaaactctgttttacccatgccagggcgagcagcaacaatcaccaaatcgactgggttgataccaccggttatctcatccagctcttcaatgcctgtcttcaacgtgtctgattgctcgccatttttgagacgtttctccaaaacctcggtgtaatcatccagtaactcagaaacatgcagcggacggatctcatcgcgtggcttacgcacctctgcaacttgggaaataaaccagtccatagactccgccgcgttctcaaccgtgccacttagaatgcgttccttagcctcgtccattaactcaatcatgagtctgcgttcatagttggctgaaactttgttcgcatagccagtgaggttagcggcactggggcagttcttggcagtcatcatgacattggcgaaatgattctcacccatcgcatcagccaccatcagagaatcaattaaccctctggtcttggcctgtgctctgatagttttgaacgtttcacggtagaacggggtagcaaatgcctctggctccagcgttgccaatacatcactggcatcaggtgttaggccactaatcaacaatccgccaattacactggattcaaaatcgtaattattcatggtctttctccgcaaatttcccttcacgaacgccggttaatgttttttctctcagcaaataatcaaagtctgccgtccatccgctatcactcccaccaaagaaaaacggcctagcctgaccaacgaatgcccgaacataggctccgaatccgtcaacatttggcgttaacagcttgggaattaatttctttaacgctttctggcgcggagtattgatctctacagcatggggcaacctgtcaccaaccgcctcattgtaggcattgaggtattcgtcgtagttgattttgggagtgggttttcgctttttaggtttagcaacctctccgttattcccctcgtgaggggtaaggggtgtattactttctttcttttcttttgtaatagtatcttttgtgtgtccctgttttggtgacagcactgtcacgcttttggtgacactttttgtcactgttttggtgacaaagtcactattttggtgacactctggaatttcccattcagataagttcttatttggccctatcatcattccaactttcactattactttcatagtgatgagttcattttttgccttgttaactttctgtcttggcagtctggttaactggctcaactgactatctgaaattctgtctacttttttactgaaaccgtaggttttcctgcaaatagcatgagccactttcgcttgatttcttgtcagatttgccccaatcaactcttcataaagctcatttgccagtcttgtatatccatcatctgtattggccactctttcccccgaaccgaaggttgtaggtggacttaactgaatgacgttatttaccgctaagctacccatttacaacccccggcttaaacactctgagaatctcgttaaactgttctactgaaaaatcctctttaagaagatcatcgagaaacttgtttggaatgaatgtgaaaccattttcttttggtatatgcgggataagctctttagctctgcgtttgtaattttcaatcgatacagccttattcatcgcttcttctctccggtcagctcttcgcaatattctttgagaaacatcgcccgtgtgctggctctcagcttcgccaacgtctcttgtatccatgtgccatcgtcagggtagaaatgcgatggcatggtgaccttggtgaaattaggaaacatggtcatgttctgtgggcggtggaaacactttaggcagatcaggtcgtagctcgtgggcttggactgcgccgtttgtggcctcgacgattatcaccacgttctctggtgatattcttttcttcccagttaaccaatcacttaccgtggattgggctttgccaatatgttctgcaaatctcttttggctaccccaaagctttatcgctttctctattgccgtgttaatcataatctcctcagctacaaattaatcgctatagctattatacatatcataaagcatcaatcaaatgctatagcgattttgatttatcatcgccatagcgatatacttaaataagtagagatttattaacgattactcataaaggttaaaaaatgacatttacaaaaaggctgaatcgtgcaatgcacgaaggcgggtttagccaaggctcattagccaaggcagctggtatggctcaatccagcgtatggaaactaacatcaggaactgcaacccgaaccactagactcgttgatatcgctcgcgttttaggtgtgcgcccagagtggttatctgatggtaaagagccaatgagaaccgaaaaaaataacgagtcagaatgcaatgatatggaaatcattgaatataaaggaatgtttccggttgatatgtatgaaggggatgagcctactggtgatcggataatgattcctaatttggtggaatctgaaacctgtagagcatacaagctacatgtgaatagtgggtgttcggaagctcctgccggcgcaattatagttattgatagtaatgaggcagcaggaacaaatgatctggtatatgccagagtcaacaaagcgttatcagtctataaattcgttcagggtggctctcatggatatctatctgttgacgatagccgcgtcccactagttaacgttggaagccctgacgttgaagttattggagttgttgtattccttcttcgaaatatgaaacatcgctgaaactccacctgctctaccatctctttatttggaacgggagttatatacctcccagttccaattctaattaactgagacactttcaccctcctaaactgtacacatatacagcattatactgcatcaattgtaacttgtttgcaataacataaattctttattttacttcataaaaatcaacatattatctatttccttgaaaaatacaccaaaaaataatcgctttggcggttgacttattaatcgctatagatattattgctgcacgtagtacagaaaagaaagtcgaacactaaagaatcagtttaattacttttgttttgtagccggagggtctaatggaaagcggtaatcaaagtacgacctataatgtcgagttagtccagaagtacggccttgtcgattcgtattcaatcgaatacataaataaaaaacgccccaaccactcattacttaaagggcattatggtagtgaagtcatatattctttatatataatgaatggcgattatatggtgctggtcgatgcttttaaaaccttaagtgaagccaatcaggaagctcggaaaattattggtaattatccccaaacggaaaaaaatttagcatcactagataataaaggtaattatgaaaacttttatcttcggcgcaatagagcgagctaacacaaaacaaagccgccctatatgcattaaggctcaggcaactaatgagcaggaagcgagaaagtcactagctcctacgcatgtaattttaggctggatgggtcaaatagttaatcgtaactgagataaacaatattaattctgataggaattaaacatgaacaataaactacaagcagccgtcgagattgcagaagaaatggaaacgttattagttccattgatggtcgaaattgaagatggagataaaacaagcgcatatttaatatgtcggggtatttatcgtcaatctaaagtattggctgagaaattaagggaagtagcagggggggggtaatactaattgtaaaaataaaaatcatgaattggaaaacacccaaaaactgtcagagaaattacaatcacttttacagctctggatggaagggaatttaactgaggatgatgcttatattttaagtatcgccactgacattaaccataatgtattgcaagaaatagcacgagtcagaggagaataatgttcatgaatgacatccgaaaacacatttgcgttaatgaagaccgtttatctgaaatgaaagaagatgatttaaattatctaatctcatcaagtgaagatgtcatactcgcaatgaccaatggattattatctattggaaatttagcaagtgccgcagttcatagtgaagaatattcccaagatgatgccatgactgatctagaaagaatagcgcacctgttaactgtagtccctcttattatagaagcggaacacgaaaacaatattagtgcaggaattgagttaagagagagacaagcaataaaaaaagaaaatcaattaattgaatcaataaggaaaaaatcatgaaaaaatttgcctctattgaaaacgccaccaatcaagatatcactatcgaattacgcgatgtctatgtcgttcgcggttccggcaagacttatctgagtgagaaaggtgcactgaataaactggcttacgttcgggcgcaagagcaattcaatgcagaagacagaccaagcaacttccctgccgaagaagtcattcaggaagacggcacccctgcattacgcaatggtgagatgcgacctgagtttatagagctacacgctcaggtattggaggaactgaaagctgatgttaggcgggagagagatttaattagaactcaaaaggaacacaaaaaggcaatagaaaaatacagaaaagcccaagatgaattaatagcactgggaaataagattcttaaattaaaatcaaaataataaaaacaacaaaataaatttaattacagcgccattgctggggattcgatcacgctaaattcaggaaatagcattatggaaaatacaagtttattagccagaagaagaaagtcattcgttaatgctttctttgagcatttaagaaaaaaaggtaaggcatcatcatttaagcgaaaagttaacggcatcgaatatcaaatcgatttagatgacaaggtatttactcaggcattaattactctttatgaaaataaagtatgtaaagcagcaagaatgaacgagcaacagattattaattattacgctgagtattttaataattacggaaatctcacgccagcaggtaaggagtttattagcttcattacagaactaatcgctaaacaattacaccagaaggacttaggtaatgacaaaacgaagaagtaaaacccgacagggatttgatggaataacaattcctcagttattccgattaaaagagaactcaataacagaatacgcaaattcaaaaaaatttatcgccccttattcgataggtgacgaagtgttaataccactcaatcgggcaatgagacgtcacgcaaagaaaaaagggatcaaattggaagaggtgaacaatgactaagaaaaatgaattaattaccattaataaaactcaaatgcctgtcgtggaatatcaaggacaacgcgttgtgacgttctcaatgattgatcaggttcacgcacggccagaaggaacggctgggcgcaacttccgtgaaaatcgttcacgcctgattgaaggcgaagatttttatgaactcactgccgacgaaattcgtcgtcagtcactaactcacatttttgcacctagaactccaaaaggtatcgtccttacagaatctggttacttgatgttagttaaatctttcaccgatgacttagcttggcaggttcaacgcgaattagtgaatagctacttccgcaggccacaaacagtactgagcgaacttgaaatgattgccaggatcgccagccatacagcccagcaacaacgtcagattaaccacattggcgaacaggttgagcaggttcatgaaaccgttgagcaaatcaagcgcggaaccatccctgtcggttggattgggttctctctggctgcgaccgaatcagggctaaccaatcccaaatgccgcactttggctgaacagtacaacgttcctattgataccgtcaccattatgacaccggacggacaacctcgccccatgaaaatcgtattcaaggaagacttcataagtgcgttccatctgatgatgggtgaagccgagaagcgtggtactcgctggacgcatcccaaaatggggatctttcaggtcatcggttgggagggcaagcaatgactattcgttcatattcgccacatatcgccttggttcatgtaaccaaagaagaaacacccgatacctcagcatacagtgagaccgctgaaatggaaaaagtcacttatatccccgtaatgaactatgaccacaatttaactctttgcatgagaaaagctgaacatgtagtcaggctaacattcgcacaatgggaatatcgccaaattgttgatgtagtcgtcactgccaatattcgcggactgtatgttatcggtcaggcggttcaaaacctgtatgactctttgcccaccatatcattctttaaccatgataccgacaaagacgacggaatggctgagtttcatgtgggtatccttaagtgcattgacgaaggacaggaaggagttgattggctcaacgaaatgcttatcaaagctgaaattatcagcatcaagccggaggtgaagtcatgctgattgcttctgatttgttacgcgccgctttgatctgtgtggccaaaggcgaagatgcggaaaaacgcccccaattatcgggggtgcacattacccgaaaacatcttgaggcaactaacggtcatgcattggtacgcatggaactcacggaaaacgtcattaactttgatgatgatactgacgtcgatctgattatccggttctgcggcgatattccagaaaaggcttgcttcacagacatccagttaggtgacgaaccaaaggctttccatttgggggaagacgaggtggtctttagccttactcatctggagataatcaacgggcgcttccctgatttagacaaagccatcccgacagagaaacagaatgttatcccgtactttggtgctaagtatctggcctacccctatttgatgtttggcagaggggcggtactcatagaaccatccggtatggaaacagcttgtcgattccggtttggcgctttcacaaacaagctttacggcaaccctgtttttatcgttctaccactttataaagacgctttcgaagctgccgagcagaaggtaagagagttggaggctgaccgtgacagataagcatcgccagatggcagacattgacgatgtgcttgttaaggccacattccacatcgacgacggcacagatcaaacacagcggctcattcatatcatgaggcgtaaccaacatattcatgagggcatctgccctcctctgccacccgcaccgaaagtggccgaagtgaaattaacaccggtgaagaaagcgcgtaataagcgaggtaaagaataatgatcaagattaatcaatccgaattacttgtcgccatactcaatgaagccgcccgtcagaattccggcattgaaatagaggaacaccagttcaacgaaataaccaaagcagcagacttgatttgtgccgtgcttgaagggaaagcaattgaacaacagatgataccttgggtaaatgttcaggacagaatgccagtagatgatgatggctactctccaccgtgtcttgtttatgtctcttgcggttctctctccgggggtggttacgaccactgggacacaaacataaatcaatggtcagtgcacgaaaacgatgaagtaacgcattggtgctatatgactgatatccctgctccagtaacaaaggagaagcagccatgatcagtaactccttccacttgactcaaatcatcgcctcggtctggggcgatccttctgacatcaccgatgcaatctggcaagcaggataccgtaagccagaacggggagaaaaggaaatcgccgagcttattattgacgttatgatgggggtgcctgatcaggtgccctactctgaaaggccgaagaatctgaacgacattctaacaacggagctgaacaacattatttttgatgcgacatggagtgacactgtaacaccggcaacggtggctaaaataattttggagaacaggtatcagaaaggagaaaagcaatgagaatgaacacagcgttcttgttaatggcagagtttgaaacctcgcaaattcctttgtcaactatagccgagaaataccttaaactaactcccgcgacagcagaacgtaaggctattgaaggcaagttaaaattcccgacatacagaatgaatgacagccaaaaatcaccacgaattgttcatgtgcacgatctcgcggagtacatcgataagcaaagggagttggcagcaaaggaagtggaaagaatgcagtttaaaagaaaataaaaaacgaactaaataagatttgattaactgtcactcgggtgctgctatcacggcaccccaatagcaccccaataaatcataactaattgatttataatatcatttaacctattaagaaaaaactcaataataagcacaaatgccctaatgttactctcattagtctgcccctcagaaataacgtcaaaacgaacgaactttatctggcggagcatgaaaaaacaagtttatccctcatacagtaccaccaattatgctgtaggcgggcaattaatgagatcgtttggcttctggtcggctaataagccagacccccaataaaataaaaaggactccagccgttttcaaccatgagagggtttcattaaaccaaggcaataaagctgccattaaataaacaaaaacgtaactcaggctgattatcggataagctttattcaatggcaggtattgcagagcaaaaagccaacataacatggataatgcataacctgccaatcctgccatgaccatcaacaaaggattgtgatgtgcccaaaaccaatctatatccagccagtatgttgataacgaaagctcaggtaaccgaacaactccccatttcaacaataattgtgccacagtgaccagcagcacactcgccaacccccaaagataacctctcattgatttagactcatcaataaaattccgaacataattgcaaaaacgcctatccagtgttttagccccactttttcctgatacaggaattgcccgaccagagttactacgacaaaattaatactaagcatgggatatgcaatactcaatggcaaatattgcagcagtcgcagccagaatatcatccctatccccaacaaaagaatagcacccgtcagccagatcgccacagatacccccttatggggggtatctgttttctgccaacaggtgacggcttgtttctggcatagctgtccggcacaggtcagcaggctaactaatatcaataatgctaaattgctggtcatgattgctttttataaatcacaagaacaaaacggtcactacggcgcacaagatcaggtttaggcaactcaggaagacctccttttgaagacaataggaaaacaatcgctacttgaccttctttacgcgctttctccagccacgtagggaatttttcttgtgctacatatcggtattggctgtcaggataggcaagaccgtactctaactcgcctgtgcgatcaaacatgtaaatgtcactgcgttttaattcccatgctaccgcggctcccaaacccactgcctcagataaaatatatttactgtcagccaactcttgcacattttgcctaatgaaactctgaggcagtttagaatcgatagtcctgttgggcaatgcgctaccaaatgtcaaactgagtaccaatgaacaggcggctgcccacatccaacgtttgccattatgaataaaacacaggtaaccaataattccccaggcgccaaaagccaccgttcccaatacccattttggccattcgctgggttgataaaaagggcgatttaagagtgtctgcataacgagtaacaccaatatcgcgataatgccaaagagaacattcaccagcccattcattttcagcgctttcatgttgccattactgacacaatcaatactgtattttgccatcatcagtgccaaaggcccgataaatggcaaaacgtaagtcggcaattttccttttgcaatactaaagaagacaaatggaatgatgaaccaacaaagcaagaaaaacatttctggatggctttttttctctttccagcttttcatcaaggaaccaggcaataatccaagccaaggaagcacacccaacaccagtattggcaggtaataccacatcggtgcaatatgctgtgccttatctgatgcaaaacgttgtatatgctctacccagaaaaaataatgccagtaatcaggttcccgcagggcaattgcaatcacccacggcaaactaatcaaaatagcgaaaataacagcaagtggcccaaagcgaaccatttcccaaaaacgtttctggtatatcgtgataggtatcatggaaatgacgggcaaggctaatgctaaaaagcctttagtcataaatgccatgccacaagccagccctaaggcagataatgccaacattcgctcacgagtactgccagctttaagtgcccaatagcagcttacaatccccgcagtgacccataaagagaacatgggatcaaggacgctataagagccaatggaaaaaacaataaacatggagatgtaaatcagactggagacaaaagcaatctgacggttttgccacatcatcatcgcgagtcgatagagaagaaatgcgctgagcaaagtgctgaacactgagccaaagcgaacggcgaagttgttgtctccaaaaatccattggctaatattattgaaccaataacctgctaccggtttctcaaaatagcgaatatcgaagaaataaggaacgatccaatctccgcgttgtagcatttcccggctgatttcggcatatcgagtttcatccggctgccacaaaaggcggccattcaggggtaataaataagtaagaataaaaaaaagagccatcaaaaaggctccaactctacttgcccaactattcaacatgtttgcgtcataccttttgttgacaacctagccagccttcacgaccaggaaaatctgaacggacaattttcccaacaggaagcgtttctctattttcaggtagcaaatgacttaatttacaaaactgaatattttgctgagggagcatattcagtaaggtttcaaactgtgaagacttcgacatgccctcaacttctgtatgaatagtataaacagaaacaccaagatcatttttaatttcatcaaggataaagcgattgaaatctacatctctgacctgtgttccaacaacttcatcataggtcggtaatgtgacagggatttgcacagtgccaatggttccatcgggtaatagtggcctgaatgggtgtgttccacgacaatcactattgtaatcaaaaccaaatcgctgtttaaccgtcagtacacgttcatccgcccgccatcctgcaactgccgagcacgtaatcgcttgccctgttgcttttttcaatgcatcaatacctagctgcacctgctctgctaattcaacctctgaccagcgctctactttggcttgccagccttgatgatcccatgcatgcagaccaacttcatgaccagcctccattgcctgtttcatcagataccctaaatcttttgcgatcttcttccctggccacgccgtaccagccagcaagatatccaaaccataaagggacgcggcatttgatctcaacattttccacagaaattttggtcgcagtaggcgccacaaatggcgccccatgttatccggccctacactgaagaaaaagctggcctgaatgtggtgtcgctgcaaaatttcaagcaattgcggtacaccttcctttgtgcctcgataagtatccacatcaattctcaaaccaactttcttcatcacattattcccaaccatttctaatcttcccttgttaattcttcaatttccccacgcaggaagaaatctagtgtttcatcaatggtttgtttcatatcaatggttggtttccatcccagcagacgctccgcattcttgatgctgggtttgcgatgttcaacatcttgatagccctgaccatagtagctactgctttcgatctttttgaatccggcaaacggagggaaatttccgcgcaattcatgttcttcaaaactttccagcaacatttcagcgagttggcgaatgctggcctcgttggttgggttaccgatattaataatttgcccgtcacacagtccatcacggttttcgatgattctgaacagagcatcaattccgtcattgatatcagtgaaacaacgtttctgctctcctccatcaaccaatttgatgggtgagccttctaccagattcaaaatcaactgagtgatcgcccttgagctaccaatacgcgccgaattcaggttatccaatcttggccccatccagttaaatggacggaataaagtgaatttcaaaccttcttttacaccgtatgcccaaataacccggtcaagtagctgtttggatactgaatagatccagcgttgtttattgattggcccgacaatcaggcgtgaagtatcttcatcaaattccttgtcgtcacacatgccatagacttcagatgttgacgggaaaataattcgtttattatatttcacacaatagcgaacaattttcaggttctcttcaaaatccagttcaaagacacggagtggattacgggtatattcaatgggtgttgcaatcgccactaatggaagaatgacgtcacattttttgatgtgatattcaatccattctgtatggatactgacatccccttcaataaaatgaaaacgtggattgccaataaaccgctcaatggcagaagacccaatatccattccatagatgtcatacttgccatcgtttaacaaacgttctgtcaagtgattgccgataaatccattaactcccagaatcagcacgcgcttacgacgactgatttgtgcggttgctttcgatccgactcgaacacctgtcacaatgcccatttctaacaccagtcggcttccttgaacataaagaccggattcgccctggccactggtaatttccagtgcaccttctccacaggcaatgacaaatggagcagtagaaagcaccgttcctggaagtttgtcatgaacctgagtgagtggacgcgaacgccaaaccgtgattttacgctcgccaaggaacgtaaatgccccaggatatggctcagttaccgccctaaccaggttattaatctctttagcagatttatgccaatcaatttcgccatcttcagccgtacgacgaccaaaataagtggcctgattttcgtcctgtgggatggacaaataatgacttgattttatttgaggtaagatactatccagtaattcaacggcggcctcgcggattttgccatgcacatccagtgaagtatcggtttcaccaatcagtacagtctgctgcgcaacgatatctcctgcatccggctttatcaccattttatgcagtgtcacgcctgtctcggtctcaccatttaacaccgcccagttaacgggagcgcgaccacgatatttcggcaataatgaaccgtgcaggttaaacgcacctttttctgctaaagataaaagatcctgactgagcatgttgcgataataaaaagaaaagataacatccggcttcatctcgcggatgcgatcaatccaaagcggatgatttacattctctggcgcaaatacaggtaatccaaaatcggcaccaatgcgtgcaacagaagagaaaaaatggttttcattcgggtcatcagtgtgtgtaaatacggcctgaatgtcaaagccagctttaatcagtgcattaagtccgacacaaccaatatcatgataggcaaaaattactgctttcattagcttttttcctgattgtcgttgatctttctaactccgactactttttgaataaaataacgcgggcgggcacgaacatcgttatatattcggccaacgtattcaccgagcaatcccatcgcaacgaattgtgcaccaatgaacatgaaaaggatggcaaatagagtaaatacaccttcagcagcccatattgatccgaaaatgaggcgcaaagcgatcagtaataccgccagcagaaaacctgtcacagcaataatgcttcctacaacactcaataaccgcagcggcgcagttgtcaggcaagtcaacaggtcatacatcagattgatcagcttcatgaaactgtacttagaatccccaaattcacgttctgcatgagttacatcaatttcagtcgttctacgggcaaatgtgttagcgagaataggaataaatgtactgcgttcatggcattgcagcatcgcatgtacgatatgacggcgataagcgcgcagcatgcaaccgtagtcacccatcgaacggcctgtagccttagttatcatcgcattgattattttggacgcagttttacggaaccaagaatcctgacgattggcacggcgagttcccacaacgtcatacccttcttctgccgttttcaccaaacgggggatttcttctggcggattctgcaagtctgcatcaagtgtgatgacaagatcaccatcagcctgatgaaatcccgccatgattgcagaatgttgcccataattacggttaagtaaaatagcaataacgtgattttcgggggtttcagccgcctgagttaaaatatcggcagagctgtcacggctgccatcatccaccagaattaattcatatttctgctcaagttgttggcacgcagcgatcgttctttccaataattggggtagactttcttcttcgttataaaccggaataacaaccgagactttcttaattttttcaaatgtcactatttctatgctccgaaagaatttcagtgattgcattcacgacacgatctacatcgtcattattcatgtctggaaaaagcggcaacgagcaaagtgttgccgagttccactccgatgcaggcaaagacagcaccggataacgttcccgataatatttttgtgtatgtgcagccctgaaatgcaagcctgtaccaatatttctttcttttaaacgtgccatgaaagtatcgcgatcaataccacagacatcttggtcaacacgcaccatgaatagatgatgggtatgcccgtgttcatattcaggaacactcaacatttgtaacggtgaattgctcagtgcggcagtataccgagctactaactccccgcgacgggcattcatggattccagtttgcctaactgtacaaccgccatcgccgcatgaatgtctgataagttatatttaaaaccgggctcaatgacttctgcctgaggtttcctgccctgaatctgccgatcaaatgcatcgacagccaatccatgaaattttaggcagcgaacccggtgtgcaagctcgtcattatccgtaacgaacatgccgccttcagcacatgtcatgtttttaatggcatgaaaagaaaagattgccgttcctcgctctcccacccattcatttttataacgggttcctacagcatgagcagcatcttcaatcagagggatattagcttcgtcagcaacaatacgcagggcatcaagatcacaaggtgcgcctgcataatggacaggaataatagctttagtgtttggtgtaatcgcttttctgactgcttccgcacttaccatcagcgtatcacggtcaacatcgaccataacaggctctgcgcccagaagacaaatcatgttgatggtggaaacccaggtctgggaaggggtgataacttcatcacctgggccaatgcccaatgctagcagaaccaaatgcatccccgccgtagcagaacataatgcaattgcgtgtctgcaaccaaatatacgagaaaaatcctgctctaactggtggttttgtggccctgtcgtaatccaacctgaacgtaaaacctgttctattgcttctatctcttcatgtccaattgctggacgagagaatggcagaaaattatccataatcgctttgcgtagcctgattcgttttataattcccaaaaattctaaatgacgtttgttcaacgaaacatcaacggatagacaaaatcaggggcaatcacaataccaaaaagagattaaaagcaaccaattaagacaatatttactaatagaaatttaaagatgatcgaccctccatagtttatagctggtattttggatatgtctaatatttacttcaaaaatttctgataaattttgattggtcataacattttgtggtattccagatactaacaattttccatgcgacaataaccatacactagtagcttgttcataggtgtgattaagatcatggctgctcattaagaccgagccgcccaatgaacaaaattgtttgattaactgatccaaaactgcttgctgagtaatatcgaggttgtttgtcggttcatcaaggagtaataattttccattcggattcaactctggccatatctgcaaaaagacccctgccagcctgacacgctgccattcacctcctgatagttgcccaattgacgaagacagtaatgaagtgagttttagctgccgacaaagttcatataacacactttcactctgatccaatggcactgaatcaggacgatacatatccagatactggtaaactggcatgataggaacagaaactgattgggaaaaccatgcccgatatttagctaactcgtgctgccgataatcacacaggtttctgccgttcagatgaatcttgccactgtaaggtaaaattcctgcaatcgctgaaagcagcgtgcttttccctgaaccattcaatccgaccagatgaatttgctctcttgctataacagattcagacaatgtggtcagtctcttgtcaaccgtaatattattcaattctaaaatcggttgacaggtcattttatttctcccatgacactcatcgaatatatttatctatgatgtgtttttaatagtagccatataaaaattggcgctcccaaggttaccgtgaccacaccaatcggcacttccgcatgggataatgacaggcgggaaaatagatctgccaataataagccactacttcccgccagtgcacaagctggaagcaaggtcttatgatctgtcagaccagtcaaccttaagatatgtggaatcaccaaaccaatgaaactaatcgcccctgccaaagcaacgctcaaaccaaccaacaatccaactaccgatacaaataaattacgccacttattatgtgatattcccaattgctgagcctgtaactcaccaagcgataggtaattaaggattttcccttgttgactcagccagaaagtagcgggaaccagtgcaataaccagccatttctgacgccagtcaataccgctgaaactacccatcatccaatacatcaactgacgcaggtccaaactggtactgaagtaaaccatccatgtcatcatagcgccaaatatcactccgaaagcgacgccaatcaatagcaaccgtgtattcgtcacttgatgttttctggaaaagcccaacaaaatagcagtcatggcgaacgccccaagaaccgcaccaatacttaataaccacaatggagcaataccatgaaagacaaggatcagacataccacaacaactccagcgccattactgatccccaataatcccggctctgccagcgggttttcaaataacgcctgcatgacggcgccagacacagccaaactcgcaccaaccactatcaccgcaatcgctctgggcaacctcaattgccagataaacaatcgagccgagtcagacagccattgattaggccagaaccataattctcctgcacacaatgacaaaataaataacataataaataagatagataggagtgctatcacacgatagtcacgttttttctggagagtgattaattcatagacagagtgcattggcggcaccagaaaaaagaaatgtatcccattgtatacaatgggatattaaaggtaagaaaaagaccgcacaataatgcggccttttttatgtgttttattcttttggtaaagctttttccacccgatttttcaacttttgacctgggcgaaacgtaacaacacgacgggccgtaattggaatatcttcgcctgtcttcggattacgacctggacgttgattcttgtctcgtaaatcaaagttgccaaatccagataatttaacctgctccccattctctaaagaatgacgcacttcttcaaagaatatttccactagatccttagcgtcacgtttgctaatacccagtttctcaaacagattttctgacatttcagctttagtaagcgccataagttcagtccctcaaggatgctttgaatcgctgttctaatgcagcaacgcatttgttgacggtcgcagcaatttcttcttcttccagtgtacgcacggtatcctgcaagattaagctaatagcaaggcttttgtagccttccgcgacacctttaccacaatacacgtcaaataagtttatgccaactatatgatttacgccaactttcttacattcagcaagaacatcttctgcggctacattttcaggcacaactatggcgatatcacggcgattagatgggaagcgagaaacttccttcatttcaggaatcacgcggtccaccagactggcccacaataattcgaatatcacggtgcgactatttaagtcaaatctgcgctccaattctggatgaacaacacctatataaccaatataattattttccagataaatcccagcgctttgtccagggtgtaaagcaggatgttcctccgccctaaatgaaatgctagatagcataccagtcaattctaaaacggattctaaatcgcccttaagatcaaagaaatcaactgcttgtttttcaatcaaccagtgttcttcaaaacgatttcctgctatcacgccaccaagcatcaattcctgacgaataccatgttcagcattttcatcaggcacaaaacgcaagccagtttcaaacaagcggacacggttttgctgacggttctggttataaacaacagtggtcaataatcctgtcaacaatgacaagcgcatagccgacatgtcagccgaaatcggatttggcaggatcaatgcttcttcctgcggatgcaaatattgctgaatctttggatcaacaaaactgtaggtaatcgcttcttgatagcctttgtccaccagcatcgttttgacgcgtttcaatggcagattagcttcacggtgtgcagtcatcacaagatcagcgcgcacaggcacgtctgggatgttattgtaaccgtaaatacgtgcaatttcttcaaccagatcttcttcaatctgcatatcaaaacgccagctaggtacaacagcctgccagctatcgttctgaactgtcacctgacagcctaaacgtgtcagaatatccgtaacttcgtcatcaacgatatgatgaccaatcaggcgatccaatttcttgcgattcagagtaatagtcaccgattttggcaaataggatccactggtaacatcaatgatctctcccgcttccccaccacaaatggcaatcagcaattgggtggcatattccatcgctttatactgaagctgtggatctacgccacgctcaaaacgatgggaagcatcagtatgcagaccataacgacgagcacggcctgtaatcgctaatggtgcaaagaaagcacactccagtaaaatatgctgtgtttcagcattcacaccagaatattggccgccaaaaattcctgccattgcaagcgcttgcttttcatcagcaataacgagtgtatcagcagaaagttctatttcgttaccatctagcagtgttaatttttcaccctgctcagccagacgaacagtaattgagccacttaagcgttccaaatcgaatgcatgcagcggttgtcccaactctaacagtacataattagtaacatcaacaattggatcaatagaacgaataccaccacgacgcagtttttcacgcatccacagtggtgtttcagccttaacgtttacattcttgataacacgtcccaagtagcgtgggcaggcttctggtgcgtcgacacggatagggaatgtagcttctgtagttagttttacaaactcgatctgtggctctgtcattgacagtttattgatgacagcaacatcacgagcaactcccatgatgcttagacaatctgcacggttaggtgtaatgctgatttcaatgacgctatcattcaatttgatataatcgcgcagatcagtaccaatcggtgcatccgcaggcagttcaataatgccatcatgatcatttgcaatacccagttcagagaaagaacagagcatcccttctgatggctctccgcgcaatttcgcagttttgatcttgaaatcacccggtaacaccgcgcccactgtagcaacggcgacacgcagcccctggcggcaatttggtgcaccacaaacaatatccagcaggcgatcgccacctacattaacttttgtgacacgcaatttatctgcgtttggatgttggccacattcaacgacttcacccacaacaacaccgtggaattgacctgccactttttcaacaccatcaacttctaaacctgccatggtgatttgatcagacaatgcttcactgctgatggcagggttagtccactcgcgtaaccagagttcactgaatttcatgagatattcctgccttatttaaattgtttgaggaaacgcaagtcgttttcgaagaaagcacgtaaatctgtgacgccgtaacgcaacatagttaagcgttccattcccatgccaaaagcaaaaccagaatagacttcagggtcaatgccaacactgcgcaatacatttggatgtaccatgccgcaacccaatacctccagccacttaccatttttacccatcacatcaacttctgcggaaggttccgtaaatgggaaataggaaggacggaaacgaacctgcatctcttcttcgaaaaagttattcaaaaagtcatgcaatgtacctttcagattagtaaagctgatatttttatcaacaatcagcccttctgcctgatggaacattggagtatgtgtctggtcataatcattgcggtatacgcgacctggtgcaatgatgcggatcggcggctggcgttctttcatagtacggatctgtactcctgaagtttgtgtacgcagcaggcgcgttgcatcaaaccagaatgtatcatgatcagcacgagcagggtgatgtgccggaatattcagggcatcgaagttatgatagtcatcttcgatttctgggccagattcaacagaaaaacccaattcgccaaagaaagtttcaatacgttcaatagtgcgggtaacaggatgtaatccaccattttccatacgacggccaggcaatgaaatatcgattttttctgctgccaaacgtgcattcagaacatcagcttccagttttgccttacgagcattcaatgcttcctgcacttcctgttttgcctgattaataacagcccctgccgctggacgttcgtcggctggtaagtcacgcagcgatgacatctggagggttaaatggcctttttttcccaggtattcaactcgcaccaaatccaacgcggcaacatcctgggcttcctctacggctgcttttgcctttgcaaccagctcagtaagatgtgacatcgttttcctcttccttcggccagatggccctttagttgttatcgactatgccccaaatagctattagtgaggtcataaaaataaaaaagcctccacactggaggctcaagcgctgtttttcgtttcttttcttacgcgcaaagccccccgatttcaggcgctaaagtaaaaaaagaaacgaaaaaaagctaatttcatcattgccattctctccattatgtccttattaacccaatcaatagtaagccatattttgggggaaagtaaaagagggagcaagctccctcttctaacctgacttatgccagagcgcccttcgctttttcaaccagagcagcaaacgctactttgtcgaatacagcgatgtcagccagaatcttacggtcgatttcaatcgaagcctttttcaggccattgatgaaacggctgtaagacataccgttctgacgtgcagcagcgttgatacgtgcaatccacaattggcggaattgacgtttacgctgacggcggtcacggtaagcgtattgaccagctttgataactgcctggaaagcaacacggtaaacgcgcgaacgggcaccatagtaacctttcgcttgttttaaaattttcttgtgacgtgcacgggcaataacaccacgttttacgcgagccatatacttctcctatcgtctctgaattctaatctaaaaaatttgcttatgcgtatggcagacaagcaacaaccaggcccaaatctcctttggagaccatgccttttggacgtaaatgacgcttacgcttagttgattttttagtcaggatgtgacgaaggttagcgtgcttacgcttgaaaccaccactggcagttttcttaaagcgtttagccgcgccgcgtactgttttaatctttggcattttaatttccacttcgcattgttgattacaacgaattagtaaggcgaatagactccaaccaaaaactgactggagcccattacttgactgcctgactatttcttcttaggagcgagcaccatgatcatctggcggccttcgatcctcgatgggaaggattcgaccacagccagttcactcagatcttcacgaatgcggttaagcatttcgataccaatctgctgatgcgccatttcacgcccacggaaacgcagggtgattttagctttatcgccatcttccagaaaacgaatcaggttgcgtagtttgacctgatagtcgccttcatctgtaccaggacggaatttgatttccttaacctgaataaccttttgtttctttttctgttctttgactgatttactcttctcatagaggaacttgccgtagtccatgatacgacaaaccggcggttcggcatttgggctgatttcaactaaatcaacaccagcttcctcagctttctcaagagcttctctcagactgacaataccaatctgttcgccatctaatcctgttaaacgaacttcagaggcgcgaatctcttcattaatgcgatttgggcgcgccggttgaattctttttccgcctttaataccttattcctccaattgatgaagattgcgactgcgtatttctgtcagtagtttttctgtaaactcactgacattaatgctacctaaatccttgccacggcgggtacgaacagaagtttttcctgattcgacctctttatcgccgcaaacaagcatgtaaggcactcgacgcagagtgtgttcgcgaattttaaaaccaatcttctcatttctcaagtctgcttttgcacgaacgccagcatcttgaagttttttaaccaattcctgtacataat

SEQ ID NO: 16847 - DNA, 66555 bp, Xenorhabdus bovienii
cgggataacaggctgataccgcccaagagttcatatcgacggcgggtgtttggcacctcgatgtcggctcatcacatcctggggctgaagtaggtcccaaggggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacggagtttcagatgaaagacagcagcttgttcgggattgaaaacagaatttgtctggcggccatagcgcggtggtcccacctgatcccatgccgaactcagcagtgaaacgccgtagcgccgatggtagtgtggggtctccccatgtgagagtagggcactgccagacacctatttagccagagaagccaccccatcgggtggcttttttgcgtttgtgaaaaatttaaacatgagaaaatccacctgacgtgaaggttgtctgcggtgccgagtgtaggacaaaattgttgaatatgattttgaactttgcgcaaagtgcgatagcccgaagggggaacggcaggaaagtccttgatcaactgccagaaatcaatttagccagagaagccacccaacagaggtggcttttttgcgtttgagaaattttattcgttatttttacgagtataagctgccaatactgttctttctgataactctagataatctttcatctttttagctgctaattctgtctgaccagaatctaaaagctccagtatatatgcatttttatcaatataaggggcatacagtagctcaggatcattcaaaagcccaaaagccaaacgaagttctgctgagatattgcggtagaaagcaatcaatctttcactgtcagttaattccacaattgcggtatgaaaacgcatatttgcggtgccgacgccaacccaatcttggttatttcgatacagttgcgcactggtcacagcctctttcattttggcaacgctggggtgcatggaatatgcctgagtgagagcctgacattcaatcagtcgtcgaacccgatagatatcaataatggatgcaatatcgggaatcgctacaaatacaccgcgattgggctggtgtttcagtaatccttcttgagttagaacgcggaatacttcacgtaacgtattgcgtgagatctcaagctgttcactgagcgcggcttctgataagcgttgcccgggtaacaactccccaataaccaatttattccgtattgtttcagcaattttcttactcaaaatttggggagaactctcttttttcatagtcatccattgggtttatagctgagaaaaagcgccttcgatgatcaaaagttaatcttcacacattccctgataaccagcaagttaccgacattggatcattatagggaaacgtattgcactgaaatgatgcatcttagtgttttccttgatgatagatgctgaaaagtgatctgtattgaacttttataacccataaaacgattctatttgctcattttctcaacatgatctatttattgttcaacaatcatatgtgaattagttaacaacatagttatttagttccacaatggtacgaatattgcttaggaaataataaatacgataacaatgacaggggaacatggcctatggcaatacaggaaacagtaaaacatgaaacggttaactttgcggtaaatcggcgatcgtctttaatggctgcggtttttttgatggcaacatcggcgattgggccgggtttcattacgcaaacagcaacatttactgcaacgatgggcgccgcttttgcttttggtattttggcctcgatcctgattgactttgtggtacagcaaaatatttggcgaattgttaccttaactaagatgcagtcggccgatatcgccaatgcagtgatccccggaagcggttatttattggctgcactagtgatgtttggaggattggtcttcaacgtcggcaatattgctggcgctggattggggcttaatgctctgattggtttagaacctaaatggggcggattattaagtgccttgatggcgatttatatttttacctcgcgtaaggctggggttgccattgatcggattattgtcgtattaggcgtagttatgatagggctgaccctgtttgttgcgatagtttccaatcctccagtgggggaggcgttgcggcaaacggttctgcctgatgacatcaattttgcgactattacgacaattgtggggggaacagtcggtggttacatatgctatgcaggggcccatcgtctgctggataaaggtatgacaggcgtagagaacattgatgctgtatccagtgcggcaactaaaggaattttggcagtaggactgatgcgttattttttatttttggcaatattgggagtggttgccagtggtgtcacactcgatattgccagtgaaacggcaaatcctgcttcacaagcctttcaggtcgtagtgggtgaatttgggttgcgtatttttggcttgattctgtggtctgcggcaatcaccagtgttattggggcggcttatacctctatctcttttgctcgcgtatttaaaaaacaattgactgatcgtcagctcaatatagttactctctgttttattaccctctcattagcagtttatttattgataggaacacctccagctgctttgctggtgtttgcaggcggctttaatgggctgattttaccccttggtttgactatctttgtttatgttggctggaaacgggctgatctcatgggaggataccattatcctcgctggttactatggtcagggttcatcacctgtgtactgacatggtatatgggagcgatgtctattagttcaattttcgcttttctgaaagcagcttaagagaataatcatgataaaagcaattgatttaaatagtgatcttggtgaaagttttggtcagtggaagatgggtaatgatgcagaaatgctgggtattgtcagtagtgcaaacgtcgcttgtggttttcatgctggagatccggtaggtattttgcagacgctgaaatctgcaaaggaaaaccaagttgctatcggagcccatgtatcttatcccgatttagtcggttttggtcggcgtagtatggatattgccagccacgaattgacagcagatgtgatttatcagattggcgccctgcaaggtttggctctagcagcaggaacaagtgttcgttatgtgaaaccgcatggtgcgctgtataacacgatcgctaatgatgagcgccaggcacttgctgttattgaagggattttggtgattgatcctaatcttgctttagttggattggcaggatcaaatatcctccggttggcacaggaaaagggtttgaaaactatcgcagaagcctttgcggatcgtgcttataccgcagcaggggagctagtttcccgtcgtgaagccggtgcggtgttgaacgatgcgaatcttgtggcacaacgcatgttgcaattggtgactgaaggtggagtagattccattgatggcaaattcacacctatcaaggcggattccatatgtgtgcatggggacagtccaggggctttggatatggcaaaacaggtaaaaaaagttctgcgacaggcagggattaccattcagtcatttatccacgcataaccatacgggtttatgatttcaggagatcactttgcgttttttacctgttaatttcaatacaatacttgttgaactcagtggattgccagaaacactggcgttgtttgattcactgagtattgctcctgtattggggattgaagagattatacctgcggcgagaaccctgatgattcgttttcgtccaacgaaaatctcaattcaccaactcgtagcagaaatgggtcaccgtgacttgcatgagtgcagtcattctcaaggaaaacagattgaaattccggtgcactataatggtgaagatttagcggaagttgctgaaatattggggggcacggttcaagacgttatccgccagcataccgaaaacgaatatacagtggcttttagcggatttgcgcctggttttgcttatatggtgtcggatacggcacagtggaatattccccgtcggcaaacaccaagaacccgtattcctgctggtgcggttgcactagcgggagaattcagtggtatttaccctcaggcgagtcccggtggttggctgattatcggcatcacaaccgaacgtatgtgggatctttcccgtcctgatcctgctctattacaaccgggttatcgcgtcaattttcgggatgctgaacgtgccactgtaacggtaagtttgccagaaacctcacgcaccaattcggtttctcaatctgaaacttctcgctatttagaaatccggagtgtgggattgcaaaccctatttcaagatttaggacgttttggtaaatcgggattggggatctcagaatccggtgctatggataaaagtgctttgcgaagtgcaaaccgtatcgtagggaatgcttccgagcaggcgtgtctggaaatcgtgcagggtggttttaaagcggttgcctgtgggcagatgatggttgctgttacaggtgcgctatgttcaattgagatcaaaaccccgcagggtgaactcatttatgtaagtgcttacaaacccattgatttaaatgatggtgatgaaattatcttgggaagacctgatgcgggaacgcgttcttatttggccgtgcggggtggttttacgatcccctccgtattatctagtcgctcatttgatacgctatctcatatcgggcctgagccattaaaagccgaagataaattggctgtgggaacaacgtctcattgcgctgcggtgtctttctcggagacgcctgcttttgtgatgccgaataaaaatgaggttgtggtattggatgtactccttggccctcgcactgactggtttactcaagagtcgattgatttattacgaaaccagatttggcaggtgacgccacaatccaaccggattggcttaagattaaatggtgagtgctcactatcacgtattaagcgccaagaactgcctagcgaaggaacctgtgccggagccatccaaattcctgccagtggtcagccagtgctgtttttgtctgatcatccattgacgggggggtatcccgtcattgcttctgtggcacattatcatcttgatcttgctggtcagatcccggtcaacgccaaagttcgatttaatcccatcagacaattccacgaaatatcagggagtgaagacttgctatgaacaccactgtgaacaatataaataagaatccaaacaaagtgctgattgccaaccgtggtgagattgccgttcgtattattcgagcctgccgtgattatggcgtgcagactattgctgtttatgcggatgctgatattaatgctcaacatgtgcaattggcagatgaagcttacggtttatcggggaatagctccgcagaaacctacctcaatattccacgtttattggcgatagcgaagcagtcgggggcaacgatggtgcatcccggatatggattcttgtctgagcgagctgaatttgcccgtgccgttatggacgcaggattgatttggattggccctaacccagaaaccattgatgaacttggcgataaggttaaggctcgtaagatcgcccacaaagttggtgcgccattggtcgttggtacgtcggagccagtcaaagatgcgcaggaagttgtcgcctttgcggaggaacatggcttgccgattgctattaaagcagcatttggcggagggggacgtgggctgaaggtcgcttggcggctggatgaagtggaagaactttatcactcggcagtacgtgaggcgacagccgcatttggccgtggcgaatgttttatcgaacagtttcttgataaaccgcgtcatatagaagcacaggttattgcggataaacagggccatgttgtggtgcttggcacccgtgattgctccttacagcgccgcaaccagaaattagtggaagaagccccgacaccatttttgactcaacagcaacgggagcgtattcatcaggcggcaaaagcgatttgtgcggaagccaattatgtgggagcgggtacagttgaattcttactaagcgccgatggaacgctctcttttttggaagtgaatactcgcttacaagtagagcatcctgtcacggaggaaacgacaggtatcgatctcgtgattgaacagttgagaatcgcggaaggccatccattgagtattcaggagacgccagttccaagaggccactcatttgagtttcgcatcaacgctgaagatgcaggcaaaggtttcttaccgatgtcagggactatcagcgaatttaccccgccttccggccccggtattcgtctggattctggcgtgatcagtggctccactattcctgcgacctttgattctctgatggcgaagttgattgtcacaggcacaacccgcgaacaggctatttcgcgcgcacgtcgggcactacgggaattcaaaatccgtggtgtggcttcagttttgccttttcatcaagccgtgatggaacatcctgattttgtttctgatgatgtcttcaatgttcatacccgttggattgaaacggattttgcgaatgagattgaagcgttaccacgtcaggttgtgacagaagatgacagcatcactcgtacatatattgaaattgatggccgcaggcatgagctcggattgcctgccgatttattagcgggattttctcatttggcgcctgttagggaacagcaatcttcccagtctgcgataaaggaaaaaatgccggcagactctcgtcaggtgaaagcaccgatttccggtatcttacattcttggattgtgaaagaaggtgaacaggtcaatgaaggtgatgtaattgctgtgatggaagccatgaaaatggaagtgcaaattaatgcacaccgtgcagggaaaatcacattctgtgtacaggcaggggattatcaggatgcagaaagcactctggcccatattgagtagtggctgtcactatgaataaggctacgttgaatcggcaggaaatacccgccaatataggcgggtagcggtattcactggctagaatatgggtgcataccatggtgcaggtggtgtattccgcatcacagatcatcagcaacaaaaaagatgccttaaaaatggggggtaaaattgagtataaatttgtacccttttgagttgttagatgctatggtgattaataatcatactgtttggagcgttttttatggttaagacaatatctcagaaggcagctcgtgaaagcttaggatctccagaattctttgagggaggggtttatgtcaccaaaaatggtgtttctgaattatttgttcaaacggcgaatgaacgagatgccgaattggaggaaagagtgcttgagcgtcaggttcacgcactactaaaactcactatgatggcaaaacaggatgttgttcatgaaagaacgatgacacctgatgaagcgttaaaaaaattacgagcatcgagaaaataatggagtattttcatgtccaatatcaggctgacagaaacagcagttcggtgtttagaagatattgaatcatttaatgccttgcgattgtcaccacagaaagcgattaaaattacagaatcattgcttcgtgagtcaattactgcgattagtgatgatcctaaacgttatcgcttcaatgcgagtttgttggatttaggtttatttgttcgggaacgtttagatattgatagaggatatcgagtgttatacgaaattaaggatgatttaatttatattttattatttttaagcactaaacaagatctcactgacgcactttatcgtcaccaaatcctgcgttctctccaataaataagcccaccttttgtgggcttcaaccaacctcaattacagcgtaaacaccccaatcaaggcaaccacactcaaaatagcggctgtaccataaaacccccatttactggctgggatatggatttgcagatcgtgcataccgtggtgcagacggtgcatcccgcaccagagcggcaggctgatcatcagtaacaaaaaaatacggccaatgaaactctggcagaatgtcagaacacgatcataagagagtgcttccggtgccaatcccaacgggatcagaaagcccagcagcagaaccatcgccggaccaacaatggcgctccacatgccgccggcaccaaatagaccccagaaaatcggttcatcggaacgcttaggtcgttgattcatcagatcctcctaggggtcagtaaaatagtgcaacgccgagaatcacggcggtggcaatgagagtgattgcccacaatagtttgataatcggctccggtgacattttttcatttttgacaatgatattgagcgctttcggagccagttcaaaccacgtttttgtatgcagcaaggtcgccagcaaggtgataatattaatcaccagtaccgccggatgttgtagaaaagagataaaacccacccaactttctgagccatctttcagggcaaacagaccatagagcaccagcaggctgaaccaaatggcgggaatggcagtgccttcgcgtatcatataaaaacgatagaagcctaatttatgccaccaatgggattccataccgcgcacataaggtttacgtttagtcgtcattactttctcctcccttattgtggtttcagcatggagataaggaaatctttggcactttctgctttgctctgttgaattgcacccgccggatcgacgtgtttcgggcaaacttcagagcagtaaccgacaaaagtacaagaccacacgccattgtcactgttgatctgaggcatacgctctttcttgccgtggtcgcggctatcaaggttataacggtgtgccagcgtgactgcggcagggccgataaattcaggattcaggccgaactgcgggcaggcggcatagcacaggccgcagttgatgcagcctgaaaactggtgatatttcgccatttgtgtaggtgtttgcacattcgggccatcagcgggcttgcgatcattgccaatgatataaggcttgatagcttccagactctcaataaagtgagtcatatcgacaactaagtctcgttcaatggggaagttgccgagcgcttcaattctcatcccttgcggataatcgcgcagaaagattttgcacgccagttttggcacacggtttaccatcatgccgcaggaaccgcagatcgccatgcggcaagaccaacggtaagacaggtcgggagcccgattgtccttaatgtagcctaacgcatccagcaaggaggtttgctcatcataaggcacctcgtaggtgacgaaatgaggttcgctgtcgatttccgggttatagcgcatgacttccattttcaggtttttcatctcagtcattcgcctgctccttctgttgtttctcttgtgctgcggcttcaccaccatagacccgcttcgcgggtttggatttagtgatttttacatcactgtactccaaacgtggtgcaccttctgggttatagaacgccagcgtatgcttcaagaaattctcatcatcacgttctgtacaacctgcatcaaggcgctggtgggctccacgggactctttgcggttcatggcggaatgcgccatacattcagcgacatccagaccaaagcccagttcaatcgtgtagagaagatcagtattgaacacgctggaacggtcagtgatttcgatatgcttgaagcgttccttcagctccgcaattttatccatggttttctgcatcagctctggagtacggtaaatcccgcagccttcttccattgaagtacccagttcatcacggattttcgcccagtgctcaccgcctttctgattcagcagtttgttgagtttatcttcgatatcacgggcttgtgcatccagcacgttttcattggcaggtgtggcttgttgaatatgtttgacggcttcttcacctgccaagcggccaaataccaccagttctgccagtgaattggaaccgaggcggtttgccccatgcaggccgacggaagaacattcgccaatagcaaacagccctttgatgcgggtttcacactgcgggttagtttcgattccgcccatggtgtaatgtgccgttgggcgaacaggaatcggttctttaaccggatcaacaccgacataggcttttgccaactcacagatgaatggcaagcgttcgagcagttttttctcacctaaatggcgcagatccagatgaaccacatcaccacgcggcgtcgcgatagtacggcctgcctgccattcatgccagaaagcctgagaaactttgtctcttggccccagttccatatatttgttttcgggttggccaaggggcgtctctggccccatcccataatcttgtagatagcggtagccatctttgttcaccagaatgccaccttcaccacggcagccttctgtcatcaaaataccagaacccggcaggccagttgggtgatattgtacaaactccatatcacgcagtggtatgccgtggcggaatgccattcccatgccatctcccgtgacaatgccgccattggtattataacggtatacgcgtcctgctccgcccgttgccataatgaccgcattggcacggatctgaactttcgttccttccatcatattcagtgccaccaaaccgcgcacctgaccttcatctatcagaatatcgagcacaaagtgctcatcaaagcgttgtatttgtgggtatttcagggaagtctggaacagcgtatggagcatatgaaagccggttttatctgcggcaaaccatgtccgttcgattttcatgccgccgaaacgacgcacgttcacggaaccgtcttccttgcggctccagggacagccccattgctccagctggatcatttctgtcgggcagtgtttgacgaaatactcaaccacatcttgttcacataaccagtcgccacccgacacggtgtcattgaagtgaaagtcataggagtcatgggattgagtgacggctgctgatccaccttctgcggccacagtatggctgcgcatggggtaaacttttgagatcagggcaatcttgagctggggattggcttcagcagcggcgatggctgcccgtaggcctgcgccaccggctccgataatggctaaatcggcattgaaggtttgcactgcgcttctccattgttcaagtgggtggttcaaatgaaattagttacaatcggctagaggacccaatgcgttatcactcgtcactttctttatctttgttatttcacaatgatattttttcttgtttaaacgagtgctattgataattttttatgctttaacgatttaggatcactatctgttactttttgtatggattaagtatagctaattgtgaagagggtaaatttgatatgaatgggggtttttgtgggattttgctgaaataatgtgatctagatcgtttttttggttttcttaaattatttatatagtaaattattcttattataaatataagtcaaatcattataaaatatatgttaatactatctggaataatgctacgatggcgaccttcctatttacagaaaatagtattactttttatttttgacaatagaaaattagattaattctttatttttttctggcggttatttttgtctgttttacagaaaacataatattaataataaggttggattgtttttttaattaaatgttttcataacaatgattaattaatatttcgttataaaaattaatgtttcgttatataaagtaaattaattcggattatataatttttttggtattgttctcacagaagtattgcaattcatagcgtataaatttgagcctaatgtttattaaattttcttttttatgtcctgatattttccacatacaggacaggggtactctgttcactggtatagcggagaatggcgggtaaaaatgatattcactaaactgatgctgaaaatttgtctagtggccttgatatgagtaaactgcgcgttttgttttattttggagtcattggaacatgaatgaagtcgcggattggcagtcaagtgcccctatcgccaatttattgcaaagggcgaagattcttgcggagatacggcgctttttcgcagatcgtggggtgttggaggttgaaacccctgccatgagtcaggcgaccatcactgacatccatcttgtgcctttccagacacggtttgtcgggccgggagcagcggatggcctgactctgtatctgatgactagccccgaataccacatgaagcgtcttttgacagcaggaagtggttccatttatcagatgggtcgcagtttccgtaatgaggaagcgggtcgccaccataatcctgagttcaccatgttggaatggtatcgtccacattacgatatgtaccgcttgatgaatgaagtggatgatctgttacagcagatcttagattgcgaaagtgcagaatctctttcttaccagcaggcgttcattcgctatctggagattgacccgcttaccgcgagtaaagaaaaactgcgtgaagtggcagcgaagctcgatctcagcaatatcgctgatcaggaagaggatcgggataccttgctgcaactgcttttcactatgggcgttgaaacgcatatcgggcttgaaaaaccgacatttatttatcacttcccggcttcacaagcgtctttggctgaaatcagcaaggaagatcaccgtgttgcagagcgttttgaagtctatttcaaaggcatggaactggcgaatggctttcgtgaactgactgacagccatgaacagcgcctgcgtttcgtgcaggataatcgtaagcgtgaagcgatgggattgcctgttatgccgattgatgaacatctgcttaaagcccttgaacacgggatgcctgaatgtgccggagtcgctttgggagtggatcgcctgatcatgcttgcgctgggcgctgaacggatcagtgaagtgattgcctttccggtcgggatctcctgacgcgactattagcgtcagagggttttaatccaacgattttattgctaaaggcgcagcttctggctgccccttcatcgctagtgttgattatttatgttcgtggcgtttttccagaaatttcacggctaaatcagggaaatcggtgaaagcaccatcaacattggctttatcgaaaacgatatcgaataattgattaccgctggtggcatattttggcagttgatcgacacggatagtgtatggatgaacggccaaatggctcatatgggcttctttcaccagacccgtcagcttaatgttgcttggtgtggagtcatcggagatgagcatatggtaatcagggccaatgccatcggcatattttgccacttctttcatagcacccggtttaaacatccagtcataactataattcacccatgagccatcttgtatctgctcataagtttctttccagtcggtgtaagcgatgagctgtatcaacttcagatccatgcccattttcggttccagctcatgtttgatgcgtttcagttcattggcatcaaagcattgcagataaactttatcgctctttttggtgtagccgtattgtttcaggacttccagcaccttggcggtgatatctttaccttcctggtggtggaaccatggggctttgatttcagggtagatacccatgtttttgccagtagatttgttcataccctgaataaactcaatttcttcctgaaaagtatgaatgcggaaatctgatttccccattgggaaacgtctgggatagctttgtactttcttaccctcctcgatatcaaaaccttcggtaaatttcagggatttaatttccggtaaggtaaaatcaatagcatagtagcggccattggcacgggcacggtttggaaagcgctctgctacatctgttacgcggtcaagataatgatcatgcagcacgatgagttcattatcttgggtcattacgagatcttgttccagataatcagcaccttgtgcataggccatggctttggcaggcagtgtgtgctcaggcagatagccgctggctccgcgatgggcgatcacaatcttgtctgcggcatgtgcaataccggacatcgacgacgctaacagcaggcctgccatgatggttttgataggggtttgcattggggttctccacatttatagtaatgtatagtaataaaaatcttaaatgaaaatgatgttattttttttagcttgttttttaaaacagcaagaagaatatgatgattattcaatgcagctttttatataaaatgacgacataacacaatgctgaatactgattttatcagtggtatgtcacagttttatgacagtaatgttcattctttaaacgtgctattgatgttgtatttttgattcaatacgatatataaataggtaaaataataatgtcatagatttggtttggttttataaatgtttaattttaataaccacttggaaataaaatgattatggccatgaagagcaaatatataaagtaaaaatcagtaatatatttaaccaaatatgacatgaataagtaaacctgtaataaggaacaatggattagttcagtcagttggatttggcaattaatttttcaagtaaccgcagtattaacaatgatactgcggtcaattttatgtgttattaccgtttgtgtggcggtaatttactggctagcattacgagcgatttcctgcttatgtttactctcgcttaacatgacaaacaacagcagaacgacggacagggcactgccgccgatcatgaccataaatccgccgtcccaaccgaagaagtcaacggtataaccgacaatgatactggcggcaaccgaaccaccgaggtagccaaacaaaccggtaaagcctgccgctgttcccgccgcttttttcggtgccagttcaagagcgtgcaggccaattagcatcactgggccgtaaatcaggaagccgataaccaacatacagagcatatcgatatttgggttacccgccgggttcaaccagaatacgatggtggcgatagtcaccagtgtcataaagaatacgccagtggcaccacggttgcccctgaacactttgtcagacatccatccacacagcagcgtaccgggaatacccgcatattcgtagaggaagtaagcccaggacgatttatccatagcaaagtgcttcacttctttcaggtatgttggtgaccagtcgaggataccgtagcgcagcagataaacgaatacgttggcaatcgcgatcatccacagcaatttgttaggcagaatgtactgcaaaaaaatctcttttgcagtcaattctttttcatttttgtccgtatagtcaggcggataatcatttttgtactcttcgatcggcggtaaaccacaggattgtggagtatcgcgcatcaaggaaaatacgataattgcgacaaggatggcggcaaatgcaggcatataaaatgcggctttccagtcttggaaccacgccatacccagcatgaacagtaacggaggcaagccgccaccaacgttatgcgcacagttccagatagaaacgatcccaccacgctctttctgtgaccaccaatgaaccatagtacggccgcagggaggccagcccatgccctggaaccagccacacagaaatagcaggacaaacatgatggcaatgctggaagttgcccacggcacgaaacccataaacagcatcactgctgctgcgagtatcaagccggcaggtaagaaaacacgtggattggaacgatcagaaatggaacccatgataaattttgagataccgtatgcaatcgaaatccctgacaaagcgaagccaagatcacctttggaaaaaccttgttccgctaagtgaggcattgccaatccaaagtttttccttaccaaatagtaagccgcatacccaaagaagatccccatgaaaatttgccagcgaaagcgacggtagactggatctatttcttgtgcgggcagccgggctttgtggggtgccggtctaaaaatacttaacatgtttgtctccacatgacttttggtgttagcgaattaccatctctgagcgatgatgatgttaaacgaagagttctcattaactattttctatatagaagaaaataatagccaaaacaatatgctatatctgtgatgtatcgctgacctgtagatatgatttcgcaaagaccgcaattttgagtgatttgttagagttttgaaatataatttactgatattatagtgacgcacgtcacaataaagcgctttgcttgttatttatgagcgtttaaagttcgtttatgttcttttcttaaaattaatccatattattggcatgggttaatactcagtaaatataaagttgtaaaaatatgaaattatattttaataaaatcacacagacataaattcataaataaagtgtgacatttatcgtcgggattttaacggataatcattatttcaataatgcctctgtttagctgtgtcatttatttttatttacatgcttggcgttttttataacgcaattacaaataaaatgtttgaatttataattcaaaatagtagatattactataaatagatattcatgatgccagttatcatgaggctttgaatctctattttttaaaataatataataatatcaaggcgatactagattgtataaggcgtaatacactctgttagccaataaataacctctttatttgtaggttaattaaagattacaaaataatattagttaataaaattattaaattagcatgaaattttatgcaatttatttttcctattcagttgaatgtcgacataaggtatttgcaatagctgaatgtaggcgaaaactgaatgttaacgactaacagcattgatgtctccattcatcacaaaaagtgatgaaataaaatggaagacagaaagagaacatcattatgaatacacacacacacaaggcaatattacacacagcattcactgagcaaacatcttcacctgatgacaatattaatagtagtaatatcagtcataggatagcagcacttgaaccatggtttgatgacgtaccatctcgcttggcaaaactggcgaaaacgataccgaatgatattgcggtttctgatccctatgaaacactggcatttggtgaattacagcagcgtgttgaaaatgcagcaaatattttgcatcagtacggtgttaaaatggggagcaacgttgctattgctgccgaacggggaattccatggtttgttactatgctggcggtttggcgaattggggcggtatatattcccctcaatacgatgatgccagaaaaacgtctgaatgacattctcgccagcctgtcggaaagtgttctcgtatcggatgatacggtatctgcggggctgaaggcatcaacattaatccctttgcacacccttctgaataacaccagtgaaataattaatgatgaaataacagaaaacatcgatatgcttgcattgggtgatcacccggcttatgtgatgttcacttctggctctactgggttgccaaaagcggtacaggtgcagcatgacaatctggctgcctgcctgtgtgcattcggcaagttactgtcagtcaatcagcatgattgtatgcttgccctgacgaccttttcttttgatatctcattattggaattactactgactgtcgttcatggcggcagtatctacattacatcaattgatactcagcgtgatgcgcaggctctgtcgcaaacgctgtctgatccccaattcacctttgcacaagcgacgcctgtcacttggttaatggccttgaatgctggctggaaacctcgttcaaagttgagcatgctttgtgggggagaggcgttgtcacaggatctggctgatcaactaacggcatccggtggcactttatggaatctctatggcccaaccgaaaccactatctggtcaacagcatttcgtatgagaaaaggagataaggttcaattgggtgggccgatccccggcacaaccatcaccattgtagacaaatacttgcggccagtgccgaaaggaacggtgggtgaaatccttatcggtgggcttggggtgacggctggatatcgcaataacccaaccgaaacggccaaacgatacgtacccgatatgacacaaaaaggtaaaagagcgtatttgaccggagatatggcacgtatgcttgaagatggctctctcatttatatgggaaggcaggatgatcaggtaaaagtgcgtggatatcgaatcgagttgggcgagattgaaaccgcattaagaaaacaaaatggcgtacaggatgcgattattcgtgttgtcggcagtggcgatcttgccaagattcaggcatttgtactgttcgatcccaatagggttgtacccgaagagtgggtacgtgaaacccaggtttcactcagggaaattctgcacgaagcctggatacctgccgaatattatcgtatcccttatatcccactgacgagcagtggcaaacgcgatagaaaacggttagacgaagtcgcagagcggttgaatgccagctatgacgttgtactgcctcaaacagaaactgaaaaacaggtttatgcaatttggcgtgacctgctggcgacagacgtattgggtgtcaccgataatttcttccaggttggggggcattctattttggttgcccgcatggtggaacggattgaaaaagccttttcactccggataccgatttcaggtatctatgttgaacctacggttgccagaatctcgtctattctggatgaaatgatggaagcgtatcaggcaaatccggctagcgctgggggagtctatcacagtgaggcgttaattcagcaacatgcagaaacgctcagaaaagatgtctacctgaaagaaagtgtgcgccctgatggcctgcctcatgctaactggtatcagccggatacggtattgctcaccggcgccacgggatatcttggtctgcatttgctggagcaattgctgaaacagactgcggccagaattatctgtttgtgccgtgactctgatgaagaacacgcacgagacagaatcaaggccgggtttgacaagtaccagattgatgttgctaacgggcttgagcgcgtagatttcattatcggagatttggggcagccacgctttggcttattaccggaaacatgggcacagctcgctgaaaacgttgatgtgatttatcacaacggggcgttggttaactttatctatccttatagcgcactgaagagcattaatgtcgatggaacccgaaccgcgctggaatttgcctgcacagcacgactgaaacatttccattatgtctcttccgtgaatgccctgtttgccacagaatcaccccgtccatttatggaagatgatcgcgctatgagcgagtcggtacgagatccttcaggttactcaggcagtaagtgggtatctgaagggatcatcaatattgcccgccagcgaggcgtacccgtcagtatttatcgtccgggtctgatccttgggcatacccgcacaggagctgcacaaggcaatgattatctcgttgcttccctgaaaggttatctggcaatgggcttttaccctgagcatggattgctgcttgatattgtaccggttgattatgtcgctgcatcgttggttcatatctccaagcaaccggaatccgatggtaaattctttaacttatttaatccggttcaagtctctatccggcaatttttcgattgggtacaggagtttggctatatcctcaacccagtccccttcaatgagggtaaagagaagatccttgcactggatgatacacacccgttgtatccattgatcccattgattagggacatgacagagaaaccttatcgagcgttagatccggtttatgttcatgaaattcacccagaactggagttgaagcaaacgctggcattattggccaacactgacattaaatgccccgtcattacggcaggatatgtccatcaagtattacaatatttgatagatacaggtttcttacccgcagcactgccagaaaacttcaaaccggaggcctatcttggaacagctaacaggaaacgaagccatgaattggatagtcgtcgtgaacagcagaaaaaagtattcggtctggcctgaggcctatgtgcttccagtcggatggggggcaatcgggatgataggttctaaagaagaatgcctcaatcatattgctggtatttggccgaagccaacaaactagatgacggatattaagtcatattaataaatattaattatgaatagcaggcatgttccagaaggagcatgccttttatttatccttctattcttatcttgtcagataagagtgatgtttagcacaatactgactttcttattccatcctatgcgcacttttagttcgtttttgttccttatcaaacagcaactgtagattttgaatatattttgccattgaaatagactccgctgaaaatggcgttccataccccgtgccacatggaaaaaatgggctgggcggcctattctattgaattgactaagcgtattccgggtgttgagggcatgaggcaattaggcgtgttatttgcctcattttgtgaggcgaatagcgttgttaatcgcctcaccttgtgagtagaatgcgttgattatttgcatcatgaggtgaatgtccaatgtggatttggcagcacgaagattggcctgattttcaatgggacgaaagtgtactggcgccagttctgcgacagattcattttaatcaggggctattgctgggtagatctgagactgaaaatacagagcagacgacactagataatcttctggccagcattctctactcctgtgaaatagaaggggagaaattaaatgcgacatcagtacgttcttcattggcaaatagattggggatcagtgaagaaaaaccgtatccaaccagtgaacaagctgatgggatggcacagattgctcttgatgtggtggaaaaatacaatgaacctctaacccttgaacgtattttgaaatggcatgagttaatgtttcctgtcggctataccctatttaatcctgttaaaggtgggcagctccggaatgggggcatggaggtagtttccggcagaatagacaagcccgtaatccattttgaagctcctcctgctgaaacattatgccaggaaatcgcaaaatttattgtatggttccatcattcccgccatgaagaaaatcttgatccagtattacgggcggcaatcacgcacttgtggtttgtcacgctccatccaatggaagatggcaatggacgtataactcgttttttgaccgatttggtattggctcagggagaaagccgctcaatccggttttatgcgatgtcagtgagtatttgtgaacaacgtaagcagtattatgacattttggaaaaaactcagcgcggcgggttagatattaccgattggatgatatggtttctgcaaacactcaatgacacactcatcgctaaactgaaagccattgatggtgttgtgaaaaaatccaggttctggaaacgaattgatcaaacccaacttactgaagaacaaactaaagttttgaatagaatgcttgatggcgattttgaacaagggatcaacagtagccagtatcagaaagtcgccaaagttagtcgggcaaccgccactcgacatttaagccatcttcttgagctgggctatatggagaagacaggtgctggtggccgcagtacacgttatgttattcatcatgataagaaacaataaaaatttagtcgcgacaaaaacattcagggcgggaatttccgccctgaatcgataacttccacaataaattaatacagccaatccatgcccatgcggtctgcggccattattgctgcatggacctgttctggggtgactttaaacggcatattgtgaatagtttcaccttcggcacaactggccttggcaacttccatgattttctggtgcaatttctcactgtcccgcaagccgagttgctccagagtgacaggaagaccgacttgaacacagaaatcgagcacggtttccaactcttcattcgggctgttttccagcatcaattgtgccagtgtgccgaacgccactttttctccgtgatagagatgatgacattcctccagcacggtgaagccattgtgaatggcgtgggcagcggcaagccccgcactttcaaaaccgataccactgagataagtattcgcctcaatgatattttccactgccggagtactgacacccgcttccaccgcgagttttgccttataaccttctgccagtaaggtgtcgtaacacagtttggccagagccagcccagtattggatgttgcaccaccagccatcgttggtttatgagcagcgctatttgcccgggcttcaaaataggtggcaagcgcatctcccattcctgccacaagcagacgaaccggtgctttggcaataatacgggtgtccatcagtacgatattagggttttgtggatacagcaggtagccatcaaattcacccagctcggtatacagaacggaaagggcactggttggggcatctgtggaagcgatggtgggggaaattattacaggtaacttgcattcatgcgctatagctttggcggtatcaagagtcttgccgcccccgatcccaattacggcctgacattggttactcgctgaaatgtctgacaggcgtttgatttcgccacggctacattcaccgttgaagatctcaaaatggctggttactgcgtgttcttccagacttttgctaacggtatctccaatgaggctcatcacgaaattatcggcaatcacaaaaacgtgatcagcaagcattttggtgtattggccgatgtgagataacgcacctggcccttggatatatttggatggagactggatcactttcagcataagaaatattccttcttcactggaaactcaacatgagctgtcataacactggcgtgtggcagatcattagcagtttcgaataaaagtatttgtttgcctgtccgccaacactatacgataaaacatacagggaagttatgagccaaagcaggaaatgcgcgatctgtgagataaaatcgaaagatttatttacgccctgattgattcggggcgtaatgttgcttcaatgattgttgaccagagttttatctgttgaatgagagaaggaaaatttcaggattaaattcaacaggatgccataagctggcaggaagaaaagcatacagatgaacagcttgaaagcgtaatccaccagagcaatctctacccagtgtgtcgccatgaatgcatcgctgctgcgataaaatgcgataaaaaaaaatgccagtgtatcgagcaaattaccgaaaaacatggcggcagtcggtgctatccaccagcggcgtttctgacgcaggcgattgaaaactcccacatccaatatctggccgaggacataacccataaagctcgcggctgcaatacgggcaacaaacagattaaaggttactaatgccccgaatccctgccacgttccttgaaaaaatagcgcggaaatgaaataggaaatcagcagcgctggtagcataacagtgaggatgatcttacgtgccaatggtgcaccataaatgcgtacagtcagatcggttgccaaaaagataaaaggaaatgtgaatgctccccaagtggtatgaaaaccaaaaatggagacaggcaattgcaccagatagttactggaagtaatgatcaaaatgtggaaaagtgaaagccagatcaacgctgtggctttctgctgcgtggtcaagtggaacatattatacctttttgatgaatggggtaagggaacccaaaaaaacaaactttctttgcctgaattatcaggtaaaacgcatcatacgcgcgttgcgcaacaaaagcaaagtgcggcagttgatgatattttgtaatataatccatcgccatagtgtgtttgaacctacagagattgttatgtccaatgtttttgctaaccctgacaaaacgcttgatacgcaggggttacgctgtcctgagccagtgatgatggtacgtaagatcgttcgccatatggatgctggccagacgttattgatcattgctgatgatccggcgacgacccgagatattccgggtttttgccgttttatggagcacgccttgattgcacaggagacaggacaaactccttatcgatatttgatcaaaaaaagcgaaaatgtagcttaagtgactggcagaaaaagtgggctgtgctaggcttctaatatggcacttggatagcattaatcacctcactgggtgccatttttcctttttccttaatagcaatcttgagtcactgtaattttgaaaaggtgcatttttgcaccttttcaatttatcttgtttatctcttgattaagaggtctgggttcttaatcaatccgcatattaatcaatcatcgtttttgcgacttaacccgcagcagccggatggcgttcgctgtaaccagcgccgtggcgcctgaatcagccagcacggccatccacagccccgtgatgcccaatagactggtaataaggaatatcgccttcaagcctaacgcaatagtgatattctggcggatgttatagtgcgttgtccgggacagggtgatcatttcaggcaaacctgtcagccgattgtgtgttaaggcggcgtcagccgtttccagcgcaacatcagtaccactccccatggcgacgccgatactggccgctttcatggcaggggcatcgttgatgccatcaccgaccatcatggtatggtgtttttcatttagctcagtgacggcttttaccttgtcttccggcaacagacccgcgcgataatcgatccccaattgatctgcaatagcggctgcagcacgagggttatcgccagtcagcatcacggcattgatgccttgctttttcagggcgcggatcgcgtctatggcatcctgacgcaaggtgtcctgcatggcaatcaaacccacaaattgctcaccctgtaccacggcaaccgccgttttaccgctgctttccagctccgtgaccctctgtttccatgcggtggataacgtattttccggcagccgctccggagccgagaccagaatcttctgccccgacaatagcccttcaaccccgatcccagacaacgctttacggtgttcagcttcgacaaccgtcacgcctttattttctgccgcgttgaggatagcttttgccaatgggtggtgcgagccgctttcgaccgcccctgccagcgccagcagtgtttctacgctgatgttttccacgggttcgatttccgtgacctggggttttccttcggtcagtgtaccggttttatccaacgcaatggtggtgactgaaccaagctgctccaatgctgctccgcctttgattaaggcaccacgacgggtcgctgccgccagtgcggaagtgattgctgcgggcgttgagataaccagcgcacaggggcagccgattaatagcaaagtcagtccacgatagagccaagtttcccaaggctcggcaaggacgaggggagggattaccacgaccagtacagagaacaggataatcagcggtgtataaatacggctgaatcgatcgatgaagcgctcaatgggagcacggcgctcttccgcttcttctatcagttgaagaatacggtcgatggcattgtgtcccggttcagagatcactctcatttgcactgcgctatcgacagagaggcagcccgcagcaactttttctccctgctggcgctctactggaatagattcacccgtcagagcactttcatcaaaactggcgaacggactgagtagttcggcatcggtaggtaaacgggcacccggcgcaatctcaataatatcccccggacgcaggtcagccgcaggaacggttttcttttctcctcctgtcaccagcagcgcctgttcaggaaccagagccatcaaggcactgacaccacggcgggcccgtcctgcggcataagattccagtacttctcccactttgaacaacagaataaccattgccgcctctgcggtggcatcaatgaatagggcaccgatagccgcgacactcatcaaggtttcaatggcaaagggagttcctgaacggatcagtttgatagctttggtagcgaccgggtataaccctatcaacgtggtaataatgaaagcaatctgtccagtgggtggatttatttttgcaatgccccaactgatgaccattaatgctataagaatgagaattggggaaaaggttttccagtgatttgccgctggaggcaatttagtcgtcgaatccgtttgcttgatttcaaaacccgcctgttttaccgcttgttcgacggctgcgcgaatatcagaatcagcatcgaccaccagtttttccgtagtaaacagcaccttgacctgtttagcttctggcaattttttaaccgcattttcgattttgcccgcacagcttgggcaatccatgccgtggatgatccagttaaaacgctggttggcggttaattcaagaggggttgtatcccgtatggtaggggcatggtcgtgtgagcagtgtccttgagcatgttgatgggagtcgtgtgaacctttatcttctttgccatgagagccgtgggaatgctcgtggtctttatcttgatgctctttatttttgtaagacaaagagccgtgctgtaattgcttatgttttttaaatatggagaacataggcggcctctcaatagagttaatccaaatgggttacagttaactctacactctggagtaaactccagagtcaaattcaaaacaataaatttttttgatgatttgtgctctttgggatgaaatcatttattccctcttttttgttattcgattagataaccaatgagtgaataatcaaaataaatgataccgacagaataccgtcggcatcactgacaccaaatagaaagggaatgggacgttatttcttatcttgacgctgttttttctgccaagccaataactcaaacacaccaaaaaagaagatcttggtctgaagaaaaacagaaaacttttgatctttgggctgggagttttttaatagcaaaagttgaaaggcatgcattatcaccgtgaaaaccatggcgatatccatgaaatatctcaatggattaggaaagggatggatcaaattgaaaatcataattccccaaacgagaaccatgataactttccctaattgaataaacatcattaactccaaaatcgtatttaagcaggtctgttgccagactactggcggcggatatacagtcggtaagcaacttgcccggcaattttttcccgatgtaactgccagtttgagggagcttctgttgcagcagattctgattccgcttcaacataaatccaactctcttcagccaaccaaccgttggcttccagtaagttgattgtctcaacaagcatccccttgcgaaatgggggatcgaggaaaaccacatcaaaaggtgtgcctgtctggttgagatattgcagggcgtttccctgtaccacattagcattttcggccttaagtaaggctaaattggctgacaattgttttgctacattacgatcatattcaagcaaggtcgcgtgacttgcattgcgcgataaggcttcaaacccaagtgctccgctgccggagaagcaatccaggcagcgagcttcctgaatgatgggcatcagccagttaaagagtgtctcacggacacgatcagtcgtcggacgtagcccctcactatcaggaacgggtaattttctcccgcgccattttccgccaataatgcggatttgtcccaaagacgtgctctgtgattttttagtcataatttacatagtctaagcatttgtcatccgatgctatttgcataatagatgacggatacaaaaaatgagaatgaagaaatatattgattaatttaccacgaaatccacacatagatatgtgttgtgatgtgatgaaaatgttagactggattttatcaccgttagaacctatcgcagcaggcgtagtggttgaaaaacaaagcgtctgctgcgataggtttttagcttatcctaataagcattaattgcacccgcaaacgggtaaagaaaataacttaatgggataggttgttaaacgccataattaaccgcgaggagtgtagtgcccaatggcagaagagaaaaaaagaggtttcttctcttggtttggacgtggtcgtcaggaaaagaaacagcaagaagaacaacttgaacaagacaaatcagcggcggaagaagccgagcagcagcgtttagccgaagaagtcgcccgtcgcgcagcagaagaagccgaacagcaacgtttggccgaagaagccgcccgtcgcgccgcggaagaagccgagcagcagcgtttagccgaagaagccgtccgtcgcgccgcggaagaagccgagcagcagcgtttagccgaagaagccgcccgtcgcgcagcggaagaagccgaacaacagcgtttggccgaagaagccgcccgtcatgccgcggaagaagcggagcagcagcacttagtagaagaaccatccgtattacccaaagagcaggatcgtccgagcaaagaaggcttttttgcgcgtttgaaacgtagtttggtgaaaacccgccagaatctgggttccggatttttagggttattccgcggcaagaaaattgatgatgatctgtttgaagaattggaagagcagttactggttgcggatgttggtgtcgaaactacccgtaagatcattaacaatttaaccgctcatgccagccgcaaagaattaaaagatgcggaagcgttatacacgaaactgaaagaagaaatgtcagatattctggcaaaagttgataagccactggatatagaaggtaaatctccttatgtcatcctgatggtgggtgtgaatggcgttggtaagacgacaaccatcggtaaactggcgcgtcagtaccagtctcagggcaaatccgtcatgttagcggcgggagataccttccgtgcggcagcagtggaacaattgcaggtctggggagagcgcaacaaaatcccggtaattgcacagcataccggcgcagatccggcctcagtcatttttgatgcgatccaatctgccaaggcgaaaggcgttgatattctgatcgctgataccgcagggcgcttgcagaataaatcccatctgatggaagaactgaaaaaaattgtccgtgtgatgagaaagctggacgaagagactccgcatgaaattatgctgactctggatgcctgcacaggccaaaatgcggtcagtcaggctaaactctttcatgaagcggttggattgacggggatcacactgaccaaactggatggtactgccaaagggggggttatcttcgccattgccgaccaatttgatatccctattcgttacatcggtgttggggaaagcattgaagatctccgtccatttaaggctgacgattttatagaggctctttttgcccgagaggattaactatcaatgattcgctttgaacaggtcagtaaagcctatctgggagggcggcaagcgctgcaaggggtggattttcatctgcttccaggggaaatggcattcttaaccggtcattcaggagcgggtaaaagcacgcttttgaaacttatttgcggtatagaacgcccaagtgtaggccatatttggtttggggggcatgacatcagccgattgaaaccccgtgaaaccccttttctgcgtcgtcagatcggcatgatttttcaggatcatcacctcctgctggatcgcacggtttacgagaacgttgccatgccactgattatctcaggggcaagcgccgaggatatccgccgacgggtatctgcggcgttggataaggtaggcttgctggacaaagcgaaaaacgtccccattcagctttctggtggtgagcagcagcgtgttggtattgcccgcgcggttgtaaacaaacccaccgtcctgctggcggatgaacccacgggaaatctggatggggaactgtctgaggggatcatgcgcctgtttgaagagtttaaccgcgttggtgtcacggttctgatggcgacgcacgacgttgctctcatagaacgaagaaattaccgtatcctgacgttgaatcaggggcgtatgcaaggaggacatcatggttaaaaatgtccgtcattcagcgaaaaaaacaacaccgcctaaacccaagtccaaatcattgaaagggggctggcgcgtacagcagcgttacgcgtggaaaagcaccttgtcagatatgctgcgccagccgctggcgacgttgttgactatcatggtgattgccatctcattgaccttgccgagcgtgttttacatcgtctggaaaaatgttaatcaagcggtggaacagtggtatcccgttccgcaacttacggtctatctggataaatccttgaacgacggcggcgccagacaggtgattgagcagttgaaagtcattgatggtgtgaaatcggtgaattacctgtcccgtgaagaagccgagaatgaatttcgtgcatggtctggttttgcgggtgctttaaatctactggaagaaaacccgctgccagcggtcgcgattatttcccctcaaatggattttcaagattcgacggtattaacaacattgcgtgatcgggtttcccagatcaaaggtatcgaagaagtcagaatggatgagagttggtttacccgtctcacggccttagcagatcttattggccagattgctgctgtaataggtattttgatggtggttgcgctacttttggtcattggtaacagcgttcgtctcagtatctttagtcgtcgcgaaactatcaatgtaatgaaactgattggtgcaacagatggttttattctgcgtcccttcctcaatggtggagtattgctggggggattgggcgcggttttttctctgatcctttcatcgttactggtttggaaactctccaatgtcgttacggatgttgcaggtgtctttggtactacctttaaattgtacggtttgggatgggatgaatccctgttgctggtactgatttctggcatgataggctggcttgcagcatggtttgcgactattcagcatttacgccgtttcaggccggaatgagtccgtttgttggtctttaggtgaacttttgggctgcattacggtcgaagaaattgtggtcgaaaacacagttagcaatttgtatccatattcataccatttagatgatttgaatatgatctctatgatggtaaaatagacatatctttggcttgaataaaccttatcggttggctcaggcaaaatttacaaggccatcaatttggatctgatttgagagaatttgaatgacaaaagaaatgcaaactttggcattagttccacaaggtagtttggaagggtacgtccgtgcctccaatgcttatcctatgctctccgcagaggaagagaaggaactggcagaaaggctgcattaccagggggatctggatgcagcgaaaaagctgattctgtctcacttgcgcttcgttgttcatgtcgctcgcagttattctggctatggtctgccacaggcggatttaattcaggaaggcaacattggcctgatgaaagcagtccgccgatttaatccagaagtaggcgttcgtctagtttcttttgctgttcactggatcaaggcagaaatccatgaatatgtactgcgtaattggcgcattgtgaaagtcgcaacgacaaaagctcagcgtaaactgttctttaatttgcgcaaggctaaacaacgtctggggtggttcaatcaggatgaagttgatttggttgccaaagaattaggggtaaccagcaaggacgtccgtgagatggaatcccgcatgtcggcacaggatatggcgtttgatatgtctgatgatgacagtcatgacagccagccagtggctcctgtgctctacttgcaggacaaggcttctgactttgccgatggcattgaagaagacaattgggaaaaccacgcggcggataaactttctctggcgatggaagggctggatgagcgtagtcaggacattatccgcgcccgttggctggatgatgacaacaaatccaccttgcaggaactggcggataagtatggcgtatcggccgagcgtgttcgacagctagaaaagaacgcaatgaagaaattgcggctggcgattgaagcgtaaactcatcactgacggattaaaaagcgataatttatttatcgctttttttgtgtctgctgcccgacgaaacgctggctagaagcaccagagaatagaggacattgttatgaaaatcgtgattgcccctgattcatttaaggaaagcctgagtgccttgcaagtcgcggaggcgatagagcagggatttagggaaatctttccgcaggcaacttatatcaggttgccaatggcagatggcggagaaggtacagtggaatctctggtggccgcaacgggcgggcagagaatttcatgttcagtaaccgatcctttggggcagccggttgatgctttctttggtttgctgggagatgggaaaaccgccgtcattgaaatggctgctgcttctggcttacatctcgtgccgatggaacatcgcaaccctttgataacgacgagttacggtactggagaactcattctggctgcgctggaacacggtgtgcagaagttgattttgggtattggcggcagcgctaccaacgacggtggtgcaggaatgatgcaggcactgggtgcgaaactctgggatggggacagccgcatcctgccattggggggggcggcactaacccgattggaaagtatcaatctttcctctcttgatccacgtcttaatcagcttgaaatcactgtagcctgtgacgtgaataacccattatgtggcgaattgggggcatccgcgatatttggcccacaaaaaggggcgacaccggaaatggtcaaagtgttggattcggcattgcaccattatgggatgaaaattgaatcactgacgggaaaaaaagtgattgatgtcgcaggagcaggtgctgcgggaggtatgggcgcttccctgttaggttgtttggatgccaacttgcagtcgggtattgagattgtcattaatatcctgaaactggaagaagccattcagggggcggatttggtgattacgggtgaaggccgtatggatagccagaccatacagggtaaaacgccgattggcgttgcccgtgtcgccaaaaagtttggtattcccaccatcgctttggttgggggaatgagccgtgattaccatgttgtgcatcagcacgggctggatgcagtcttttccattgtgccgggtgcctgctccctttccgatgcccttgtcaatggggctgataacttacgggtaacggcgcgtaacgttgcctcggtttggcgtatggcttattcgcaataatagtcattcttttgggcatcatagcggaaatcgctggccgccataaaaccactcaacgccggagcgtggatatcaggaaaatgattcaggctccattcccaacggttgatctcaggaaacgcggccttgacctgttccagcagataagaacccacaccgcgccggcgggtcacttcccgtacacaaaaatcttccagtattcctgttgatgagttgagcgtcactttaaccgcagcaagtagccggtcattaaactgtgccacaaatagtttttgatcacctgctaacagcacttcccactcctgcgcatcttgttccggccaaatttttttcaaatcaatcttatcctgtggggataaaacccttattggtttaattgttaatttcatagagttgttccacgatgatgaagcaatcagtcaattaatagcacattgcaccatgctgtaagcaaacaaaaaattgctcctaatttcaacttattgaataaattaataatcatgtcaggagatttaacatggggtagagtagatggtatctttatagtagtttttaagtcatacgagataaactccataacattaaggggtcagaatgaagcttactgagataagcctcaaaggctttaaatccattgataatgtgaaagggcaaaccatagtatttggcgatattacgttgctgctcggtgccaatggctcaggtaaaagcaacttaatatctttctttcgtatgctggtatccatgacatcgggagatttgcagaaatatattggtcggcagggggtcagccaactcttgcattatggctcaaaagtcactgagtcaatgaacttcagtattcgattagaagatgaagctgaatgggatacctatgaggccacgttgtcttatgctctttcagatcggcttttttttagcgatgagtgtgtaacgtctcaaaaacagaataatgcaacacagtcgaaatatgttttaccaagagatggaagtgaatcagggttacacagtgacaaacatacgacaagcaaagaaataactgccttccttgccggaataaaaacatttcaatttcacgatacatctgatacatcacgcatcaaagaccgaacttatgttgatgatgcaagctatttgagaagcgatgctggcaatcttgccgctttccttaagatgatgaaggataatgctcagtatcgaacttattacgatcgtatagttaggcatatacgtaaggtaatgccccaatttgaagattttgtgttggatgccttgccagggaatgagttatttgttcgtttgaattggtctgacaattaccgccctgatcatttatttgggccggaacagatatcaggtggctctcttcgttttatggctcttacggttttattgcttcagccaccagaattattgcctaaagtgattgtacttgatgaacctgaattgggtttgcaccccgaagcaattaccgagttggcaggaatgatcaaacgtgcttcaaaaaacacacagattgttgttgcaacccaatctacacggttagtagatgagtttgatgccgaacagctgataattgttgagcgtgataatcagactggagcaagcacctttaaaaagttaaaacatgaaagtttgagtgaatggcttcagcgctatagtttatctgaactatgggagaagaacgttcttggagggcagccgtgattagattacacgtaacggctgaaggccaaacagagaaggctttcgtttcccgcgttttggcacctcatttagcgacctttggcgtgtatgctgatgcccgctgtgtcttgacgggtagagataagcgggtatcaaaagaatatcgtggaggattacttagttatcaaaaggcaaaagcggatattcaaacttggatgaaagaagatcgggacagaaactgtcgatttacaacaatgtttgatttatatgcattacctgacgattttccaaattatcgacaagctaatcagcaagatgcctattccagagttcgaattcttgaggatgcattcttgaacgatgtaaaggatgaaagattcattccatatatacagctccatgagtttgaagctttaattttttctgaccctgcgaaattagattgggaataccttgagcatgatactgccatcgcttctttggttagtatggctgaagatcaaaatccagagcttattaatgatggcaaagaaacagccccatcaaagagaatttttaacgcactttctgattacgataaagttagcgcaggtgtttctgttgttgaacatattggattgcagaaattgagagaaaaatgtaggcattttaatgagtgggttacccaattggaaaacttaagtcgttgaacagtctgcggtcatctgctgttaaggttgatgaccacaggctagtcacaaaccattatttgtttaattgttaacttcatatattcactgacctcaatgaaataaattccaacgttaatcgtaatttatcttactttttccaatatttttggcaaaaaattttaacagcatgaattttccaagttaaaaattgagcccatcacatatcagtagcacatcacaccatccttttaacaaaatctgctttggcacgggttccttccgtggggagcagtaccgctctaaagtttttaatggaaaacgcatcaattcatcaaattgatttattaattttaaataataatattgagagcctctaatatttttgcgatgaataaagggggaataaaggaacaatatgtgtgctgttttttgttttgacataccctcgacaacgtatatattaagcagttatttttaattaataagaatttatgaatatttttcacttacctgaaattaataaactcaacatataccctatgtatttcaggatgccaacaacgctgtaacttgaaggacgggtataaaggcaaagtggtcattctcacaacatgccgctttaaggaaaaggagtcagttgtgaaatcgtttgaatattattatcagcgggaatttgattatttaaggcaacttgcaaaaattgtgagtgaagaaaacccgcacctccgtgatgtattgggtggcggggatcctgatgtcgaaagactttttgagggtgcctctgtgttaacggcgcgccactggataacgtggcgctcagcgagcagcttggcaccagcgtttctctgaccgtcatgcgcgatggcgtcactgaacgcaccgtcaacggcattgtggcgggggcagagcagggcaatactgacggtctgcgtacctattacacatttattgtccgccctgaaatgtggttgatgacgctcaatcaggacagccggatttttcattaccaatccgtaccggatattctcgcccggttgctgaaagagcatcgcatcaaggcggagagtaaattctataaagatcaccagcaacatgcaatacgggaatacaccacccaaaaacgtgaatctgcctatgatttctggtgccgtctggcggcagaagagggcatcatgttctggcttgaagaggacaagctgttctacagcaacgcccaccttggcatgttggcggcactgaccctgacctacaacgttcaggccaataccgacaacagtgattcaaccgcatggcagtggaattacggcgaatacctctgccctgatgaaaccctccataaagacaacaacttcctgcgcccctcctacccattgcaacataccgctgcactggaaaaaggcatggggcattcagtttttgaaagttatggccgttttcagaaggatgcagaaggtcgtcctttcacccaattgcggctggagcagttgcagaaccagagcaaagtcggtaaagcgagtaccaactgtatcaaattaagaccgggtcggatcttcgttctgcaatcccacccgattggtgccatgaatgatcgctggcagatagtcacggtttcccatcaggggcatcagccacaagcctccggtgaggccggggagggaaccaccttgatcaaccagatttcctttattccgggcaggcaggattggcgtccgccttttcaatataagccgctggcggatggcgatgaagtggccaccgtcgtggggccggagggggaagagatctacgtcgacaaacatggcgctatcaaagtgcatttccattggaaccgttacgatgaagcagacgaccgggcatcctgttgggtgcgggtggcgcagggctggaatggtgatggctatggttttatggcgatcccccgcatcggtcaggaggtgattgtttcctacctgaacggggatattgatcgcccgatcgtcaccggctgtacctacaacgggcgcaaccgcccaccgctggatctgccagcggaaaaaacgcgtaccaccttcaagacccgcacccacaaaggtgaggggtttaacgaattgcgctttgaagatgcgaaaggcagtgaagagatctatatccacgcccagaaagatcagcttatcgagataaaccacgataaaacccagcgtgtgggtcacgatgaaagccactatgtcctgaacaaccgcaaacatgaaatcggccacgatgaattcatccggatcatgcatgaacagcacatccagattgacctggaccagtttgaaaccattaccaaagatcgcaaaacccgcatcaacaataactggcaggaaaatatctttgcggatcacctgcaagaagtggggcgggacaaaaccgccaaaattaacaacaactacaccctgaatgtggtcaacaacatccagagcctgacgaaagtccatacgctacaggccagcgaatccgtgctgatcaaaggcaaggcggggtcgattaagctgggtggttcaggggtgacgatcactggcaaaatcaccctgcaaggggatgtgtcggtaacggggggtagcccgggtacggtgccgtcactcagcggatcagccaatgaagggttggtcatggccgaggattgccgggaaaaagcccgtaagccgcaggagtcatcggaataatgtcctggatacccgattatgccgaacattgggtggtggattatgcctataccacgccacaaggcgaacatgactctgcccgggcgattgtccatgcaacgagccagccgcaggcgctgtcggcgctggcagaatatgtcctgcaggcgggagattcaccggggcaataccaaagtattcagccgttgcctgaataccttgccgccagcgctgaggtcgaattgccgctactgcggcagttccggcagggggtggagcggaatgcccgggtgatcccgctgaacgcacacaataacaaccccctcctgccggccgcgcgtggcgtattgcagttcgccgtgacggaaaccctgcccgccagggagcgcgggcaataccgctatatggtgattgatgccaccgtttaccgccgggtcatgggcagttttatcgtgccagacctgatggtctccaacctgcgatgggaaagcctgtttcagggagaaacccaaatcacgctcgaagacagcgccccttatctggtggagttaacggatgacccaacggtgcactcggcttttcagcagaagatcacccagccgatcaccccggagccgggcatttttatcgacagtgaccagccatttcctgtgatccgtaatcacctgcgtaaattcacctatctgagaaatgaacaacaccaatcctgggtgttttaccgcttctatgtgccgcaaggcttgctcccgctactgaaaagcctgccggatgaacaactgatgcattttatgcgcccgataatgcggatcggttatttcgacagccagacggggcagtactacgccctttctgtggctgaaaacagcctggatcaggaaaaaacggctcccgtggtcatcaaccgctctctggtgggcatattggcggggcagacccaagcgcgggcggtggcgcagatagtgaaatttattgcagagacccagcctgaactgtcgccagaacagcaagaacagctgcccgcctttgtggtgcaacaggccaatcttgcctgtctggcgggattcgcccatcagcgttcgattctgtatctggtggcgggcagaagtctggcgcgggataacgaagcgctctggcagcgggcatggcagcatgcctgtgtcgaagcacaggcgctggcttgttatgagtattgttttaaaaaccgggcattaagttaacacaaggagagaagagaaatggaaaaatcgatattaacgaacgcgggtgacgctcttgagaccgccgcgaaaaaagcggcgaaaacgtttgaaaaaatggtcgatgaggcgaagacacgcatacctcatgagctggacatggataccgttgtcaggccctgtgacgccaatatccggccggtttatcctgtcagatatgcttatatgaatttttttggtgacacatggatagatgctcaattaccgccgccaataaatacgtttattgatccttatgatgattcattaagtgccagcgttctggggggctatagtattcgaatgccaagaccgggttggatctatgtcaaagaagaaggggcgattaaaacccggggttcccaacagggtggcaaattactgattttcaaattcagccctgaaattgtcaccttagagggcaaaagggggatggtcacaaaatacaccaaatatgagcaaaaagccggaagctcatcgtgggaagaaatccaccctgccagcggtacagcgggattaggctatccttttctggcgattgataaagatgtgacccaaatcagcctcatttacagtgaagtcgagctggctaaatctgtcctgaataagatggataacgataaaaacttccgcaagaatgcgatgcaatttgtggatttagacagtgaggtatcagattatgccattgatgccagacaagaacatttcgacggattagtggaagatttcaaagatcctgaaaaacaatttcaggcatacaaaaatcaattagccgatccgcttttacacgctgctgatttgggggatatcacgacggaaggcagttttttcatggatgccgatatggaaatgcgttatatagacagtcttatctgcccttattacaaagataaagcgaagattgtggtattgcatgatccggtgggatatcagcgtgatattttaatggcctataagttacttaatctttgggagctaagctatagtgcaactaatatgtatcctcttacgatagggaattttgttgagatattatctgcatcaaaaaataaagaaattaaaaaatgtgttgaggagtgtattcaccaagaaaattggaaaacttggtggcctaaattaactacgccgattaagagtgtaaaagatagaaagaaagagattcttgaattttataaatgtttttttgaaagtgaaatgattgcaggtaaattaggtgggcttacacattattttaagaattttttctccgtatctgataaaaaggacatttataccgaaggtgatgcaaaagaatttgaacgattctgtattttacacgctgaattaatggagccgctaaagcattcagaagagggattgttggcgatggaaagtattattgcgggtccattggccatagacggaaatagtgcgtgggaagttgccctcaatggaatagtgaattcattgggccatgatggcgttgataaaggttccattgcaaagttcctcaatcggggaatagatataatactcagtgtcgttggcaatttactggctagactgtatgtatttacaacagagttatcatataaagggatattacatttacatgtgttgagtgttaaacaggtaacgcataaacttgtgcctaaaatcttagattatttggggcttgaaataaagcaaggaaaatatttcgaattaaccgagaaagaatattataagtttctaaaagaaattgaagaatatgaaaatcaaggagtatcaggtaaaattaagaaaggcatggatcatgctgagtctggcttgaaaaggtttgtagggaaaaaagtgtttgactggtctaacaggttggataattacaataataatataaagataaaaataccgctgattaaatttaaaaggcctgagttaaatcctcagtttaagtttttttataatgaaaataagtctgctggctatttattgagctctggcttaagtggtttggatttatttatgaagagttatatgttatataaattgacatcaatgtctcgtttcgaaaagaatgcgccatttaatgcaaacagacttccttattattatgtttcaagctatgcgaatactatattaggcggattaattgctgcgaaaggtgtttccgctattggtggagatgctattaaagttgcagctagcctggcgggtaaattgaatagccccgcagcgaaagcgttattggattctgcatcacgcaggcttctgttagaaagtgctttaataacaaaatgggtaaatggtggattaattactacagggtttgtgagtggagcactttcttattacgatgcctacaactcttttggttttggtaatgataaagaagcttattctcatatttcaataggtacaggatcaataataatggctgtaggatggtctatggcggtagccgcgtcggaagtgacttttggcatcagtcttctgattgcgctaggtgcttcactaatgcttggtggaacattcgcagctatatacttcaattgggtagatttggaaacgttgttaaagaactgcttttgggggaatggagagaaatatgctttttggagtacagataaagatcgtctatctttagatagtcaattaaaaagaatgagaaactttgatgaagaaattaaaaataaatacttggttgagaaacaagtatttttaaatctttttattaaaccaatattaaaaatagaaaataataaacaagggaagatgatttataaatttatactacctagtttcaaatggggggaatcagatatatatcatgaagtcatgccatctggtttgtcagatggctatagtgaccctgatgcgtcaataactgaacgtagttatggtagatatcattattttgtggcgaaagataagtttgataaagcaatagatatcgctcgtaaaaatcgtgaaaatctaatttatgacgaggaaagtggtttaactacactaaccgtagaagtagacgaacaatattctgtgtatatgaaagtcttttggtattataagccaacagaagatattgtttctcctcttcactataaatggggaaaagagccaacattggaaaatgcggtttatggatatgaagatgaggtattacgttaaatgagtatattaattaaaaaaatattcaagaaaatttttagagtgaagacacctccaacagagccattatctacatttggtgatcccgttctggaggaaaagctaattttactggataataaaaccgtaaaacgtgcaggatttttggatgcaataaatagcaaggagtgtcattttcgtcataatcttatcagagcaagaaaagaagttataatacctgtgtttgttgggtttatgttagggttttgttttttcattaataattttgttaaagtatggaaagctaatgaagaagattatctttggttcttaaaagatgcaaaagaaagctatggagagcaattttatttaaatcctaatgcacctgcatatactaaatcattacagattatatcagatgacaaaaaggtatctttattagaatatctctatattaaatattataaagatagtttttatggtgaagaaagggctagacgatatctgattatagatgccagtttcgggttgtttttcctgagtgccaatattcttattatcagcatctttttgagattacgtaagcctgcaaatttcatcattgatcatgaaaaacaacttttttacacttggaaaaaagggaaggtgtatgtatctcgctataaagaattaggcgtagcgtttgctaataatattttgcatttcaaatgttatgggctgaacgaaaagaatgaactgacatatcagttttttatcccttatcttagccttttcaactcagacgaggataaagcttatatttttgcatttatgtcaaaatatttattacaaggaaaagaggctgtcagttcagttgattttaaacgtcaagagcgattaccgtggtttcgtaagcaaataaaaccagcagattgggaaactcagattacggcaattgtagctgaattggataggcttgggcctccgaaaggggcgactgatcctaaataatagctggaaaaaatattaatatagtgagttatatttttatgccaaaaaaatagcaccgaaaaatattataattatctcggtgctaattttaaagttttaaaaatcgtattgtaaacagttgatttattatcatttatattaaattgttatatgggatttttttatagctaaagataacgaaattaaattcatttattaggccaatttttaaaaaataaaaaataaaaaataaaaaataaaaaataaagatgatttatagttttctattacctaattttagattgatagaatcagagttggtttataatatcttgaaatctttttatggtgaagaaggaaggaaccaccctagttattattttatgttgatacgctataagaaggcatcggaaagataagaaattaaatacggtggatacgtctttttatctgtcttcgcctgatatcacccctgaatttattggtgcatcaacccgtgagcactggcaccttgaaaatagtcttcattggttactggatgtggtttatcaagaagatgtatgtcgggttcatgacatgaatgaggctgaatctctggctatcatcaggcgcttggcattaaatttagccaaactgtaaataacgcaaaaacgtatataatttttctcataggtattccaataataagcctgattgataatcatatcgggagtattcaggcaattaatacaaatgaagatataataaataaagttcttatgttgactgtgggtattatgatgataacgctattattcacagttattaaaataagtgttaaggaaaaagaggcgttgtacgcctctcttatttataaatcttattcagagtgaatgaaatcatagcgtgtttaattgtcaattttctataatctactgtataaattggataaatttaactatttcggtaagttatatcaatttttccaaaattattggaaaaatatttttaacagcgtgaattttccgagttaaaaattgggtctatcacatatcagtagcacatcacaccatcctttgaacaaaacacaagcaattacccccttattttattctgttattaatgctttttactgcctcattgatttgatttacaggataaaactcctgtttaatatcatgataaataaaatcttattaataaaaaactatgattcattcatcactggcaataaacgacatttatccgcctaagataatgaaacatctaaaaaataaacacaacaaactaatcataaagcggggataaccagatgaagatatcaaaaacgaaaacagttctggcaggttttatcgcgatggcgataagccagcccgtgtgggcagaagagatcaaagtcgcggtcgtgggggcgatgtcggggccggtggcgcaatatggtgatatgcaatttacaggagcacgtcaggctattgcagatatcaatgccaaaggcggtatcaatggcgataagctggttggtgtggaatacgatgatgcctgtgacccgaaacaagccgttgcagtcgcgaacaaaattattaacgataatatccgttatgtcatcggtcatctatgttcttcctcgacacagcccgcttctgatatttatgaagatgaaggcgtgatgatgatcaccccagcggcaaccaatgccgatctgacaacccgtggctatcagacgatcctgcgtaccacggggctggattctgatcagggaccgacagccgccatatttattggcaatagcatcaaaccacagcgtctggctatcgttcatgacaaacaacaatacggagaagggctggcgcgttccgtgcgcgatagtctgaaaaaagccggtatcactgccgtcttgtttgaaggcgtgaccgcgggcgataaagatttctcggcactggttgcccgcctgaaaaaagagaacgttgattttgtttacttcggtggttactaccctgaaatggggcaaatcctgcgtcaggcaaaacaagcaggtttgacagcccgttttatggggccggagggcgtgggcaatacgtcactgtccaatattgctggagccgcgtcggaaggcatgttggtaacactaccaaaacgttacgatcaggttctggcgaacaaagctatcgttgatgccatcaaggcgaaaaaacaagatccaacaggcccgtttgtctggacaacttatgctgctctgcaatctctgagtacagccatgaaacgcactggcagcgccgaacccgctgaactagcggcagatttgaaagctaatcccgttgataccgcaatggggaacctgagctgggatgcaaaaggtgacctgaaaggcttcgaatttggtgtatttgagtggcatgccgacgggacatccacagcagcaaaataaaaaaataggcttttacatcgcctttagcccctgtcttggcgcaggggcgatttttcagagagatgtcttatgttagaacacattctttattttattcagcagatgctgaacggcctgactcttggcagtacttatgccttgattgccatcggttataccatggtttatggcattatcgggatgatcaactttgcccacggtgaagtttatatgataggcagttacctctcttttattgtgattgccgccctgatgatgatgggcattgatgtcggctggttgctgattgcgacggcatttttggcttcgatcatcattgcgagcgcctatggctggagcattgaacgcgtcgcctatcggcctgtgcgtcattccaagcgtttgatcgccctgatctctgccatcggtatgtcgatatttctgcaaaattacgtcagtctctcgcagggctcccgtgatctggcactgcccggtttgatcagcgggcagtggacattaggagaaagcaacggtttttctgccagtgtgaccgcaatgcagctaaccatctggatcgtcacaatcgtagctatgttggtactgacattgtttatccgctactcccgcatgggacgagcctgccgtgcctgcgctgaagatctgaaaatggcgagtttgctgggcattaatactgatcgcgtgatttccatgacttttgtcattggtgcagcaatggcggcggtggcaggggtgttgctggggcagttctatggtgtgattaatccttatatcggctttatggcagggatgaaagcctttaccgcggctgtgctgggcggtatcggcagtattccgggagcgatgctggggggattgatccttggcgtatcggaagcactgacctcagcttacttaagtacggaatataaagatgtcgtgtcattcgctttgctgattggcgtattgttggtgatgccgaccggaattttaggtcgtccggaggtagaaaaagtatgaaaccggccaactggattaatgcgattatcgctacggtaacgctgtttatcttggcggctttcatgatgggcatgcaattgtcactgcaaggcacaaaacttgtggtgcagcgtgctgacgaagtgcgctggatgtggatttccataggttgtgcgatcgtttttctatttcaattatgtcgccccatgatccagcagacagtacagaagatcccgtcaaaaagctggaagttagctgatttggatggatcaacccgaaaacagcaattactgggggtactcattgttgctgccgccattatttggccttttgtggtttcgcgcggtagtgtcgatattgccacgctgaccctgatttatgtcatgctcggcttggggctgaatgttgtggtcggtctgtcagggctattggtattgggctatgccggtttttatgcgattggggcttatacctatgcgttattgaaccactattacggtttgggattctggcaaagcctgccactggcgggtttgactgcggcattgttcgggttactgctgggttttccggttctgcgattgcggggcgattatctggcgattgtcacactgggctttggggaaatcgtccgtatcctattgctgaacaacacagaaatcaccggtgggccaaacggcatcagccaaattcctaaacctaccctattcggattagaatttaaccgtagcgtcaaagagggcggctgggataccttccataatttctttgggttgaaatacgaccccagtgaccggatcattttcctctacttggtggctttgctgctggtggtattgacgctgtttgtcattaatcgcttgttgcggatgccattgggacgagcttgggaagccctgcgtgaagatgaaatcgcctgccgttcactggggcttagcccgacgtgcattaaactgaccgcattgactatcagtgcggcttttgctggcattgctggcaccttatttgcggccagacagggcttcatcagcccagaatcttttacttttgctgaatctgcttttgttctggcggttgttgtgctgggaggaatgggatctcagaccgcagtgatcctgtctgccatcatattagtggtctcccgtgaaatgatgcgtgatttgaacgaatacagcatgctgctgctgggggccttgatggtgttgatgatgatctggcggccacagggattattgccgatgaaacgtcgtcagcttgaattaagtactgaacagagagaccacaaagcatgaatgcgacccctttattacaggtctcaggcctgactatgcgcttcggtggtttgctcgcagttgataacgtagagctggccttgaaccaaggtgaaatcgtttctctgattggtcccaatggggcaggaaagaccacgatattcaattgtctgactggtttttaccggccaacctgcggcatgataaaactgcgggaaaaacacctcgaaggtttgtctgggcaagaaattgcccggttgggcgttatccgcacctttcagcatgtcagactgtttcgtgaaatgaccgtcattgaaaatctgttggttgcccaacatcgatttctcaaaaacagtatttttgcgggtttattgaaaacaccggcattccgacgagcggaagctgaggcgcttaacagcgcagctatctggctggaacgggttggattgctgccactggcaaaccgtcaggcgggtaatctggcttatgggcagcagcgccgcttggagatagcccgttgtatggtgacacgcccggaaatattaatgctggatgaacccgccgcaggacttaacccgaaagagacggaagcgttggatgccttaattgtagaattaagaacgcagtatcaggttgctattttgctgattgagcatgatatgaaactggtgatgggaatttcagatcgtatttacgttgtgaatcagggcgcgcccttggcacaagggcgtccggaagagatccgtcataacccggaagtgatcaaagcctatttgggtgaggcctattaacatgttggagtttaatcaagtatctactcattacggcaaaatacaggcgctgcaccaagtcagcttgaacattcagcaaggggaaatcgtcaccctgattggcgccaatggggcaggaaaaaccactttgctcagtaccttgtgtggtgagccaagggcaacggaaggctgcattatctttcggggcaacgagattactcaatggcagacggcacgtatcatgcgtgaagcgattgccatcgtaccggaagggcggcgggtatttgcccgcatgacagtagaagaaaatctggcgatggggggattttttgcgcataagcagcaataccatgagcgtattacccgggtttaccagctcttcccccgtttacttgagcggcgcagccagcgttcaggtacgatgtctggcggtgaacagcagatgctggcgataggcagagcgctgatgagccagcctcaattactattgctggatgagccctcgttgggattggctccgattatcatcatgcagatttttgacaccatccagcaattgcgcgatgaaggtatgacgatttttctggttgaacagaatgctaatcaggcattgaaattggccgatcgcggctatgtgctggagaatggccatattgttctggaagaccgcggagccgcgctgttagccaatgaagccgttcggagtgcttatcttggcggataattgccagaaaagatttccctcaacgaacttgtccccgctaactggatccaaaaaaacagattgcctcgctcatctatgggtggattgttcgatggattggtcactttgttttttgttcatcctgcggaaagcaaggtaataaaaaatcaagctgaattgaaatccagaatattagcattactgacttattaaattgacttgtcgtacaatggccaattaacttattggatatgtggataaataaaaatccagggtgattatgagattttaacaatcaccctgtaaattcaatttagacgttatcaaattatgattaaaaaaagtgactgcttaatcatgaattccaatcaccatcgcccttagctaggcctgtaagggtaccaagtccctttcccataaagcctcccaacggataatagttactatcctgaaatataagtttacccgcaaatgtccatgtataagcccaaaaatgaactgttttcgcaaaaagatcagtaggatttgcagtcgttacagtccccgaccaataatctgcgtaacctgctgtacttgctccccaagcacctcccgaaaattttttggaaccatcgtcaagtgttgccgtgacattataatgaatgatttcacttattatagatactgatgcactaaacaaataatcatcatttttatcgaacatcattttgattgttttatcaatatttttagatgaacttttaccactcattgaatcacagaaagcctttatagcctcagctttaagttcatctggcaataccaatttagtatctttcataaaattcacccttagtataaagaataaaaagttatcaggatattaaatatctatttaaattttgaatgatataatagaaacataatttatagatttattggaaataaaaattaatttttttggtgataaaaatttatttttatattgatgtaaaataattctgtcatattcgcctgttttaaggcgatctgctacaaactaaaagctattccaacattattataaatcgatgaataaatttctaatttaaagtctagtacacaataaaatattttcaagtaattataataaacaataggtattattacgcatgagttaacccactttttgcaatgtcatgtcagacaatatgtgggattgtccacgtggactatggcaaagtacatggtgaaggctggtagttcatttatagagtcttacgcgcgatttgaacaaacgacttagcgaataaggtaagtttaatttggctctttgtaatatagattattatttttaatatcagttaattatgtatttatttagtgttggatgttgctgataaaaagcgcgatactacgtacatatgcacaatagaacctaacggaggaaattatgttgcacgttgctgattatcctcaaatgaagcagatcgcatggtatctaaaagatgacgctgaattagatgaaaaggaagctttagccttttatgagcgcaactggaaatatgtagagccagaggcgctggaaccgcatgagaaggcgctaatcgataaattggtaaaagaatacggcggcggtattttaaatgtataaatatcggctggaacatcacgccaagatagcgcgtattcttgaatccattgatgccgattttatcgaagatgctgaatgttattttgcaggcggtacagcaataaatcccattttgaccgttgcatagggctgctacatatctcagaagagaatacagataaaatcgtttcagcgttgaatttgtctttttgtgacaatgattatgaatctgattttatgaccaacttcaatcgatagacataattaaataataattcaattaagtggctcacacaatccgataagcatattgataaaggcttatatcattatcgacatttggtgcaaaatgcatttgccagaattaaatattttagagtaatcacaagaagatacgataaattagaaccgaattacgccagcatgttggtactggcgtttatcaatgaatcaagctttagcgcgaagatttcaattcacggagcgattttaaatagtagggtttccccggattatacaacggccccatatcgatagtttcatgattagatttggcgatatatcccataccttctctggcggcattggccaacagaccgcaatcctgatcaccagaccaggaaaagatccctcccagttgatgctcggtgacatattctcctttttgtttcaccgtgcggggagtatccagtgagatgaaatgcccctgtttttcactgaacaggaaatccgcattagcattggtatctgtcatcagtacaaactcattttttcctgtactcagtgtatgttcactatccatgtagttattgacaatatcgaaaaattccggcgcccctttttccattgtgcccagagcatcacccggcttatcgtacaaacgtgtttccagcttggcacctttacccgaacgtccatagttggcataacccaagttaattatactcagaggaataccgagatcttgatgcaggtaattaatcgccgcttctgccgagagatcatattctccattaggatcgggctcgttaggggaatagaggttggaatgatgtccgatataggcggcccatccggtgccaaaaaagtcgtaactcatcaggaaaatattatccagcccatttttaactaattcagcgatatttgacttagcaagtttggcttttaccccactacaggcaatagaaatttctttactgcctatgccgaactgatcatccagctttattctcagatctttaaccagcaaggcataatttttgccgtcgtcttcactgataatattgtgtacatctcccgcagcacctgggtattcccagtcaatgtcaacacaactgaacatcgggaagcgttcaaaaaaatcaaccacgctgttgatgaaaacagtacgttggtttttatcttctgccatcttggagaaataactcgataaactccagcccccgatactgaatgccagctcaagtttgtgtcctgccgcccgcgcgcgcttttgtaattcccgtaatccgcccagcaaacccgccgctttactctgctgataatagggcagaaaagtccctgcattaattgaagtatttttgctcgattcaggcagaccgacgttacgggcggtgcctaaatcgccgtaagggtccagtggcacaatatggccttcggtgattttctggttagtctgggaattccagcctttccagacttcattcactttttctttcttgacgccaatatccccacaaatacccaagaagctgaaaatcaatttatcgtaagtggtcgggtcaatcgtcgatagatcaaagcctctgccgcgatcctcggggttttcattcttgtcatcaagacgggcatcatattgacaccagtccgtaatgtaagcagaaagtttgggtttggccggatcacgctcatattggttatacatcggtttacagacacgggtcgcggtataagagaggtttgtgcctgagccatcgggtttgtacttcaccttctcgtaagtctcttccgtgtatcggtcagattgcagaacgggggatggaatctcttctttcgggtttaccgtaccctccgttggattaccatgtgcgttgatctcttctgccgttgccgcacggacgtactgccaggcattgtgcggcgaactttcctggccagattgacccggtacatgccagcgttcaacccagtaagtattggtataaacgttgctattaaaaatcacgttataaacccgcccgccttcctgttgtttccaggcagtgagtggatcaccaataacatcactgatatcggacattgcttttgatgatgtgtaagtatatttgttagtcattaataaactccgataatttttcctgttcagccccctgttcaggaggctggttaatcatgaaaatcgccagtaacacgctgaacctgtgcggttatgagtccgtgattttttgttctaccagcaatttctgaacggctttaccgaatgtagaggagccgatttttgcggtataccgaacatggagaatcacatcggtcagactgtcgagattttgcgagttattggtaaagccgaatgtccaacttgattcgacacacgcgccttcaaatggcaggaaacgctcatcatcaaaattcagtgtgaacataccgctgtcgtttatgccagtggataaggaaatctgctggttgggatggatgctgcgtgccagataaggcgaatcagcattaatcccttctttcaccagcttttccattgtctggatgtcggctttcaccatgcgggtattgacgcccagagagagttgggcgcaaatgtcctcataaggcccgattaacatgggcagagaaaccgagacagatttgatccggcgattggcaaggttagggtaatctttagcaaagtctgattcttgcaggttaaaagtaataggagagtgctgtttcagggttgcaagatcgctttcccatgctgttttccgtaatgccttgagagagatagttttagtgatttcttgcaagcgtgagttttgttcaacataagcgcgctccattctttgcagcgccagtttcagtgtttcaccggacattaacccctgatagagatcattccagctactgccttcaataaaggtctgctctgaatccaattcgtactgcaatgaggcttctgcggagaggcaaagtgatgaaacggcatcataggcttgcaggtacaggtttgacagttggctaatcatccatgtgtacaggctttcattggtaaagcggctggagaaataatccaacagtgccagcgatttttgctgttccgcctcaacctgtgccaaccgtttcatggaagcagtcaattgcaggttttggacattgatttgctgatcaatggaattgacttcccattccgcctgtttgtattgcacttcccattcttggcggcgtcgacggtatgattcagacacattcagactatcggctttgatactgtcagattgatgtttgatcatgatcatttcggccgccgcattcagtgcagctccccagcgcgatccgcccacggccagcccatagatattgggtagcatatccagtgcagccgcgccggtacgcaaagtttgtgccgtcagcaacgctgaagcggattgggattgcagttcaatcacctgttgctcggttgacgaaatattttcgtcatacaatcccttaaagtgttcatgccgctcttgagctgattttttactgacctgcaaaacctcaaggctggcttgattgatgttgatttcctgctgttgcagatcgattgagaagcggtagagatcactactttggagcatctggaatttttcaaagctcaaactgtccttgcgttccagcaggctcagtaaggtgccgccaaactgtatcatcgtttcaacacctgctctggcacgtgccagcatcggttcaaaacggtaattgggcgttttgaaattcatccggctggcattgcgggcagtgacgacgcgctggtaacgcaggttcatcaggtcgcgtggcgagatcttctcatcatagagtgccatgttgatctctttgccatccagcgtcaggttgtgccgtaaattgtaaatccggttttccatacgatcccaaatctccgtcagttcattattgatcggcttcatgaatagctcattatcaagggcgcggatcgtgttgtcatgaacgacgggaatatggggcaatggctggctttgcatctccagttggcgcagctcactgttgtcatatcggtagagagcatcttcaagggacagcggttgccagaagcttgccaattgcacatcagggcgtcggccaagcagcgaactggcggttgcataactcaaacgggcaatagtccttgccgtgggttgaagcttccggtattccatgtcaccgtcgtcaatcaagtttctgaccaggaaatagaaaatcgccttgcgataatgtatcggttcaccggaagcaattgcatcgggatcgctcggctgcatcaggctgtagtttttcttcggttcatcaatcaatgggcggctgttccagtagcgcggctttccttgtttcagagccggcttatcctcattttcataaggatcgaaaatatacttgagccagcggttagcttcttcataacgctgctcaacattgaaacgccatgccaccatgaacggcatatggaagaacagtacccagaaatagatgccattggcacccttgagatcaatcggttctgtgccactgccggaaatcgactcttcaggcaggttctgggtatcccaactgagcaccagatccagtttctggctggctttactgacgagttccttggcgaacagggtatttaagcggatttgtttatcggcataccaaacgggagtaggtggattttcagggaattgcagatattgggtttgcttggtttgcttgatctggaatttttcacgaacccgcctgcccacgctcaagatgactctgattctgccgccgatatcgtcggcatttgccttaggcaagctgaaaccggtgacaatcgtgatgtcgctgaggtcatcgctgtgacaccgtttgactctgacactgaactcgattttcccttgcttaaaatcctcttctgtcagtactttgtaatccagccaacatctgtttttatttttgtcttccagccagatgcagtacaggatgtttttgctcaggctgaaatcgtatttgtaggtggagatggaggtcagatacatatccagtgaatcttccaaatagtcagctttgaggtcgaaatcctccttgttccccagtgagccctcaaatgttctttccttctcaatcggccactttctattgatatggacgggatagaggatcagctgcttgaattcatccatgccaccattctggggttcacggaagaagaaccaaaccagtttgttaccataatcatcttggtcagagagtttcgtggttgagggcggcagatctgtggaggccatcagcatgttatcgcagatataactgaatactatgtcatagtcataagggccttcgctgttttttcctttaagacgggtaaatgccaccagtgccagacggtcttctttttcggttcggtcgagcacggcaatcattttgtccatagcatggtcaagcacctcttcgcgtacggtggtgccgctgctccatgtaccatcaaatcccaagtgcgccagattgagcttggtacggtatcgaatgatggtcttgctttcgtcgtttttgtttttctcttcttcttttgagacttcaaaccagcttatgtagagacggttattcatgatgaccggacggacaacgccattgcgggcattttctaacggcacactgataggtttccactcgctccaggctgttggatacagctcattcgagtccgtattacgctgtttcatgtccagtgttcgccagaaatagcgataaggctgggtacgggttttagcaatgaaataggttttgtcattggcaagatcaataccatcttcataacccgaaataatttccagattactgacttcttcaaaattgttcaggtaaccaaggaccgccttctgagcgacgttatccgtcagttttccctgattcagcacactttccaattggaagaaaaactcggttttggtcagccgcaaggtaggatcaacataaatttcggggtataacctgagttactgattggcagaccaataaccgtaacggttggcaaactcctgccagtcgtaggtttcttcctgagtcatggaaagacccggttccaaattgagcacaatacggttgatatactgctgtatcgattgggttacgtgagacacgcgcgatgtgatgacttttgaagagacctgggtatccagtagcagaaaatcatagagatcatcgacgttcttgattttgtcgcgataaaactggaaattttttcccttgggaacaatttgcccaagatagtaatcaacgagcgcatcacgcagatcttcttgtaattttgcttcgatggaattagacattctcgttatctccttgcgtttttaacgccgccatgaccgcttcaccgacactctggtaaaggctgaaatcagtattgagggttaatgtgctggcatcccataacgttttgactgacaggctggtcgtgactgcaagctgctgtaatcggcgtaaccaatcgatatggggtaaatttttggcctgcgggggtgtcaattctcgcaatgtgcaggccagataaatttcatcggcgttccagcccagaatatcggccagaatttctgcacatttttcactttcatcattattgtctttgacggcctttccattggcttgcggcttgttcgcgtaagaaaaatagtcatggatcttgtcttcgttctgattggcgttgttgacgaagtcttgatagcgggtcaacagatatatttcattcagtgacaatgaatttgatgttttactgtttgacaaaccgagccattctggttttgtcaggcgtagcaaaagcaggtttttattgagatgcctgaacagccccaactctttcagtacattgtcagtaatgctcatatccagattatcggcttctgccttgataccggaagccagcaaaagatcaagctggtggtaaggcaggccaagccagcgctgcaagcggacaaagcggttcagccgatcataacggaagttggatacggctttgatttcacgcccgttatccgcccgaataatttccagagcatcttgttgtccggcattaatgtaaaccccgccataatgataagcggccgggaaggtggcggtgctttgcccgttgaaaaaaatcgggttggaaaaatgggcattaggggaaacgataggccggtagttaccactactgaatagattttcaatgtgagtaacttgcgttccggtttggtcgccaaaaatggcgatcttcttaagctgggcgctttcttcttctgaaagaccataattattgataaagaagtcattcgcctgcggtgataattcggaagatgacgtacctgatttggcaatcgcaagacgataactcattgcctgaaacacaataccgtctattggcccggttggttgattttcacctgatggtgtttctttgggggtcgccgcataaatggtcatattaccaaagtatgggccatcatccagattgccaatgtctgagttatcgctttccacataggtcagctttaactggcggctaaagggcggagagttgtcaaacggctccatccttgccttgacgcgatagtaagtgagaacgttttctgcccgtagcttgaccgagatggttttgtctgcctgatttttgcaggtgatggaaatcctatcgtaggcattgggcgaattttcgaccagtttgatcggaccttcaacactgtcatcttgagcaacaatataagcatgccgcgaaatatctttgtcaggcacaagttctgtcgtactgctgccgtaataggctttgatgagctgatcccgtgacagcaggttctgagagaaaggggcagcttcggtcagtaggctgatttgttcattgctcaactgtgaataagccagcaagatctggtcatattttgaaatttcagtatgccacgggaaatgcgtatcgacttgccggatcacggtacccaattcatttttgctttctgccagcctccggttgatctgctgagtcggcaagttataggacaacgtaaagggaaaacgcgtttctcccaatacctgattaaccggtttattggcttcccctgtctggttaatatatattctggcgctttcagacagcacatcatttacgatggtcagagcaggaagctctttataaagcgcatcgctatcgagcatcagatgtgaaatatccgaccgcctgcttgccagcaaaatcgcctgattggtgccatccacttcaatctgctgaataaatttatacagatccaacagatagttggcagggctatcaagggattcgatggcatccggctgacagaagtcatcccaaggctccgggaacaggccgctataatcaggcaattttcctgtttgttcgttggtgttctgattatctgtcgtggttgacaggaaagccgcagtctgtccatcgtattgtctgagcgggttctgccgatagtattgaaccagttggttagccatactcactgctttgtcaaagatgatttcagcatgacccgcaagagattcattgtgacgtttaataaaacgctgttttgacaggctgacaatatcgaagatggagtgatagcccagatttctgagtgaatctaccaacgaaacagatggtggggtattgtgctgtttcactgtggtgagtgaatatttttccggtgatggtatttccggtaatgatatttcagccaccgccgtcaataatggtgatacttttttcatattctgctgttcatcagaataattgtgattcttgtccatttttattatcccatttcaattattctgccatattcatcaaacagtcattaatcaaataaccattagatgctgtatttcagacgttatgttgattaaacacagtccttacattgaggttctttgggtttatcgtaagaagggagatcatcgttatcgaaataaaacggtgacatatcgataacacttttcttaacggtacgtcccagaccttcgtgggctgcgttggttaataggccattatcctgatcaccggaccaaataaataagccgcccaatcctttttctttgacgtagcgggctttttctctgactgagcgtggcgtatccaatgacataaagaccttgagatctttgttataaagataatccgccttagcaacactatcttgaatgatttcatagccattacgacctatgccattttcgaaatcaacatagttatagataacgtcagtccattcgataaccgcagattcgaaagttccgacgatattgccctggctgttataacttccttgaagcgggcttttactggtaatgtctgcgccttttgcattgcgcgtataaccggcataaccaatgaaaatctttttcttgtcaacacccagagtgattaaatgctgaacggcatcatcaatagaatatttggaatgttggtcatctttgttgcgataaaggttggtatggtgagaaagtttaccgtcacccaaggtaaagaaatcataagtcatcaggttgatgccagtgacaccggctttcatcagttctggaatatgggcatcatcaatttttttaggatcggctgaagccgcaatactaattccttgtaaattgggaatattggctgccgttaattcctcaatcagttttttataatagacgtaatcatctgcactaaattgatttcccattcccgcagagccggggtattcccagtcaatatcgatatgattgaacattgagaaacgactgaatagatctctgattccatcaataaactgtttacgatagggttcactgcgacaaatgtcataaaaagcaccactcattgaccagccgccgatactgacggaaacctccagattaggatcggcctttttcaatgaattgaaaccgcccagtaatcctttagctttatcttggttatatattgttgggtacggatcgaatgctccactatcgaaaccgcagttaaagtaagcgctgacatcggcccatgggtcgattgggataggccatccagtgtaatttttgagggtttcaacctcatcggctccgaatccccaacctttggcagcactcagaattgtggttttctttggcccttcatcaccaacgatgccggcaaaactgaatatcaatttcttaaaggggctgccattggttgaatcacctttaatgcgggtcaaatcggcaccgcgcccgccttgagttttaaattgttcatctgtagggaattctattgttcctctggcatcatattgagcccagtccgtgaagtaacacgcgatactgaattcatcatcatcgttataggtgttaaacaccgtcttagccatgcgggtgggggtataggttaaaatatcggtgcttgttgccggattataaccgtttaattgataggttttttgtgttgcttccttgccataaccctgaacagggcttggatgttgatatcctggatcagtgttataaactaatttgctttctgtatctttttcagtgttatccatcttatactccattattgttacatatctttggaaaaatcagatatgttctctgtgattatcaatgttaaaaatgatggagttggtcagatggcgatgatttatttgatttaagcctgtaatataattcattaataacattttaataacatagagcgtgattaatctataaatagaaatttaaaactaagctaaagataatacgttttcttatgaaataatttaaacaatttttttatgtataggcagtaaaaaatagaagtgtcattttttatctggagtattcgagaatatacaggaatagatcacattgatgagactatggatagcattattatttttttattttaaataattaaatcataaaaatactaaaaaatgaaaattgataatgttctttctattttacgatttgagaaataggataaaaatcacttttaaaaatgaattaaacaatatttgtcatcatgccataacgtgccttcgttgagattatcaaaaatgtgataactattaacatagtcggcactttaagccgttttcagtctgcatgtttcagtgtggtttgtggcttgtttggatatgggcaaaaaccctgtgtaatcggtgctagtttggttgatagcgtgatttcagaatgaggattgccaaaccaatcgctagagcaaatagcaatgcacctgcgataaagatccattcatagtgattatcgaataacagaaaactgctaatcatagggccagccgacatccctgtatacctgatgaaattataaaggccgattgcggttgctcgttcttcgacaaactctgagattagtaaagttgcatgtgtgggcatcgatagccccaatgtgaaaccatagaagacggtgattgtgactaaaacagcaatactcattgaataagtcatggcaaatatcaaaattatgaacaaatttaataggctagtgataattaacgctcttttttgggaaacatgctggtggatcatgcgatagctgtaactgccgccaatcattgccagggacataggaataaacatccagccaatatcggcagggctgaaatgatactcactacttaaaataatgggtaaaaaagtgagtagacagaaataacagtaaaacagcataaaactgatacaaaacacagattggctgatgttatttgataggatttgatggaagtgatccttcatttttttattttgtgtggggagttcaggcttggtctctggcagccaaaacagattccctatgattaacagaccaccaataatggcaagacactgaaaaatggcaacatagccatttaattcagccagataaccaccgaacagtggcccaacggcaggagtcagagccaataacatctggtaggtactcatggcttttgcccgttgctgtccctcatacagatcgccaatgattgtcgccgcaacaacgggaatggcgcccagcccaatggcttgaataacccgaaagaagatcagccaatagatatcggttgtcatggcacagccgagagatcccataacgaagataacgaggctgggcagtaaaacggtttttcgtcccttactgtcaatcaacgggccatacacgagttgcatcacggccaaaacaaacgtgaatgctgaaattgtcaaattcaccaagggtagcgaagtattgaacactaccttgatgagagggataaccggagtataaatattctgtgccagcgagcctaaaaaagcactgaagcacaccaggtagaagatcgtttttaaattacggcttgaagtttggctattcatctctgttccttttattgtttccttggaaacaaaattagaattaatgaatatacctgatacatgtaagggacggtatcaggcagtttattacggatatagttggtgtgatgggtaacccctgagagtgtagataaaataatcaggggagtcagaagcctctgttttgccagattgaatcaggccttaaagcaggcttctgacgagtttctctggtcccacttaacgaccatcttttcctataactgtttcagcaatgggaatatattgatcagtgagtttattgactgtgctgccctcttttttatctttataacaatcttcaaagaaccagctaattggagtatccaacaatatagtaatttcaacaagatgaactatattaatccgattttttcctgtttcataacgtgaaagctgctgctggctaatgccaatttttttcgccaatgatgttgctgtcatactcaactctttccttttggcctgaatacgttgtccgactaataggttagcttcttccatatcttatcctttcaatttaaatcagtaagttatggcgttatcaaggatagttgccctggagcttgaataatggcttggcttttacctcaccatttgcgcctattgttacacctgattcgccgttttgttttccgacatgcactttgttttttttaatggcatgacttttttatgaacgtgttgtaaaagacagtgcccttaccaagtaaaggggttttcttctatgacacgaattgcattctttgttttggtgtcaccttgcatctttcaacttcctcacctgtcaccgggttaaacagcatttttattctccttacacgagggataactaacctgcttcctaacttttttcttatggtaatttatgtaattttaaatttattaagatattgaatataaaagaaataaaatagataaataagaataatctgtaaaaataattaatacagatttaaaggcgaattattggatgtatattggttctattaagacctttcttcaggctagaaactggacaaaatataccaaactgtctagtttagatttataatctatttgaaaataatttaatggaatttaatttcggatatgtcaatttaaaagaatattaattctgattagcttgattatacttggatgccaataagtaacgatttttagccatcaatactattgcaaagagattaaatatgtgaataacaaaaaaaattcatggattataattgcttaagtggaatgagctgtaatatgtaacgaaatttgacttaggagatgttatataggattatgtttacagtttggtataaaatgttttgttttttaacaaaattttatttatttaagttagttaaagatatttctacattttaatggattattatcgcaaatttttctgatttttattaaaaatatcatttattgtcattttttccactaaataatctttcagattctcaaaaataatggcttactcgcactttggggtattatcaaaagatggccgttttttcgacagatatggatggtgatttattattttttcaaataaaaacaatatgataattatttttttatgataggatcattttttatcaagtgacattcatcctgctccatattccatccttgaataattacacctttgagcacgtttttgtattgaactctccatttgtataagaaaactccaatttttacatagtggtctgaggtgtccttttattcatggttgcgtttttatatgaggaaatgacggaacgtaatatggagcctatataccatgccagatcacaatgaaaccttatctgacaaatggctggatggagggatattttttttggggggggggtaggtaggaacagatcttggaaatggaattattcccttcatctttcaaatggcggctt

SEQ ID NO: 16848 - DNA, 193877 bp, Xenorhabdus bovienii
ctgatgattattacaacaaattccacttaagttgctagtttttccagcgtaaggaagccataatctcgtaatacgggtcgcagagcctcgctatttaggtctatttttgtgcaataagccaaattatccgctgttgttaaaaataaattattttggttcttcaccaaccacaccgttctacgcgcaatagcagctccagaatcaatcaatcgtgtgccatcaggcaaaacttgtgaaagctcttctgcaatcagggggaagtgagtacaacctaagatgacagtatctggcggttctctcattctcaaccacggtttgagaattttttccaatatttccagtgggatcttctcaccatgcagctttcgttcggctaactctaccagttctgcagagcctatagaatgaacctgacaatccgtggcaaatcttgtaattaattctttggtatagtcgcgattgactgtagcccgtgtcgccaataatcctattactcggttacaagtcaactttgccgcaggcttgattgcgggcacaacaccaacaacgggaaaagaaaaacgttcgcgcaatgcaggcaaactaaccgtgctagctgtattacaggcaatgatgacaatagctagggggtgtcttttctgaatttcatcgacaactcgaacgacccgctcaatgatcacttccgccgttttttctccataaggaaatgcttcattatcgaaagcatatatatagtggagctccggcaataattgtcgaatttcttggtatacagataaaccgcccacacctgaatcaaaaactagaatcgttggtcgggcggttttaggtaaatcagaagttgtagcttccagtgagaaagtattctcggcctggggtgcgatagccatacgctgtctcataatttttatcaaacagatttgctattctagcacggattgtgaggtggttagtgattgggtatgatgcgctgatatcccataaactgacaccacccaatttaaggggcttcggaggataaacactataatctgcatcatcgcgctgaccgatatattgataggttactccccaatcaatattgtataattcccaatctaattgatatttaacctgctgtttagccctgcgagctaaccgcttattattgccatcacgcggatcaacatactgtaatgtcaattggtgctggaatattccggtatccatggttcctgtccattcaacacctttgatttttgccttaccaatgttctcatagtggttattggcaaaatttatcagttgttcaatatcattatgataaacagataagcgccaattaagtggcccagttaatccttcaattccaccttcccactgtttacttttttctggtttgagactttcatttccccacttgctatagagttgattcaatgttggagccttaaatgcggttccatacgagacgatcaaccgatagccatcaatgaattcccaacccatgccagtttgccatgtggtattccaattatattcagaatgacggtctgaacgaacagcaccttccagcgtgacatcatgaatcttttgctgtgtcgtcaaatacaggccggtgttatctacgtctttttgtacaggaatattattcgaacctgccgcaaccgattctcttttccagtcaacaccaccgctaattgccccatgacctacttgccatgagtttccccattgcacattatattgtttggagttacttaagttggagcctttgccataacgcccatatttaggatcatagttgtaatctttgacatggctgtaactggcaatccattgggcagaataaattccctgtgtaaattgaaggcctgcatcataagtacgactgaatagctctcgagtatctatcagcatctgattgtcactatcataataggcatcataagccgttcgattattcaacccatgcgcacgggcaaacccactgaactgatcattaaatttatgatcaacgcccagccacagcattttgctcataaaaccatcgctatcaggctgacgatgcccacccgtaccgccaccagccaccacatcgaatcctttggtataggtatatccggccgctgcggtcaataaggtattctcgccgagcttctgttgggtcgaaccattatagttctggtatccgtgcgagccgatacctgcattcaatgttgttccctgttgctctcgcttggtaatgatattgattaccccaccaatggcatcagaaccatatacggcagagcgagcgccgcggatatactcaattctctgcaccattgaaagcggtatctggctataatcggccgcgcccgtgatacccgcctgatttaagcgaataccatctactagcaccaatgtatgatgtgattccgtacctcgaacaaataaagaagcgtgttgccctattcccccattctgcgcaatatcaatactgggtaggcgacgtagaacgtcaaccaagctgctggattgccagcgatctatctcttcgcgggttaccaccgtcattggtgctaaaactgaaggaataggctgtttaaagcggttcgcggtcaccaccagtggatcttgattatcagcagctgcaaaatggctccagctagaaaacactgccacagaagcagcagataaaaggatacgtttgttatttgtcatgagagaatggcatctaactatattgaatctagcgaataaagtgtcatgctacgatgaaggcgggagacagtccagaatgaccccctatcaaaaagaggctcatgtgccagaaaactggacatcctttgcactttccctacaatgccgctcggaaatttttcttaacgcgaccatacgagaaccagataatgcagaatgtcttgccaacggaagattatgaaaatcaattgatggaaaaggtccatcgtctgaaaggaatgatgatgccatttagtgcacctgagcctgaggttttccgttcccctgcatcacattacagaatgcgggctgagttccgcatctggcatgagcaagatgctctttaccacattatgtttgaccagcagaccaaacaacgtattcgtattgatcaatttccggttgccaatgagctgattaaccagatgatgcaggcaatcattgctggcgtgaaagataattctctcttgcgtcataaactgtttcaagtggattatctgtcaaccctcagcaataagattattgtctctctgctttatcataaaaagttgaatgatgaatggcgcgagcatgccatcacactacgtgatcaattaaaagcgaatggatttgatgttcagctgatcgggcgagcgtcaaaaaccaaaatcatgctcgaccatgactatattgatgaagaactgccgattgcgggtaagacgatgatttaccgtcaagttgaaaacagtttcacgcaaccgaatgccagcatcaatattcatatgttggaatgggcgatgggtattactaaaggcgccaagggagatctacttgagctatattgtggtaatggcaatttttctctggcattggcacagaactttgatcgcgtactggcgacagaaattgccaaaccttcggttgctgccgcgcaatttaatattgaagcgaaccaaattgataatgtgcaaattatccgtatgtcagcagaagagtttactcaagcaatgaatggagagcgggaatttaaccgactgcatggcattgatctaaaaagctatcaatgtgaaaccatttttgttgatcctccacgcagtggattagatgatgcaacagttaaaatggtacagggatatccacagattctttatatttcctgtaatccagaaacactcagccagaatctggaaatactgacacaaacccataaaataagcaggctggcactctttgatcaattcccttatacgcaccatatggagtgtggtgtattactggaaaaacgtaactaatcgccatctactatagctgaaaaattagttggaagaccaaaacgccacagcgatcaatttgtggcgttgttcgttcaaccgttatcaggaaaataatcagccatggctttctgaagtgagtatagcttgttgtttacgccctttgatctttctgtaaatccaaaatactaaagcagtatcaatcacgacaggcaggaaattagaaccaatttctggatattccacccgaatgatggcgctgtaaatgaagattcctaagaaaaagcagccagccgccaactttggtaatccatctgccattggataattcaaataacgatgatggaggcaatacagagataataccagtgcgataatcgggaaaattgaaaaaggcacaagcgagttgaaaaatgctgagaaagttccgtgtgttgccaatccaacgataagagccagcaacatagtgcttttatcttggcggtattgttccatcgtattattctcctttcattattattcaagaggttttagggacagttttttttcttgttcccgccgataccaataataagcacctttggaaatcaggcggagttgcaaaactaaacgttcttcgagacgacgccttttttcctcatcaatatccagcgcttctgcacctgcgctgaatacgattgtcaccatcgcctcagcttgaatttcagtaaaatgacgcggcatgtggcttgcctgttcgaggtagtctgccagctctgcaataaaatgttggatttcccgtgcgacagccgcacgaaactcagccgatgtgccggaacgttcgcgtagtaataaccggaaagcattgggattgttgccgatgaattccatgaacgttgaaacagaggttcggatgacgctgccgccttttgcgatacgctgacgcgcctgacgcattaactgacgcaacattaagccactttcatccaccattgtcagccccagttcatccacatcccgaaaatgtcgataaaatgaagtaggcgcgatacccgcttctcgagctacttcccgtaggctcagacttgtgaaactccgctcagcactgagttggctgaatgcagcttcaatcagagaacgacgggttttttctttctgtttcgctctgacaccagttacgttactcaccacaatcctgatatatccattcgactatataatgaagcaaatatatcagattctgctgtgtttgctgtgattgttctcttaaagctattatcccatattccccggtttcatttctaagtaataggataaaaaccgtatggtcattaggttattacatcaagtaatgttaagatagagttgttattttgtgtaaaaacaggtctttcctctatgcaatatactcattttgatgccattgtgattggctctggtcccggaggggaaggagcagcaatggggctggtgaaacagggaaaaaacgttgcagttatagaacgttacaatagtgtcggtggtggctgtacccattggggtacaattccatcaaaagctctccgccatgctgtcagccgtattatcgaatttaatcaaaaccccctctatagtgataactcccgcattcttcgttcctcattttctgaaatcctacgccatgctgacgttgtcattagccagcaaaccaaaatgcgtcagggtttttatgaacgcaatcggtgccaaatgtttgcgggcgaggcagcattcattgatgaacatcgtgtgagtgtccgttatgctgatggtagtgttgatatattaagtgcagataagataatcattgctactggttcccgcccttactgccctcccgatgttgatttcactcactcccgtatttataacagcgacaccatcctgcaactggatcatgaaccccgccacgttatcatttacggcgcaggagtgattggctgtgaatatgcttctatcttccgagggctgggcgttaaggtagatttgatcaatacccgtgatcatctgctgtcttttcttgatcaagagatgtctgatgccctgtcctatcatttctggaatagcggtactgtcatccgccataacgaagaatatgaaaaaattgaaggtcttgatgatggcgtgattgttcatctgaaatccggcaaaaaggtcaaggcagactgtctactgtatgccaatggccgcaccggcaatacagataagctagggttggaaaatgttggtctggaaacagacagccgtggtttactgaaagtgaatcgcgtctatcagagcagcaatgaaaacatttacgctgttggtgatgtcatcggctatccgagtctggcttctgccgcgtatgatcaaggacgcattgccgcaaaagctatcatgaccggaaacgccaacctacatctggtggaagatattccaacagggatttataccattcctgaaatcagttcaatcggtaaaaccgagcagcagctcactgcgatgaaaatcccgtatgaggtaggacgcgcccaattcaaacatctggcaagggcgcaaattgccggcatgaatgttggtagtataaaaatcctgttccatcgtgaaacaaaacagattctgggcatccactgttttggcgagcgtgccgcagagatcatccatatcggccaagccattatggaacaaaaaggagaaggcaatactatcgaatatttcgttaatacaaccttcaactatccaacaatggcagaagcctaccgtgttgctgcactcaatgggttaaatcggttattttgatgttttgccaaaaacttcaaaatagtcacccattttagtccgaatcgcctctgccaattgctcatagcgaccgcgcagaggtgagccggggcgataaaccaagataatcgtacgcttaggctctggttcgatacattccaggtagcagacaccatcgcgttttctctcttttggcacagccaaatcaggcagcaatgtaatcccactgcctgctgataccatattacgcagggtttccagactggttgccctaaaatgagtatcttctttggctcctgcctgaaaacagaaacccatcgcctgatcacgcaaacaatgtccgtcttccagcattaataatttttcaccagcaagctcttccatcttgatatgcgtcctattcgcccatctgtgcccttcataaatcgctagtttcatcggttcttcaaagagtggcacttcaatgaacgcttcggtttcttttaccaaagccagaatggcacaatcgagttttccgctatcgagttgcgccagcaggttctgagtctgagcctcatgtaaatacatttccagcttggggaatagcttgtgtaactcaggaatgataagaggcaagatatagggaccgacggtggggataaggccgatatgcagagggccagacatgctttcaccttgaagagaggccatttcctgcaagactttcacttctcgcaataccgttttggcctgttccaccagcaacattccctgttgcgtgaacagcactttacgactggtgcgctctagcagcatcacgcccaactcatcttcaagtttgcggatttgcccactcagtgtcggttggctaacatgacaagaatcagcggctcggcggaaatgccggtattcggcaagcgctacaaggtattccagatcgcggatattcattcccaacctcagtatttgatatcaatgatagaattgatcaataaatcattatacgcacgagggaataaaactatcaaatgcttgtgatttcaggcattttttatcgaaataccttatgagaaatcaaaaaaattattattagaaagctgccccatatttatggctgaatagacattcagcgacttattccctgacctgtcggccgaatgctactgatattctcgttcactcaacaccttaaacgctgtatcaaattcattaaaaaaaattactattatatcatcctttcatttatgggcagtaaactcacaatattcctcttcagaaatcagcaccgctttgccaaaagatttgttataacttaatacagaaaaacctgccggattgggcaggcatatattaggttctcaggctaacccattgttaaccgctgtttaacctctgcaatcgcctgtgccacctgtttctgtgatacaccaccttttgccagccgtttatccaaacaggattgcagcgataaaacgtcatacacatctagcgaaatagcttcactgaatttttgcagttcaaacaaagacagttcttctagcgctttaccttccgctatggccgcaattaccacttcaccaacaatatggtgtgcttcacgaaatgggacaccttttgctaccagataatccgccagttcagtcgcgttggcataaccctgttttgccgcttcctcacagcgcccgcgttgcacctgaatgccatccagcaccagcaccgccatatgcaggcaatcccgccatgtatccagcgcatcaaacagaccttctttatcttcctgcatatctttgttataagcgaggggaagccctttcagcgttatcatcatgcccgtcaatgcgccctgaacccgaccacatttgccccgaataagctccagtgcatcagggtttttcttttgcggcatcagggaagagccggaagttacccgatctgataactcaataaaacccgcttctccactgttaaagaaaatcaggtcttcagcaaagcgtgaaaggtggatcatgctgatactggcatctgacagtagctccagaacatgatcccgatctgaaacgctatccagactattacgtgttgccgaggcaaaaccgagccatgacgctaattgttcacgatcgatatcataggctgttcccgccagtgcgccacagcccaatgggctgacatccagccgtttcagtgcatcttgcaggcggctctcatcacgacccagcatttcggcataggcgaggcaccaatgagcgaaagtgactggctgcgccctctgcaaatgggtataaccgggcatcaccgcatcttgattattctccgccgtaatcaccagcgcctgttgcagctccacaagtgcctgctgaatatcggctatctgatccttgcaccacagtttcagatcagttgcgacctgatcgttacggctacgacctgtgtggagttttttacccaaatcgcccactttcgcgataagttgcccttccacccagctatgaatatcttccgcatcgctttgcaaaatggccttggggttggcccgcacttcacccagtaactcattcagcgccagttccagtttttgctgttcttcggaagtcaatactcccaccgtaaccagcgcctttgaccatgcaacagaaccaataatatcctgctccgccaaacgataatcaaaacgcagagaatcgttaaattgtttgaatcgctgatcggcttcctgactgaaacgtccgccccaaagtgccatatgtcgttcctgttttctctatttaataaaggttaattgctcagaaattattttttgctgttcagtgtacgaatacgtgaagaaagcgaatagaggcgaataaacccttctgcatggcggtgatcatagacttcatcttctccaaaagtagcgaattcttcagaatagagactgtatgtcgattttttctgttcagcggtcacctggcctttatacagctttaagaccacttccccactgacactgtcagccaacgtttccgcagcagcctgaatcgactggcgcaatggcgcaaaccaacgaccatcgtagacgacataggacatttccaaccccaattgctgacgccatttgaagctgtcgcgatccaacaccaactgctcaattccccgcaatgcggccatcatgatggttccacccggtgtttcataacaaccacgggatttcatgcctactaaacggttttccacaatgtcgatccggccgataccatgtttggctcccagttcatttaatgcattaatgcattgatagggtgacagcaccttaccattcacgccaaccacctcacctttttcaaccgtgacggtgacatattctggctcattgggcgcatcttctggctctgctgtccacacccagcaatctttattggcagcattccatgtactttccaataccccaccttcggttgagatatgccatgcgttttcgtcacggctgtaaattttttccagcgtggcggtggtgggaatatcgcggactttcagataatcaagtagagcctcacgggaacgcagatcccattcacgccatggagcaaccactttcagatgcggcgctaacgcagtataagtactttcaaaccgaacctgatcgttacctttgcccgttgcaccgtgagctacagcatcagctcccactttcagcgccaattctacctgtgccttggcaataattgggcgtgccattgatgtaccaagcaaatagctgccttcatacagtgcgcccgttttcagtacgggataaacatactctttgatgaactcttcacgcaggtcgataacgtgacattccgacgcaccagatcgcaacgctttctgctccacaccttccagatcttcgcggctttgaccaacgtcagcaacaaacgcgacaacttcacaattgtcataatgttctttcaaccaaggaataatcgcagatgtatctaaaccaccagaatatgctagaacgatttttttaatgcttttagtcatagggataaccttttatttttgttcatctcagccaaatactgtgccactaatcgacaaaaccaagccaattacgccgaaatccgcgtaccggtgggtatgccattaaataatgcaattaattgatccgtatgtcgccaacttgcaatatcaaccggatgccccagcgtttttgccgcttccaaggccgcattaactttcacaatcatgccattggttatgattccatgctcaatgagctgttttattttttctgctgtcagctctgggattttctgaccttttccatccaaaataccgctgacatcagacagaaaggccagatccgcatttaacacctgcgcaatggcggttgccgcctgatctgcattcacattcatcagctcaccctcttcggtgatgccaatagagctgataattggcatgtaaccgacatccagcaaaattttcaggagatcggatttacccggatgagcttttccagtgtgaccgaattcctcatcaaactgggaaacttgcaccacaccaccatctcccagacacaatccaatcgcaggcaatcggtattttatcgcccaagccagcagtgtcttattagcagttcctgccaatgtccccgtaacgatattaatttgatctgctggcgttacccgcaggccttgtttcttcacaatcggtagctgcaatctctgcatcagttcatcaactaaacagccaccgccatgtacaatgactaacgggcgcttatgcgtcttccgatatgactgcaatgtggaaaacaaccgcgccagcgcttcttcgctgtctaacaacacaccacccaatttgataactaacggctccatcggatttatcctctgtcggtattaaagtctgccggaattaaagcaatgcctgagtttctgcaaacccaaaacgaatattcatgcactgtactgcttgtgctgccgcgcctttcaacaaattatcctcagccccgacaatgatcaggtgctgtccttgaacggcaaaaccaatatcgcagaatggcaaacccacgactgatttcaatgccggcataccttccgtgtatagacgcaccaacggtttatcatgatacgcctgctggtaggcttccctaatttgctcttctgttacgcctgatttcaacttgcaggtgatcgtggcgagaataccgcgcgagaaattacccagatgagggataaaaatgacttcggtgcctaaatgtgccgcgatctcgggttgatgacgatgattaaaaatcccgtaaggctgcaaactgacttcacagaaactgttattaattgttgctttccgccctgctccactgacaccactgacagcattgatgacgggccattgttcagtatccagcagatttttttccagcaaaggcttcaatgaaagctgagagacggtggaataacagccgggaactgagatcaactgggcagtcttgattttttccgcctgccattccgccagcccgtaaactgcctgatcgagccaagccgtatttttatgctcgaacccatagtattttgaataaaactgtgtattttgtacgcgataggctccggataaatcgaagacggtacaacctgcttgtagaaatatcggcacaatatcatggctgacttcatgggcagtggcgaggaagacgacatcaataccattcactgcttcagccacatcagtcagcggctgtaaaggtaaatcaacaatgcccttgtactgcgggtagagatctgaaaaacatttccccgcatctgaactttgagacgaaaccattaagccagagagatggacatggagatgacgttgcagatatgctgctaactctgctccggtatagccactggcaccaactatcagcgtattcaacatgggacttattcaccttgtagtagtaacccaatcacattactgcatttatattcagttataatgcatgaatattgatactatcatgagtaagggctgtcaacagtgaatattaaattaccatcatttattaaattatatcatcagctcattgccacaccttccatcagcgcaaccgatgctgaactggatcaaagcaatgaaatattaatcaacctgctggctggctggttgaaagaccttggttttaacattgaaattcagcccgttcctgaaacccgcagcaagttcaatatgctggcaacattgggtagtggttctggaggtttattgttatgtggtcatacagatacagtaccattcgatgaaggacgctggacacaagatccctttacactgaccgagcgggataacaaattttatggccttggcaccgccgacatgaaaggcttctttgcttttatcattgatgcactgcgagatattgatgccagcaagttatcgcatcctctttacattctggccaccgcagatgaagaaacatcaatggcaggtgcgcgttattttgctgccaataccgccattcggcctgatttcgccattattggcgaaccaacatcgttacaacctatccatgcgcataaggggcacttagctcatgttatccgcattgagggaaaatccggccattccagcgatcccgcacgcggtgtcaacgcacttgaactcatgcacgaatccatcacgcaattgatggaattacgcactaccttgcaggaacgctatcacaatccagcatttgttattcctcatccaactatgaatttcggccatattcacggtggtgatgccgcaaaccgcatctgtgcctgctgtgaactgcatatggatattcgcccgctgcccggattgaccttgcaggatatggacgaattactgcataaagcactagagccggtgaaacagcgctggccgggacgtttaagcgttacccctctccacccccctattccgggttatcaatgcccgaccgatcacaaattggttagcgtgatcgaaaatttgttgggaacgaaagcagaaaccgtcaattattgtacggaagcgccttttattcaggaattgtgtccaacattagtcttggggccaggatcaattgaacaggcacaccagcccgatgaatttttaagtatggaatttgttgagccgaccaaaaaattgatttctcagctggttgaacatttttgcctgcaagcccattaactttacgattatttttactctacaattgggagagaatatccagtaaaagttttaacctcgataagtgcatcggggtttttcgctattttatgaccaaaaaaacgcacaaaacttcatgaattcctctcagtatcactcataatccgcatagctccgttcacaggccaattaaatcaggcgtttctcttgctctgcccaacatgaatttctttcctgatcattttgaatattcctcatttcggataagtcactttgctgttgactaaacatattgcttcgcccattctatttagacatctaaacgtatagacatgtaaacacttaagcatctaaacgtaagcggatcaaaatattccgctgatttacgaggacacagggtatgagtttttttcacgctaatcagcgagaagcgctgaatcagaatttggcagagcttgaagggcagattcgtgtttcttttgagttctttccacccagcacgactacgatggagcaaaccctgtggaaatccatcgaacgcttaagcaaactgaagcctaaatttgtctccgtaacctatggtgccaattccggtgaacgtaaccgcactcatagcatcatcaagggcattaaagacaaaaccggccttgatgctgcccctcacttgacttgcattgatgccaaccgtgaagagctgcgtaatattgctcacgattattgggagagtggtattcgtcacattgtggcattgcgcggtgatttacccgatagcagcggtaaaccggaaatgtacggtgccgacttagttgagctcttaaaaaaagaagcggattttgatatctccgttgctgcttacccagaagtgcatcctgaagcgaaaagtgctcagtcggatctgattaacctgaaacgcaaaattgatgcaggagcaaatcgcgccattacccaattcttttttgatgtagaaagttacctgcgttttcgcgaccgctgtgttgcaacgggaattgatgtggaaattgtgccggggattctgcccgtctcgaacttccgtcagttacagcggtttgccacaatgactaacgtccgcattccaagctggatgaccagaatgttcgaagggctggatgatgatccggaaagccgcaatttagttggcgcatcgattgcgatggacatggtgaaaattctcagccgcgaaggggtgaaagatttccatttttatactctgaatcgggcagaattaagttacgctatctgccatacgctgggagttcgtccttgttgattgttgatagaattaacggacgctgggccaagataagatttctttgcggatcacaatcaaacggtggcgatgtaaatcggaatcgcctccccaacagagggcatcccacttttcaagaaaggaaattgtatgttctacgttattttctgaaatacacagtttgcggttaagatccatattttcagtcagatatggctactctgaaccgagcggaataggggttcgacgttattgtagatagcactcactatatgctatcaaacgactattctatcgacaatgttctcatttcacaggaggccagagctgagaagtatgcaccaaagctaatatccagacactttcccctgaaacctcataaaccagccgatagttctcatacgggaaaacttcgaatgtccctgaaatttcaccggcatgtcccatataaggaaattcaatcaaccgttccgcagcagtttcgaataactcatccatttttacggcggccactggatttttagtaacaagatattcccatattgtttcactatcctgcaaagcttgaggtgtccatataaccttcatttatcggcctttttccgtgctctacgagctgcaaaaatcgctttggcatcagtatgttcaataccctctccagcatttatggattgacgcgcagtatcaacttttcgctgaagaaagttacgatactcatgacgttggatatattcccgcatcagttcacgaacaacctgagaagcaggacgatgttccgcggcagtagctgccataaaatcttcacgcaactcagattccagcttcatcgtaaaaacagcttgtttattcataagccctcctctcaaatgtgaacaaagtatatactatttaattaccagacgacagtatcagaaaatcgcattttgaaaagaattattcaaaaaacaaacagcactataaagagatttttgatgtagagattgtgccaggaattctgccggtttcaaactcccatcagtcacagcgattcaccttgatgttgagagtgaaaaaatgatttcattcaactttaacatattgaatattatatataattgtgacacatagaaaaaacaatagaatctgcgaataaagctattaaattaacctgaactctggataaagtaattcttaatcaaaaataaaaaagccgaacagttccccattcggctttcttcattcagaaaatcaaaagctagccggtattgcgcatccctgccgcaacccccgcaatcgtcaccatcaatgcctgttcaagatgaggatcaggctgttcctgctggcgggagcgctgtaatagttctgcctgtaacacgttcagcgggtcggtatatacgttacgcagcgcaatagactccgcaatccacggtaaatccgccattaattgttcatcctgcgaaatcgtcagcacagttttaatatcctctgccaactgattacgcagcgttattcccaacggccacagttttttatccaccaagcgttgatcataatattccgccagccataaatcggccttggcaaataccatctccaacatggcaatacgagtattaaagaaaggccaatcgcggcacatatctgccaataccgacagtttgcccgcatcaatcacatgttgcagcgctgctcccgcgcccaaccatgccggcagcatcagccgattttgcgtccaagcgaatatccaagggatcgcacgcaggctttctacaccgccggtcggacgacgcttggccggccgtgaccccaaaggcagtttcgccaattcctgttctggcgtcgccgctcggaagtaaggtacgaattctggctgctcacgcacgtaatcacgatacatgtcacaggaaacatcagagagcgtatccatgacttgcttccattccggttttggttctggcggcggcagtaaatttgcttccaaaattgcactggtatacaacgccagactgctaatcgtcacctgtggcaaaccaaacttaaagcggatcatttcgccctgttccgtcacgcgcagcccacctttcagactgcccggcggctgagaaagcaaagcggaatgtgccggagcaccaccacgaccaatcgtaccgccacggccgtggaacagcgtcagcgttacgccttcctgctcacacactttgatcaacgcatcctgcgcccgatattgcgcccatgatgccgccatcactcccgcatctttggcagagtcggaatagccaatcatcaccatctgcttatcctgaatcagctcgcgataccagccgattcccagtaattgctggatcacactttccgcattgttcaggtcatcaagggtttcaaacaacggtgcaacaggcaatttcagtgagcaacccgcttctttcagtagcaacttcacggccagtacatccgaggggactttcgccatagaaattacataggctgcaatcgcatcttgtggcgattcggcaatgaccttacaggtttcgaagacttctagggtttcttcacttggctgccaacgatgtggaataagcggacgttttgaattcaattcacgcagcagaaaagtttgtttctccgtttctgaccagctcgcataatctccgagttccagatattgtgtcagctcggcaatagcatcggtatgacgggaactttcctgacggatatcaatacgcaccaatgacagaccaaagcagcgaatgcggcgcaaggtatccaacaattggccattggcgataatttccatcccgcaggttttcagtgattgatagcaggcatacagcggttgccacaattgttcgttatgcagcagcaaacccgcagggggcaggacttgctctcctttaaggtgtttctccagatacgtcagcgtgctatttaattgcgtccgcaattgtttggcaatttcacggtaaggttccagcaccccattaccccccgcaagctggcgcagttcaggtgtacactccgacatggagagttcagaaactaacacctgaatatctttcaaaaacagatccgctgctttccagcgactgagcaacagtacatggcgagtaatttctgcggtaacgttggggttcccatcacgatcgccgcccatccaagaagtgaaacgaatcggcacggcttccacaggtaagctatagccaatggattcttccaattgctcattgaattcacgcagaaatgctggaacaccttcccacaaactattttccaccaccgcaaatccccatttggcttcatcaatcggagtggggcgaattttgcggatttcatcagtatgccatgattgggcaatcaactggcgtaaacggcgcatgatattattgcgttcataatccgccagatcatcatggtcaagctgtgccagacaggcattcacttcgaccagtttatgaatcagagtacgacgggcaatttcggtaggatgtgccgtcaagaccaattcaatggcaagttcattgactgcgttgatcaagtcatcattgctgaattttttatctttcagccgattgaataaagcctctagcgctacaggattgctggccgcttcaccatgcggtgaaatactgtgatattgctcggcaacgttggccagattaagaaactggttaaaggcccgagcaaccggcaataactcatcattggataaattttgcagtgtagataaaagttgctgccgatcagcctcgtttcctgcacgggatgatttggataatttccttatcgtttcaactttatcaagaatgccttctcccagtgcttctttgatagtgttacccaataacttaccaagcatactgacattgctgcgcattgcagagtattgttgattcatgtggtttctgaccttgtgttgctgtatttaatccatttcacccgatcgttgatcgctttaatcggcatccaccctgtttgcagagcatatttttgtttatttctgatgttctattcatatcagaaaatgaacgatttgggcgaattttatgaaatttaatagcagcttattttttataagcagatctgattggctgcctggcgtatgcccaacaaccagaagaataagacgttttttattgattagaggatgattgaatcagcttgttctggttatctaccgaaaagaggtgcagaaaataactttccgtaaccggcagggataaaaatgagtaatatccctgccgcaaaattggctacctaaacttaaagaagctgtgacaaacggttcaaatccgattgaatcgctcctgccgtaacatcccgcccagcacctggaccacggatcaccagtggattgtcacgataccagcggctttctatcgcaaagacattatcccccggcaataacgaagctaagggatgatctgcacgcacggcttcgacaccaacttttgctttaccactggtggcatcaaagcgagcgacataacgcagtaccatgcccatttcccgtgatgcttccaaccgttggagcatctgctcattaataacggcactgttttcaaagaaatcttcgatggaaccggttctggcctctactggcacgagggattcaacacgcacctgatcaggctctatctcataacccgcctcgcgagccagaataatcagcttgcgcatcacatcctgaccggacaaatcgatacggggatcaggctccgtcaatccttgctgccacgcctgctccaccaaatcactgaaaggcacagaaccatcaaattgcaggaacagccacgataatgtacctgaaaaaatcccgctgatggacagaatggtatcgccactttcccgcaaatctctgacagagtggttaatcggcaaccctgcaccaacggtcgcattgtataaccaatgacggccggtttttgcaaaagcatcgcggaccatgcgataagtgttactgttcgaagaacctgcaactttattagcgctgataacatgaaagccatagctggcaaaatcaatatagtctttagccaactcctcgcttgcagtgacatccaacaccaccaaatcgtcataagggtgcgctctcatccacaaaaacagcgcatcgtcttcatgttgagtggcttcatcatcaaagaatgccaatgctcgactcgcatcaagtccctgataattcagcaagctccgacgactgtccacaattcccgccaaaataaattcaaaaccactgcgggcagaaatattcttctgttcacgagcgaacaattctagccagcgtgagccaatgtttcccttaccaaacagcaccagaccaatgcgtttttctgcccggaacagactttggtgcaatccctgaatcagatgtgaagtctggctcaggcgcaaaacagcaacaaggctgatcccctcttccgcatgccagataaattcaacgggctggtctttaagctgctgataaaaacggtggctatgcaacggattcttgcacactcccgccccaaccaaagccaccaacgccaatccttctcgcaaggacaattttcctggcaaagacgcatcctgcaacacatcgagagcactgttcacgacttcagaggtataacaaagctgaatcaaattacagtcagcgtgcagacctgtcgccaacggccggacttgtgcgcgtttcagcaatgaatcaatgtccttgtaaatctgcttgaaatcatgggcagaagaaatgtgcagctcaatcagacagacatcatcatgactggtcacaattttcgccccagtacctgttgccagcacccgctcaatgcgggtagatccttgttcaggctggtaactgcaacgcaattgtaaatcgatatcactgacggaaacaggctgcaaggtgcgggtatgaagtacgggtgccgccaggcgcgccagttcacttgcttcatccaaacgcagtaaaggcaacaggcacgcatccttaactttacgcggatcagcactgtaaacacccgctacatcgctccaaatcgttacttttttggcgcctgccaatgcaccaacctgtgtggcagaataatcgctgccattgcgtcccagcagtacagtttctcccttctgatttctggaaataaaccccgtgaccaccaaacgcttactgggattttgaatcagcagttggctcagtaaaggttgggacaagttcacatcaacctgcggctgggcagcgcgttctgcccgcagaaattggcgtgcatccaaccatgcactggaaatacccttatgctcaagcaccgcagccatcaaacgggctgaccagatttcaccatgcccgaccacctcggcgtacgtaatgtcagtaatcggtttatccagcaatacacttaatctttccagatccgagataaaatgcgccacgagttcttctgcaatcacttcaggcaataaacctcggatcagctcctgctgataacgccgcagtgattgctgtacttgatgcgctgaaattcggtcactctggctcagtttcaaccaatcaataagctgattggttgtgctccctgccgccgataccaccatcaaatcacccggctggctataattcgccataatttctgcaacccgctgatagcatttcacatcagcaaggctgctgccgccaaatttatgtaactggcggccgaattccgcccccgctgttgccagtgcactcatgattaatgattacctcgttgctgctgcctgaaatgctttgtccagatccgcaattaaatcctgactatcttcaattcctacagagacacgaagaagtgaatccgtgatccctgcctgcgcccttgcttctgccgacattcccgcatgtgtcatcgtcgcagtatgagaaatcaacgactctacaccaccgagagattcagccagagtaaataattttaacgcagataaaaagtggcgtagggtctgttcatcaccatcaagttcaaaactcagcatcgccccgaagcctgcttgttgtttaagggcaatttcatgcccgggatgatttttcaaagcagggtagtagagttttttcacttgtggctgctgttgcaggtactcagcaatggccgctgcattattctgctgtagcattacccgtgcagacagggtacgaataccccgcaacaacaggtagctgtcaaaggcggcaccggtgacaccaatattgttcgcccaccacgccaaattttctgcgatcacgggatctttggcgataatcgcccccgcaatcagatcggaatgtccattcaggtacttcgtacaagagtggacaactaaatcagcgcccaaatccaacggcttttgcaatacaggactcaagaaagtgttatcaacaatcgccaatgctccaacttcatgcgccaacccacagatatattgaatatcaacaatgcgcagcagaggattactcggcgtttctatcagcaccagttttggcttttgcgccagagcctgtttcagggcttgattatccgactgatcaacaaaaataacgttgtacgccccacgtttactcagactgtcaaacaggcggtaactgccgccataacaatcatggggagccaccaataaatcccccggttgcaagaaaacggtacacagcaggtgaatcgccgacatgccactgctggtcatggctgcccccgctccaccttccagctcagccaaaacctgctgaacgacatctcgactgggatttccacgtcgggaatagtcatgtgcccttggctcattgaaaccagtgaaattatatgtgctggaaagatagataggcggaacaacacaaccatattgttcatcaatatttgaaccactttgaaccgcgactgttgcttgtttacatcccataacctttacccgtcactttattattggagtcaccaaagaataacgactggaaagatagacgtcaatacatctagacatctaaaattatttaaggtttaattgtacaattggctcattgtccccattttttatgttagctccgggcatattttacggattagtgctgccatagcgatatagccaataggggaattatgctaaaataatgaattaccgacatgaaaacagatcagaaacttcccgtttttctggtttcaattgtttgatttcaagactatttaaggtatctcatggctgagtggaatggtgagtatgtcagcccttatgctgaacatggcaaaaaaagtgaacaagtcaaaaaaattacggtttcaattccattaaaggtcttgaaaatactgactgatgagcgcactcgtcgtcaagtgaataatctgcgtcatgcaacaaatagcgaattgctgtgtgaagcatttcttcatgctttcactggacaacccttgcctaatgatgatgatttacgcaaagagcgtcatgatgaaatcccagaggcagcgaaagacataatgcgtgagctcggtattgatcctgaaacatgggaatactgatgcaaacaaaaacgcccgatgcaaacatcgggcgtttttgtttcaaccgtactgcctgtaaagtttacaggcagaaaatggtcattacttactagagcctggaacgctgaaacgtttgttgaagcgatcaacacgaccacccgtcgcaacgtcacgctgcttgcctgtgtagaacgggtggcattcaccacaaacgtccagattcaggttgtgattaacggtagagttgatggtgataacgttaccgcaagagcaagatgcagtaattgcttcgtatttaggatgaataccttttctcataggaaacctctgttaaggccgtgtcgctatccagccttgttgccgccagacaccacacgtcgtgttgattgaaataagttcggtaatttctgtaccaaaggcggcggatcatacagaatatcggtttattgcgcaatgaaatctgctgatttgctatgatacccttatcactgtatttttctttagatattcctatgtctggtcattaattatccggaaatcgccttatgacagttgttcaggttgcgctgcctgtccccttaacccgctcttttgattatctattacccgaaggattgccattgcccacgacaggtgtgcgggtgctcgtgccgtttggcaagcgcaatgcaataggcattgtcacgggaaccgcaggcagcagcgaaattccctttgaacagctcaagccacttgccgcgatccttgatgcacaaccgcttttccctgacgacctttggcaattgctccagtggtcagcctgctattatcactatccactgggagaagtgttgttccatgccatgcccgtcttactgcgacagggaaaacccgccgaatttactccactttggcaatggcaggttacggaagcaggccatgaattccctctggagcagcttaaacgttccgttaaacagcaacaagctctggcttcgctacgcctgaaacccatttaccgtcatcagatttctgaactggcattcagcgaaagcgcattgcaatcattgaaaaagaaagcgctgattgatctgcatccgatacagccggaggcaaaaaactggcatgagcagtttcaaattattggtgaacggctacaactcaatacagagcaggccagcgcagtcggcactgtccgagcagaagatcaggttttttctccatggttgcttgcgggtattacgggttcaggcaaaaccgaagtgtatcttagtgtgctggaaaacattctcgcgcagggaaaacaagcgctgattttagtcccggaaattggtctgactccgcaaactatccgccgattcagagaacgtttcaatgcgcctgtcgatgtcctgcactccgccttaaatgacagtgaacgtctgtcggtatggctacgagccaaacggggagataacgcgattgtcattggtacgcgctccgcattgtttaccccctttgcccatttgggtgtcatcattatcgatgaagagcatgacagctcctataaacagcaggagggctggcgctatcacgcccgtgatttggccgtgttccgggccaagaaagaagacattcccatcatgatgggtacagcaacgccggctctagaaacgctgttcaatgtgcagcagggaaaatatcgacaattgacactgacccaacgggcgggtgaagctaagcctgcggttcagcatttgctagatttgaaaggcttgccattgacagtcggtttatcccaaccgctcatcaatcgcattggcgagcatctgaaagcggataatcaagtcatcctgtttctgaaccgccgtggttattcccccgctttgctttgccatgaatgtggttggatagcggaatgccaacgctgcgatcactactacactctgcaccagaaccatcgccatctgcgttgccatcactgtgacagccagcgcccgatcccgcgccaatgcccccaatgtggcactactcatttaattcccgtcggattgggaaccgagcagcttgaagatggcatcacaaaattgtttcctcatattcccgttacccgcatcgatcgggacaccactagccgcaagggagcattggaacaacaactggcggcagtgcaccaaggcggtgcccgtattttaattggtactcagatgttggcgaaaggccaccatttccccgatgtcacgttagtcgtcttgcttgatgtcgatggcgccctgttttctgccgatttccgggcggctgaacgtttcgctcaactgtatacccaagtctccggccgcgcaggacgggcgggtaaacggggggaagttgtccttcagacccaccatcccgaacatccactcttgcaggtgttgctggaaaaaggttatgacgcatttgcccgtcaagcgatggaagaacggcaacaagtgtttctgccgccgtttgccagccacatcctgctccgttcagaagaccacgacaatcagcaagcccctgcttttttgcagcaaatgcgtcaattgtttgaacatcacgctctgcgtgatgaacatttatggatcatggggccagttcccgcattgcaggccaaacgtggtggccgctttcgctggcaattactgattcagcacccttcacgcatttttctacagaaaatgatggcggcaatttatccgcaaatcgccgcgctcccgcaggcacgcaaggtgaaatggaacattgatgttgatcccaccgaaggctgatagcagaaattgaaaatggcacgttgtcgcaaaggctcccaaatcaaacagaacattctgaaaaaacagagacaattatttccttaatttgcgaagtatctctaataaatgattcctatcacattttttatgcaaacaaagtaacagattgatctgttactttgtttaaaatgcacttattaatatgactgtagaaaatgaaccgccagcgtttccctctcaggaatgactggcgtttttttagcagctaggaagcaatcgtttcgctgcctgtagaaagtaaggagtgaactatggaaaaaaagaattgtgcattggcaaccatgaaagatgtcgccaatgtggctggtgtttctaccgcgactgtatcaagaacacttatgaatccggacaaggtttctgcccgtacccgtcagaaagtagaaagtgccgtactggaagtgggctactatcctcataaccttaccaaaaacttaagacgcaatgaatccagagcgatcttggttatcgttcccaatatcagcgatcctttctttaccgaagtcattcgcggcattgaagaaacagcagcagagcatggctatctggttctgattggcgactgtaagcatcagcagcaacaggaacatgcctttatcaatcttctgattaccaaacggattgacggcatggtgctgcttggctcaaacattcctttcgatgtttccaaagaagaacaaaaaaacctgccaccaatggtcatggccaatgaattcgcacctgacctggaactaccgactgtccacattgacaatctgacttcggctttcaacgctacctatcacttacaaaaactgggacacaaacgcatcgcctgtattacggggccagaaataatgccactgtgccattaccggcttcagggctacattcaggcattgcatcgtacgggagaagcgatccgcgaagattatatcctcaggggagatttcacccatgaaagcggagctgaattggcagaaatcttgcttaacctgccagagccacccagcgcgattttctgccatagcgatatcatggctattggcgcaatgtggcaagccaagaaaatgggattaaaattaccagaagatctgtcagttattggctttgataatttaaatctggcgcaatacagcgatccaccgctaacaaccgtggcacagccatgttatgagattgggtattattcaatactgttgttgctggagcagcttcagggccgcatcgtttccaaaggttcacgattattggatgcagaattgctcattcgtgcgagcacttgttcgcctaaaagctaggcaaataaccgcagattcagtaacattagttatctatcccttaatttttttaaacaacttcagcgaattaaatagtggcacaacgagattatgtaagtcgcgggcgttctaatccccgtcagaaaggcactggtaagaaaaaaaatcaggctcaaggattacccaaaactacattagccgttgccgtggccttggtggtcatgtttattggtggcctttatttcatcgcacacactaagaacgatagtgtacaaaatccaccaccacccgctcatcattccaaaaaccaaggcctaccgccaaaaccggaagaacgctggacttacattaaagagttggaaaaccgtcctgttggacttccttcgatacaggaaccgacttctgctaatcaaccaaccaaccaaccagcgaaactaacgcaagaacaactccaattacttgcacagatggaggcagacattcgccagcccccgacgcccttaaaagaagtgccttacaacagtgaacctgttcctcgctcacaggtcattatcaccccgcctgaacaaaagccgcttgttgcacaagaaaagaccccgccagcacaatctctggcacccagtgaaaccaataaatcaccgaaacctgcgataaatgaatccaagttgatgctacagtgtggctcgtttcgaacaatagagcaggcagaatccgttcgtgccagcctcgcattcgcaggcattgagagccagattacaacaaaagacaattggaaccgggttgtagtagggccttataaaaacaaggaagccgcggaaaaaatgcgcagccatgttacaaatgcgggtgtgccaggctgtattctccgccctgccgggggttgaaaaatcagaaaattcccccatcttaatcgctaataacagacacgcggtgcttttccagcaatacagcttgcaattgtggcataacaagccaaagtaccgtgtgtaacgtcttctattttgtaaccaggggctaactcgtgactacaatcgtaagtgttcgccgtaatggccaggtcgtcatcggtggtgatggacaagcaacaatgggtcataccgtcatgaaaggcaatgtccgcaaagtacgccgcctttacaatgacaaagtcatcgcgggttttgccggcggcaccgcagatgcatttactctgttcgagctgtttgaacgcaaactcgaaatgcatcaggggcatctgaccaaagcagccgttgaacttgccaaagactggcgaacggaccgcatgcttcgcaaactggaagccctgcttgcggtagcagatgaaaatgcttctctgatcattacaggtaacggtgatgtgattcagccagaaaatgacctgatcgccattggttccggtggttcatacgcacaggcagccgcccgggcaatgctagaaactaccgaactcagcgccagggaaatcgcagaacgcgccctgactattgcaggcgatatctgtatctacaccaaccataatcacaacttcgaagaactgccttcaaaagcgtaaggatagatagcatgtctgaaatgactcctcgcgaaattgtcagcgaacttgacaaccacattatcggtcaggataaagcaaaacgcgctgtcgccattgctctgcgtaaccgctggcgccgtatgcagttggatgaaacactgcgtcatgaagtcaccccgaaaaatattttgatgataggcccaaccggtgtcggtaaaaccgaaattgcccgtcgtctggcaaaactggccaacgcgccttttatcaaagttgaagcgaccaaattcacagaagtcggttatgttggtaaagaagtcgattcaattatccgtgacttgactgatgcagcagtaaaaatggtgcgtctgcaatccattgagcaaaaccgctatcgtgccgaagagttggccgaagaacgcattctggacgttttgctcccaccagcgaaaaacaactgggggcaaacagaaacacagtccgaaccttctactgcccgtcaggcattccgcaagaagctacgcgaagggcagttggacgataaagaaatcgaaattgacgtcgcatcagcacctgttggcgtggaaatcatggctcctccaggcatggaagagatgaccaaccaactgcaatctatgttccagaaccttgctggtcagaagcaaaaagcacgcaaaatgaaaatcaaggatgcgttcaagctgctggtggaagaagaagccgcaaaactggttaatcctgaagagctgaaacagcaggccattgatgccgttgagcagcacggcatcgtctttatcgatgagatcgataaaatctgtaaacgtggccagacttccggcccagatgtttcccgtgaaggcgtccaacgcgatctgctgccactggttgaaggctgcaccgtttccactaaacacggcatggtaaaaaccgatcacatcctgttcatcgcctccggggcgtttcaggtttccagcccttccgacctgatcccagagcttcagggtcgtctgccaattcgtgttgagctacaagcgctgacgacagaagactttgaacggatcctgacagaacctaacgcttcactgactgaacagtataaggcgttaatggcgacagaaggcatgaatatcgatttcacaactgacggtatccgcaaactcgccgaagccgcatggcgagtgaatgaaacgactgaaaacattggtgcccgccgtctgtatactgtgcttgaacgcatgatggaagatatttctttcgacgccagtgaacgtcaaggacattcggttgaaatcaatgccgattacgttaaagagcatttggatgagctcgttgcagatgaagatctgagccgatttattttataatcggcaacctgagccttatttactcgcaatgaagaaatgggaggcttgcctcccatttcttcattttcattgcaacaaaatttatcacaccaacaatacgtaataacaatatgaattcaacaacgtctatcagtcagatgcaggcatggttggaaagcttgcgccccaaaacgctcccacttgccgtggctgctgtcgtgagcggttcagcccttgcatcatggacaggccatttcaagtggcctgtggcgttgctggctttattgactgctgccctgctgcaaattctttccaacctcgccaatgattatggcgatgtcgccaaaggcagcgatacagaaaaacgtattggcccgatgcgtggtatgcaaaaaggcatgattacggccaagcagatgaaaacagccttgaagatcaccgtgctgctctcctgtctatcgggaattgctctcattaccgtcgcctgtaacagcccaagcgatatcatcggctttctgacgctgggagtattggctatcgttgctgccatcacttataccgtgggaaccaaaccctatggctatatggggctgggcgatctttccgtcctgattttttttggctggctgagtgtcattggcacctattacctgcaagccaatacttttgatctgagtaccgtgctgccagcaaccgcctgtggcttactctccgtggcagtcttgaatattaataacttgcgcgatatcgaaagtgatcgccaaaacggtaaaaatacgctggccgtcaggctgggggcaaaaaaagcccgctattatcacgcggctctgctgatcggtgccatcctctgtcttgcggcctttacacttctgcacctgaagggctggtctggctggttattcctgctcgctgttcccctgctgttgaaacatatgtggaaagtactgcacgatcggacgcctaaaggcatgcgcccaatgctggtacaaatggtcaaagccgcattattgactaatgctctgttttccatcggattggtatttaattaagcgagtaagtatccgttttacacataaattttaagattgatgattttgccaacactagcttgaaaaggatatactgtctgtcccttgcataaaccagacgtaaatcccatgaaatatgatacttccgaactttgtgatatctatcaagaagatgtgaacgtggtagaacctttattctccaactttggtgggcgtacttcatttggtggtcaaatcatcacggtgaaatgctttgaagacaatggcctgctttatgatgtgcttgaagaaaatggcagtggccgtattttgctcgttgatggtggtgggtctgtccgcaaagcgctggttgatgccgggctggctcaacttgccgtcaacaatgagtgggaaggcattgttgtctatggcgcagtgcgtcaggtcgactcccttgcagagcttgatatcggcattcaggcgatggctgcgatcccagcaggctccaacagcgaaggcatcggagaaagtgatatcagggtgaattttggcggcgtgactttcttttccggcgattatctctacgctgataatactggcatgattttatcagatgtcccgttggaaattgacgaagaagatgaagatgatgaagtataatcacttcatcatctattatgccaaaatgttaaagagggcgtattcatcgcccttctcaacaaaactgcaatactgatttactgcacatcttccattttacccagcaaagtccgcaaacgttcttgccacgccagttgttcctgtttgaactgttcattctcacgcaccaacgagtcgtggctacttgccgcactttggatatcctgagacaacgctgcgttcctttctttcagttcttcaatttccatttgcaggagagttatagtatcaatcgcctgctgaactttagattctagcttttcaaaaacttcaaatgacattctcgagccctcttttaagcaattccttgattgtatttagccagttaaggcctgtctagtttcatcctttcaatgttcgttataacgagaaatatagtgactaatccgaaatgcaagcgagatcacatttccatgatgaacaaaaccccaatcaaatgcgaattcgctcattttgttgacgcaacacgcagatttcaatttcgctatttctcgtttacgctcattaacgataaattcacagtcatctttcttttaagagaagaaagcactaataattaatctcccctgttcttttttataggatctagaaatgagccagaccaccacaccaacattatcaggtcaatgcatttcagaatttctgggtactgcattgctcgttttcttcggcttaggctgcgttgccgctgcccgactggcaggcgcacaactggggctatgggaaatcagcatcatctggggcttcggtgttgccctcgctgtttatctgactgccggcatttcaggtgcacacctcaatcccgcagtcaccatcgccttatgcctttttgccagctttgacagaaaaaaagtgctcccttacatcattgcccaaatgctcggcgggtttgccgctgccgctattgtctatatgatgtattacaaccttttccttgattatgagcaagttcacaacattgttcgtggttcacaggaaagcctcttcacggctggtgtattctccacttatcctgcgtcacagctatctgtattacacgcgtttattgtcgaggttatcatcgcagctgtcttactttgcctgattctggcactgacagacgatggcaacggcatcccgcgtggcccaatggctccgctgttaatcggcattttgattgccgttatcggtggttcatttggctctttgaccggatttgctctgaacccagcccgtgattttggccctaaactagtcgcttatttagctggctggggagatattgccctgacaggaggcagagacattccttattgtcttgtgccgttggtagcccccttcattggtgcaattctaggcgcattcggttatcgaaaactgattgcccgccatttaccgcgtgcggtgtaaagttgccatactgaaaaatggcagcaaataaaaataaaaaatgaataaattaaataccaggttatcattatgacaatagaaaatatcactgagaaaaaatatatcgtcgccctcgatcaagggacaaccagttcacgagctgtcgtactcgatcacgatgccaatattgtctgtatttcacagcgtgaattcccacaaatctaccccaaaccaggctgggtagagcacgatccaatggaaatctgggccagccaaagctcaacattagtcgaagtgctggcaaaagctgatatcagttcagatcaaattgccagcattggaatcaccaaccagcgagaaacaacgattgtttgggaaaaggaaacaggtaggccggtttataacgcgattgtgtggcaatgtcgccgaacagcagacatttgtaccaaactaaaacaaaaagaggggctggaagaatatatccgccacaatactggcttagtcgtcgacccttacttctccggaacaaaaataaaatggattctggataatgtagaaggcatccgccatcgtgctgaaaatggagaactgttattcggtacagtcgatacttggctcgtctggaaaatgactcagggtcgtgtgcatgtgaccgattacaccaatgcttcccgcaccatgctgttcaacatccacaatctcgattgggatcagaaaatccttgatgagctgggtattccccgcatgatgctgccaaaagtgtcatcttcgtcagagatttatggccagaccaatattggtggtaaaggtggcacacgcattcctatcgcgggtattgcgggcgaccagcaggcagccctgtacggccaattgtgtgttcatcccggcatggcaaaaaatacttacgggacaggctgctttctgctgatgaatacaggaacagatgccgtacgttccagtcacggcctgctgaccactattgcctgcgggccacggggtgaagtgaactatgcactggaaggcgctgtcttcgttggcggcgcgtctatccaatggctacgtgatgaattgaaactcatcgccgatgcggcggattccgaatatttcgccactaaagtgaaggacagcaatggtgtttacgttgtgccagcctttactggcctgggcgcaccttactgggacccttacgcccgtggcgctattttcggcctgactcgtggtgcgaacagcaaccatattattcgcgccacgctagaatctatcgcttaccagacccgtgatgtattggatgcaatgcaggctgactccggcacacgcctgcaatccctgcgtgtagatggcggtgctgtcactaacaatttcctgatgcaattccaggccgatattctgggtactcgtgtagaacgccctgacgtacgtgaaagtacagcgttgggtgccgccttcctcgctggcctggccgtcggtttctggaaagatcttgatgaagtgaagagcaaagcgacaatcgaaaaagagttccgtccgggcatcgaaaccactgagcgaaaccacaaatacaatggctggaaaaaagcggttgcccgcgctcaggaatgggaagaccgcgcttaagaaaatatggaaatcaaagctctgacatagcataccgctctgtcagagccttttagcgggaatatgcgttcctgccagatgctaatacggttttatgaggccgtatgctcttggcgctgaactcgctgggaaataggcaaccaacaagacaaaataagcagcgccatggaaaacatcaacataccgacgctgaactggctattttgcggcaacatcgccgacaaccatgtcgtcacgccagaaccaacattctgcaatccacccaccagcgcccccgccgctccggccaaataaggaaatggctccatagcaccagtggtagccaatggaaacagcataccggcaccgaaaaagaataaagttgcagggatcagcagtgtccagacattcataataccgaaccagccgggcagccacatcaatacgcccgccagcaaacagcacatgacagaatgccacatcagccgataaaacgttttgccatcacgccccgcataccatgctcccaaaaatgcggcagggatcggcaaaataaacaggatactgaccgttaagctatccaatcccaacacagcgcccatcaacacaccgctactggcttcaaaaaccgcgacgccagccagaccaccaactagcataatcaggtaagcaacaaaagcactattggagagtaattgctggaaagaaaccagcatggtgctctgttttgtctgcacagggcgggtttccggcaagtgttggaacaaaaagaaggctactgttgcccccaatgacagcagaaaccaatagcaggcacgccaaccaaaataatgaccaaccatgccacctatcatcggtgctagcaaagggctaaccaacacggccatatttagcaggctattggcataacgcaacgacgtcccggtatataaatccctcggcatggtgcgcaccatgactcccgccacccccgttcccagcccctgaaatacactggcaatcaccagcaccaacaaactggaggcaaacaatgcgcaggttgttgccaccagaaaaagggtcattccggccaaaatcactgggcggcgaccaatcttatcggataacggcccataaaaaatctgtgaaagcccgtaagaaaacaagtatgccgccatgactctttgcacttcgccagcaggctgaccaaaatcactcgccatatctgcaataacaggcacataaattgtttgtgtcatctgacccaccgcagccagagcaatcaacatcactaataaattaaagtgttctatttttctcatcgcatttacatacaatttatttaagtacagtttattaaactaaaatttatttaaattcagcttaatcaatggataacgcgcttcaacaaagccctcaggttttcaattaagtacctgacgtaccgacttcgttagatgtgattgacttaacaaatttatattttttccagacaggatacaatttcacatgaagaaaaaataacagtgatattatccatgtatgtcaataaaagtgtacatataaaaccaaagtattggcataaataaagacaatcaaactgtaacacgtaatcgataagtctattcccgacaatcacgtagaattgtcataaaaatcatcaattcatacagtgttttttgtagagaggctaattgtaatggcaaactgggttacaggaaaagttaccgacataaccaattggacagattcactattcagcatcaaagttcatgcaccgattgaaagatttaccgctggccaattcgcaaaattggctctcgaaattgaaggcgagcgtatccaacgcgcttattctttcgtcaattcccccgacgacaatagtctggaattttatttagtcaccgttcctgaagggaaactcagccctcggctcgcagcattaaagaatggggaggaactcctcgtcacagaacaggcggcaggtttttttgtccttgatgaaatccccgattgccaaaccctgtggatgctctcaaccggtacagccattggcccttacctttccattctccagcaagggaataatctggaacggtttgaaaatattgttttggttcacgccgtgagactggaacaagatttgagttatttgccgatgatgcaacaactagagaaaaagtttcaaggcaaattaagaatccagaccattgtcagccgtgaaaaatgcccaaattcactcatggggagaattccggcattaattgaaaatggcgagctggaagctgccgttggtttaccgatgcaggcagaaaatagtcacattatgctgtgtgggaatccccaaatggccaaggacacccaacagcttctgaaagaacaacgcaatatggcaaaacacctgcgccgtaaaccagggcatatcaccagcgaacaatattggtaatcacaacatcgctaacccactaatcagcgttttggagcaggttcactggcagaaatatactcaaccgtttctgccatctcaccaaaacggtttggcccgtccatgctacgaaatacaccgcaatccaacacaatcataacgaaaatcaacgttggaatgaaacgaccaatcccccattgccagatagctgccattgcgctccaatcgaggaaaagcaatacccaagctaaagccagcagtagcacccagccaccatgtttattccggtcatgcagacgtttcgctataatcgctgctgtcgggtacaggatcaaggcgatacccactgcggcataatgcatggggaaggcattcatgccatgcaaggtcaaaagcataaatatcagggcgaagcagatgccaatgccgatccagaattcccgtcgcccaattcggcctttgaatgaaaatccccattgttgtaatgtcatgtattcttttccaattgtggatgctgtttttccggtatttacactcagcgagtacaacatgaaaacaggcatgaataaacttctggtgacaatattaatcgcttttggtatcagtttgccattatcgacctttgcaggtgaaccttctatcacaccggacacacgctcacaactgatgtatttacttcctgattcccctacttttgaggaaaccattccggtatttcgggaaaaatacaacaaaaaataccctgaaatccccctgcatgaatataaagtcattgtcagtaaagatatctccctgcctttcattcgtgctgccagcaaaattaacgaaaaaatttattcttcggcagtactggaacggggcagcgaaaaaattaaaagtttgcaaattaccctgctgccaccacaaagtgaaccggagaaagaacacaatctcgcactgataaaacagtatattactgccctgatcagtcaattcgagccctcgctttccccagatcaagccaaccaacaattagaaaaatttttacaggctgcgcaaagccaccgattcttcagccaaaaaatcggtgcgatacgttatgtcatcgtaaacagcagcgaaaatataatgaccttcgcaattgaaccgattaagctatcgttatctgacgcacccgcgagcaaaaattagtgacgcagcgcagagctattcgcaccgatgatctttatactgtcgggattccgcttacagagaatggcacaaacgctattccctcaaagcgtgttaattcagatcgcaatttgattattttctggttggagggaaaaacatgcgacatccattagttatggggaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctaggtgcacaagatgttgacgttaacctttctggtgcgttcaccggcgaaacatccgctgaaatgctgaaagatgtgggcgcgaaatatatcattatcggtcactccgagcgccggacttactataaagaaagcgatgagctgattgcgaaaaaattcaccattctgaaagaacaaggactgattcccgttctatgcattggtgaaaccgaacaggaaaatgaagcaggccaaaccgaagccgtatgcgcacgccaaatcgatgccgttctgaacacgctaggtgttgaagccttcaaggataccgttatcgcatacgagcccgtctgggcaattggtacgggtaaatcagcgactccggcacaagcacaggctgttcataaatttatccgtgatcatatcgcgaagcaagatgctgctatcgctgaacaggtcatcattcaatacggcggctccgtcaatgccagcaacgcggcagaactgttcacccagccagatatcgatggtgctctggttggtggtgcatccctgaaagccgatgctttcgccgttatcgtgaaagccgctgctgaagcaaaaaaggcataagacgatttaattgtcgataaaacaattaacaataaagcaaatgcctataaaaaccgccacgtaatatcatccagtggcggttatttctaaacattaacgccggataatttcatcgaaaatgccacccgtggcaaaatgcgcctcctgggccttatcccagccaccaaatacttcatcaatcgtgaacaatttcagtacgggaaaaacagcgtgatgtttttctgcaatggctttatcacggggacgataataattctttgccgcaatttcctgtccgacaggcgaatacaggtatttcaagtattccgttgccagctcacgggttccccgtttatcaaccaccttatcgacaacggcaacggttggctctgccagaatggaaagactcggtgtaacaatctcaaacttatcctgagccagtgcatgggtagccaataacgcttcgttttcccatgcgatcaacacatccccaattccgcgttccacaaaggtattggttgcaccacgcgcgccagaatccaacacttcgacattcttataaagcgccttaacaaaggctttagtcttgccttgatcctgattattctgtgccagcccatatccccaagccgccagataattccaacgtgcgccaccggacgtttttggattcggtgtcacaacagaaacaccgggacgaaccaaatctgaccaatccttgatatgtttgggattgcccttacgtaccagaaaaacaatggttgaagtataaggcgcggaattctccggcaggcgatcaatccaattcttggcaatgcgaccacgctctgcaattgcattcacatcatatgccagcgccaatgtcaccacatccgcctgaaggccattgatgacagacgttgcctgcttacccgaacccccgtgtgactggcggactgttacgtgatctccggttttttgctgccaatactgactgaatgcctgatcatactgctgatacaattcgcgggtaggatcgtaggaaacattcaagagttgcacctcttttgcccatgcactacctcctgccaagaccatcaataatgccgtcaacacggcataccttcttgctgcccatctcgtgaccatcgtgaaatgctcccctaagctatttatggtatcgccataaaagctgacagaaagcagtatgacgcagaaataatttaaaatttctgcttatgcataagtggaatatagtgcagaaaagggcagccataaaatatggctgcccttgaaaaagtatgttgcaggcgagaaaggtttagtaaagctgcttcgccgtttccagccagtctttcttaaaaacacgctgcatattttgcaccgcatcaataatgtcgtgatgaacaagtttctcgttctggatacccacacaacggccaccaaaaccttccagcagcaactggacagaataagcccccatgcgagaagccagaatgcggtcatacgccactggcgcaccgccacgttgaatatgccccagtactgttgcacgggtttcatgacgtgtttctgcttcaatgtatttcgccagttcatccacattgcagacatgctcagtaatggcaacgatggcgtggcgcttacctttttggatacccgccttgatttccgccagcaattcttcacgatcgaacgggatttcattctcaggcaaaacaatgaattcgcacccacccgcaattgccgcagacaacgtcaaatcaccgcaatagcgccccatcacttctacaatcgaaatacgcttgtgggatgtcgaggtatcgcgcagacggtcaattgcctctacaactgtttccaacgccgtaaaataaccgatagtgtaatccgttcctgccacatcattgtcaatcgtgccgggcagaccaatacaaggaaaacccgcttcagtcagctttttcgcccctaaataagaaccgtctcctccaatcaccaccagcgcatcaatgtcatttttacgcatattttcaatggcaatttcacggactttatcatccctgaattcaggaaaacgcgccgatcccagaaacgtcccaccacggttaatcatgtcagaaacactgaaacggtcgagcttcttcatgcggttttcatacaaccccagatagccatcataaatgccgtaaacctccaacccttcggttaaagcgacacgaacaacaccacgaatagcggcgttcatgccaggcgcatcaccgccactcgttaagactccgattcttttaatcttgttgatcatgatgacctctgacttgtagatgtaatatttaccaatctgctgactgatcccctaacgggaaaatttacgcatattttcaatggcaatttcacggactttatcatccctgaattcaggaaaacgcgccgatcccagaaacgtcccaccacggttaatcatgtcagaaacactgaaacggtcgagcttcttcatgcggttttcatacaaccccagatagccatcataaatgccgtaaacctccaacccttcggttaaagcgacacgaacaacaccacgaatagcggcgttcatgccaggcgcatcaccgccactcgttaagactccgattcttttaatcttgttgatcatgatgacctctgacttgtagatgtaatatttaccaatctgctgactgatcccctaacgggaaaatttacggcggttttacgaaactctgatcgtcacttcattagctgaattgattcaacttcatctatgatacggaaaaacacccagtctgcattaagattatgtttattttctgacgctcttttgattatgaataaattccccgttaatcccaacggtttttatgcttctctggcacaacggagcaaggatcttggtgaataataatatcggcacccggaaatctatcccgcaatttattttcaatcccctcggccaaagcatgcgcttccaccagcggcagatgatcatctatctccagatggaactgaataaaacgcgttggacctgattgacgtgttcgcaaatcatgcccacccgctattccgggatagcgcttgatcatctcaataatctcttgccgctcttcatcgggcaaagcgcgatcaagtaaagattgtacggcatcgtaccccatccgtaacgcactgtagaggatataagccccgattcccaaggcaaacagggcatccgcacgccggaaaccatacatactaaagaccaatgccagaagaatcgccccattcatcaacagatcggacttgtaatgcaacatatccgcgcgaatagcctgactttgagttttattgatcacccatttctggaacgtcaccaagcaaatcgttgaaatcagggcgatgacgatcacccagatacctatcgtcgcatgctccaatggactggaggagaccaaatgctgaaaacccgttaaaaacaggaaaatggccgatccggaaataaacatactttgggcaagcgccgccagcgattccgccttaccatgcccgaaggtgtgctctttatcggcaggctggagcgaatagcgcacagcgaaaaaattagtcaaagaagcggccagatcgactaaagaatccaccagtgccgccaataaacttaccgatcccgtcaaccaccaagcaacaattttcacgaccagcaacacactggccagtatcgttgccgacagtgcagcagcactgacccatcgcccataatttatactcattgactaccgcccttcggttattcagtctcaagtataaaaatagcgtgtcagatggaaaaatataggggcagcaaaacaaagcgaatcaattctatccaacataccgccatgcccctcaataattccgccaaagtctttcactccactgtcacgtttgattgctgacatacacaacccaccaataaagcccatcaacgtgatagccaatgacatcagccccgcttcccacggtgaaaatggcgtcacccaatacagtgacatccctagcagcgaagaggccaaaatcccgccaataaacccttcaaccgttttattggggcttaatttcggcacaattggacgcttaccgaataatttgccgaatacatactgcaaaatatcggacatctgcacgacgatcatcaggaacaacaatagcttgatattctgctcctcataaccgggaatatgcaacatcaacaaggccggagcatggctcagggcaaacaccgtgatcagcattgccgattggattttggcggttcgttccagaaagcgggtggtatccccaaccaatgcaatacgaacaggcaaaaacagaaaaacgtaaaccggaataaaaaccgagaataagccgtaccattgcatcccaaccaagacatactggatcggcataaagacaaagaaacaccagaaaagagcctcatgatcaccgcggcgagtcggtgtcaatgtgatgaattcacgcagggcaaaaaatgacatcaccgtaaacaggatcaccgaccccacagacccaacgataacagccagcacacagatgatacacatcatccaccagccacggatcctagcattcaggttatcgatagtcgcactgcgctttgcccccgaataccaaagcgacaatatgccgccaatcgcactggcgataatcaataccccaaatatcccgcccagcaaaagcatcaggtcattatcaatcttggtcatcgcatcaactcctccagtgcagactgggcacgttgcaagaaggcgactttactttcattttcacccaatttatccagaggcttaccaaatgttgccgaacaaataatcggcaccaataatctttttcctttcggcaggacacgatttgaattttccagatagacagggatcatttcagcatcagggtactgacgggccagatgatacaagcctcccttaaacggattgagttgttcaccatctccccgtgtaccttctggaaagaaaatcaacgactcttttttcgccagaatagcttccaaaggtgcaagaacccccgattttgaggtatgttcgcctttacgctcgatcaagactgcacgaaataccttatacataagatagcgacgcagcctggttttatcccaataatcccgtgcagctacagggtgaatctgataacgcaatttgggcggaagcccagaccagatcaccaatccatcaagatggctggtatgatttgcataataaatgcggcttgaggtcgatggctgacagccaatccatcgtacttgtacaccggtcaagacacggcacaggcccaataacgtcgcgcccatgcatcttgctaataggcttattttatgagagttagccatattgggtatccttatcccttactgtgtaataacagtgataagattttctaattagcggcttaagagaaggtaagataatcaagattggtcaagataacaacgggctaaggacacgttattcccaagcagaggagagctaaattcatccaagcctatattgatacgggctaataagcaatctcctcattaatagagaattacccttataatttagtgcggtaaaataaaaaataagaacctagcctaccaaaaatgcggccatgagcggttctcttgacattttggggctgaaaaatagctcaatagacggcattaataggggttcagttattttggaaatcttctgcgcgatcaaccaatacagataaaaatgaggttctggcaagttcatggacatttggggtcatgatactaatgagttgatatttctccggctcacactaatgacgggtatacacgcgagatagctattactcttacgtgcaacaacgggcatcttagctggccacgattcctcatcaggtaatttgatatgtattttgaaaacaaaagaggcgcatagagatgcatgatcttcccagcgcccctcgtcaccaaaacggcctcaaccctaataccgctcgcttaagcacgagcggtattagggtctaacccgccttttaggaaagaaaggaaaggctgttataaggatatattgatatcgttaacaccacaggcgcgcgcataacgactgagtgtatcgatggatgccttaacgatatttctttctatttttgatacagtcggtggtttgatccccattttttcagcgacctgagcgctggtcagcccggcatttttccgccattcagccagtatattctgcatttcaatcgctaactcaagctctttttcttcttccgctaacgcggccttaaatcgggggttttcttttgttctttcttcaatgtagagatctaaatcatcacgcatcatatttcctcttaatctcttgatggttctgtcagttcatttcttcgcgcaatcgctatcctgagttcattaaggggagtggtattggtttttttcacaaagcatcgtaacagatagattttcttccctgcggcataacaaaaaaaacttctggctattccatctttggcttttgttctcagctcaaacagtcctttgtatccctctatcggttttgaatgcggctctctcaggctggtcgggttttctcttaatcgcttaattaacgcgaccatgcgcagttccagcgagtcgggcagtttcttcctgcatacagtaaaacccgacttacctaaaggacaggcaacccatgtcctaaggcatactttcgctagtcatttcatgatgaacggaggaaaaataattgcattacagcagatacttggtcacgccagcataacccaaacaatggcctatgctcaccttgccccagactatctacaatatgcaattacattaaatcaccttaagtgtggaattaaagtagcgtaagaaagaagagtgtggcgatcgtccaccgatcgtccacactcaaaaactttcaaatactttctaaccctttcgtatttttttatgttgttgtttttacagggatgtgcactgtaagtgcttgaaaaaaaagccccacaagggggctgaaagacagggatggtgtctatggcaaggaaaactgttgttgatgcaactttacgtcaagggtattaatagaaatcagttcatttctcgatcaacacgcacttcataacgtttctggagttgtactttctgctctgctgtcaacaattgataaatctgattgcgaatacgtgcgatctctatactcaaatcaacattttctttcgctattttttcaagctgcaacctaaccgcagcctcatcaaaattcgttgaattcaaaaggctatacatcttccgacgttccgctctaatatctgccacgggtttctcatgcagacgttgctttttcactaaatcccatatctgctggcgttgctgctctgttaaagtgactccagcgaagatacaactatagttatagttacgttcatcattcaggcaataactaacggtattcttattaccatatggcatacaatattgtgagaagtcatccgcagtaacattatcagtaccagcagtttcagctaaagcatcggttgccctaagaacaaacattgacgctaaagccaagattgctatgttacgcatcaaataattcctcgcttcctcgaacagtactattcgatgtcagtgcggatcactataaccctgctgctgcaaactagcgtcagagcatgtaaaagaacgtaaagttatggaatagcaaagtttgttatcgtattttgctctcggaggaagaaaacatgcataaaatcttattagttgatgatgaccgtgaactgacatcgctattaaaagaactgctcgagatggaaggattcactgttgtgctcgctcatgatggcgaacaggcattacaatatatcgattcttcaatcgatctgctactactggatatcatgatgccacgtaaaaacggcattgagacgctaaaagagctacggcaagaccatcagacccccgttattatgttaacggcgcgtggaagcgatttagaccgtgttctagggttagaactgggtgccgatgattatctccctaagccgttcaatgatcgtgaactggtggctcgtatacgcgcgatcctgcgccgttccaactggagcgaacaacaggctgatagtgggacacctgtactcgaggtcgataaactacaactcaaccctgggcggcaggaagccagctttgacggtgcgattttggatcttaccggaacagaattcaccctgctttatttattagcgcaacatttgggacaagtcgtttcccgcgaacatttgagccaggaagtcttgggaaaacggttaactccctttgacagagccattgatatgcatatttccaacctgcgccgtaaattgccgaaccggactgacgagttaccctggtttaagacactgcgcggtcgtggatacttaatggtctctgcaaaatgatcaatagtttgacagcccgtatttttgcgattttctggcttacactggcgctcgtcctgatggtggccttaatggcaccgaaactggattcacggcaattgacaccgctgctggacagtgaatatcaacagggcactatactcgcgaaacagatagaaaaagagttaacccgctaccctgccaatgaactgttttggtggctacggttggatcgcgcaattgcaaaatggacgccaccggggcaacttttactgctcgttaccagtgaagggcgtatcgttgatatccagaccagtgaaaagcaggttgtccgtaacttcattggtcaatccaataatgcagatcatcccaagaagaaaaaatatggtcgctctgaaatactcgggcctttttctatccgcgatggtgaagatcactaccagctttaccttattaggcccgcaggtagcccccagtctgactttattaacttaatgtttgaccgaccccttttattacctgcagcaaccatgttaattagtgcgccattgctattatggctggcatggagtttagccaaacctgctcgtaaattaaaaaatgcggcagatcaggttgcgaaaggcaatttacggccacaccctgaactggaatcaggtccacaagaatttttagccgctggcagcagcttcaaccagatgatcaacgcgctggacagaatggtgacagcccaacaacggctgatttctgatatttctcatgaactgcgcacaccactgactcgcctgcaattggctagcgccctgctgcgccgacgtcatggtgagagcaaagagctgcaacgtattgaaacagaaactcaacgattagatgagatgatcaatgatcttctggtactttcccgcaatcagcataagaatgaactgctgcgtgaaaatatcaaagccaacgatatatggcacgatatcctagagaatgctaaattcgaagtcgagcagatgaacaaaacgctggatatcgtctcccctcccggttcttgggttatctactgtaatccggcagtacttggcagtgcattggaaaacatcgtccgtaatgcccttcgttattctagcagtcatatcgccgttgcgtttaaggcggataaccatggagtgacaattacggttgacgatgatggcccaggtgtcagccctgaagaccgtgaacaaatcttccgcccgttttatcgaacagatgaagcgagagatagagaatcgggtggaacaggattggggctggcgattgttgaaacggctgttagtcagcaccgaggatgggtgaaagcagaagatagccctttaggtgggttacggctgataatttggttgccgttgcatgtaagatgaaccactttcatcttacaatttagatagttacggtttgtaatagttaaagaaaaaaaattattgtacttgacctcaaagcagcgaaggtctaacctcgtcgctgcttaacacaaatggtttgtgcttatggttttttttattaaaaaaacataacaatatcaaatccatacataatcccctaaggtagggcaggcattctgggagccataacctagtgcggtagctttaattaaacatcccaatatatatttcaaaaaatttttacctaaatgggaaaatatcagagagaaacattaaaactcctattaccactggcctgaatatgttttatttggatttgtcatcttatcttttctcttgtacaacatttacttcagataccgaattaacaatgaatgagagttcacttaataaaacatcttgctgccatacacgcccttcatcagatttgaaaaatcaactataaaaaggatcgacaccttcttgctaagaatcgacactgctatttcaagatatacctaattataacataacagtccatgctgtcagttatatggaacctaaacttaaaccattaaaaagtactttatcaaatagatgaatagctgtcatattttcagcaagtacaatcaacataaaacagttcgttactcctatgttaaaagcagtaaacaagaaagctattcatataatcaatgtattctcagcctgcaataatgtgatttcagtcaagattaaagcagatgataacaccaatgaaattaaaacaatactcggagtattatatttactagcaataacaaactgtttaaacacgatatatacaataggccacctaaaaaattactccaatgcagaatgtcaaaaccgtagtaaaaaaagatacggtttcacgccaagctatcagttacttatccgatttacccaatagagtttaattaatttctatttttaatagtctgaaataaagactcttagtataatagtgtctttatttatataatagagtaataattaaaaaataacatactaaagttcataatttattaactcacataagtgctgaacaactagctaaatttatcggaagacaattcatattttgaataaatttctctaaaaaccaaatataataataaaagaaagatatcatatccaaagaagcgatgttgcagagatattttcaattatttgctatattacaataaattccctacataaatacaaaaaaatttaaggcagaaataaaacgaaagaaagctgccataagcataagttatttgtctaatatctttgcagcacaaaaccttcataatttttccttgtgaggaaaaaaaagccaaggctgcagcatatcatggtcaaaaggataagtgtcatatgaaaactgtaataacatacggaacgtttgatttgtttcatgttggacatgttcgtttactgaaaagactaagaaatttaggtgatagacttatcgttggcatatcaagtgatgagtttaatagtataaaaggaaagaaatcatttttttcttttgaagaaagagctgagattgtaaaagcatgccgccatgtcgatgatgtctttgccgaaaatacgtggaagcagaaaagagaagacattattaaatataaggcttcaattattggtatggggagtgattgggttagtaagttcgatgatttaaatgatatctgtgaggtgatttatcttgatagaacagaaaatatatcatcaacaggtataaaaagtgcattagcaaaagtgacaccgaatgaaatttctcaaatggaaacacagataagcactatgttggaaatagttaaagtactatccgcaaataaataaaaggtgttttttgatgaaaaaatttataatagcacttttgaaaaaaatcacatatttaataccaaagaaaaacaatagagtatgctttaaaagttttcctgattatagtggtaatgctatagcagtgtatgaatacatgaaaaaaaacactgattatgaacttatatggttaattgataatgaaattaagcctaaaattggagcaaaaaaatcaaagtcaattagcggattatggacatttttccgtgccaaatatattataactactcacaatgattttgtgtccatttcaccatcaaaccaaatctatataagtttatggcatggaatgcctttaaaaaaaataggctatactggcaatgaacatataggaatgaagtctatttcagcattgagaataagtacatctgagttgactcgtagcctaatatctgccagtttcaatgaaccagcaaataacgtttttataaccggacaacctgtttgcgataagcttttctcacaaaaaaagataagtgatttttttgatgtaccgaatgatgttagaaaagttatattttaccttccaaccttcaggcaggattttaatgaaaaaaaaatagaaggacgaaaagtcagctcacataatatttttaggtttgacaaatataaccatcacgagtttataaaatatttagaatatgaaaaaatattgcttattgttaaactgcaccccgcagaagaatgctatttaaatgaaattgaggaaaacgggtactttaaatttattaaatctaaagatattgatttatatgatgtgctggcagtagcagatagtctgattacagattattcatcagtttatatagactaccttattttagatcgcccactagcatttgtagttcctgataaggagcaatatatacaaagtcgaaacggttttactcttgaaccatatgacgactggacaccagggaacaaaatcatatccgtatctgatttgtttaattttattgatatgctatcttctggacaagataattataaaaatgatagacaaagagtaaaaagaattatgcatagatatgatgacgatcaaaattccaaaagagtttttgatatgctaatcaagagataagatataatatgatatatatcttattaccatttatattatttttttttgttttcttggaacagattaagatttcaaagaaaaattcctttatattatgtttttttgtagtatgcatagaaattcttttctttggatctagatacaaagttggagtagactggcaaaattatgtaaactactttaaaacattagatgaatcgtatcgatttgagattggttattatttaataaatgtaatatttaagtttattggtcttaattattgggctatttcattttttgcatcttttattttttccatcacactgtttgccacaatctggaaaaaggttcctttccctattctttttttagcattgtattttatgataaatatgcttaaccagatagaggcagtaagaagcctaattgcatactctattattttatattcattgcaacaggttattttagggcgttacttaaaagcattaatattttcatgtttttcaattctctttcaccaaacaatgattgtctttattccatgtatttttttatataataagaaaatatcaaatggctattttttcacattactcttcattggtctatttctatatgcaatcaatatatcaccaatcaatgctcttcttacagaactatcaaattattttttcaaagatagattacaacattatttattaatacaaactgatgggaagtatgaaagtgtcctttccgtaactttaataataaaaattataatattttcagcaattactttattcaagaaaaaattagataaaaaatatattaaaaacccatcatttaatgtgttttataatattggagctgggtacatactgatatatgtatatatgctaaatgaacctgcaattatttataggctttccgatttatttgtgattgggtttatcgcaacaatttgcttcttcattaactttttaaatgaattaaataaaaaaattgttatacttggaatattagtcatttcgctcctcatttataatagcccatttagtgataaatattatcaaaactatattattaactatacttctttcctatcattaattttctccaatgaaaaagaatcatataatgtaaatagttactggaataatcctaaatgaaaaacacaaaaataacattcgttgttggtgacattagcgccaaaggtggaactgaacgagttacatgttcgataataaatgctttaaataaagttgttcccgtagagttaatttcgcttgaaaaaacaggtgagccttttttttccatcagcaattctgtaaaactaaagtatataaatgaagatccttcgtcatcaacactatatggtaaaaaagttttttttcttaaaagatttttcttagatgctctttacattgcaaagactttacctaaaatacgaaattatttgattcaagtagaatcaagccacgttgtatccacagatacaaaaatggcacttttgctcaaattagcaacatttgcaacaaagactaaagttattgctatggagcattttggttactatgtacctcataaaatgatcagaggtataagatctatattatatagatatgtacacgcagtcgttattttaacgaatgaagacaaacaatgttatttaaaattcaataagaatttacatataattccaaacatagttgcatttcaatccattgaaaatcctaatttagactctagaagaattattgctgtcggcagacttacttaccaaaaaggctttgatattctaattaaagcttgggaaagtgttgaatctcaaacatcagaatggaggctcgatatatttggagaaggtgaggattatgataaattaacctcactaatcgaggaaaaagaactaacacagataagtataagaaatttctcaagcgatattgaaaaagaatatttgcagtccagttttttagtaatgtcatcccgatatgaaggactaggaatggtattaatagaagcaatggcttgtggaataccttgtattagctttaattgtcctacagggcctagtactattattcaaaatggtattaacggatatcttgtaccagagcagcaagaaaaagcactttcagaaaaaatattatatttgatacaaaatgagagtgaaattaagataatttcaaaaaatacaaaaaaaagcattactccattcacagaaaatgttgttgttgataaatggttatcattgttgtatggtgagacgatagatgcaaataaaaactttgaaaaataaagggattcttgatttaacatattatgtgttaggagacctctttataaaagggatgatgtttattacattaccattattaactatatttttgactccggctgaatatggtacattgtctatacttacaacaatgataacattttttgctgttcttttcagtgtgaatattgaaaattcagtaaataattactatatgagaaacggtgaagattttggcggttttttatattctaatataatttttattattttctttcaattgattgttttttcagttttttacctgctttcatcagaaatttcagattttttcaaagtaaaaaaaatagactcaattttagtaggaataatttgcactgttattttctactataatctatatatgctttatttgcagggggctaaaaaaagcagggatttttctctaataaatgtattcaataaattattggaaatagggctgttacttttattggcttgggaaataacaaataacaaatatcttagtaagatatatgcacaactagtcgcaatttcaatatttttaccatatatattattcaaattaaaaaacttgtgttcgtttaattttaagttctcatatgtcaagtattcattggccttctcaatccctctaataccacatgtattgtcaaacactattttaagtcaaagtgatcgagttatgattaacttgatgataggagaaaaagagactggtctatattcattcgcttataatctaggcttgtcaatggcagttgtaatatcagcatggaatagcatgtggcaacctagattttatgaattatataataaaaaagattttgatgaaataaatgggcttatatctttttatagcaaaataatctcagcgataggtgtgctgacgatattaataacgggtcctattgtgaaaatatttgtctcgcctgattactatggttcattaaagataataccgattatcattgcatcaaatgcattattctttcagtattatctatatgtaaattatactttttaccatagaaaaagtttaattatttccagtagtacgttagttgcggcattagttaatttatctttaaattactttcttatccccaaatggggagtcgagggagctgcttatgctacattaatcgcgtatttcatattagctattattcattatttaaatgcgaagaaggtttctacagataaagtaataagtctatctctggcttttaagtggagtattcctatttactttactgcgataattgtggcctggatgtcttaatatgcaatacattcttttttatggtgaacttcccccaagcgtaataaatggcgtctcactttcaaacgaaaaaaacattgaaatcttaaacgatttttacaaaattataaaagtcgaggaaaaacctgtttcttctaaataccggtggtttagtaagattattaatattttttatgattttttaagcgttagaaaaaaatgccgaaaatataaatttgattttatttatgtatcgttaccgacttctattttaggtgcatttaagattctaaccataacaacgttatcaacttttctcttacaaaaaaataggatagtcctacacctgcatagaggagacttcgataaaatatataaaaattcattcttctatagattaattttaaatatattaatcaagaaaacttatagaatagtatcattatcagaacaacaccgaagacaattgttaaatttttttcctgataaaaaaatctctgttgtcactaatacaataagagaagaatttttcataaaaaaattaactttagataaaattcgttttttatatttatctaattatcttggagctaaaggtatttttcatcttttgagagcattcactcaactaaaaaaagaaaatatcaattctaatgttgaattatgctgttatggcgcattcttagatccatctataaaagaagaaattttatcatataacggaactaatggtatttcaattcatgagactttggatgggttagataaaatcaatgtattagagcaaattgatgcattgattctaccttcttttaatgaaggtcagcctttatccatcattgaagcaatgtattacgagtgtgctgtcatcactacagatgttggttttatcaaagaaatgttacctatacattatccgctattattagactctcctgacgaaaaaatattaaagactgcaatgaataaatttatttctatgaataacaatgaaaaggaaaaattagtctgtgaacttaaaaataattatgataaaaatttttccaattcaatacataaaactttagtaaaaaaggtgtttaactgtgaaaataatttttgtaaataatagtttagtaccgtacagacatcatttttttaattatttattttctaaaaataataatgaaataaacgattcaatcgtattatatcttactgaaaaagagtccattcgtaaatggaatgaaaatgaaaatgaaaatgaaaatgaaaatgaaaaatataaatatttttttcttaaaaggatatttcaagcaaggaataaaaaaacaacaacctcagactacattattaatcactcatatttgaaatttttaaaaaatattgatgtagttttcactttaggatatagctattctacatatataattatgtgcctgtatgctaaaataaaagggataaaaaccgtttgtttttgtgaaacaaatgaatcagataaatcccgtaataaaataaaagggaaactaaaaaaaatacttcttaactttttatatgatcattttactgttccaggagaaaatgcgaaaacgtatctacttaacctcggcatccccgaaaaaaaaataacaattatcggaaattccgctccatttggaaaatttaatttgaaacaaaatagccatcaggataaaaaatataatagaataagaatcctatacgttggaagattttctgcagaaaaaaatattatttttgctttaaaaaatttagagaaagtaaatgaaaaaataaagataacattagttggaaatggagagcttgaaaatgatattaatcatttagctactaagtctaaacatgaatactctattcttcctttttgcgatagggaagaattaccaacactgtataacgcaaatgacatacttttattaccatccctgagtgaaacatggggattggttgtaaatgaagccttagaatttggtttggcaatattggcttcaaatcatgttggttgtgctccagaactagtaaaaaacaatggagagatattttctgttcgttcagaaaatgattttttagataaagcaaaaagaataattgatgacattagtaattataaaaaaaactctagaatcatttacgaacacaataatgttttaacaaactcggagaaaatgatgaaatgtttgagaaacataacaaaataataaggaagctattctatatagaagaatggaatacaggaataattaaaagaaaaaaatctgatataaagaacatctccgattatatattacatgaagatatctcctggttgaaaaaatacaatacatttcaggcagacccttttattttagaacgcaatgggttaatatatattttttacgaatcattaagcctgataaattctaaaggtgatatcaaatgccgagttttagataatcactttaaagaattagatgatatattgttgataggactaaacaacactaaatgtcatttgtcttatcctttttattttgagcatgaaaataaattatttttaataccagagacttctgaattaagtgaagtttctctattcgagtgtgtacattttcctaacgagtggaaaaaaatacatactcttgtttctggggtaaagttaactgatagttcaatcatacgttcaaataaagaatactacttattatcaactgacttagataataatttaattatccatatgaatacaaacctttttggtgattggaaacggatttttccaaaattaaaattatgtaatcaacattctaggggggcgggagccccattctattcccaagatagcgtgttttttttcactcaagaatgttttgaatataactatggcaatgcaatctttatgaaaaaaattacagcaatagggaggaatgaattttcagaagaattgataagtaaaattgaacctctaaaaggaagttataacgaggggattcatactattaatttttcggataattatatagtaatagattctaagaaattgaagtttaatttgttttcattttttattaaacttatttataaaataaaagttaaattacgacaatcctattgcattggggagagatcatgaaaattgcattaattacaggaattaccggtcaagatggttcttatcttgcagaattacttttagaaaaaggatatactgttcacggtctcatcaggcgttcatcatctttcaatacaactcgtattgattctttctgcaagaatgagaaattaaaattgcattatggtgatctaactgatagttcgaatattataagattaataaaacatatcgaacctgatgagatctataatttaggtgcaatgtctcatgttgccgtttcatttgagtctccagaatatgtagcggacgttgacgcattaggaacattaagactcctcgaagcaataagaataaatagacttgaaaagaaaactcgattttatcaagcatccacctctgagctatatgggctcgttcaagaggtgccacaaaaagagactacgccattttatccacgttctccttatgcagtagctaaaatgtatgcgtactggattactataaattatcgagaatcgtacggtatatatgcatgtaatggtctattatttaatcatgaatcaccacgtcgtggtgagactttcgttactaggaaaattactcgttcgttagctaatattgcacaaggtatcgaaacttgtttagaactaggaaatttagattcattacgcgattggggacatgctaaagattatgttcgtatgcaatggatgatgttacagcaaaaacaagcggaagattttgtcattgcgacgggtaaacaaatttctgtgagagaatttgttcgcatgtctgctaaagagctcggtatcacacttgagttcagtggaaacggtatcaatgaaattgcaaaggttatatctgtttcaggagaaaatgcgccgatagttaacattggtgatatcattgtacgagttaatccaaaatattttcgccctgccgaagttgaaacattactaggtgatccaagtaaagccaaagaaaaactaggctgggttcctgaaattacagtagaacagatgtgtgcagaaatggtgttttctgacttagaacaagcaagacaatatgccatattaaagcaacatggatttgatgtatcagtttcgctggagcattaaaatgataaaaaaaagaatttatgtggcagggcaccgaggcatggttggctcagctatttgccgccatttagaaaaaagaaataatattgaattaatcgtacgatcaaaaaatgatttagatttgacaaatcaagccgcagttgaaaatttcttccgctctgaaaaaatcgatgaggtttatttggcagcagccaaggttggaggaattcatgctaataatatttacccagctgattttatctatcaaaatttgatgattgagtgtaatgttattcattcggcacacaatactaatatccaacgtttgttgtttttaggttctagctgtatttatcctaggcttgcttcacaaccaatgaaagaaaatgctttattaacaggagttcttgagtcaactaatgaaccttacgcagttgcaaaaattgcaggtattaaactttgtgagtcatataaccgccaatatggaagagattaccgaagtgtaatgccaacgaatctatatggagaaaatgataattttcatgtcgagaactctcatgtaattccagctcttttgcggcgttttcatgaagcaaaacttcataataaagaaaaaattgttgtctggggaagtggtactccaatgcgagagtttctatatgttgatgatatggcagcagcgtcagtttttgtcatggaacttgattataaaacatatacagctaatacatcagacatgttatctcatattaacattggaacaggaatagactgctcaattaaagagttggctgagactatggctaatgtagttggatttaacggaaaaattatatttgatgacactaagcttgacggggcaccacgtaaattaatgaatattgagcgtttattaaatataggttggcgatattcttttaatttaaaagaaggtcttgaaaaaacatatcaatggtttttaaaaaatcagaatagctttagaacgtagttgtattgaagaattagaagtatagctatggaaaccatttagaagatttctgttacttatattaactttggtgccaaaatcattacagagaaatactgttattacggcaccttaatttatatagataatacacgattttctcatcagaaaataaaatctcacagtgtatttctatgatatttatataacgcctgatatatctaaaaactattttcttaacaagatggaatgatatgctgttacctgtcatcatggccggaggctctggcactcgactttggcctctttctagaactctttatccaaaacaatttctatcattaacaacagaaatgacaatgcttcaagatacattgcagagacttatatttattgagcatcaatctccgattattatttgtaatgaggagcatcgttttattgtagcagagcagttgagaaaagctgagcttgaacatagcggtataatattagaacccataggaaaaaacactgctccagccgttgctcttgctgcgttgcaagcatcaagtcaagggaatgatcctcttttgcttgtgttggctgcagatcatgttatcagaaatattactgcctttactgatgcggtgaataaagcaactgaatatgcaaagtctggtcatcttgtaacatttggcattgttcctgataagcctgaaacgggatatgggtatataaagaaaggaaaaaatatatcaactgatgcttttattgtggaacactttattgaaaaacctgacattttaactgcaattgaatatatttctaaaggtgattacctttggaatagcgggatgtttttatttaaagcatcagtttacattgcggagcttaaaaaatatcgtcctgatattctacatgcttgtgaaacatcaatgtcaagtgcaaaactagatcttgattttattcgccctaataaaaactcttttatgatgtgtcctgatgaatctattgactatgctgttatggaaaaagtagattcagccatcgctatacctcttgatgcgagttggagtgatgtgggttcttgggctgcattatgggaggttagtgataaagatagtgataataatgctattagaggtgatgtattaatagaggaaactgaaggaagctatatatattctcaagacaggctagttactacggtaggaattaaagatcttgtcgttgtggagacaaaagatgctgtacttgttgctcaaaaaaataaagtacaaggtgtaaaaaacattgtcaagagattaaaagaaaaaaataggctggagcatatacaacaccgagagatttatcgcccttggggaagtcatgatgctattgctgatggcgctcgctaccacgtaaaacgtgttattgtgaaaccggggcaaaaaacagcaatgcaagtccatcatcatcgagcagaacattggataattgtttctggtacagcgaaagttttttgtgatgataaagagtttctaattaccgagaatgaatctacttatattcctattgggtctcctcactctatagagaatcctggtaaaattcctttggaaataattgaggtcaggtctggagtctatcttgccgaggatgatgtcgtacgagtgtcaacttctggggttggttattaatgcgtatttcaattatcactgcaacttataatagcgaaaaaaccttacgcgacactttgatatcgcttgaaaatcaaaattataataatgtggaatatattatagttgatggcgcttcaaaggataaaaccatcaatttaattactagtaccagtacaaaagtctcaaaaattatctgtgagccggataaaggaatttatgatgccctgaacaaaggcattaatgcagccacaggagatgtcataggatttttgcattcagatgatctacttgcatacaacgatgttcttaaggatgtcgctgaaaaatttgtgtcgacaggttgtgatgcagtatatggagatttggaatatgtttcacagaatgatatcgcaaagcgtatcagactctggaaaagtggtgaatttagtcgaaccaaacttcagtttggatggatgccccctcatccatcattctatatgaaacggtcctgctatcaggaacatggtaatttttcactcgactatagaatatcggcagattatgattctctgctaaggtatattcttcaaaaaggaattactgtttcgtatattcccaaaatactggtcaaaatgagagtcggaggcattagtaaccgttcagtatcttcaatgtttagcaaatcattagaagatattcgagtcatgaagcagaatggtattgtttggccacttgccctcatttataaaaacttatcaaagatttctcagtttatcaaaaaataaaattatgatgaatattaaatcaactatagatcaaagtaatattgcttttggcactagtggtgcaagaggcctcgttgttgatttcacacccgatgtctgctcagcatttactcatgcctttttgaatgttacaaaacaaaacttcaaatttgataaagttgccgtcgctatagataacagaccaagtagttatattattgcacaagcttgtgctgatgctattcaaaaacaaggtcttacgcttgtctattatggcgtgattcctactcctgctcttgcttacaaagcgatgcaagataatatcccttgcattatggtgacgggcagtcatattcctttcgatcgaaatggccttaagttttatcgaccggatggtgaaatctcaaaagaagatgagcatgcaattcttaattgtgactatccgtttgagtcaccgtcaccatccactctatcagagttaaaagtctcaactgatgccgctgaagcctatacactccgctattcgtctctttttgattcgtcattactagccggaaaacgcatcggtatctatgaacactctagcgcaggccgcgatctttatgccaacatcttggcctctttaggagccgaggttatttcattaggacgcagcgataagtttgtaccaattgatactgaagccgtaagtgcggaagatcgcactcaggctaaacagtggtcgaagcaatatcatctcgatgcgatcttctcgactgatggagatggcgacagaccgttaattgccgatgaacaaggtaattggttacgaggcgatatactcggattattatgtgccgaggcgcttaaaattgatgcagttgcggtgccagttagttgcaatacagccattgaactttctaacaaattcaagaaagttaaaaaaaccaagattggctctccttacgtcatagaagcttttgatggactaagccaggattaccgtacaattgcgggttttgaggcgaatggaggtttccttctcggaactgatgtttcggtgaatggtaagcatctcgccgctttaccaacacgtgatgcagtactgcctgctttgatggtactcagtgcggcccgttttaataccattgcggagctggttgatcagttgcctaaacgtttcactttttctgatcgtctgaaaaacttccccggagaggaaagcaaaaccattcagcagcaagccgtgcaagatcctgcagctttccttgtcgatgttggattcgccgggcgcacggtaaaatcaatcgaccagactgatggggttcgattcttgatggataatggcgatattatccatttgcgcccttcaggtaatgcccctgagttacgctgttatgcggaagcagaaacagaatctcaggctcaggaatatgtcgagcgaaccttagctttgcttgcttctatgtcatagattttgatgtgaactaatgctacatcagtgacctgtttggcagcagactaacccgtcagttcttgttgatacctgtgtaaaatcctccctcatgagatttatttatatcttcaattcagctttacagcaaacgagtgcgtgcaccattcagtcaatcgtcgaccagagacgcatcatttgaaaataaaaatcttgaaaatcaataaaacaaaataatatctaaataaaaatgcatatattagatatataaaattcggtcatgacttcaaagcgttaatttgatattcttgtactttttaatgggatatcatcatgactgttacgatagaagtgacttgtcgatattgcgaccgagctgaacctgtacgcaaacacggaacaggtaaggccgggtttcctcgttattattgcaagggttgccaaaaaaccttccaactcaattatcgttacaatggccataagccgggtatgaaagaaaaaattgtcgatatggcgatgaatggctccggtgtgagagacacgggacgtgttttaagtatcggtatcaatacggtaatgcgtactttaaatctatggtctcccccgtttttgcaaccctgattttgacgcatgtggacttgcctaaatctatctgacgtctgtatggggaaaagttcccgcgccacaatgagttccgcacccggtaatcctgaaaaaactcacggcttctataagccattttaaagtctaggtttttatcgggccgactggccgttcatgtcatcaataatcagtcttcgcaaaaccagagagttaatcgttattttctctattagttcaacaacgtagggggtatacctgaattcccttactgattgaatactcctttttttgtaatgattgcccaagcgatccgagccagcttattggccaatgcgcaggccacaacacaagaatgctttcgcgttagctgctttttaacccactccgccaattttcctgacgggtgatccagtttctgtatgtaaacccgggcacacagcacgagcagttttctgagttgtttattgcctcgtttgctgatgcctaagagtgtattacgccctcccgtactgtattgcttcgggactaatcccgtggaagcggcaaattcccggctgtggctatattgtttcccatcccctaaccctgatgccagtacgctagctgtgatggggccgatagacggaatagtcagcaatcgttgagcaccctcatcttgtttaatagtcagaacaagttcttgttcaatctcgctaatttgctcaaccagatacagataatgggcgtgcaggcgttggagcagctgtaccagataagagggcaaatcattttcagcgataacttcagacagctgtcttatcacagcaataccttttggcatgctgataccaaattccagtaagaaagcatgcatctggttagtggttttcactttatctctgaccagggattctcggacacgatgtaatgcccgcatggtctgctggctttccgtacgtggctgaacaaaacgcatagaaggtcgtgaagccgcttcgcaaatcgcttcggcatcaatgaaatcgtttttgttgctcttgacgaaaggacggacaaactgaggtgaaatcagtttagtttcatggcctaatgccgcgattttacgcgccatgaaatgcgcaccggcacaagcttccatcacaacagtggcattgggtgtcactgccagaaactcaaggagtttagtgcgggtcattttcttatgataaagcgcttttccatttttatcctgaccgtgcaggtgaaaggaatgtttacccaagtcaatgccgataagtgttgttctgttcatgatgatgccctcttctaaaagaaaaacacactgtcaatttactgcaacagggtgggggagaccatctcattaaactctcgccaaaacaagtaacatcgcgacagaccgcttatgacgatgtcacacttatctgtgaattggatgagcaagggtcttttgtaggcaataaaaaacaacgtcattggctttggtatgcttttgatacgaaaaggaaacaagtcatcgcccatgtctttggcccccgaacggatgcaacctgccgaaaattactcaacttattggcgccttttaatattcgtttcatcacgaccgataactggggaagttataccagagaagtggcgccggaaaagcatctaataggcaaaattttacccaacgtatagagcggcataatctcaatctgcgaattcatatcaagcggttggcgagaagaacaatttgttactcacgttcaatggaaatccacgaaaaactcattggcgcatatattgaaaaacatcattacaaccctttggggtcatgctccaatctttatcgccaatctcggaaaaatatgaagataatattttattagtcagcagtaaattacaaatttaacacaaatctaatttgaaattcaataattcattcaatgtatttgatgaattcaaacactattggtctttactaaaaaataaaaatattccatatgactttcaatatacaaaagaagtgatggattttttctatcaatctgagagcatttttaataagttaacctcagcttcgtttaaaaatagcgatatcacaatcccgtaaattcaagctcggttttttaggttggaatgtataagctattaagccagcgacgatttccaataaaaaaccgagctgactacggtgtcttgaatgctctatctgagaaatatttttgagctgatccacgaccgtttctatcaaaaatcgctttcttaacatcagcttatcccagagagataacgcttttgccttcatgttactacggacatgagtgattaacgttattccttctgcttccagttcatcgcacaaggcctgtgacaaataccctttatcgccatacaaacaccctgttaacccttgtacccgtgctttgacgggatgacgatcatctttatttcctgaggtcagcttaaccgctaaaagttcaccacaatcattgataaccaaatgaagtttaaagccataaaaccagcctgtactcgttttccctcgctgtgcgacgccctcaaatacgcgatgacggggaatacggaggttgtgacaaacagcaattttggttgaatcaataaaggcgatcccctgggtttcagccttgcgtgacgaaaaaaaagcacagagaggaatgagcgccctgtgctttaaggttaacatacgggtgtagctgaccaacctgggaaaatcggctttaaggtagtgtttgacatgctgaatataaaacgttttaaaatcacgataatggctcatgtggaataaaatgaggagcgtcatcacttcactgagagaaagggaagcttcgcggcgacgtttgagcaagccattttcaattaactgttgatgtcagagaggaataaatttttggcaaaagtcatcgacgcagcagtaaagttcttctaaattagacatgcctgaggatctccacgattttgttttctttgacaaaaactttgatcgtgcctcaggcacttagttcccttcttaagcaaacctcaggttaagttaggtctagaatgctgctcctgtcataatgatctaaataagatattaggaaacggtaaactttattgggataatataccaatcgctctgctagataaaatagaagttggtatccacttagtagaaaaaacacacgcagcagaaatggatactgtagaaaattacaactatatctgtaacaatctgattaaaacatgctaaacatcgtcctattcgaaccagaaatcccgcctaacacggggaacatcatccgcctttgtgccaacacgggctgccagcttcatttaatccaacccttgggtttcacatgggatgacaaacgcctgcgtcgcgcagggttggattaccacgagttcgccaacattaaacaacaccatgatttccatgctttcttggagagtgaaggtttaagtccggtgaattcacaatcccctactagggtgcggttgtttgccttaaccacaaaaggcacgcctgcgcacagtaatgtcagctatcgggatggtgattacctgatgtttggcccagaaacccgtggtctacccgcttatgtgttagataatatgccaacagagcagaaaatcaggatccctatgctgtcagatagtcgcagtatgaatctttccaattctgtggctgtggtagtctttgaagcatggcggcagttagggtattcaggggcgttattgcgggattaatattaggccattcagcgcttacatcgcgctgaatggccttaattctttattacaaacagagatcggatctcaaatcccatccccatactcaaacccattactgataccattaaaatgctggttcatatctagtgatggtttgtcactttctggtttacccacaatccgcgccggtacgcccgccacggtggtatgaggcggaacaggacgtaagacaacagaacccgccccaattttcgcgccacggccaatttcaatattgccgaggatcttagagcctgcaccaatcatcaccccttcacgcactttcggatgacgatccccgcccgctttgcctgtaccgccaagtgtgacggattgcagaatggagacatcattctcaacaactgcggtttcaccaatcacaataccggttgcgtggtcgagcatgataccgcaaccaattttcgcggctggatgaatatcgacaccaaaagagacggatatctgattttgcatataaatcgccaatgcctggcgctcttgcttccagagccaatgcgctatgcggtatgcctgtaatgcatggaaacctttaaggtagagtagtggtgttgagtatttgtccacggcagggtcgcgcagacgaacagctttgatatcacgggctgccgagccaatcatctctggatcgctgcgataggcgtcttcaacaacttctctgaccgcaatcgcaggcataatcggggttgccagtttatttgccagcatatagctcaaagcactaccaaggttttcatgcttgagtaatgtcgcgtgaaaaaaactggctaacatgggttcacaatcagccagcactctcgcttcattttttatatttttccagacttcgttcagttcttctcgagacatagcaatcattctcatttgactgtttcccgccctaattggactcacttcccactatacaccctgatacatcgaacgaggatttacggttattatcgctgactcaagagttaaggctttctccctcatctcttgtcgctctgcccaataatgtctgggctgcttcgataacgttcttattacaatatagtatctgatagatctgctctgtaatcggcatttcaacaccggctcgttctgccaatgcccgagcttctttggtgttacggtagccttcaacaacttgcccaatctcatgttgtgcatcgtcaacgctgataccttgtcccagcatcatgccaaaacgacggttacgagattggttatcagtacaggtcaaaactaaatcacccaatccggccatacccataaatgtcgaaggatcagcgcctaatgcgataccaaggcgactcatctcggccaagcctcgggtgattaatgctgtgcgagcatttgccccaaaacccataccatcagatatcccggcaccaattgcaataacattttttattgcgccgccaagctgtacgccaatgaaatccggatttttgtacacacgaaaacttttgccgcagtgaaaaagctgctggagttcttcgccaaactcaggtgtcgtcgcagatacagcaatcgcggtcggtaaacctgccgccaattctttggcgaatgtcgggccagataccactgccaatgggatttcgttacctaatatctcacgtgccacatcctgcaataaacgcccggtttcggcttcaaggcctttcgttgcccagacaatacgggagtccggttgtaaatgtggttttatctgctgtaacacatccccgaaaacatggctgggaaccacgatcagaatattactgctggttgaaaccgcattcttcaggtctgcttcgagcaataaattatcagggaaagaaatatccggcaaaaatgcctgattgcaacgcgcctgctgcaaggcatggacatgctgagggttatgcccccagagcacgacttcatgcccgttgcgagccaatgtgatggctaaagcggtgccgtatgaaccggcaccgatgactgtcatagaagcggtattcatcaggcttcctgagtagcttcactaggctcagactgctgttgcaggtaattcatgaacagtgcatcaaagttgactggtgccagattcagttgtgggaaagtaccacggcctaccaagctggtgatgcattcacgggcatatgggaatagaatgttcgggcaataggcgcctaaacaatgtgccagttgggttccatcaataccgtcgatagagaaaatacccgcctgctgaacttcgcacaggaacgccgtttcttcccctaatgccgctgtgacagtaacacgcagaacaacttcatagactccctgaactaattcattggaggcggtatccaaatctaatttgacttccggttgccactccagctggaaaatctgaggtgccttcggtgcttcgaaagaaacatctttcgtgtagatacgctggatctggaaagccatttcggtgttgttttgttctgacataatgatttttaccttgttaagacgtcctgattaaaccttgatgatgtaagcataccgcttacacctgtgttcgttattttttgccgcgggccaatggcagattttcacctgaccatcccgtaattccctctttcagggaataaacctgttcaaagcctgcacggatcagatgctcagccggcgttctggattccagcccattcgctgaaaccacaatgacaagctgttttttatgcttctcaaactcacccagattattttctttaatctcagatggcgtcaggttaacggaaccaataatatgccctctgcggaaatcgtcacgggagcgtaaatccacgacgatagcatcttccttattgatgaaatggatagcctgtgcacgagtgatctctttactcttggagaacacgctttttgccgtcatgacaatgacagccaccagcaatgcaatccaggcaaggctcaggatcgtgttccggctaataaattgcatgatttcttgcagcatgggggaaacaactcccgttagttaataacaaatatctaaggtagcagagtatacctgtgtgctgcgtcaattacagccaattagcgccaacccagtgcagattttgcggagagtttcgagaaaaagtaaaaatcctccgatatccatttaattgccatgcttcgccaaaatattttatgtcacactgagtcgatacaggattttcaccaataaatgggctaaattaactaaaatttatattatttaaaaagataaaaaacagtcagttctctggtcagaggcaacccctcatgaaataatcggacacgatatggtaggcaaggtactcaataagatggctgatagtaaggatctaaaaagccgtaatcatcggcagaagcaggatcagtggcaatccagaggcttagtgctctgtatattgctgtttgcctttttcagcacagatacctttgccaatcagatttcagagaataaagaccagctcaaggatattcagcaggatattgccgagaaagagaaaagtgtaaaacagcagcaaaaaaaacgcactaatctactaagtcaattaaaggaacaagagagcacaatctcagaagtggggctttctctccatggcacccaaacccacctgaataaactgggcaatgagattacatcactgaatgcgaatatcaaacgcctgcaaacgcaacaaaaagaacagcgtcggctgcttgccaaacaattggattcagccttccggcaaggaaatcaccaagggttagagctgctgttcaatggtcaggaaactcaacgcaaagagcgcatactcgcttattacagctatctgaatcaggcgcgtcaggaaacgatcaataaactgcaaaaaacaaccaagcagcttaaccagcaaaaaaagctgcaactggaaaaacaaaatgagcagaaaacaatactgagcagccagaagcaacaaaaacagaaaatggaagttgtccatattgcgcggcaaaaaacgctgacggagctagaatcctcactgcaaaaagatcaacaaagtctgaccgagcttcggcagaatgaaacccagctaaggaataagattgtcaaagcagagcgagaagccaaagcccgtgctgaacgtgaggctcgtgaagccgcacgcgtccgcgcacaagtcgcagccaagcagaaacaggctcaacagaaaggctcccgctacaaaccgacggaagaagaacgctcgctgatggctcgaacggatgggcttggtcgcccggccgggcaggcaatctggccagtacgcggtcgagtcatccatagttttggtgaggcaatacaaggtgagctgcgctggaaagggatcgtcattgccgcagcagacaatacggaagtgaaagcgatttcagatggacgggtactgttggcggactggctccaaggctatggtttggttgtcgtagtgcaacacggcaaaggagatatgagcatttatggttataacaaaacgacgctggtcagtgttgggcaacaggtacgagccgggcaacctatagcgttggttggcagcagcggcgggcagcagcagccttcactgtattttgaaatccgccgccaaggtcgggcagttaacccattaccgtggttaggaaaataggggataagaaaataatggtgaagtctcggttaataaggcgagttatcccgttcacactgttatcttggatgctcctgttttgcctatcattactgtttaccctgaatgctcatgccgcacgtctggccattgttattgatgactttggctatcgtgttcagcatgaaaacaagatattacaaatgccgacggcggtttctatcgcaatattgccagattccccacacggccgggaaatggcgcaaaaagcccataaacaaggccgggagattttgatccatctgccaatggctccactcagtaaacaaccattggagaaaaatacgctgtatccttccatgagccgagaagaaattggccgtattattcacgatgccatacagaaagttcctcatgctacgggcatgaataatcatatgggcagtgcaatgacatccagtcttagtggcatggagaaagtgatgcaagtgttatcttcttaccgccatctctactttctggatagcgtgaccattggcaagacacaagtcaccaaagcagcgatgggaacgcccgttcaggtgctccgccgtcatgtttttctggataatgtgcagacagaagcagaaacacggcatcaactcaatcgagccattgctcttgcccgtaagcaaggttctgccattgccattgggcatccttacccaaccacggttcgggccttacagcaagccctcacaactttacctgacgatattgaactggtaacgcccagcaggctgttaaaccccacttcagcgagccaaaacgattaccagattgcacgtaaatgtgcaaaacctcatgagccagaaaccgtacctgcaaccaaactggattatctcaagagggtaggcaacgcattaacgcacaatgctattgttgagacgttgagtcagcacatcgataaacttttgggaaaaacatcaaaacaacaagaagtgctacaccatgcaggaaaaacagcgtcgccgcaaaaagataaaacagtacaaggcagcacagacgcccgtacaacgacagacgcctgtgctgatttttaacggctattccagatagtcagttaatcccaattcaggataactttgccggattgccctgaacgcatgatatcaaagcctttctggaaatcatcaatcgagaattggtgagtgataatcggggtcagatctaaaccagactggatcaatgccgccattttgtaccatgtttcgaacatttcacggccatagatccctttgataaacagccctttaaagatgacctgattccaatctatcgccatatctgaaggtgggatccccaacagggcaatgcgcccaccgtggttcatggtactcaataaagtgcggaatgcctgtggcgcacctgacatttccagccctatatcaaaaccttctgtcatgcctaattctttcatgacatcggttagattttccttactgacattcacggcacgggtgacacccattttacgcgccaaatcaagccgatattcattaacatctgtaatcacgacatgacgtgcgccgacatgcttacacaccgcagccgccataataccaatcgggccggcaccagataccagtacatcttccccgaccagatcaaaagacagtgcagtgtgaacagcattgccaaacgggtcaaaaatagcggcgagttcatctggaatattgtccggaattttgaaggcattaaatgccgggataaccagatattccgcaaatgcacccgcacggttcacgccaacgccggtcgtattacggcacaagtgggtacgcccaccccggcagttacggcaatgaccacaggtgatgtggccttcaccagacacacggtcaccgatgttgaaccctttgacttcttgaccaatcgcgaccacttcaccgacatattcgtgccctaccaccatcggcacagaaatcgttttctgagaccagtcatcccagttatagatgtgcacatccgtaccacagatggcggtcttgcgaattttaatcatcacatcattgtgccccagttccggtgtgggcacatccgccatccaaataccttcttctggctttaattttgacaatgatttcatagtgataccttatgcaataacattcaactgtttaccgatacggataaacgcagccaccgcatgttcgatttgctcttcggtatgggcagcagagatttgggtgcggatacgtgcctgatctttcggaacaacgggatagaagaatccaaccacatagataccttctttcagcagctcagccgcgaattcctgcgccagtttcgcatcgcctaacatcaccgggatgatcgcgtgatctgcgcccgccagtgtaaagcctgcggcggtcatttttgcacggaacaggttggcatttctccacagacggtcacgtaattcgtcgccatgtttcagcatacccaacactttgatggaggctgctacaatggaaggcgccagtgaattggagaacagataagggcgtgaacgctgacgcagccattcaacaacttctttgcgtgccgcagtataaccgccagatgcaccgcccagcgctttaccgagtgtgccagtgataatgtcaacgcggcccatgacatcacagtattcatgtgtaccacgtccacctttgccaacaaacccaacggcgtgagaatcatcaaccatgaccagcgcatcaaattcatcggccagatcacagaccgatttcaagtcagcaatcacaccgtccattgaaaacaccccatcggttgccaccaggatattctccgcaccgtctgcttttgctttttccaactgtgctcttaattcctgcatatcattattggcatagcgataacgcttcgctttgcacaaacgaatgccatcaatgatcgaagcatggttcagagaatctgaaataatggcatcttctggcccaaacaatgtttcgaacaggccgccgttcgcatcaaaacatgaagagtacagaatggcatcttccatacccaaaaattcggctattttattttccagttctttatgggagtcttgcgtaccacagataaaccgaacagacgccataccaaaaccgtggctatccagtcccgcttttgcggcagcgatcaggtcagggtgattagctaaccctaaataattattggcacagaaattaataacttggctaccatcggcaacggaaatatcggcattttgcgcagaagtgatgatgcgttcatgtttgaatagcccttccgtacgggtttgctccaactgctcattaattctttgataaaaagacgctgacatttttctctcctgagtacctgaataagtgaaaggcgtggtgtattttacttatagatcctgccagtgacgatacagtgagaaagataatatcaactttgtaaagccgatcacggcttggaggctgatgtactgcaagatcgcaggattttcccctgtttaagctgctgtcgtcagtaatgttaagtgctattatacgcttcaaagataaagttaactgactatttagaggtaggccaaatgattattgtcactggcggcgcagggtttatcggcagcaatatcgtcaaggcactgaatgacgaaggctataaggatattttagttgttgataatctgaaagacggcacaaaattcgtcaatctggtcgatttggatatcaccgattatgtggataaggaagatttcattgccagtatcgttgcgggtgatgattttggcgatattgatgccattttccatgaaggcgcgtgctcatccacaacggaatgggatggcaagtatatgatggacaataattatcagtactccaaagatatattgcattactgtcttgagcgccagatcccttttctgtatgcctcttcggctgcaacctacggcggccgcagcgagaatttcattgaagagcgtcagtatgaaaaacctctcaatgtttatggctactccaagttcctgtttgaccagtatgtccgcgacattttgccacaggcggattctcaaatttgtggcttccgttatttcaatgtttatggaccacgcgaagggcataaaggcagcatggccagtgtcgcctatcatttaaacaatcagattcaccaaggccaaaatccgaagttattcgccggtagtgaacatttccgccgcgatttcatctctgtcggtgatgttgccgcagtgaacctgtggttctggaaaaacagcgtttctggcatttttaattgtggtacgggccgcgccgaatctttccaagccgttgccgatgccgttaccgagttccatacagaaaaatcccctgtcgtggaatatattgaattcccaaaaaaattaaagggacgctatcagagttttactcaagctgacctgacgaaacttcgtgctgcaggttatgacaaaccattcaaaaccgttgccgaaggcgtcactgaatatatgcaatggctcaatcaggataattaatcgacctctatgaagatattggtgataggcccatcatgggtgggtgacatgatgatgtcacaaagcctctaccgaaccttaaaggctttgtaccctaatgcagaaattgatgtcatggcacctgcatggtgccgcccattactggcaaaaatgccagaggttaaccaggctctggccatgccgttagggcatggtactctcggcctgggtgaacgccgtcgtcttgggatcgcactgcgcgaaagtacatacgaccgcgcttatgtgcttcccaactcgttcaaatctgccttagtgccttttttcgccaatatccccctgcgcacaggctggcgtggtgaaatgcgctatggcctgctgaatgatattcgtgttttgaataagagcgcctttcctcttatggttcagcgctatgtggctcttgcgtatgatgggaaaatgatgagtggtgctgaggatcttccccagccgctgttatggcctcagttagacgtcagtgatgaagatattgcggaatcaaccgcagcctttaatatcgctgatcatcgtcccattattggtttttgcccgggcgcagaattcggcccggcaaaacgctggccacattatcattacgccgcccttgccgaacaattgatcactcaaaaaggctatcagatcttgctgtttggctctgccaaagatcacgaggctggtgaagatattcgagcactgttgagcgaaaatgcccgtgaagattgcctcaaccttgcggggcaaacttctcttgaacaagccgttaatatcatcgcagcctgtgatgccatcatcactaacgactcaggtttgatgcacgttgcagcggccttaaatcgtcccctagtcgcgttatatggcccaagtagcccggattttacgcctccgttatcaaacaaagcagaagtgatccgcctgatcacgggttaccacaaagtcagaaaaggtgacagtgctggtggctatcatcaaagcctcattgatattcaaccagagcaggtcttggcctcattggagaaactgctacaggtggagaaccagaattaatgcgggttttactggtaaaaacgtcttcaatgggtgatgtgctacataccctgcctgcattgacagatgcaaaacagcactttcccgatatccagtttgattgggcagtggaagaaggattcgcccagatcccaacatggcacagtgccgttgaaaatgtgattcccgttgctattcgccgctggcgaaaaaattggtttagaaaagatattcgtgaagagcgggcgcggtttagggaaacattacggcaaagccaatatgatgccattattgatgcccaagggctgttaaaaagtgcctttctggtgacacgtttggcacatggctcaaaacacggttatgacagcaaaagtatccgcgaaccactggccagctttttctacgatcaccgtcatacaatcagtaaacagcaacatgcggtagagcgtatccgtgcattgtttgctgatagtctgggttatcaaaaacccacagaacaaggtgattatgccatcgcccgccactttctaaactcacagattaaaggccaaagtgactatctggttttcctgcacgcgaccacccgtgatgaaaaacattggtcagaaaaccactggcggcaactgattgcagagatccagccaacaggtatgcgtatcaggctaccttggggggcagaacatgagcaccaacgggcattgcggttagcagaaggcttcgcccatgttgatgtgttgccaaaattaacactggctgaagtggctcaggtattggcaggcgcaaaagccgtggtttcggttgataccgggctgagtcacctcactgccgcccttgatcgcccgaatatcactctgtttggccccaccgatccgggtttaattggcggctatggaaaagaacagtttcccctgaaatcggtagataatacgatgcaaagcattgcaccactgaaagtgatgcagctattgcagaacgtattaaaatataaccttgcctagcggaagtgtaacgcaccagcgatttttatactcaaaagtaggattacccaatgagtaacgcatagttttgtctgcttcctgacactgtgcttttgcttcttgggtattaacccacatcaagatgctgccaacgctaagatcagcatattcgggatcatacccgccattgatcgcatcaaatgaaatccatttagggctatcggcacgcaagacaaaatcgtatgcgcaagggttgccattgatcagtagcacatagccaaagatatgctcacgaagctctgtgtacatctcaagcaaatgcttgcgttgctcagccgagtgattgtaatcccagcgcttttggtacagatcaacatagatattcaccaattcttctgcactgaattcactcgaaggacgaatttctccccccgctcgcttgaatttgttgatctcgttgctgcggttacggcgggttttgtaagaaaagctgtctttgatcaggcagatttttcgtttgttgaaaagagtgtagctggcattgacgatatttcctttatgaagcaatgacaaacgtttcgatttttcaggaaaaatgattttgacatcttttgaaattggaaaaatgatttcatcataaagaaatgggtattttttttgtaaactagctgctaacttattattaacacaagtaaaatatgctcccacaatcgaagagctgtgttccttaatatagaagaataattcattatctagcttttcatttaagaatgatacaatgttaggatgtgttgatacactcccacctaatagtgtataagcttctttgtatcgttcaaaattacatctcttccatcctagaagaaatggctttatttttgccatagtcaattccatcaaattactgtggttttgatattaagatcattagaaagttactttggggtcttatcttacacaaaaaagccttccatagaataaaaagattttcacctatgataaccacaggaaaagaaaagaatagaatatactaattcaattaatatattctactcatatcgttaattaataagtatcattttttataattataatattctgataatgtcattccctgaactaatgaattcaagaagttaaataactcttccaaatcttggtaaagttgttcaatctgttcttcatccttaaaggtagggcttccactcggcataaattccgacgaatgcaacataaactcaacataatcattaccatcagccaaagtttgctgaacaacttttttcatctgctccaagtttccgccttttggacgtaaccagttaacagatgaagaacggtgcttaccccgtaaatgatcatacttttgcttaataaaattcataaccggagaatgcttatactgaatgctcataggaacttgcagtaacgaagaatcaccttctttggcgatatcctgcaaatccataaaataagcatgagccggaaaacgactatagtctgtcccgccatctccgttaggatcgcctttggtaaaatgccaattgactttcggtgtcacagaacaatcaacttgataaccatattcaaccaatagttgggcgtaatattcattgaatgcccagcggccagcacgatgactcaacatcttagtctggagcttctcttccagcaaatgagtcatgaaatcaactttcgctttgatttgatccttaggatattcaattaaataaggcttataacccatatcatcaacagtgagaggaattataggtgggctgttccaagcatgtaaatgcataccgatttcccccgtgtttctggcaatcacatccttggcaaattcgatatagctatcatccattgccatctcatagttggttaaccagacgggtttaaatccaaaacgctcacacagattctgaaacctaggaaggtaccgagtattttcggtagaaatcttatcactgttttgccaaaggttatcgccttcagtatcaattgtgatgatgaatgctggtttagtcatgaaaaatctacctaaaatagagaaaatatgagtttatattactcagtgtaaacaggcagcgcaatttacctacttaccatcggccacttcctaacagctgttattcaaagatacatcgatccccttaatctagatcttttttgccaatgtgctgaaaaaagcatctatctgttctacaataatttctaacggcatttcactgattttactgttatttttattttgaactaactggaccgcatttttattgcctggtccccacacatcattgtttataaaacatccatgtttgtcattgccatatagtgcaactgtgtttttttcatatgctgctgcaacatgtacaattgaagtatctggtgaaataactaagtcagcgtgttttataatttctacagcactgagaaaatcaccaaatggattaacaacacatccactcaaatatgaaagcgcatttaatttttcaagtttaccaactaatataatattaattgattgatctaaacaattaaggtgagacattattccaatcaattgctccttagaaagatctcttttctcatcagcagcaaaaggattaataactacggtgatgttaccagataaacccgtataaaaatcacatactttatccttaataacctgatgaatatgtatgtcatactgcatattataattatcaattcctatattattcataagagatttatatcgctcagtaatatgcgaatgataattcaggtattttatacttttattgtaaatattaatgtcatctttattaaagccaatagtattttagcattaatgagccgtataaataagagatagatgacaggggtttgatcgcccatgtcgataacaagatcatacttctcttgttttaatttcaatcctaagttaagtatatctatgttttttctaggataaaaatagaccttgtcgatatatggattattttcaatcacacaataattcgaaggccctgatagtacatgcagcttgaacccgttcagagataattctctcaatacaggagtaaatacaatcatgtcaccaattttgttatcatctcgtaaaaaaagaattttgtttatgtcaccaagatgaaattgtttcttactccatttatcaataaatattttagctaaattaaagcgaagctttttaaaaaaatagtttttatttctatttatttcacgtaactttttgaattttttttcagtcataggaacatctcgaaaaaatagcactaaaaataattattattctatcaaagataaatacttatcaagcacaacttccaaatcaaattttttatacaaatctgccgtaatcacaggtggcctttgataaaccaaacgtattttttccgctaatgactctgatgtcagttcagatgtgtattgctccaattcacccaccataatctcactgactccaccagggcagttcgtactggcaatcggtgtatggcaaatcaaagcctcaatcaagacgttacccaacccttcactgtctgaactcagcacaacagctttagcgccccgtatcacgggtaatggattcactaaaaaaccgattagtgtcactttcgattgcaggccaagtgacacaattttttgtttgatttcattggttgttttttcatcgccctgacccgcaattaacaatttgcaaggcaaattcgctctggcaaaagcttccaacaagcgatcatgacgttttacaccatgaaaacgcccaaggtgaagaaaatagtcttcaccagaataaggattattttctaatgagttagctttgatttcagcaaggttaaatggattgtaaatcgtaactatccttttaggagccagcgatacattctccttcaaatccaagccaaccgcatcagaaacacaaatcaaattacgatcccgataaacgcgttgaattttccatttcttaatccaacgcgccaatcccgttttattttcaaggtatgatttagagaatacaccatgaatacaaaaccatacgttcaaatctgctaatatcttagacttggctacaatacgatccgtcttgtgtaagttagatatcaccagcacaggggtacctttttgcagaaagactttctccaataccgtatccatggatttagctctgcgataaatctcagtctgtcttctaaaagggcctgcatattcatcagtatcaacgatcaactcaacatggtcagggatcgggtattcacatttgtcagacagcgacaacaatgtaatatcaaacccttttttttgcaggccaccacataaacggacagtgacattctctgcaccaccacccggtaatccgtcaatgataaacaggatatgccctttcataaggaaagcaccttgctatacagctcagtaagctgctgggacaaataagcgggtgtatagttggctatcttttcttttgatagcatggagatcctgctagttaaatggtctgcgggtattaaggatatagattccgccaatgcctgaatatctaaggcatcacacacaaacccattttctcctgaaactatgaattcagctcccccacaagtcttactggttatgacaggtaaaccacatgccatcgcttctaaaatgacgtttggaaaaggatcgtataacgttggcagcagtaatccatcagccatttgataaaatggcaatgtctttttttgtactcccaaaaaccgaattcgctcatggcagccgagagcactagccaactgcttatatttagactcttccttatcttgaccaatcacaatcagataagcttctgtcatgctgattgcttcaattgccgcttttagcccttttctttcaaaacctgaaccaacatacacaaaacactttgcctgtgcaggaatgctatatttctgtcgtaattcaattctttcttcttccccagcaggaaaaaattgtgatggatcaatggcattatagataacagcaattttctcttcagacaggtcaaaatcttccatcacttcctgttttaccatctgagaattacaaatcacctttttcaattcaggagcagaatacatttttttttcggcgtccatgacataacggtgataacgactggcaaaaagcaacttacttttccaagatggcaagatcctcgctctctgctgcaaccagcgttgatgcacaccatctccagcccgataaacatcacatcccgcaatacgctcgtggctctggacgatatcgaacccttccttttgccaaatttctctggcagcgttggcaaatcccttttcacgactgatgcgtccccatttaaaaggattggccaaatgcacatgccagttagggttcatactcccttgccaagaacgcgtaatgacgtttaattccagattttcattatccaatgcttccagagctctggaaataaagcgctcagcgccaccatcaggccgatatttttgccggacaatggcaagacgcacagatttcatcataaatatctccgggcagcttcaatcacaacatccaccggaatcaagtccaggtagcggatatctgtttttgtatcaatgccatcaggatccggcaatttaccgtaatttcctgcccagatcacttcaccattggcattccatggccgccaaaaaaccaatttagatggcccgaataacgcgatgcagggagttttcaacgcagcagccatgtgcatgggaacagaatcaacaccaataaataacttcgcatgatcaatcaacgccccaagttgtggtaatgttatctgtcccgccaaagagacgatattctcttgagagcaggcagataaaattttcgcgaccatctctttttcccgcgcctccgttcctgatgtcaaaacaatagcatgcccgtcggcctgcaaagcattaatggtttcgctgattttctcttcatcccagcatttgaaaaaccagcgtgatgccggatgaataacaatatacttttcattaatcccggaactatgcaaaagatcagacactttctgtctgtcttcttcactataactcattgttacatcaatattaatatcggaaagattaagtggtttcagggctgatagattctgttcaacaacatgcaggttttcttcaccctcagtagataccaaatctgtaaaacaggctttccatatgaggttttgccgcttgggaaaatcaaaacctatgcgagctggagcactgataagctgagaaaccaaggcactataccattgatcagcgaggttaatgacgagatcatagtttcggtttctcaattgtttcagcaaacgccaatgatgagcaacataggcttttgcaccttcttttttccactgcctgtctatggggaaaatatgggctattgatgcaaaattcatcagcataggttttgtttctttgtacagtaaaacatcaatttcagcatcgggaaaattttctttcaacgtattcacaactggagtgatgagcaacatatcaccatgatgtcttagttttatgatcaaaatcttttcaaatcgagtggttattttgcccattatatttccaatattcacgatgaggtggaaatgttcattaaattatattctaaggacaacaagatctcgcttctctctttacatatcgagctagttaaccttaacaaaaagtttacccccttgtccttttgggagagaggcgagcaacatatccgcattttacacactttcttcaggccaatgtggtactatagccgcagtctatgtcagtgaatttgatagaatgttgcttcgcttatatcaggtacttctctaccttatccaaccgcttatctggttacgcctgctgctgcgcagccgtaaatcccctgcgtaccgcaaacgctggggtgaacgctatggtttttgtgccaaaaaagtcgcaaaaggtggaatattactccattccgtttctgttggagaaacattggccgccattccattagtaagaatactacggcaccattatcctttcctgccgattaccgtgacaacaatgacaccgactggctctgaaagggtgctttctgctttaggtactgatgtcaaccacgtttacctcccctatgatttgcctggctccatgagccgtttccttgataacgtcaaccccaagctggtgattattatggaaacagaattatggcccaatttgattacccaactgaaccaacgcgaaatccctctggtcattgccaatgcaaggttatcaacccgttcagccgcgggatatcaaaaaatcagcaactttattaaaactattttaaataaaataacactgattgccgcacaaaatcaggaagatggtgagcgcttcatcgaactcggcttaaaacgttcccaactcgccgtcactggcagcctgaaattcgacatttctgtcacgccagaattggcagcaaaagcagtcacactgcgccgccaatgggcaccacatcgtccggtctggattgccaccagcacccatgatggagaagaaaccatcatattggatgcgcactgcaaattaattcaacaatttcctgatctactgttaattctagtaccacgccatcctgaacgctttaccaaggccgcagagttaacccaaaaagcgggattaaattcgatattaaggagctctgacacaatacctgatgccaatgtgcaggtggttatcggagatactatgggcgaattgatgctcttgtatggtatcgctgatctggcttttgtcggagggagtctggtcgagcgtggaggtcataatccgctggaagccgcagctcatgctatccctgtcattatggggccacatactttcaactttaaagatatttgtgccaagctggataaagccaatggccttatcgccgtcactgatagtcactcgttgagtgccgctatcaatagcctgctgacagatgaggactatcgtctttattacggtcgccatgccgccgaagtcctgcacgaaaaccagggagcacttcagcgattgctaaaactactggaaccttatctcccgccacggggtcattgatgagcaagagaaaacgcctgtccgttgtgatgattgctaaaaattccgccgatttgattgcagattgtctgctatccgtagattgggctgatgaaattatcgttctagacgccggcagtactgatgcaacttgtcaaatagccagcgaaatgggcgcgaaagtctacatcaatacgcaatggcccggcttcggtcgtcagcggcaactcgcacaatcctatgccagcggtgattacattttcatgattgatactgatgagcgtgtaacccctgaattaagaacatcaattgagcaggttttggcagatcccgacgatgataaagtctatgactgcgcacgtctcaacctgtttatgggtcgttttatgaagcacagtggctggtatcctgataaagtcattcgtctctattgccgcgaacgttatcaatataacgacaatcaggttcatgaatcacttaacactcaaggcgcccgcatcgtgacattaaagggcgatttacgtcacctcacctgccgtaatctgatggaattccagcaaaaacaattgaattacgccagagattgggcaaaatatcgccacgaacaaggtaaaacagcccgttatttttctatcttcagccatacgttaggcgcattttttaagacatggctgttaagggccggcttcctcgatggcaaacaagggttggtattagcaatggttaatgcccagtacacatttaataaatatgctgccctctgggaactcacccaaacagagagtaaaaaacgatgaaaaaaaaagcaatttatcctggtacttttgaccctatcacccacggccaccttgatattgtgacccgtgcagcaaacatgttcgaccatgttttacttgccattgccaatagtgacagaaaaaaccccatgttcaatctggaagagcgaatcgcactggcaaaagaagtcaccacccatctggataacgtagaagtggtcggatttagtgaactgatggccaattttgccaaaaaacaacaagccaccattttaatccgtggagtacgttccgtttctgattttgaatatgagtggcagcttgccaacatgaaccgacattttatgccagaactggaaagtgtctttttattgccctcgcaaaacctgtccttcgtatcatcatccttgatcaaggatgtcgcacgccatgatggtgatgtttcatcattcctgccagaatccgttgcacaggcaatgctaaagaaattcggcaaataagatagcgtgaaaaggggggtgatcatcgtcaaccccctagataggctcaatgctgacactgacgacagaaaaacgtactgcgttgccccagttttatactctcaattttttcaccacacttcggacaaagttcaccttttttgccataaacaaataattcctgcgcaaaatatcccggcttaccatcggattgcagaaaatctttcagtgtagtgcctccctgctcaatagaacgatgtaagatctgttttatcgtatcggccagtaaataagcttcttcctgtgtcaatgaattcacggggcgctcaggcagaatatgcgcaacatagagagcttcattggcatagatattcccaactccaacaaccaccttgttatccatcaaccaaggtttgatcaccgtttttttgttgcgggaaagggtataaagatattcaccatcaaacgtgtcagaaagaggctcagggcctaaatgagccaatacagaacactcatcaagattgtcactccatagccacgccccaaaacgtcggggatcggtataccggaggattttgccatctgccataatcaaatcaacgtgatcatgtttttcaggaggagattcattcagcaagatacgtaaactaccagacataccaaggtgaataataatccagccttcaggcagttcaagcaataagtactttgcccgacgccggacactgagtaccggttggtcagcaagcttcatgatttgttcggaaactggccagcgcaagcgcgaatttctgacctcggaatattggatcacattacccgtcaagtggggttcaattccccggcgactggtttcaacctctggtagctccggcatactgactccttaaattaaccatctacaacatcatatctcagcagattacgataccgttttcatgtatcatttgcagccaaatttggttgggatagttgagagaatagaaattactatgcttgatataaaaaacagatttaacataggcaacaacaagaaatccttatggaatttatccattattggtctgtttatcattcttgtttatctgccagatattacaagatataaaaatcttgtcatgatccttatctgtgcaaccgcactctgctatctcgtaaaagattttcgtcaggtagtcaattcactacgtagttcgctatttttatccattttgttattcgtattggcaatattctattctatcggcatttcgattgatcctgctctgagtttcaaggaaatgaacaaacccatactcaatggattactgctgttcagcatgactttcccaattgtgctctatcaggaaaagaaacagcacatcgcgaagatgattctgattgcgtttattattggcatgagccttatctcgctgacagatattgcgaaatacatcatcaattattacgcaactggcgaaatgccgtttatgaattacaatcatcgggaattttcttacggatttcttttctatttccctgtgttgctatgtacctgggcattatggaaaaaacattctctgctgagttggctactactgattattgcctcagctatcggcctgttcttattactcggtactctttctcgtggtgcttgggttgccattgttgtagccacagtatttattattgtgattaataaagagtggaaactcactctggctgcgacaatatgtctggggctactggccggagccattcactggtcagcagtatctaaccccgccacgaaattactgcttcacaaactcacccaaacagacagcagtcatcgctatagcaacggaacccaaggttcagcatggtcattaatcatggagaatcccgtaaaaggttacggttttggtaataaagtctaccatcaggtctacaatagccgtgttgctgattatcctgattgggcattcagaacttcgattggcccacataacgtatttttatcgctttggtttgctggcggtctcttcggtttgatcgccacccttttgatgacgctttccgcattatttacaggaagccagatcattcgccagcatagcgggatcatccgacaagctggcctgatacttctgacggcctttattggcctgtttatcgtcaggggagcttttgaaaatgcctatatcaatgaaataggtctcttattgggtttaatgattactctatacaagcaaaaagatgattagaaactgaactcattgttgttaaatgccagcctatacgacacaaattggacgggctggccttcaagctatttcagcaatcgcttatttagacaggttttccgctatcacttgcatgatcagctttgcacgctgatcccagttaaaacgttctgctaccaatcgttgtgagtaacccactttagccatcatttcagcggggttatcaatcaatgattgaatctgttctgcaaagctctccgcattttcgctgtcagcaaaattgaccgccttctcatccacagcatcgcgaatagaaggaaaatcagaaataacaacgggtttgcccatcgccatgtattcaaaaagtttgagtggggatgtataacggctgccaatgctggttttcgtcaatggtagaacacaaatatcactctctgcaataacctgaaaacgctttttcggctggataaacccaaggaaatttaccttatcactcacgccaatctgttgggctgtacacttcaatcgttcaatctgcacgctatcgccaccggcaatgttcagtacagcattgtcaaggtagcacatcgctttcataacagtaggaacacctttccagcgatgcaaactgcccaaatacagcacctgagttgtttctcccaatttttcccttctgccagaagacgctatttttgtagattcaaccgccagcatatcaacaccatcaggtgccactataatcggcgtcttaacactatattctttataaatatcctcactcaatagtgaagtcagcacaaacacgaccttggaatgatgataaacctgttgttccgtgtttctgagcttatgatatttacgacgatttttacgtttatctaagttatgggattctttaaacgattgtgcaaaaacttcgtggctttcaaaaaaatgcgggatatcaggatgtttacgcaggaggtaattcgccattttaatattgcgagtaaaaatagcgtcaatttgatgatctttcagccagcgagaaacctgaaaataaaacaatttctgtgtattgagggggaaataccactttctacgcatattgcgcagagctatcagctcagcggaaggcggcaatgctctgcctataatctcctcaacacgcttttgaccttctggcgtaatcaggtagacgctgtgcccctgccgggcaaaagcatcgacattctgcaaaatctgcagcgaagcaactcgataatcaggtacggaataagggtcaatatacgcaatcttcattatttttttatcgcgcccaataaacgacttgcagaatgttcccaagtatacatcgtttcaatccgctgacgagcctgttttcccattgctttccccctgtccggtaaggacaaaagatgattgactgcatcagcgatagccgctgcattgccaggtgcgaccagaatacccgcatgattctcattgccgaccacctcaggaatgccaccaatataactggctatcacgggacgtccgcatgccattgcttcagcgatagtaataccaaatgcttcatcaccaatactgggaaagatacccgcatctcccgcagcataaaattcaggtaattgatcatgaccaacaggaggatgaaaaatgactgttttttctaaattcagttccgaaaccttttttttcaacaacttcagatcatcacctgcgccaataatcaataaccttacatccttgtcacgcagtaaagccatcgcatcaatagcgactttcatgcctttccaacccaccagcctgccagcgaaagtcagcaaaaacgtattttcattgatatctagccgattccggagatcagaattaacaggtttaaacttatcaatatcgacaccattataaatcacatttggaaattgtttaaaatggtgctggatctgccaagcattaaagtggctgcatgcaacccacgcagatattttgttacctaatgcccgatcacctttgaaaaaactggttccgccactcatatagcaaaactttgtgcaggaagttttcggcatcattctgggccagaaaaaatcaaaaggtttcgtcaaaatcacccagtcaaaattttcagcgataaccctttcacgggcatgacgggcaaaagaataacgctcaacaatgcgttgaaaacgccgtccaatattgatgactcgttctctgggagtaaatggaaatgtgtgaatatgaatatttcgctctcccaatactggcctaacgtcacctgttccgccgaaaatatggatctcgtgccccgcatctgtcaaagccttcgccaattcccaaaccgctgtttgaataccgccataagacatagtaacggtgacatcgataaatcctattttcatttattcattatccttcatgtgtttttcaacaagttctgaacggagctccagacttgttcaaccgatattgctgacattgcatcttggcgagtcgcctgttgataatctatcggatgttcaatcaccgccaattttggatgttgctgaggagcaagaaaacggccaggatgaaaactatggtacattgccaccatcggaatacccagcgcacctgccagatgagttgtgccagtatcaacaccgacgtacaaattaagttgactcattattgccgcattctgcctcatcgtcgtcttgcccgccaatgatgtacatctttgtgttcccagcctttcagagagtatctgcgcactcgcttcaccatctttactgcccaacagcaaaatatgggcatgcggatagtgacaataaatacgttgcgccagctcgtaaaaatgttcctgaggccaatcacgataagattttgctggaaaactctggagttgaaagccaattcgtaatcgttgttctaacccctgctgccgaagaaaatcgcaggcatacttctcttcattctggctcacgcaatactgcaagcgccagtcactgacaccaatatcaagtgcattaatcaacagcgccctttcttgctgtgcttgagtgaacgcccgcggctttaccactgctagctcatttgatttatgacaagaagtttccgaaaaataaatagttaaatctgatttacgtttagcatattgtaataggggtttatcatgaccatataccagggcaagatcataacgtcgacgggaaaaccatcccctccattttgcctgtccctttgaaaaagcggttattgaattaatttcactaatattctcaaggatctctttcgtttttttatgtgctaatacataaatattcgcttcaggccatcgtaatttcaacgcccggatcactggcgttataagcagagtgtcaccaaaacgggcaataataataaccagaatatttttaggctgcataatgacaagtataaaattattaaaccgataattggaattagagcactatacatcaaagttattcaatactctattaactgacggatagttttcatactcctaaaaacaataaaagaaacactatttcaaatgattaagcaaaaaataactactttgtaatcagatgaaaacaaacaccattacgaatagatggtcaaaatggaactatttacgttccatactaccgtaaaagataaactccattttttctaacatattatccatgctaaataaatcggcagcccgttccaatgaggcgttccccatctgcaaacgcaactcagcacttttcattaaaatatctaacctttcagttaactgttcaacacatcttggctcaataatataacccgtatcaccatcaataacggcctcagtgattgcgcctaccgaagtagataccacgggcaaaccacaggccattgcctgcataatgccttgtggaacaccttcattgccaaacgaaggtagtgcaaagacatccatcgcattcagacagtcaggcacatcttgtcggttaccgaggaaaatgacactctccgtcagcccttcgtgtttaacccagggttccagattttttcgctgggggccatcccccacaaacagcaattgccagtcaggataacgctggtgcaatattttccaactatcaagcaagtaacggtgccctttccaggttctcatcgtagcgacaatacccagggtcggtttatctgcaataccaatacgctgacgacaaagttgcttattttcgggatgaaaatgcgtcagatcgattcccgtcggtacagaggtcatgtgaggtaatggataaccattattcgtatgcagatattggcgtaacttctcccctgttgtcacaatatgctgacaggatttcaaatacagccagcgagtcgccacggatgtggatacgttagtggaaacatggcgggttcggactatcggtggcatacctttcaatgtggcacatgccgcagccaccaaccaagaatcagtagagctgtgagtattgatgacatcaaattgacggccttcagcttttagccagcggcgcatcgcccgcaagcagggaaggcgttttttttcaatcggcagcgcaacaacaggtacaccatacgaatgggcttcatgataaatcgttgacgctgggcagcaaacaataacaacctgatgaccgcgttgtatcatgccctgagattccgtcaggatgcgaatctcttgccctccccaaccacacgatgattcagtgtgtaagatatttaaggtttttttagtcatttttcagaatcacgcctgacggttcaaacattaaaaaggcgttagtataacggaacgagatgttacgtccatggataacctatcttcaaccaggctatccatgcattctggcaggtataaaaaaacccagcatacgctgggttttttctcaatccactaaaattatttaattttagcttctttgtacaccacatactggcgaataactggatcaaattttctcagttccagtttttcaggcatggtgcgcttgttcttcgtagtggtatagaagtgaccagtaccagcagaagaaaccagcttaattttatcgcgaatacctttagccatttttcagctccttagtatttctcaccacgggcacgcagttcggccagaactacatcgataccctttttgtcaatcacacgcatacctttagcagttacacgcagagttacaaaacgtttctcagactcaacccagaaacggtgagaatgcaggttaggcagaaaacgacgcttagtcgcatttaatgcatgggagcggttattaccactcaccgggcgcttgccagtaacttggcagactcgggacatgtctattctccaaaaatcaaatcagctcgagctttatattgggtatgaccgcctcgtcaggcttaggagcccatctcagcacattttcatcactgaaaagactcacattatcccaataaaaaaacttactgagataggctcttctcgccaaacccaagatcctcaaaggtggcgtagtatacgccctcattcgctgatgctcaagtcccgaacaactaagatctgatctgattgcaaaaaaaccggactaaatccagcctctttccacaaatgagacacaatgttgcttaccaatcacgatatgatccaaaactttaacgccaaccaactcacaagcatcaataattttttcggtcaccaatttgtctgccagactgggttctggattaccggaggggtggttatgagcaagaataatcgatgcagcattaactttaactgcctgtttcacgatttcacgcgggtgcacttcaactttgtttatcgttcctttaaacatttcatcatgacagatgactttattctgattcgtcaaaaacagcaccacaaagacttcacgatcctgccaggacaataaatcctgcaaataattttgcgtcgcgactgggctactcatcacatcttcatggataaattgactggagaaaaaacgttttgccagttcagataccgcctgcaactggacatatttgcatagccccatccctttatgtgaacaaaaatcggcataatccgcagagagcaggtgataaagtgaaccaaatgatttcagtagatgttccgccatttgcacgacaggaacccctcgggttcccgtacgcaaaaatatagccaacaactcggcatccgtcagggaaacggcgccataagccagcaatttctcccgaggagcaagatttgaatgcaattcatcgcttatttccatcacagtaacatccatatactccccctcattccctttcacccagtggcttcacgccgccaatatcccatgatgaaaaaagcaccgccagccccattttcatggcttgcgtagcgcttcgcaaacttgtcattttttggcacctgaataaggcaggttctcaactcaatattttcttatggtagaatcttaggtaattgtaacttacatgtggataatcagaatggcaggattttccagcaaacagctttctggtaaacatatcgtgctcggcatcagcgggggaatcgccgcttataagacagctgagctggtacgccgtttacgtgatcgcggtgccgaagtacgcgtcgccatgacgccagcagcagaagcttttattacgccactgaccttgcaggccgtatcgggtcatccagtctccgatgaccttttagaccccgccgctgaagctgcaatggggcacattgaactggctaagtgggctgatttgattattctcgctccggccacagccgatctactcgctcgtttaaccgcaggcatggcaaatgatttggttaccacgatttgtttggcatcagcagcccccattgctgtcgctccagcgatgaatcagcagatgtaccgtgcgcaggcaacccaacataacctaagtgtactcaaagagcgtggcgtgctgatttggggtcctgatgagggaagccaggcatgtggtgacgtcggcccgggaagaatgcttgaacccatggcgatggtcgaactggcaacacaacatttcaacaccaatcaagatttcgccggtctttgcatcaccattaccgcagggccaactcatgaagctttagatcctgtccgctttattaccaatcacagttccggcaaaatgggattttccatcgcacaggcagcagcggaacgtggtgctgacgtcacattgattgcaggccccgtcaatttaccgacaccaccgggtgtcaaacgtatcgacgtaaccagtgcgctggaaatgcatgagcacgttcaggtaaccgcagcttcacagcatattttcatcggctgtgccgccgtagcggactaccgtttcaaacaaatagcgactgagaaaatcaagaaacagggtgatgaagtcacatttacactggtgaaaaatcctgacattgtagcgagtgttgccgcgatggaaacaaatcgtccatttgtcgttggatttgcagccgaaacccagaatgtggaagaatacgcccgcggaaaactcaagcagaagcatctggacttgatttgcgcaaataatgtatctctggccgaacatggcttcaacagtgataccaacgcattacatctattctggcatgatggcagcgttaatttacctcacagtagtaaattacagctcggccactgtttattagacgagatactcaaacgctatgacgaaaaaaatcgacgttaaaatccttgatccccgcattgggcaagaatttcccctaccgacttatgctacacctggctctgcgggtttagatttacgtgcttgtctggataatacagtagaactggctcccggccagactgaactcctgccaacagggatcgccatccatatcgcagatgaacaattggcggcggttattcttccccgctccgggctgggtcacaaacacggtgtggttctgggcaatctggtggggcttatcgactccgattatcagggacagctgatggtttcagtttggaaccgtggtgataagatgttcatcattgaacccggtgagcgcattgcccaaatggtttttgtgcccgttgtacaggccgaatttaacttggttgaagattttgaaaccagcaaacgcggcagtggtggttttggtcattccggtcgtcaataactttccataaagcctgataccgtcaaccgattttcatattttttgcccatgatcgtggtgggcaaaaaatagctggatttgttttgctgttttagcaggggtcttatcacacatggcagaaaaagaacgtacaaaaaagaaaaatagacgtgaggaaatcttgcaggcactggcacacatgcttgaatccagtgatggcagtcagcgcattaccacagcaaaactcgccgcaaatgttggggtttctgaagcagcactttatcgtcattttccaagcaaaacccggatgtttgatagcctgattgagtttattgaagacactttgatttcgcggatcaatctgatcctgcaagatgaaaaagacaccattacccgcattcggttaatcctcaccctgcttttgggctttgcggaaaagaaccccggattgacccgtatcatgacaggtcatgccctgatgttcgaacaagacagactacaaaaccgcattaaccaattatttgaacgtattgaagcgcagctccgccaaattttaaaagagaaaaaaatacgtgatggacagggattcgattatgacgagaccgtactggcatcgcagttactggcgttttgtgaagggatgctttcccggtttgttcgttctgaattccgctatcgcccgacccaagagtttgaaatacgctggccattgatattgactcaactgcaataactgagcctgcaccgtgaaattccctctttcatgctgagaatgataacgtgcggttttttcgttgaattgtgttaacatgcatcttctagttgagttcactataaagtaactcagtaatggcatcgttaccgtattacatgcgggatgtcatttctactactcaccccgcccggccattgggcgagggtttttttttatctcagttgtttttacttagctgacaatcagataccgtattctctgcgataggcttccaccgccgccaaataaggctgcatatctggattttcacgtagatagctaatcaagtcattcaaagtaatgatggaaaaaaccttgcagtgatagtcacgctcaacttcctgaatagctgaaagcgtctcccgcccgcgttcttgacgatccaaacacaagataacaccagacaacgttgcaccgtgttgcttgatgatttccatcgactcgcggatagccgttcctgctgtaatcacatcatcaacaacgacaacattaccttgtagtgggctaccgaccagtgatccgccttcaccatgatctttagcttccttacggttaaaacaataaggcatatcgatgtcatgatgttctgccaacgcgactgccgttgtggttgcaatcggaatacctttataagcgggcccaaatagcagatcacacgagataccactatccaacagtgcagctgcatagaaacgaccaatcaatgccaaatcacgcccagtattaaatagtcccgcattgaaaaaataggggctctggcggccggacttcagtgtaaattcaccaaatttcagcacctgcttcttcagtgccagctcaataaattcgcgctgataggctttcattggagtttctcctctttgatttcttgtcatacttatcgccattttgcaggcataaaaaaggcgactattcagccgcctgatcaatttatttatttcaacgcatctcgctgcgctgcaaaaatcgtttccaacccctctttggcgagggaaagcaatgagagcaattcatcatggctgaacggttcaccttctgccgtgccttgcacttcaatcatccggccgtcatccatcatgacgatattcatatcagtttcagccgccgagtcttcaacatattccagatcacaaagaccttcacccttaacaatcccgacagaaactgccgccaccattgatttcattgggcttttcttcagcttgccatcagtaaccagcttgttcagcgcatccaccagtgccacacacgcgccagagatggcagcagtccgcgtaccgccatcggcctgaatcacatcgcaatccagcgtaatggtatattcacccaattttttcaaatctactgcggcacgcagtgaacgcgcaatcaggcgctggatttccattgtacggccagtctgcttgcctctggcggcttcgcgggcattacggctattggttgcccgtggcaacatgccatattcagccgtgatccagccttgcccctggcctttcaggaaacgaggaattccttcttcaacggaggcattacataacactttggtatccccgaactccaccagaaccgagccttccgcgtgtttggtgtaatgacgggtcattttaataggacgcacctgccctgccgttcttcctgctggacgctttcctactggactcatagtgttctctccgctgttaaaacattattgggggcgcattatacggcctaacgaggcgaatgcctatcctgcatctacgcggggcgttataatccgctcatcattctataaactggaaacgaattatgatccgtagcatgaccgcttttgcgcggcgagatatcaaggccgattggggaaacgcagcatgggaactgcgctccgtcaaccaacgttacctggaaacctacattcgcctgcctgagcaattcagaagccttgagccagtcattcgcgaacgtattcgttctcgcctgactcgcggcaaagtggagtgtaacctgcgttttgatctggatacccgtactcagggaaccttgatgctgaatgaaaatctggcgaaacagctggttgaagcggcaaactgggttaaacagcaaagcaatcaaggtgaaatcaatccagtagatatcctgcgctggccgggcgtgatgtccgccgaagaacaggatttagacgccatcagcatacaattgctggcagagcttgatctggctcttgatgcctttatccagagccgtgaaacagaagggcaggcacttaagacgctgatcgagcagcgtttggatgcagtaacagaagaagccagcaaagtccgccagcaaatgccggaaatcttacaatggcaacgtgagcgcttacagaccaaactggaagaagcacagattcagttggagaataaccgtcttgagcaagagctgcttctaatggcacaacgcattgatgtggcagaagaactggatcgtctggatgctcatgtaaaagagacacgtaatattctgaaaaagaaagaagccgttggccgccggctggattttatgatgcaggaatttaaccgggagtcgaatacactggcgtcgaagtcgattaatgcggatgtgacaaattcagcgattgaattaaaggtgctgattgagcagatgcgcgaacagattcaaaatattgagtaacgtttcttagcatatcagaacaaatcataaagccagtatatactttgttatatctggcttttttactatcagagcattgcagagcaaatcacaatagcgcatgattggcgtgtacccaaaggtgtacccatagcacattaagaaaaccattttgggtacaccccctaattttttcattggagattgcacaatgcctaaactcacagataaagagatcagggcatggattaagtcaggtgaaaggttcgaagggaaagcggacggtaacggactatatttacgttttagagaaattgaccgaattccatcatggcgtttcagatataaattggctggaaagtctaggactatgaatttgggaacatatgctgacttatcgctagccaaagcacgagaactcaccagagaactatcagcccgtgttgcgttgggctatgacgttgctggggaaaagcagcaacgtaaagccgaagcactggcaaaaattgaagctgaaaagaacgctataaaagtttcagatctagcagccgaatactttgagcgccaaatactgccacgctggaagcaccccgacatactccgcagacgaatacttactgggttgctatcgctcgtggtcatatatttaatgatggcaacaagcgcacagcgtttttcgtcaccatgacctttctctaccgtaacggtatcaagatccgtgataacgacaatacgttggaaaacttaacggtggaggccgctacgggtgagaaaaccgttaatcagctagcacagcacttacgagagttagtggataatatcgcctcaattagttaagcacttctgataacctcactcaagatgaagaaaagcggcattattttttaaaataatgccgttgataatattacaagataaaaaaatcctaattatcattatttcccagcaggaatttttgctgatttccaggcagtaaataatgccaatagtggggtaatggcaaagaataaaaataaccaataagaagaggaggaagcaccactgacaccgccgggttggtaaaacccaaacacattaacggtcatgccagccaacgcagaaccaaatgcgctcgcagatagctgaacgatggtaatagatgcccccgcgatatctttatcagaatcggcagaaacctgtaagatgcgggtcacaatatgcggccagccaaaaccgaccccaaaaccaaatagccccagcccaagaataagcggcaatatggtttgccactgacctgacgatgagcgcggcagcataacaatcagcaacaccatgccaagcaacataaaaatagggccactcacaatggagaaccgcatctttgccccctgccaacccgcgctgagtatttctgcaatcgtccagcctaccgctgctgctgcaatcatatatccagaaaccagtggagattgaccatgcagaacttgcagaaaataaggaacaaaaacgtcagccgacaggccaatcactaataacaacatggttgtgaacaataccagatggggagaacgtaaactcaacgcattctggggcaataatttcactagggtacggcgctcatggataataaataatacgatcaataccacagctgcaatgataccgataatattggccttcacatcttgtgacaagctacctgcagaaaccgccataaccgcagccgacagcagaaacagctgtacaatcggcaatgccgctttggtttcattctgtgcattttttttcggtaaaatcaggtaggtgaataaggcgtacaacagcgtgattggcaacatgatgccaaaagcataacgccatgtgtccatttcagcaaaaatgccgccgatggcaggcccggctaaagtcgctacgccccacataccagaaatcaacgccatagcacgaggccagagtgattgggggaaaaccagattcaccatggaatatgaaagtgcgaacaacaacccacccccaaatccttgaatagttctcccaatcaacatcacttccatcgtcggtgccaacgtacagaataaactgcctacaaaaaagaccagtgccgcaatcagataggattttctcgctcccaaagctctcaataatcgtgcggaaagtatcgcaccaatgattgatgtcacgacaaatagcgttgtattccaagcatagagattcaaacctccaatgtcgtttacgacagaaggcaagatggtaatcgcaattaaagagttaatagcaactaatgctacacccagtgaaagcgccattgcattcgccgcatttttgctggaaaaaagatcactccaactattttcctcagttactatcatgattattgtcctgaacaccagttgagttgtgaaaagtcttacgataaattaaacaagataaatcttggaataaattaatgtagggttcaacaatatgtcaagcattgacttggaaaataacatcataactgcacaaactgtgagcgagcggttattgatgctactgaaaacacgaggcgccatgcaagcctctgatgcaggcaaaatattgggaacctctggagaagctgctcgtcaacaatttgtgaaactggctaaagaggggctggttgaagcagaatcagagacaaggggagtgggtcgccctactcagctttggcatttaacggacaaaggccacgcccgattccctaatactcacgcagagctaacggttcaactgctgaccatcattcgcagtcaactcggcgaaactgccatggatttaatcatcaacacgcgtgaacaaaaaacttctgccagctataaaatcgcgatggaaaacgcagaggggttacaggaaaaaattgagcgtctggtcgcaatacgcaatcaggaaggttatatggcgcaatattcggttcaggaagatggcgcgattctgtttattgaaaaccactgtccaatctgtgccgccgccacagtttgccaaggattttgtcgggcagagctgaaactgtttcaggaaattctgcaagccgaagtggagagaacggaatatatcttgaacggtgcccgacgctgcgcctaccgcatcacaccattgaaatagattgaataaaacctacacgacgggaagcgagtaggttttattcaccttgatgtccattagattcaaccaaatacaaaatccatcagttcatcctgagtcggtgcgccatcagggccagaacggctgacagtcacggccgcaacacggttgcccagttccaccgcatcacgcagcgacatcccctgagacagcccagccaacatgccgccacaatgcgcatcacccgcaccaatagtatcctcaacgttgacctgataagcaggaatatattccggttcgcagcccggctgacatatccacgctccctctgcaccaagacgaacaatggcagtgaatccccgctcattaacataacggccagcctgtaccacaggatcgccggcgccacacagcatcgccgtttcatcaagatttaaactcaatatcgttctttcagcaggcagtgcttgaataaattccctatctatatcaggcaaacgagggccaaaatccaataccaatgtcagccctgagggagaagccagcaaccattcacgcaaagcgcctgctttgggatttgccaattcatagccgctgaaatagacataccccggcttcggaagcggaatagtcgccagaatatcggcattccaactatcgtcacaaccggggacagaaacgtatatgcgctcatcatcaggcgtcatcatggcaatgcaccagctattgtcacgttttggatgacgcaatgtcaccgttaatccgagcatttccatctcttctgtgacacgttctccccaaacaccattacccacgaatatgccattgataaccggaatttgaagacggcacaatgcccgcacaacgttgaaggcacagccgcctacttgccgatcaacttcttcagcttcccaatattcaccgctgtggggtaattcagataacctgagaacaatatctcctgtagccgaacccataaccacaacaggcagtaaaggcaccttcatcttgtatacctacccagcatcaaatacagaccataacaaataaaactaacaaaaaatgacaggaacaggccaagactggaattcgcaaaaattccaactgcccatggaccactgataaagtcatttttcgtcaccagaaaaccgacaaatgcgcccagtaaccaacacaatacggggatccatttaatgccaccatttggaccaatatcattgtacaaactatcggtacaataaccctgcttacggcggacgataatgtaatcaagtaagaataccgcctcccacggagccagaaacacaccgcagaataacaggaatgagacaaatggccccatgaagtcgccagtaacaaaaagaagataaatcgcaagagtcagaacaataatggaatcaatggtgacagcatggatctgtttgacttttatccctaatgtcaaaaagttcaagctagcagaatagaggctcaagactgccattgttactatccctgccgttgccgtcatcaagtaagggatcaccatccaatccggcaaaatcgagccaatttgagcgatagggttctctgatgtgggaagattgggtaattgaacagagagcagaatgcccgcaaacaataacagcaccaaaggaatcattcctcccgcggttaccgctgtgaaaatttttaatttggaagaactttcgctctgatagcggctgtaatccgctcccgtcgccgcccatgcgatgccagtccccgccgcaaccaccgaaaccgcaggcaggaaccccgttaaccaactgccggatggcatagccagcaccgcttcccactctgtcgtaaacaaaatatagaacacgacaaccagtgtcatcgcgccaaaaacgtggataatccagcgctgcatggcaatgagcatctcttttcccagcagagtgacgccaattgacagccctgcaaataatatcatgctgatcacggtcaaaagtgtactttcagcgagcccgcaagcctgaaataacgcagagagtgtcaaagttccagtaacgatattaatggactcccacccgagggagatgccccaaaaaatcatggtcggcgcaatatttcccctgatgccaaaaatgttacgagaaagcgtcagagttgaagttcttcccaatttaccgctgaaactgagataacccactaaggcaaaactggatagccctatcaataccgcaagtgcagattgtagaaaagagagtttaaaggaaacaatgatggcaccataaataatgccgagaatgccaatgttggcggccgaccagatccagaacaggtccatcggtgtacccgtgcgttctgaaggagggacaatatcaatacctgtgtgttctaccttccagaatccctgattattctgctgtgtacccattacgttttccatcattgtctcaagggaagatgcttaagacacaaggaataaagccctacctgagttgatttgactaatctgtaacatttccttggcaggaaacacgattatattgaataacgtcctgaaaacggctctggtcacggtttgaaggatactcactcccctaggttggcacaaataatcgcgcacattatcggagtaccataaaaaatctcactatgaccagagcactacgtaccgactcgattaactcttgacgaagccaacaaagcctctgattcttcaagtgcctcatagcaactcgacggtcgctatgttattccagagccgacatgatgctcagactttgaatttgaagaatacataacacacctacatttcttgcatcaggtcaggtagttttaaagtaatactgccaaactcccgacttcttatataagcaagatttatactttacatcaattattaaggccaatgaaagtccaatattgtcattatgtgatgccaatctaattccaatacactcttaccttagtgtaaatgctaatgtacacttaccccgccaaataaccggggttaaaaagaatgccaaatcactttgttgactgggtacgcgaagaactgaaaaagaaaagtagtagtcctcgttacatacaattacaacaaaccattgaaattgcgattaaaaaacaattaataaacgaggatgattttttaccgcctgagcgccggttagctgaattgctcaatatatcgcgagtgacagtcagtaaggctatgcagctcttggaagaaaaaggggtgatcatacgccagcaaggtgttggtacgcaggttgccaaacccggagggggctcactcaatcaggccgtgggtttcacttcccagatcgtgaaagaaggtggaacggtatccaattattggttatcgcggcgtatcattcctgcaccggaagatattgccaagaaattatccattaacatcggtgaaaaaattgctgaactgcgtcgtatccgccttgctaacggtacacctgtttcccttgaaaatacctatattccccgtgaatatttgcccaatcctgaattattggaaggttccctgtatgcgcattgggaagagcaaggtattcatctcaccaacgtgaatcacaaaattaaggctattgcctgctctatggaacttgccatattgctcaatatcgctgaaaaatcgccattgctgcaaattcatcaaataagccagaacaatcagaacgagattattgagttcagtgaaatattatgccgcggtgatatttatgggttggatttcaatgcaccacagaatatcgacattaaatataataaaaaaagccgtcatcaatagagagcataaaaaaaccgtgggacacttattatgcccttcagtatgaaaattataaatcgctgttaaaacagatggatgaaatgtatacctacattaaaaataacagggtaatagatcctcaattatggggaaatgtcccgatacggagaaccgatttcttcattgttcgtagaatccacgatcaatgaagtcatatttacagaagctattgcagcataagtgccccacagatttttttgctctctacttacacggatttttactgttaagctgagacgacatcgcgcccatagtttttagcgtaagcattttcgacccccgtaaggatttcaacgatatcaaagtaccgatcccataacggtgtttcacgcaactcttcaacgagcagttgatagctttcatgatctttggcatcccatacccagatgtctgtgactcgtgttgaataaaactcgacgtcataaaaacgcagcgaaacaccggcggcatgttttttgatgatgggggtaaagatttcagcaaagtgtttgaagcgttggtcgatagagaaacccagccattcaggggttgttttgaccagcatgaatacggttaaagcgggggtaaaatgttgtgattgagacatgattgtcgttccttgcattcgttgttgaggcctctataatgcgagctattacttatgttcacaactcgcattccccccatgacaacgttatcaaaccaagagcgaccaagattacgaaaacagccgaaacaagcgcgctccctcgcgatggttgaagcgattattgaggccactgctcgcattttggagcggcatagtcacgaaggtttttcgacaaatgccgttgcagaactggctggcgtgagtatcggttccctgtatcagtactttccatgcaaagatgcgctgatgggggcgctaatcgtgcgtgagtcagcacgacttatcaccgaagcacaaaaggcggtaacaaagacgagtgggcgtgccgggatttctgcctttattaagtcctgtgtcgatcaccaactgcgccgccctactttggcgcggttgcttgattttgaagaggcacgtttgccttttgatagtgatgtgcagcgggcgaatacacagttgcgcagcatcatcactgaattgctgataacccccgatattccttcccagactgatatccaggttgctacgcgagacgtgatggcaataatcaaaagcatggttgataccgcaggtgaatacggtgaatctgccaaatcagggcttacggaaagggttgaacgtgccgtatttggttatctgtctttcagatttatccccttctgccagacatctgacagaaagggatagagatagctactcttttcctgccgaattcaattgctggtaaatatagtgtttataactatcgaccagagctttgtcctgacagtcattcaacgcaccatcacataaatgacgcatcgtcatgttagcctgatagaatggcggtgccgtcaatcgagcgcgttccagaatcataccaccgaggaaggagatatccgtcagcttgcctgttgtaatggcagttccctgcgccagattatcccgcatagtaaattgagttatgtgtgccggatcagctaacggagaatcataattcccaaaatgaatacttggctgatgatcaccaaaatagaggaaaagcgttggtttatcgcgtgtggcaacaaattcactgaaatccttgatagcaggatcagatgccttgattttctccatataatgactgaacttacctactgctgatgaaccctccagtttgtctgtcaaaccgtaatcatcgctatgcccttcatcataagggccgtgttcatacatcgtcagagagaaaataaagatcggtttgtccgtctccttggccagaatcgttttcacataagacagcatatcttgtgttgggatcgtccataaattttcctccagactggctggataacccagttcctgtggctggataatgcgatcaacacccattgtcttgtaagcgtgtccagcatggtaggccgatttattgaatggcgtcagtacaacggtgtaataaccattatctttcatggcgcggaacaagctgttttgcaggtgatcaacgacaaaataaaatactgcatttttgcgggagccgaaatcatccgtgttcaatcccgtcaaaacagagaattcagatagccatgttccacccccaaaggtttgcactctgagtgggctttgagcgctgacacctacatcacgctggaacatataaagatccggcagctgagcattggcaggcaattggtaaatatggggattaacggtggattcctgtaatagcagaaccacatcaggtttcacatcggactgaggctcaggcaaggtaacgctttttgcctgttgcagaaaatagtccgcagactcaccaaattggggcggctggtattcagtatctttagctgacatcatcatgttagtcatggttccacgccctttcggcaattccccctgccatgttgtgtagtaagcattggtggtcagattgacgacacagacaccggcggcgaccagcaccacactggcaacgcgccattttatcccgcgcacaggatctgcttttcgccaactcaacaccatattgaagatcaaccagactagcatcgctgccatcgcaacccctgccagccaataatgacgcagggtttcctgatttgacgggtctagcatgacattcaaatcggaaaacatcaggtgttctttgtagtaatggacttttatctggttgatgaatttgatgataatgaatacggttccggtaaacgccgccgaaaatagccaacgggctgaaaccaaaaacgtcagaccaaagatgacaccgaatacgccgacagaaactaatgctggatagatatcactgcttttttcaaacactattatccaggacgcgatcagcagcacccccaaatagatccccgagattatcttttttttcatacgccattcagttccacaattgagttcagttttgcaccgaccgatgaaaatagcatggttgcccgatataccgtgcataaaataaggcagcctttttcgttaaaaccattcatctgaaaccatttcgcgaaaaaagttcacgaaattaattcggctagagcaaattttttagaacattccctcatcccgcagaatatgccaatcagattttctgcgggtaaatcccgtgcggtcaaaaaactccagtatttggatcgccagttttcgcccaacacccaatgcattgcgaaaatccactgcggttattccgccgttatcctgattatatttacggatcacatcagcgaattgctgaatgcgcctgcgatggtaataacgatcggacacgatggcagtaatcaaccccagttgtgctgctttccgtagcaaatagcgaatggtttcttcttcttttcccatttcggccgctaaatcacgtacccaccacgcttcatccttgaaataaggttctgcggttgaccataggctggcttgctcttccgtaaacgccagcccatgttccggcagatgcagccagccatgagtctgttttagcgcttttcgctcaagcagaagatgaattagtgtataaaccagcgcgtcatccagtgcaggtaacgtcattcgttttaaacgcgcttttcccaatcccagctgatcagggtgtttctcgtgatattcagtcaaaatctgcaataacttttgttccgccaacattgcgttaggttgtgacagcatcataccgtcagcaataatggctttaacatcgatcagcagacggttcagtgtcttttctgtcagttggcgcgcccatgcaaaatggctgagtgacagcgccccacgcggtaaatgcagggcaagattttccgtatggctagaagattgagccagttgagctaaccagttcaggaattcaggctgacgtttgcccctgcgtggagggttcaggttaatcactcgcgcccccgccagcgttcttctggcgctgatatcccgcaggatcagacgatcattctctgtcagccataaagggtgatccaacaccagttcagctaataccggcgtttctaaaagcggggtcaatagcgaaatacggccggttatatgactggcagcatggtgaatatggagagattgccagttttgcagcggttcatcggtttcgacttccaccaacactttttccgtcgcagacagcggtttttgtgacagcagccaatcaccccgggaaatctgtaccttgctgatatcccccgcgatattcagtgcgatacgttgccccgcctgcgcagattgtgttgtttgattctgagcatgtaagccacgtactctgactatttgctctctgtctatttgatcactattggtcagccacaacatgtcacccacattgatactgccagcaagtgccgttcccgttaccactaacccagcccctttgacagtaaaagcacgatcgattgccagacgaaaacgttgattcaatttttcatgctgctgatgttgttggtgaatcgcgatcagatgctgcctgaactcggcaatgccatcccccgttgccgctgctgtcacaaacaggagcgctgattgccaaccttgtgtcatcagcaattgtcgggcctgctgctggatttcatcaatccgcgcctgttcgacacaatcggctttagtcagtacaacggtaacggcagggcgcccgattaaccgcaggatagccaaatgttcacgcgtctgcgccatcaccccatcatcacaggcgacgaccagcaggatatgatcaataccgcccacacccgccagcatattagacaaaaatttttcatgtccgggtacatcgacaaaccccacggcagtgccgtcccgttgcggccagtaggcatagccgagatcgatagtcatgccccgttttttttcttccggtaaatgagtggtctcgacacccgtaatcgcctgaatcaacatagttttaccgtgatcaacatggcctgctgtagcaaaaatcatagtcaccgaacctgtctctctgattagctatttctgtaacgattcctgtaacaacaacgtctgcaacaaggcattcccatcttcaaggcaacgtaaatccagccataaccgcccatcatacagacgtccaataactggcttttctaaattgcgccattggtgagccagtttttccagcgtactgccccgtccatcaatggcagtaaaagtcagcgcccaactgggcagacgatcgacaggcaatgaaccactgccaatctgggaatagcaaggttcgtcgcgagcaatgaatgtctcgccgtaatatgcctgaatgtgagggagtaactggtgcgccatatcacgaatttcggcttgcggacgagtcagcagacgcagggtcggcagtttttggcacaattgttccggatgttgatagaggcgcaatgtcgcctctagggcggcgagagtcattttgtctgcccgcaatgcacgtttcagaggatgacgctggatagcctcaatccacagtttcttgccgacaataatgccggcttgcgggcctcccagtaatttatcaccggagaaagtcaccagatcgatgccgtggtccaggtaatcccgtggtatcggctccgcaggcaggccatattgtgtcatatcaaccattgagccactgccaagatcaacggcagtggctacctgggaggtcattcccaattttgccagttcggcaccagaaacttcagcggtaaagccttcgatactgtagttgctggtatgtaccttcattagcaaacccgtttctggattgatcgcctgttggtaatatttcagatgtgtccggttggtggttcctacttcaaccaagtggcagcctgcctgtaccatcacgtcgggaatacgaaatgcgccaccaatttccaccagctcgccacgggaaaccacgacttgcttaccctgcgccaccgttgccagcaccagcaaaaccgcagcggcgttgttgttaacgatacaggcatcttccgcacctgtcagagaacacagcaaatcggccagcgcccgatcacgatgcccgcgccctgcaccatcgagagaatattccagcgtgaccggagagcgcatcacgtttgtcaccgcctcaatcgcggattccgccaatactgcccgacccagattggtatgcagcaccgttccactcaggttaaacacgggcttcaatgccgaagattgatcttgcgtcaagcgctggcacaacgcatttgcccagttatcactccatgctggcaatgcctgatgctccctgatatcaaaccgtgcctgctcctgcatttcccgcagggtattcaccacccgcacctgcccgtgaagatccgtgagctgaaagatatccggctctcgcagcaagctgtcgatagcaggtaactgacgatacaacccataaatttcttgtgtcatcgtttccccaccgcaggttattcgttaggaaacaggaagggattcaggctgctgcgagcaaaaccttcttcctccattttggcatcaaggatcagtgatgccagatcatctgcaaccgcatctacgttgggatctttctcttgatacagaattttcaggtaactaccgcaatccccacaactttctgccttaatcgcggcctgttcgctttccagcgaccaataattcagatcgccagtctgttcacagttactgcattttatgcgtacaacatgccattcactttcacacaaatggcagtgcagatagcgcagcccttggctcgaaccaatctgcacgacactggcaacgggcatactgccacagaccgggcagaactgacggtgctcaccgtactcagcccgcgctttaccggggatcaaactggccatctgcgcccaatagactgacagtgccgcccagacaaacactgcctgatcagggctgaccttggcaaattccgtggtcagcagcgcgctggccacctcttccaattcctgcacagaattttttgccagattttcaagagtaggcttcacatgctcaggcatcgtaggcaataattcggcgatcagggaatacaggatattatgccaatgctgagttcggggaatggttttgcaatccagcggaacactgtttgtttgcaataaaatatcgtccaattccatattcaatggattgtcatacagcgctttttgctgcgcctgtacaatttccgcagcaaaattgagataacttgagaatgggtgattgtctgtcgccaatgctttgagacgctcggcacggcgttgatacaggtttttcaggttggcaaacaacaacggagggataaatccggctcccctttcattcacgcgctctttgcctagctgatctttgggtacgatgcgaatactcataacctttttaccttttatctttctggctcggtggtctattgtagtcccatcattcgtaagcagtaaccctttgcttagggcaaatttgtattattggacattgtcattccatctgaatgatgggaaataatgcgagaaaaaatagtttaattacaaaataatagaatacatcccctattaaacttaaaattagcaagaggctactttggacataataaaaatcaacaaacaggtggggaatatatgattcagaataaaaaatccgtccaattatcacattctgttgttcattattactgtgtgggagaaggtgatggcattgtgtttttgcacggaactcacagtgatggagaaagcagttttggtcatatcgtcagtgaattcgcgaaagacaacacggtaattattcctgattatgccggatgtggaaattctacccttccacaaggcgaaatcacggttgatcaattggcagagcaaattgccgcgatgatcaaagacagtgcaaaatcccctgttactttggttggcacatcattaggcgctgtcattgccgccgttgtcgctgccaattatcctgaattaatcagcaaactggtattaaccgccccttgggcaaggggccaagatgccagacaccagttgatgtttcaaacttggttggcattagaacaaaacgccccagacagcgccacggcttttggcctttctcacgtattaagcccggtgtttctgacctcattgggcagtgaaaaaatcaaacagatttgcagtaaagcatcggcaaaagatacggataaaagaattcaacttgggctgaatatcgatattaatgagtcattaagcatgataaagcagcctactttagtgatagggttggagttcgatactctgatcccgctttatcaagtaaagacggttcatcagaaaataacacagagccaatatagtgaaatagccagtgggcatgctgtacaactggagaatccacaggattggataagttgtattaaaaactttttacagagaaagtgacattcccactgtcaggatcggcttcgacacccgaacaccgattttgcagtggtgataatttcatatcggtatttaaacggcgctttaataaattttttcctaaaaaaatatcaataagacatatcgaaaataaaaatctctgtacagattttaattattcctaaattaaattcaagaacagttattccaccattcactattgaatataaatatacttaagacaaggttatataaataataacaatcaaatataacatactgttttatatccattaattatattttgttattttacacatgagtatgtgattaatgtcgtggaaccattaaatatttttattcattgtctcatctttcttttgttttattatcacatctctattttagtgatgtttttttaaaagccatagatcatagaaattcaaaatggaggggaaaggcagggcatactaaactatttaacgttgagtgtagcccacatgggcgtggataggtcggataacgggttggttacccgatgacgaggaattcgaaggttgtgacaaacggcaattttggtgggatcaataaaagcgatcccttaggtttttgcctcgcgtgacgaaagaaaagggcatagaggaataagggtccttttctagggtgagtatttggggatagctgaccaacctgggaaaatcagccgtaaggtattgttttaaatgtttaatataaaacgttttaaaatcagtatattacagatatagctgcggaatgactgttatatgttgaacaattagttaatcttgtatgagttatttttttctgattgatactcatttgatggacgtacaacgtaggattgtctggctccataagttgtgctcgtattttgaataaatattttactgttttcttttgttatataatagtaatctggaaaatttcttccttcgttattaaatttcgggtaaatgtgtgctttttcctcaaattccggatcaggaaaatactcttctgagtaaacaatttcgttccctttaataaaaataaattttaaaccaacatcaacgaaactgtatttcataccaatggctatattgatattttccggcgcatcaccaggttgaaagatgtaagctctatcccactcaaatggtatcacattccgaaaatcgactagacactcgttcctccattcacagttgttatcaacataactagtgatagcatctttcacatcccatttataagatgcgatataataaatagaaacaatagctattatcacgatagaaaatataacttttttattctttataagtttccattttactgacatagtataccctcaatccccatagttcatcagcgattaatactactgcacgaataaaaatttactgactcgccaaacattagctctctgcccaatagtatcaccgataatacgaaattcaatcgaatcactcatcatcacaaccctcattttaaccacacaacgcactctgtgacccagatatgcgttcgttgttcttgatgcgttctgagcacgtccggtcgctcggttgggtgcgggtgaaactactgaagaatgagttgggaccgcggtcccattatcgtactatgattcggatgcatcatctggttaaaattaaaccataaacctataagcatcaatagctttaaccgtcatgggtaatccctgttttagcaacatatataaaaattcatccgtagacatcggtggatttttatatatgttgctgccttaccgcttccagcgcagctgcgtggtttaagtcaaaaaggtctgaaataaactcgtccggatgaagcgcttcaatatcaaattcagccaaaatcttgggcggaaagtctttcaagttcatagtgactatgacttctgcatttgcacgtatggctgtggctagcacgtggcgatcgtcttcatcaggtagtctgagcccttcaattaacagttcaaatcctgtgacattagcatccggcaatgctgtattcattaatgttgttgtttgttccagtacttcgggctttatatcactgcgctgttttagtaaatttcgcttccattcgtcctgaatagtgtccgaccatttgggttggtacaaaccagccagccctaaatgcataagtaaatcgcgcaatcttgccgggtataaaacacatgcatcaagtacggctggatagggagagtgctgcatctgtcaatagcccaagttaagttcttgcgcctgagcagcaagctcttgcatagcagctatgctgtcagcatcacgtttctttttgtattccatcaggtcggcgaataacactcgacgatgccgccctgttttatgatgaggtaatttcccgtcctctaataatttaaccatatgaggacgcgatacattcattatattcgcagcttcctgcgtcgttagttcagcatgtactggtacaatttgtacggcgttgcctaccgccagttcacccagtatattcatcagcatggttaataccgaggtaggcagttcaatttggtgcgacacgttatcagcaccgttaatgataatctgctgagtttcggatttagtagaaagaaacgtggccagctctcgttggccacgcattgcgatttcaatctcatgttgtgctggaagattcaagctggttaaagttgtgttgttcatatttatatacccagtgttaatatttttgttagtataaacgaaataaacgaaataaacgaaattcgcaatgaacgaaacaaacgaaacgcttgatagatttatgaccagacaaccataataaactactccattcgggcgaatgaaattaatcaaaatacgcaagccacgcctgaatcatcgcatctttcaggttgtccgcctgaccaacccatgcgtaattttgtccactatattcgaatctaactatccactgaccatcgttacggcgatgtggtgcagaaaatcgtgggcgttctgctgattctggttgttctatctgttccagtttttcctcaaattctgaattaggttcaggctcctgttctggttcagatccgttctcggcagtatcatcattaatttctatctcatcatcctcaatggattcattatcaatgatgtcagtctccagttcctcatcctcatcgtcctgaataatgatatttggagaattatctacccgctgatatcgaccgttttcgccaatttcctgttctaatgcatcagctgcgaattctaaataccgttttgtcagtggaatgttgaaccctaatgtacgcagctgagacgaggtgactaaatcatttggatatgtttcaacaatctgtttggtaccctgcctcacatttattctttctctttctgctgttctgctttcaaaatctcacgataccagcgcggatggtgtttcttcgcccagccgcgcgtaacccagccttccaccatcgcccgcaccgaccccttgacccagaatgccgcataagcatggacgataatggtcaggatcaggctgatggctgacagcgagtgcaccagcaaagcaatccgaatcagcgggatcgggaagtattccgcgaagtaaagacgccagatgatgatgccactaaccagcaacaggagcaggcaaacactgacagaccagtaaatgccttgctgcccgaggttatactggccggtatctccggtttcctcattacgcaacacgttgtgaacatgcttcgcccactcaatgtcatccctgtcgagcaggttatgtttgaaatatctgaaaaacataaagacaaacaggaaaaacatcacggagccggcaaacggatgtagtatccgtgacaactgcggtgtaccaaagatattcatcatccagttcaacgaagggaaaaagaatcccaaaccactgatggcggtgaacaagaagacgataacgacggcccagtgattgattcgttcaatcggggaatgacggataatgatatcgttgcgctttttcattgctgttcttcctcattggctgaagattcaacatccttgcgcgcactctcttcctcttcttccgatacgcgattcgggccaattccgacataatggaaaatggaggcggcaaaacctatcgccgccagaggcttccaaatccctttccagaatgtcaccgtcgggctgatggtcgggttatccggcaggccatgataaagcttcggcttattggcatgatgcaaaacgtacatgacgtgcgttcccccgacgccttccggatcgtacaaacccgcattgtcataaccgcgcccgttcaactcttccactcgttccgccgccaacgctttcatatcctgcttactgccgaaatgaatcgcgcctgtcggacaggttttcacacaggcaggctcctgccctacgcccacacggtcaacgcacagggtacatttataggcccgattgtcttccttgttaatacgcggcacgtcgaacgggcagccagcaatgcagtaaccacagccgatgcagtgttctgactgaaaatccacaatcccgttggcatactggataatcgccccttccgcagggcaggctgtcagacagcccggatcggcacagtgcatacaaccatctttgcggatcagtcattccagcctgccatattcctcaacttcagaaaatcgcatcaccgtccatgacttcgctgtcagatcggccggattgtcataaacgccgacgttatggccgacttcatcacgaatgtcattccattctgaacaagctacctgacaggctttacaaccaatacaggtcgtgacatcgatcagttttgccacttcctgctggtgatcccgcacacggggtgcgggggtcagagagctggtggcggagcgacgaatgatgtcttgagtctgcaatgacatgatttttctcctctacaccttttccacattgaccaaaaatgccttgaattccggtgtctgcgtgttggcatcaccgacaaacggcgtcagggtattcgccagaaaaccttttttcgccgcaccttcaaaaccccaatgaatcggaataccgatagtatccacttgacggccatgcacattcagggttcggatacgcttcgtcaccaccgcttttgctttgatatagccgcgattggaactgactttgacggtatctccctgtttaatgcctttctccgccgccaaccgttcaccaatttccacaaattgctccggctgggcaatggcgttcagcaacgcatgtttcgtccagaagtggaaatgttcggtcagacggtaagtggtgcctacataagggaatttatctgccttacccaaggattcaaaatcactcttgaagatacgggcagccggattggaaatgacattcggatgcagcgggttggttcccagcggcgtctcaaatggttcgtaatgctcagggaatggcccttccgccattttgtcgatggcaaacaggcgccccataccttcaggctgcatgataaatggcccgacatcggttcccggtgccgcattgctgtagtcagggatatcaactccgctccatttatcaccctcccacgcaatcaactggcgtttagcgtcccacggtttgccctgtggatcggcagaagcgcggttgtacaggatgcggcggttcagtggccacgcccacgcccaaccgagcgtattaccgatacccgacggatcagcattatcgcgacgcgccatctgattgccttccggtgtccagcttccagcgaaaatccagcagccactggcggtagttccatcatcacgcagttgtgcaaaggatgagagctgttgccctttcttcaccagcacattgccgttggcatccagcaaatcaactaaggctcgaccattgctttcctgcgcgacttcttctggcgttggattatcggcatcaaaataatcccatgtcatgttcaacacctgttcaggaaaagccccgccttcttcaaggtacatatcccgcatgcgcttgaagatcccagacaaaatttcgccatcactgatcgcttcccccggcgcatccgcacctttccagtgccattgcagccaacgggcagagttgactatcgagccgttttcttccgcaaaacagcaggagggcagacggaagacttcggtctgaatggaagaaggatcaacatcgttaaactcgccgtggttctgccagaatgaggcggtttcagtgctgagtgggtcaaccgtgaccaagaatttcagtttcgacaacgcggccaccactttgttcttgtgcgggaacgacgctatcgggttgaatccctgacagatatagccgttcacttccccttgtgacatcatttcgaaatattgcaggacgtcatacggcttatcccatttcggcaacagatcgaaaccccagtcattctctttgtgggcatgatcgccgtagaaactcttcatcaggctgacaaagaatctgggataattaccccagtagttgacctgccccgggacagtggatttcggggtattggcctgcaagtaagtttgcagatcggtctgtttttccgatggcaaggagagataacccggcaggctttgggacagcagccccaaatctgtcagcccctgaatattggagtgaccacgcagcgcattgatgccaccgccagccatgcccatattaccgagcaacagttggatgattgccatagtccgaatgttctgtgcgccgacagagtgctgcgtccagcccagtgcatacaggaaagtcgcggttttgtcttttacgctggtttcagccagatattcacacaccttgaggaaatcctctttcggtgtaccgcaaatatcggtcaccacatccggcgtatagcgactaacgtgctctttcagcagattccagacacaacgtggatggctcagggttttgtcgcgtttggcaaaaccgttttcatccagcgcgtagttccatgtggttttgtcgtagcggcggttttccgcatcatagccgctgaacaggccatcatcgaatgagaagtcttcccgtacgatcaggctggcactggtgtaagcctcgacgtattcgcggttaatcttttcattgttcatcaggtataaaatcacacctgacaggaaggtaatatccgtaccggaacgaattggcgtatagaaatccgccacagatgccgtacgggtaaaacgtggatcgatcactatcagtctagcgttgttgtgaattttggcttccattgcccagcggaaaccgacaggatgcgcttcagcggcattcccacccatcacgacaatcaggttcgcgttcttaatatccacccagtggttggtcatcgcaccgcgaccaaatgttggagcaagacttgctaccgttggtccgtgtcagacacgcgcctggttgtctacggccagcatgccgagagcgcgagtgaatttttgtgtcaaatagccggtttcattactagcggcggaggcgcagagcatccccgttgtcagccaacggttaacctcaacaccgtcattgttggttttgatgaaattggcatcgcgatcttgtttcatcagtttcgcgatgcggtcgaaagcgtcatgccagcttattcgctgccattgattggagccgggggcacgatattccggatagtgcaggcggtttttgctgtggacaaaatccaccagcccagcccctttaggacagagggcgccacggtttacagggtgatccgggtccccttcgatatggaaaatagttgctttggcatttttggcgccatcaccgaggctgtacatcaacagcccacagccgacagaacagtatgtgcaggtattccgggtttcacgcgcacgtaataatttatagttacgtgtttgtgcaagcgcggcggttgggataaaacccagcgcggctgccgtcgtacccgccataccgccagcgcagatcttaaagaactgccttctgctgacttgcatggggatctcctcactcacattgctcattaacacatgccctgacggaaaacccgtaggtatgcaattttaggcctagatttatgaatgtttttcttttcattttggattctgtctgtcaacaacatcatgcgtttaaatcgtgtaaactccctacgctcacgatttatccacacaaacagtatcatgaacgaatctgatggaaaattcacctaatggataatgcaaattcaggaaacaggttaataatcgacgagatttgcggagccactcgcatcaatgtgcaacaaaaaaaccatctgaatagcccaaaaccggactgggtggcagaagaagtcccgattgcattggtctacaacggtatttcccatgttgtgatgatggccagccccaaagatctcgaccatttcgcgatgggcttttcattatcggaaagcattatcacttccccacaggaaattcacggcatagataccgtaatcagttgccacggcggtattgagctgcatatcgaactttccagccgccgttttgcggaattaaaagaacgccgacgcaacatggcaggcagaaccggttgtggtatctgtggcaccgaacagattgccgaaattttccgtccaattccctccttgcctttcacccagactttttcattggattatcttgatcaggcgcttgcacaattaccccgtcttcaggaaatcggcgcggccacaggttgtacgcatgctgctggctggattgatgctaaaggggtattgcttggcggcagtgaggatgttggccgccatgttgcactggataaattattgggaatgcgagccaaaacgggctggcggcagggcgcggtattggtttccagtcgcgccagttatgaaatggtacaaaaatccgctatgtgtggtgtagaaattttgtttgctgtttctgccgccacctcgctggcaatcgaagtcgcggagaaatgcaatttgacactcgtgggtttctgcaagctgggacgggcaacggtatatacccatccacggcgtctggtggattaatcaagactatggaacatccacaagttgggttcaatgtagtagcccatctgtttttcaacatccaccagcagcggcaccaacccgcccggaatgatgtattccccactttgtgggaatttcatgcctgtccattcttgccactccgccacggtaccgtaaatatccatagagcgtagcgcaggtttaatgatttttgctcccaagcgccaatgagtgcggatccaagggtcaaaaggctcacctttttcatttttccattcacagtactgaacgaaatcttgcaggggataactgcatttcaggctcggcctgaccggaaccacaaaaccctgcaatcccgcttcacgggcagtctgtttcacgctgttgatcaataacgcaggcacgttatgtccacggaattcaggggcaacggtcaccgaaagtgctgacagcagggtcggctgttgttttccttttgctgccattcctgcgcaatacacggcatcccatccttcatccggcaattgatccaaagcgtgcggttcccacgggaaaggaatggcattcaataacccaataaggcgctcttcctgcccttgttgcagaatggcaaatttctggaagcgactgaaatcgggttcatataatttttcccaatgttgttgggcaacaggatcttgattcataaaaaaaggccataaatgacgaacaagatcatatatttgttcgtctaaatcagccctctcttccgcagattgaatgattattttagcgtccataattacccccgattaaatctattgggtataaattaaacttagtaagcagagaattgcacatatacgatattacagtaagatacccacctttaatgataaatttaatttatcattaaatttatcattaaatttatttattcccactcaaattcaattcctaatattaaatgattaacacgttatctttatttttcattcgaagatatatctacgtaaaaatgcttatatagccagattaaaaacattaatttctataatggtatttattgatgaaaaagtttaaataacttgattaaataaatgacgtaaggattttttgaaaaaaacgacattactaataacacagtaatatcaggtgattaaatctacctgcgtcacatttttagtaaaaagtagattgttgttttcttactctaaaacagcaaaaagcatcgaaatttaataagttagactcaaattttaattaataaaccctgtaaaacccagaataaataataataattatcatttacattatcatttgaaaggtgtaggttttcttcgcgcaataaatcaggccgtttttatgattgggtaacgagggatcccccgattctaaatgaggataatgatgaaaaagatcaatgtattagtcgccgctttaggcgcattagggtttatggcacaagctcaggcaagtgttggatttggtcagagtcaagaagacactacacctcacattaaggttggtgccaccaaagcgagttcaagtccacacggtggctcaggtgatgaaccaggtattggcgtcagttccgttcgtgacggtatgcttatcggtttttccggattaacccgtatggctcctgctgacagcaatggtattcataatatctcgatggcaggcgcacccggctctcacggtggtatgggtgtattccatttcagcaaagtcgccaatgcggacgtttactttggcgaatggtcagaaacaggtaatgcaacagacacaacccataccgtttattatgcgggcaaggacattaccaccaatatgccaaccgatggtacagctacctatgtggtgaacggtattaaccagtacagcggtgacaatgccctttccggcacattaacagcagattttggtgaaaaaacgctgatcggctccatagaaaataccgctatgacagtcagcattgatgccgatatccagtctgatgcccaattctcaggtcttgctacaacaggcgatcttgagggagaaacccaaggtcacttctttggtgatggcgcttccagtctggcgggatatgccacatttgatgataaatccaaggataccgctttcggtggttcgaaacagtaattgctaatggttcagagaacaatgccatttttggcattgttctctgttttgtttattgccgttttatttatcgctatttatttctaataacgtgagccttgtgagctggtttttcgatgtctgacaatataacaaccccaatattattaacggcactgatggccttatgcctctccctgcccgtttatgctgatgaagataccaaccgcaaaatctggcaggaggcgcagcacaatcaacaagaaaatgaagctgatctgataacgccagagcctatttttattgaggatggcgcttcatcgattgtcattaacggacaaacatttcaggtagaaaacaacctcaataacatcggtcaggcgctataccttgccactaaccatcgacagtggccggacgtcagacgttttctgacggcttatcaaaaactatccgggcatgatgtcatgctggtctcttttgcccaaggcggcctagcgcgttttgaaggcgatttggatctcgccgcctatcattatcaaaagctcctgaaccaacaacccgacttcacacgcatcaagctggaactggcccgtgtctattttgaaaatcataaaaacagggaagccgagcaactgtttgcgggattgagtgaacagaccccgttaccggaaacggtcttgaaaaatatcaacagctatctgaaagcaatagcattgagaagtgactggcgtggctctttttcggtgggttatgcctataacgataatgtcaatatgtccccggatcaggaaccaacctgccttacctataaccctgatgggagttgctatgagaaactccatataccaaaagccattaaaaagtggggaatgtcttatgacgccaccctaagccgacgttaccaactttccggtcatcacggtatttttgggcgtggcctgatttatggcgaaaactaccgtgattaccacgctgaaaatgaaaataccgtcctgctggtcagcggatacaactataaaagcagaaatcacgatttctcttttggccccctgcttgaatataaacaacgggcgggtgatacctattatcgcgccacaggtgttaaaacggaatggagacaaacattcagccctaaaacggctctcaatatcgagctggagcataaacaactgcggcatcagcagcgttaccactggaaaaatggcgacctttcctcttcctatctcactctatcccatgccatcagcaaagaatttgtcgtatttggtggcggtgactgggtctatcggaacaatccgcaaccggcggatcgctatcaacaatggggaattcgggcaggcatatccggacagatctaccccggtattaatggctcactgtctgccacactgcgagagcggcgctttggtgcttacagcccgatactgcacgccagacgtcaggacgatgaacagatctatactgccgtcattaaagtccctgccgctgaaatattgggtatgaccccctctatcactttccgccatcgacgcaatcacagcagtgtgaattggcggtacaactataactataacaaaaacgaagtactgctgaggctggaaaaatatttttaatcaataagttatgattttctatttgcgtaatgatgattgacaaattgaggcaagggatatcaatggcataccgagttaaaatacagctaacccccattacaattgcactatcactggtattttcgctgacagcacctcccctgtttgccgaacccaaatctaccgtcacttctccaagcaagcagacggatttaggcaaaattcgtgtcacagataacagtgataaagatgaagccagtcatgatgcggtctatgacaaagatatctcaaatatctatatcggcaaggaacagatagagcgctataaaggggcatctccagccgatctgataaaaggtgcggtaggtgtctacagcggtgatgcccgtaatagcggcgctttggatatcaatatccgtggtattcaggggcaagggcgcattcccgtcacgattgatggtacggagcaggctattacagtgggacgcggttataatggcgccaataaccgcaactatattgatcccaatttaatcaatagcatcgaaattgaaaaaggcccttccctgaaccgcaacgtcaaagggtcaatcggtggagccgtggttatcaaaacattaaccattgatgatgtcgtgccaaaaggggaaactttcggcatcaataccaaactggaaaccagcagcaattcagttagggaacgcaagccttctttggcactgggacaagactaccgtgatgttcccgactttatccaaaatggtgtcgaagctgatcctgagctgaaaatcacgccccattcgtcaaaagacaataaatttcccggatttaaagataatgctttccgggtcgcattaggaacgcggcaggaatattttgatctgatgctggcttatagctaccgtcgtcaggggaattattttgccggcaaaggcggtgcacaccgctatgatgaacctatcacggcagcagataccgaattaatgaatggctataaaacaacgttagatccttacctaccgtttgctgcccatatctatcgccccggcaatgaagtacccaatacttccagtgagatgcgctccgtgttaatcaaaaatacttggcgcctcaccgatgatcaggcattacagttaggttttcgcaatactcacatggaatttggcgatatcatgccttcgcgcttaggctgggtgaaggccgaagataatgctgttccacaatggccactggcgaatgtccaccagcaggccgtcaatctgacttataaatggcaggcggcggacaacccctatatcgattttgatatgaatctctggacgacccgcacgacaagcaatactaataccgctgggggatatccccgaacgcctgtagagagggactactcttgggataatggcagtggtgtcaaagcctctcacattgatggctcgttgattgataccgccaaaaccaatgcccaaaacaatcgctggggcgtggatatctccaataaatttaccttggcttccagtttggatctgaccttaatgggaaatttccaacgcgagcatctcgactccaatgatggctacaaccccttaaatatgtacttcttccagtcgccagcacggaaagggcagcgtcaggaaatcaatctcgcctttaactttgactggcggccaacatcatggctggcactaagtgccggtgccaaacgtgtctcctattggtccaaagatgactttcttaatgaacgacgtgcagcaagagatgcccgttatagaaataactcggaaaccaccgggcatcaaataagttactaccgaacgatgaccgaaagagaagcttatataaaacagaaaaaactgtctaaaatgagtagagaagaacgaactgaatattttaaggtaaaaacaggagatatcacctctcgcgatgggcagcagcgcaaaatggttcgtcaagaagtcgactggctctacaattccagcaatggccaacttaataaaagcgataacccctactttaatgggcagttggatatgcaggaaaagattatcgacccaatgacgggtaaagagggatataaatatgaatatggctcaggagttgatgcaaatggtataaggcgtgagattcctgatgctgatccctgggaacctgcctctaaacgcaaagatcacgcgtgggcgcccactttctctgccacggcctatattacagacgatttccgtatctatacccgctatgccgaagccgtcagaatgcccagtatttttgaagatactgtgggtttctccggtaacaaaagcaatcgcgtaggccagaaattcaaacccgaacgcgccaaaaccactgaagttgggttcgtctatgatttcagccagttggttgatgcagaacgccatgccgatatcaaaatgtcttactacaacaccgtgattgaaaatgtgtttgaccgggataacacctatgagttttcccaaatggacaaacagaaacttgccggtctggaactacaggcgcgttacgacaatggcagtttctttaccgatatgggattaacctacaacctgaaaaataaagtgtgtgacaacaattcttcattgagaatgaattcattgaatcgctacgatataccagaatgtattgatggcggttttgcgggaggctatctgcgtacctccattcagccccgatattcagcgaatctgactgtcggcgggcgcctgtttgatgagaagctggagctgggcagccggatgttctaccacagcaaagcagaaaacaaagacgaaaaatggttgatggaaacattacccgatgtctataaaggccagtcaaataacccaatgcgctggaatccggttctcaccgtcgatgcctatgttagctaccagatcacgccaaccctatcgatggaactgaccggaacgaacttaaccaatcgctactatctcgatcctctgacgcgctccatgatacctgcgccggggagaacctttaaactcagtattaccagccagttttagaggatgatatgactaacacagccatattggaaagcccagccaaccattttccgcttctgcccggaaagcaacttctggttggtatcctgattgccattttattgcatatcagtctgatatggctgttcaatcgacatgcctcatatgatgacagcgctcatcatgtaaaccaaagctcgcccttaacggggctttccatcacgatggtagccgcttcatcatgggcgaatgaaccagagtctgtctctcctccgccaccgttgatcaccgcgcctgaatcgccgacaaagccaaagattgctctggataaagcggttcagcccgaaagtaggctggaaaaaccactggaatccgtcaaaccgcaaaaacaccaaaagccgcaggagaaggcagaaaaaaaatcagcgctatcaccacaagttcaggacagtaatgaggaacttgaaaccagcggcaccgatcagatcaattcacaaagtagcatgagccgagccgcaactacacagcctctggtgggtcagggcaatagcgcactggataattacccatcaagactcaagcaagaagttgaaagccacaaacgttatccccgtaaagcaaagcgaatgaaacaacaaggcacagtgaccattggttttactctgcttaatgacggttcattcacggctgccagagtgattaactcctctggcaacagcgtactggatgatgccgcgctggatgccatcgctcgtgccagttcggttggtcccaaaccggcagatttggcacccgatgtaacacttgaaattgattttgagctggattaaataacaatcgattccagcatagaatttctttctgcatcactgattgtgggaatggcatagaaaggcacaacattcacaggataaatacccactaatcccagcgttccaagtgtcatgtcacgcatgaagttatctatctccatgtcattctgaaccaacacttcttttgccgtacccaacgtgacatacaccgttgcggatttgtctgtcagaaaaggggtaaaaattttgtcatcttcatagtaagcaaagccattggaaaagacccggtctatccatcccttaagaatagctggctgaccaaaccaccaaataggataaataaaaataagatgatcggcttctttaatcatagactgacttttcgctacatcgggtaatacttctccacgatgcagagcttcaaaatctgaactggcaagcacaggattaaatttttcatcatagagggaaataaaactatattcctcacccttattacctatttcgctaataatcttttccttgatagcatgattaaaactttttggattagggtgggcataaataatcatatgtttcatgtttaatatttccttagaggaacaaaaattatattgatagatatcatcataaagatgaacccgcttaataaaaagcgagttcatctaagcaacattatcaatagcacttattcacaatagactggaatagcatttacgctccacaactatctccaccatcaatgaccaatccttgggctgtgatcatggaagcatcgtgagaaatgaaaaacatgactgtattggcaacatcctgcgggctgaccaaacgccgcaatggaatacgtttttcaatgcgtttaagcagggctgatgttgaacagccaagcaattttgcctgcggctctaaccccttcactaacatcggcgtatccacccaagaaggcaagacagcattgacggtaatctgccgttctgccaaatccaaggccagtgactttgttagccccagtaaggcatgtttcgatgcagaataagcactattatgtttctttcccgctttaccaagaatagaagaaataaccacaaccctgcctccaaggaggatttcaggtacaacatgcgataataggcgttgtgttgaatataaattggttgctaatatcgaatcccagatatcactctgcccaatatcattgctattatctttaccatgactgattacgattccctgtaagttaccactcttaatcaaagggaatacttcattaattattgcgttttcatcagttaaatcaatctggattgctttaatatattctggtgactgttcaaccagttgatttaatccatcatgttcaatatcaattgcaatgacataatatccggctacaacaagtttctggcaaacgacgtatccaattccactagccgcgcctgtgacaataaatgttaacatcaaacttccttctgttagcttaatgcaattccaccattgacattaatcacttcccccgttatgtaattattctctataagaaaatgtaccgacgaggtaatttctctgacagtgccaactcgtttaagtaataccttgttattaattaattctttatgtgtatttaataatgattccgacatttccgtctgaataatgcctggtgcaaccgcattcacccgaatattcttggctgcgacttcaacagcaagtgcccgcgtcaatgattctattccgcctttggtggccgcataaattgactgacctttattgggccttttggctgaaatcgacgagatattgataatatgcccactacgctgaggtatcatcactttcaatacttcacggctacacaagatatagctcaataaattgttatttatcagtagttcaatatctttggtttccattgtggccaacaatccatctctggtaatccctgcgttattgaccagaagatcaattcggccaaacgcctcactcacggtattaataaatgtgctgacatcttccgctttggcaagatcggctctgattggcagtacgtcgggataatcgtgtgtcacttcagcgataaaatcggctgtttgaggcatttcatttcgataacaaaacgcgacccgatatcccttctccaacagacttagcactattgcccggccaatgcccttactgcctcccgttacgatggcacatttttttacggcgtcttgccctacctgtgtgttttcactcataagctagaattctctttgatatccgatagggtgaaatggtgtttcctcgcgatcgccataatgtcgagaacttgatgggtagagatatttccgtatgaaaaattatctttatgctgttccaacgccagcaaaatggtttccgtcatgcaggcataaagctgaccttctcccaaataggccctgacccgcggatctagactgtcatgatgaggagtctggacaattcctccccgcagtattttgatatccggtcggttcctcaaatcatcatcggaaaggttatgcggaacagaaatatcacaaacgatcgcatcccgttttatctggtctaccgatataaaggcttctgaggcattggcggcacacacaatgacatcactgtgctcaatatcagaaatactctgagaaatatggataaatacctgatcgggataatgctgaaccagatagtgatcaatggcttcacctatgctggttttaccctcattgaactggctaataaagtcatcatctggcatcaatgcaagacaatccacgatcctttgtgccaacccacccattaacggctgtttattgacaataaattgttcatagatatattgataaatatggtatttcacttcattcagttttctcactgaaccctgattattactgcctatcagcaccatttcctgatattgtggccccaaaatttctgcataaacccgaccgatattccctgcaccaccaatcaccgcaagccgcatttgggttatatctcgatgcgatgtacttctttgcaaggcttcaatcccaatccccacagtcaaagcattaccggtcgttatacctatctggttatttttcactgatttaccattattggtaataatcgatgtaaacatccccaacccaactaccgtattaccagactccacagcttgagcaatacgaacatcaatttcatgcctcaaccgcgccaaatcattttgggccagtgcagccttaatcatttttgatgtcacaggaatcggatacagcgtaaagtctaccgactgcccattaaccgagcttatacgtgcgggtttgaaaggtttagtcgccagattaaagctggtgctctcgacaaacgattccaattcttcatcgctgaaaatgctgaaagagggatcaacttctctgagccagtctgcagaaatcagatggttaatgaacgccgccttataatttgctgaactgccattttgttggcccacttccctgctacgataatcagcaggagtggattgattcaacttcccaaggataggggccacaatgaaccctgcattggcatggcgaatcgccagacaaactttggcaagctcatccacaaaccggacaatatcccgaagttccagaaaaacagagggttccatacggatcacattggacgcactacctgaaggcgcaacacggatatggctgccgcacagtaaataaccactgatgatatagcccaggctgccctgaacagcgatattttgcaaaatgtaagaatctgaatcatctacatcatggaattctaccccccagatcagcccttttccgcgcacatctcgaataatatcggggtagtcttctttcagggcatggagccgtaccttgaactcttcccccagttgggtgacttgcttaagtaactggcgctgatcagcatgcagtaagtttatatagtccaaagccacccggcaggaaaaatcatcctcaccaaacgttgagctttgaattaaatcaaaccccggagtaaaactctcctgacggatcgcaacaaccccgattttggcgtaccctccacccaatgctttggaaaggacataataatcagcatgaatacccacatcactggatgccaccagaaacccacaccgcccagatccagcctgcacttcatccgcaatgattggacatctaataatctgttttagttgattaactccgcttacctgctctgcactaagtgggtaaacgcccccctctccctgaacgggttctatcaacaatgcggcaacggttctaaatttctttttcgtcaggataatccggtcattttcttcctgtggcagccataaccaaccattcagaatgtcattggctttctctcccatctcaacaaactcagacagtttctcagtggaaaggaaataagtgttgattttcaggcgtttcaagtaatcacgatacatagtaccgtgtgtacagttcgccgttactatcatttttccatgaaaggcatgttcaagggcaagaaatgttggctttgaatctaaccgactctggttgaatgcagtcaacgcacgttggatatcttgggcagaagccttttcctctagttgcagctgctggcactgctcatctgtcagcgcaatcactgacccgccgtttattttagcagtagcctgtgcaacctcttgctccaaggctacaagctctgcattacgtgtgaattcgacacttttcagcgcaacttccatcgattctgctcctgtgctggtaaagcagaacacaaaatcgccgctggtcgcagtttcttccttcagtaattcattcaatctttctgccaagacggccgcaggctttctgatggaaaactggttatgaaccggtatctcttcatcaagatagtgcttaattctttctctgataagaagggaattgtggccaagcaatgtcgcaccatatcctcctaaaagatctaatacgggtatttcctgatcctgttcatctttgtaatacaaaaaattgcccgaagcccgatgataagttttgtctaaaccaatagaaaccaatgcacgggtaagcaatggcttacaaaacctagcgtaattttccattatagatccttaatatgtgaacctgcggttatatgaagctatggttgtgtggagctatggtttgagactagggctggcagtctcagtccgtacacaggctgacatatagtccgctatttcattgataaacaagacggcttcagcacaatgatttccttcacgatacattctgctcagagaggaaatatcgatggtcggataatcttgcagtgtcggtctttcacccttcgccagaataaaagtgacgccaaattccacaaagtcttcctcaccatcagattgagcatcatgagtgatatttcccatgccagaagccaccactaatgcatagtcaatcatgccgttgctcaggaataactcagcctcactgaatgctgacaacaaaccgatatttccacgtaaaaaagaagcacaatcgcattgcaggctcaattcttgggaaagcacacctagcaggttattactgagcgatagggtaattaagaaaggacttacctgtactgaattccagatagtttgataaatttcatgttcattctctgccccatgttcttcctgttcaggattcaattccgaaggcataggatgaagatagccatactgtgtggtatacaggccaaatcttttattaggatcagcgatatccaaaccggataacattaacgctcttcgcgctgaaataatgcctttttccgttccgatagaataaaaacgcctcaacttgtcatttttaatcagctcaccgccattattctcatgattcaagctattcaatgacggatgatgactagtcacattatagctaataagttttacgcctctatttatcaccgtaatcccctatcactaaacacgaattaatgccaccaaagccaaatgagtttgttatcgcattttttacggggaaaggcctgcccttctgtggaacataatccaaatcacacagtggatcaggcgtttcaagattgatggtaggaggaataaacttgtttttcaccgtcagaaccgttgctacagtttcaaccgctcccgctgcggctatccagtggcccaacatcgattttattgatgaaatcaggggcggctggctaccaaagatccgcttgataaccgcagtttccaactcatcattcaatggggttgatgtaccgtgggcattaacataatcaatctggtgaggttctaatccgctgtccctgatagccttcctgataacgttttccgccccaataccatcaggatggggagcggtcagcttataagcatcaagggaagcaccatatcctgtaatttcagcgtaaattttcgcgcctctgctcaacgcactttcttcactttcaaggactaagaaagcacccccttcgccagcaaccaaaccactgcgatttttatcaaaaggccgacaaaacctgtcaccccatttttctgttgtggcagttgctcccaacaaattcaacccgaccaaagtgcgcaggcttatgaccgaatcagcccctcccgctaacatcatggtggcctctccccttcgaatggactggcaggccagcccaatagcgtgagtcgcaccagcacaagccgcattgacattgacgacaggccccgctaaagcaagctggcgagcgatctccgttaccattccatcattactgcatcttatgcctgaataagtacccaaattattgcgttgctgcaacagggattgcataactggttcatgagaatgacggcacagatttctatcatcttcaagagtgctagaaaccccgctacacccataaattccgatgcgcttcccagcaagctgtgccggatgtagccccgcatcttccaatgccttggctgcagcaataattcccatcactccacgtctgtctgtcatcccggattccggcaggtacgcagagtgattggcaatcagtgaatcaaaatcaatctgtgcagcatatttgataggtaatgcgccattatctgcaaacgccagtggtttaacggcagattctccatcgcaaagtttttgccagaaaacatcaatatgagtcccgaaagcactgacgatccccatgcccgtgactacaacgcgacgatcagaaaccatcacaactccccctctttgggcatccccatgcgaagcaaaatggcaatgcattgattttccaaaccatgaaccacgactaacaccaaactaggcggcagtggacggatgaaattccgattgacgttatcaacactgatcccttttttatgcatgtcaatggccagattaatcgcaataaaaggtgcagcaggccctgaatatcccattgttttatcaagataaaattgtatagcatcaggaaaagtatcgcttgccagtgctatgaacccatcagtagcttttccaacatggatgatttggcatggcgataaattttcctccgtcaattcagtcagaaaacgctgatacggattattgttgtgaaaggctgtgttgtgcagaaatgaacgttcaaaacggaggatctcaccgtccgcattatgaacatcttcatgcagagtgataaatgccgccgcttctgctggtagccacggggtattttttatgaggcgttcgtatgcaaggtaataccacggtgaaattttctggctgcccccgccgcagagaacccattggctacgtttttctttaatactgtaatagccttccagaaatgcattgccacctgcatcaacatgaggagaaaaaaaaccattgtctccctgaatattaagatgttgagataaatggctggctgttgacgtatttaacagtgccaatcccattaatggaggtgtttcaaccaaggctctggaaacataactttcatcgtcctgtgcatcaaaggcaataggaagtatgtcatcatcagcatcactggttcctaatccgataaacaatcctcgttgttcaggcgaaattttatccccagtgctactttcccacgttttgatgccagaatagagcacccaccgactttgcgcattcgcaacccgccggacaatcttatccatacgtggcatgacaaaagccttatcgctaataagcctttcacctacgatattgggtaaatgaagtgaactatctgaacgttcagccgctgctatattaccctgtatcaggttgtccatattcaggccatcaggaagcaggctaactccactggcaatgtagattcccatttttcacccctcatgccgctttaatatcagactgctattttccccaccaaacccaaaggaattactcaagatgtgattaacgcgtttcacttttgcagtgctgttaacgttaaccaccccatctgttttccccgcctcagaaaaattaaggctgggaagaatgagttcattcttcagtgtttcaatggaaaggatggcttccaatagtccgctaacagcaagcgagtgccccatcgctgatttcgtggaaataaccaatgggttatgggggaaaagtgcattaatcgctttgctctcagcaagatcattattgacggttgatgtaccatgagaattaatgtgctcaatatcctccgctgataagcccgcatcttgcaatgcagcagacatgcagtcccggtaatatcgcccagagagatcggttgacgtcattttatacccttcggattgccgagacattcctgcaatttcagctatgatgttcgcctttctggcaatagcatgagaacaacgttctacaaccaaaaatgcagaagcatcagccagaacacaacctgacctatctttatcaaatgcccgtgaagattcgctcatatcggtaaatttaccgtcatacagcgctctgactttcttgaacaataattgcataatcgggtgggtggcttcttcagaagcaccaaccaatgcaatgtcaagcctgccactcttgaggtgctgataggccgaatagagtgcgaccatgccagctgtacaagcatcactataaattttgggtagtgttgagatatttaagctgtttgccagctcttcggcgatttcatatgggcgcatcagcgccccaaattgttcaatatcgatatattttgagggtgatattcctgaattgaaataacgggataatgcctcaccatcaacaaacatcttgttattggcaaaaaataactcacattgggattgatttaactccgtttgagtcaatcccgccatttgcaaactatttgatgcagcaccgcaagccatcaagaaaacacgattattggataattgtcctgtacagctgaattgactacgtaacctatctatatctttggaggataatttggcactcggaatatgggttattccatactcttttaataactcatcttcacagataagtgatttcccttccgatagagaattaaataaatcacttgggcaatcatgattgcgaacaattaaaccataaccggttacagcaatattatctgtactaataccagtcatagttatcttctattttaataatatattttattcaggttattttctattaatactgaattgtaattatttttatcttagccagttaatttcatgaattaagaaccttattatttaattaacatttctgaacaatatttttctatttcttccaggataatctcatccgcattttttccattcgactcgtaagtggctttacataatgaagcccaattgtgaacattggtttcaccaaatacgtcacccaaagtatgaatggtattcaactgttccggtgtataatcataacaactataaacaagtaatcctttgccttcttgagtaagagtatcctcagctaacagtcggttcagtacctcttcggaaagaacttcataagcatgggcaaaaacactttttgtcggcatcgtgattttaaatttcttaccaaggttaaatgacaaatcaataacatctaaagaatcggcacccaagtcattaattaatgaagaattttcatgaatagtattttcttcaacaaagagaattgaggataattcctcacataccgcagatacatattttttcatataacattcgcctacaaacgtatatttaacttaatggaataataaagtctcacaaactattccaccatgtcaataaataagaaaaccaatcctacaaacaaaaataaaaacaccattaattaaattaataacaaacaagaaagaatatattattttttttcaaatttgagatttggaataattatatataactattccaaaatgaaatcatgattaaatattcattattaacaataaataaatgaataaaaaaacaataataacaaattgttattttattcattttatcttaaataacaacaaattaataatattaacacaaaacattacaatggaatttaatttgttacttataataaatatgatataatatcaattattataattatcttaagaagaaaccaagttataattaattaaaatataaactgtcttatttggtatatcgtcatgaaaaaaatcatcaataacatccaagcttatataacaataacaaaattgcatcatttcattaacaatagaatatactgctggtgattcaatctttaatgaatgtaattcctatatcatatcgaaatgaattgatataaatctgaaaaaacatttaaataaagcgcaatatgtcctaattgtacattgtttaatttttttaaaaaaaccgattgatattgctcttccttattttaataaggcaggtattgttcaagttaaagcaatagccgatgtgcagcgaaagaatatgctagtgcagatattacggtgaacgcgtactgtccgggagagcatcaactttcttttggagatacaatggtagtttattttgaatatacaaaataaggtagataatttatctgagaaagagcataagccaatcctagcaaagctcatcaaaatatacatttgataagcctcagtgaacgttacccgatattttttacccattcacttcccaatacaaaaactcgaaaaaatcctgcccagcaaatcatccgaagtaaattcgccggtaatttcacacaatacctgttgcgccagtcgcaattcttccgccagcaattcccctgaacgggcaaaaaccagttgttgatggccttcctgcaaatgttctgccgccgtattcaatgcctgtaaatggcgacgacgggcgaggaagcccccttcggtattgctgttgaaacccatcgcctcttttagatgatcccgcagcaaatcaatacctttcccctcacgggcagagaggcggattaatgagtaaccacttacttctaatacgccggtttcttctccggtcatatcggtcttattgcggatcacggtaacaggcagtgatgcaggcagctttgccataaattccggccagattttcgcaggttcaacggcatccgtggtcgtgctatctaccataaacagcacgcgatccgcctgctcgatttcctgccatgcgcgttcgataccaatgcgttccacttcatcgctcgcttcgcgcagccccgccgtatcaataatatgcagcggcattccatcaacatgaatatgctcgcgcaaaacatcgcgggttgtacctgcaatatcggtgacaatcgcggcttcacggccagccaatgcgttgagcaaactggatttacccgcgtttggccgccccgcgataaccactttcattccttcacgcagcaagcttccctgacgagcttgtgaacgaacgtgaccaagctccgcaatcacctcatccaacttggcttctatcttgccatcggaaagaaaatcaatttcctcatcaggaaaatcaatcgccgcttcaacgtagatacgaaggttagtaagcgcttccaccatttggtggacgtgatgggaaaatgtcccttgcagagaattcatggctgaacgggcagcttgctcagaactggcatcaatcagatccgcaatcgcctcagcctgtgccaagtcgagtttgtcattcaaaaatgcacgttcagaaaattcacccggattggcaatacgcacagcagaaattgtcagaatacgttttaacagcaaatcaagaatgaccggcccaccgtgcccctgaagttccagcacatcttcgccggtaaaagagttggggccggggaagtaaagcgcgatgccttgatccagcacagttccatccacatcacggaagggcaagtaatccgcataacggggtttcggcaacttgcccaataccacctcagcaacttccgccgccttagggccagaaatacgcaggatgcctacaccgcctcgtcccggaggagtggcctgagcgactatcgtatcggtggtattcatgaaactctctcttttactaatcaactgaaataataaaggcggccaatgaccgccttctagttagctcttttaaagagctactttttttcgcgggtatgcaaaccgcgtttttccagactgcggaaaataacctgctgctggatgatggtgaccaagttactgacgatatagtacagcaccagaccagacgggaaccacaggaagaagacagtgaacattacgggcatgtaagtcatgatcttctgctgcatagggtcggttacggtcgttggtgacagtttctggatcacaaacatggtcgcacccatcagcaatggcagaatgtagtaagggtcttgtgcggacaagtcctcaatccaaccaatgaatggcgcatgacgcagctcaacagaacccatcagcatgtaatacaacgcaaggaagattggcatctgaatcaccagaggcagacagccgcccagtggattcactttttctgttttgtacagcgccatcatttcctgactcatgcgctgacgatcatcaccatgacgctcacgcatcgccgtaattttcggctgcaacagacgcattttcgccatggaggtgtattgcgccttagtcagcggatacatgataccgcgcacgataaaggtaatggcgatgatggagaagccccagttaccgatgaattcatgcaggaatttcagcaatttgaacagaggctgagaaataaaccacaaccagccgtaatcaacggtcagatccagatgtggagcaacttcagccattttgtcctgaatttcagggcctacccacagagtagaggagatattctgcttgctgttaggtgcgatattgacggtttcacctttgtacccgattatcgccattttctggcttttctggtcaatcgtgtagaaagtactggtagagtttgcgcccggcacccaagcagtggcgaaatattgctgcaacatcgctacccagccaccgttggtcgttacggctaacgctttatcttcaatatcgccgaatttgtatttttcgtattttgcttcagctgatgaataagcagcaccgcgataagtatgcagagcaaagttgctgctgccagtatcacgacttttcggcaactcaacactctgcttcaactgaccaaagaacgccatctgcaacggcttgtcagtcacgttatcgatgttgtaatcgacagaaaccgcgtaattaccgcgtttcaaaatgaaggttttgacataaacaacaccatctggtgcagtgtaagtcatcggaatacgcaattcattctgaccatcagccaaaacgtagctatcctgagtggtgtggtaaaacgggcgttcagcttgattatctgggccattggtgccagttaatccactttgagcctgataaatgaactcaggggtgctttcgagcagtttgaatggtttgtttgaaccgagggtatcaggataggccagcagatcagcctcttcgatatcaccgccacgggtattaatgtgcaaagaaagcacatccgttttcacggtgatcagtttaccttgcccactgcttgcttcgctactcggcgtatttgcttgttgcgtgatctgtgccgttggttgtgggttctgatctttctcccacgcctgccagaccaagaacgaaacaaacagcaaagcgatgaaaagaagattgcgttgcgaatccatcgttaatgttctctgttatcttcgttttttttaggtgggacaggatcatcaccaccttcgtgtaaggggtggcattttaatatgcgtttcactgttaaccaactgccttttatcattccaaacctgcgcagtgcctcaatgccatattgagaacaggtaggatgaaaacgacagcgaggccccaacagtgggctgatcaccaactggtagcccctgattatcgcaatcaagagccgcgaaccaagcgacagtgacgacgccataatttgcccaacgcctccgttagctcacgattatcaagctcagcaacccccttcctcaccaaaaccacaaaatccatggaaggcaatttatgctggtttaaacgaaaactttcacgagccaatcgcttgatacgattacgctcatgggcgcgtttaacattttttttggcgacggttagaccgatgcggggatgccccagctcattaaggcgcccaagaatggttatctctgcggagcttgcccgttgtggctgctggaaaacataagtgaaatgctcgggagttaacaaacgtaactccctcggaaaagcgagcttaaccacgtggtatgattagctttattacttagaaacagtcagacgagtacggcctttcgcacgacggcgagccagaacttgacgaccatttttggtggccatacgagagcggaagccgtgtgtacggttacgcttcagtacggacggttggaaagtgcgtttcatagcgatttctacctaacttaaaatttgttactgattcagcaaattcgttggcgaccagtgagaaataagtagacaccgatgcctcagtcgcaacatcaatatatagaaagaggcaggattgtaataaaatgtactacccctagtcaatccatcaatctaagatgacgcgagcctgaccgctttcctgtcggttttttttactttaaccagacattaccagacttttgctacccgaggtgctcacccaaaacttaaccagccatagccggaaaaaatcgttggcataacacgcagggtggaggattatacggactgtgtaataaagcgcaaggatcatacaccgatccttacaccttaatcgtgatcatcatgttgttttcacttcatattttaaacaatagctaaatggaatttgctatataccatgattacactacagtatcttctacgagccttatattctccgagtgccaaagcgtggcgatctccctgtggataaaaagcgtcaaagctgtgtaaaagaatgaagatctataccgtcttttgcgttatgatcaccgatcccgatctcactatacggatcgttgggggagcgatgatagtaaaaatcgccacaaggtacatgcgaccttcctcatcatcgggggaatgacgctttatacccagtataacgtatctattattccgatttcttttattggtcttgttttaggggagttcgccgtgtcactttcgctttggcagcaatgtcttgcccgattgcaggatgagttacctgccacagaattcagtatgtggatacgaccccttcaggcagaactgagtgataacactttggctctctatgcccccaaccgtttcgtgctggattgggtaagagagaaatatatcaacaatatcaatttgttattaaatgatttctgtggccctgaagtaccgttactgcgttttgaagtcggtaataagcctgtttcaccgaaccagtctacatctcagaaaatcattgccaacatgccgatagctactgcgccgtccagtttatctgtacgcccaagctgggataatgcaaaagcccagccagagttatcctatcgttccaatgtgaacccaaaacatacgtttgataactttgttgaaggtaaatccaaccagctcgccagagctgcagcccgacaagttgccgataatccgggaggcgcatacaatccgctgttcctctatggcggcaccggcttgggtaaaactcaccttttgcatgccgtcggcaatagcatcatggcgcgcaaagccaatgcaaaagtggtatacatgcattctgaacgttttgttcaggatatggtaaaagcattgcaaaacaatgcgatagaagaatttaaacgttattatcgctcagtggatgccctgctgatcgatgatattcaattttttgcgaataaagagcgatcccaagaagaattctttcacacgttcaatgccctgctggaaggtaatcaacagattattctgacatcagatcgctatccaaaagagatcaatggcgtcgaagatcggttaaaatcacgttttggctgggggctgaccgttgccatcgagccaccagaactggaaacacgcgttgcctttctgatgaaaaaagctgacgagaaccaaatccagttacggggtgaagtggctttctttattgccaaacgcctgcgatccaacgttcgtgagctcgaaggcgctttgaacagggtcatcgccaacgccaattttaccgggcgggcgattaccattgattttgtacgcgaagcactacgtgacttattggctctacaggaaaagctggtaactattgataatattcagaaaacagtcgctgaatattacaaaatcaaggttgctgatctgctttccaaacgccgttcacgctccgttgcccgcccaagacaaatggcaatggcgctggcaaaagagctgacgaatcacagtttgcctgaaatcggggatgcctttggtggacgtgaccatacaacagtccttcacgcatgtcgtaaaatcgaacagctgcgtgaggaaagtcatgacatcaaagaagatttttctaacttaatcagaacattatcttcctagcgctatgaaatttatcattgaacgtgagcaattattaaaacccttacagcaggttagcagtcccttgggtggccgccctaccctgccaattttgggcaacttgttgttgcaggtgacggaaggttccctgttgctaacaggtacagatttagaaatggaaatgaaggcacgggttgcgctgtctcagccgcatgaacagggcgcaacaaccatccccgcgcgtaaattttttgatatctggcgagggttgcctgacggagcggaaatcagtgttgaactggatggcgatcgcattctggttcgctctggccgcagccgtttttcactgtctaccctgccggcttcagattttcccaatcttgatgactggcagagcgaagtcgaattttctctgccacaggcaacactgaaacgtctgattgaatccacccagttttcaatggcacatcaggatgtgcgctattacttgaacggcatgctgtttgaaaccgaagaggaagaactgcgtaccgttgcaacagacggccaccgtctggcagtctgctctatgaatatcggccagaacctgccttcccattcggtgatcgttccccgtaaaggcgtcattgaattgatgcggctgctcgatggcggcgatagcccgctgcaattgcagattggcagtaataacattcgcgctcatgtcggtgatttcgtcttcacatccaagctggtggacgggcgctttcctgattaccgccgcgtactgcccaaaaacccagataaaacgctggaagcaaactgtgacgtgcttaagcaggcattttcacgggcggcgattttatccaacgaaaaattccgtggtgttcgtatctatttaagcgaaaaccaactcagaattaccgcaaacaacccggaacaggaagaagcggaagagattgtcgatgtcagctaccaaggcactgaaatggaaattggcttcaatgtcagctatgtgctggatgtcctgaatgcattgaaatgcgagcaggtaagtctcttgctgacggatgccacctccagtgtgaaaatagagaattcagccagtcaggccgcgacttatgtcgtgatgcctatgcgcctgtaaccacattaactcattttatgattctctcgcgtttgctgatccgcgattttcgtaatatcgcgaatgccgatctgactttggcaaccggttttaattttctggttgggccaaatggcagtggtaaaacaagtatactggaagccatttatacattgggccatgggcgggcttttcgcagcattcaggcgggaagggtgatccgccatgattgtgaagaattcattcttcatgggcggctggaacagcaattccacgaacggatcttggcggtagggctgagtaaaaaccgtctgggtgacagcaaagtcaggatcgatggcagtgacgggcataaaattgccgaactggcgaaaatgctgccgatgcaacttatcacgccagaaggttttacgctgctaaacggtggccctaaataccgccgcgcttttattgactggggctgttttcacaatgagccgcgtttttttactgcctgggtcaacctgaaaaggctgctcaaacagcgaaatgcggcattgcgacaagtgacctgctacagccaaatccaacactgggatcgtgagcttgcaccgctagcgactgaaataagccaatggcgggctgaatacattgcaggtattgctgaagatatcgagaaaacctgcaaacaatttttacctgaattcaccctcagcatcagcttccagcagggctgggacaaagagagtgaatatgcagaactgctcgcgcggcaattcgagcgcgacagaacgttaacctacaccgcttccggcccccataaagccgatctacggatcagggtggacggcacaccggtagaagatatgctctcccgtggtcagttgaaattactgatgtgcgcgttgaggttagcgcagggtgaatatttcacccgacagagcgggcaaaaatgcctgtatctgcttgatgattttgcttctgaactggatgccggccgtcgtcaactgttagccgagcgtctaaaatctacgcaggctcaggtatttgtcagtgcaatcacgcttgggcaagttacagacatgattgatgtaaatagcaggatgtttcgcgtagaacatggcaaaatcgaggttcaaccacaggattaagatgagcgagaaacgttgatgtcgaatacatatgactcctcaagtatcaaggtattaaaagggctggatgccgtccgtaaacgtccaggcatgtatatcggtgataccgatgatggtaccggcctgcaccacatggtcttcgaggttgttgacaacgctatcgacgaagccctcgcaggtcattgtgacaaaatacttgtcaccatccatacagataactctgtttctgttcaggatgatggccgcggtattcctaccggcatacacgaagaagaaggtgtttcagcagcggaagtcatcatgaccgtgctgcatgcggggggtaaattcgatgacaactcctataaagtttccggcggtctgcatggtgtaggggtttctgttgttaacgccttatctgaaaaactggaactgactatccgtcgtgacggcaaagtccacgaacaaacctaccagcatggggttccacaggccccgttgaaaatggtcggagatactgagcagactgggacaactgtccgtttctggccaagtatggacacgttcaagctcaacaccgaattcgaatatgatattctggcgaaacgcctgcgcgagctgtcattcctgaactccggcgtttccatccgtttagtcgacagacgcactaatgcagaagaccatttccattatgaaggtggtatcaaagcgtttgttgaattcctgagccgcaataaaacgcctattcaccctaatgtcttctatttttccacggaaaaagacggtattggcgtggaaatttccatgcagtggaatgacggttttcaggaaaacatttactgtttcaccaacaacattcctcagcgcgatggaggagcccacttggttggtttccgtgccgcgatgactcgtaccctcaacagctacatggataaagaaggttacaacaaaaaatccaaagttagcgccacgggtgatgatgcccgcgaaggcttgattgcagttatttccgtcaaagtccctgatccgaaattctcttcccagactaaagacaagctggtttcttctgaagtgaagactgcggttgaaacccagatgaatgagaagctggtagaatacctgctggaaaacccgaacgatgccaaaacggtcgtcggcaaaatcattgatgccgctcgtgcccgtgaagcggcgcgtaaagcccgtgaaatgacccgccgcaaaggcgcactggatctggcaggtctgccgggcaaactggctgactgtcaggagcgtgatcctgctctgtccgaactctacctggtggagggtgattctgcgggagggtcagcaaaacaggggcgcaaccgtaaaaatcaggcgatcctgccactgaaaggtaagatcctgaacgttgaaaaagcgcgttttgacaagatgttgtcttcacaggaagtcgcaacgttaatcaccgcactgggctgcggtattggccgtgatgaatacaacccggacaaactgcgttatcacagcattatcatcatgaccgacgccgatgtcgatggttcccacatccgtaccctgctactgacgttcttctaccgccagatgcctgagatcattgagcgtggctatgtctatatcgcccagccacctctgtacaaagtgaaaaaaggcaaacaagagcaatacatcaaagatgacgatgccatggaagcctaccagatgtcgattgcactggatggcgcatctctctacaccaatcagcacgcgccagcactgaaaggcgaagcgttggaaaaactggtcactgagttcaatgccagtaacaaaatcattaaacgcatggaacgcctgtatccgcaggctttactgaataatctgatttaccacccgacactgaccgaagatgccttgaacgatcaggcaaaagtggaagaatgggtgagtacgctggctattcgtctaaatgataaagagcagcatggcagcacttatagctatcaaatccatgagaaccgtgagcgtcagatttatgaacccgttctgtgtatccgtacacatggcgttgataccaactacaatctggatttcgatttcatccacgggggcgaataccgccgcatcaccaagctgggagaattgattggcaacctgattgaagaagatgcatacattgaacgtggcgaacgtcgtcaacccgtgagtaactttgaacaggcattagaatggctgagtaaagaatcacgccgtggcctttccatccaacgctataaaggtctgggagaaatgaaccctgatcaattgtgggaaaccaccatgaacccagaaacccgccgcatgatgcgtgtaacagtgaaggatgcgattgctaccgatctactgtttacgactctgatgggagatgcggttgaacctcgccgtgcatttatcgaagagaatgccctgaaagccgcgaatattgatatttaatcgtccttatcccagatagttttccactatctggctgggatacaaaaaatccttaatctggctcacctttcaacacaaggtgagccagatttattttatcggttctttattgttggctaccttataaatgcgtactcattaggctttgattatgtaattcaatcgttttcataaatcttgaacttgccccgtgctcactcccgatataatccccactaattattcccgcatgagggatcttatcgacagcatcagccaaaatgcccttatttttagataagtaacgttttacccctgaagtcaattgcccacgcccaggagaggcaaatggaatattcgtttgaataacattaagctggctgtcaggcgctggggttgcatgatactcactcaaaaactcggctgtctccgttgcgctcgctctattagcccactgagtatgaacttgttctttgtatttccaatgggactcagttccatcatagccatgaaccataagccctatgttttttcctttactcagtaaatcaaccgttgcttcacctaaactcgatgtatcatcaggtgtaataagattattacggtgggtagtgagtacatcctgtaaaaatgtatctgaagccgatgttctagacgttgctttcttctttccttcccctttaaataccattttgagcacatagaaattattagtatcttttcctgcatgctccaatagtgccttaacatcggcagtggcatcacctcctgcaacgctagggccatggaaaaaaccaaatgaaccatctttgcgctgtgctactcgaatatcgaagtacctagcacccgcttctgcttgctccttcaaggttagattttgagttttaaatgctcggggcaatagtgctcctaaactcattgagaatccgcttttttgccctactgtaggcataagtgcctgcgtcatggctgcccagcattgctatctgagataacttagtatccgcaggtaactcattatgatttatgggaaggtttccagtcggatcaaataatgtaataggattatttctcaccattcggaacaggttcaacccgtccactgttcccgcaggatcggcacttaaccaacgcgctgtccacggttggaacggtatccatagtagtacaaccccgttgcatcccgctccttgcccgaatatcggatggtcttgtagtccgcttctgtctggcttctggctgtccacaccgccgtgccgccatacggatagtattcttccagactgatgatctgcccgtcaccgcccacttccagtccgctgctccccaccagattatcgtagctgtagcgtatctggttgttactgagcgcatccggtttgccgctttcccagtgcagtacccgcacttgcgcccgccccgcctcaccgaccttaatgatttgaagtacttccttttccacatcgccgttttttgtggtgcgcagctccagctccggcagataaagcacccgctgttgctgttggctgccaccagtctgctgcgtactgactttcaccacacgctgattactgccatcataaagataactttccctgtctggttgaccagataaacgatttacccgtgtcacttgttgcaactcccccctcatcgtccaatccaatctctgccctggcattaattgcagttgagaccctgccttatcaaaaaaagtatctacttttgatggtatgtctgtcagtgtgctgagtacggcatggttattacgttcggagacagtaatagcagtagtgtagttgtgaccggttgccggcgcgctgtggcgtatctgggttagattgttaccacggtcatacgtgtaagtgcgggtgtagttagtgtaagtgctgctgtcagtatccagaggaataatcggtgtcggcaattgattagtttgctgcccaattgatacaggctgtcgtaaaacataaatcgctttagcatctaccttctgattgcgccaaaagcgggtagcgtcagcatcgacactatcagtacgtaggacatcaccggtgagggaggagagataagtgaaattgggattaatcgcttggttcgactgctgcaattcagccaggcgcggatcaatactcgtgctcaaactgccgggggcgttaaaccggtagcgagtgatacgatcatcgatgtgatctggctgatcaggatgacaatgataatggatatcacgcacagtcagcatccggttatcctgcacggtgaccactggcgttttgtggtgaacctgaaggtttttatttatcatatccatgctccgcagccccatttcccacaaactaaactatgtcaagttttgtcatggctaggggtcgttaaaaaggttgtgtgatttattgataaccacctgaatttcacttcagaaggaaactcagtgtctgaggcacgagcaaagtttttgtcaaaggaaacctcatcgtggagatcctcaggcaagattaatttagaagaactttactgtcacgtcgatgacttttgccaaaaacttattcctctctggcatcagcaattgattggatacgggtgactcaagcgttatcggccggcttccctttttctcagtgaagccatgaatagcctcactttatttcatataagatatcaaaaattcttatgtttctcatattaagcactatattagtgacgatttccgggattggtcagtgacactcggatgttaacgctgaaaagaagggcgctcattcccttgtataccttccttttatcacgcaaagcaccgcagttaactcggtttcttactggaaattgtatcagggttaattgcttatacgttccaaccgaaaaaaccgggcttgaatctgcgggcttctgaaatcactgttcttaaacagagttgaaattacagcaaaatacgcagcatacggcgcagaggctccgccgctccccacaacaattggtcaccaacggtaaaggctgacagatattccggccccatattcagcttacgcagacgtccaacgggcgcattcagtgtccccgtaaccgcagccggggttaattcacgcatgctcaattcacgatcatttgggataacgcgaacccaatcattatgggaagccagcagcgtttcaatttcatggatggaaatatcttttttcaatttcagggtaaatgcctgactatggcaacgcagcgctccaatacgaacacacaggccatcaacaggaatgatattattgcctgtattgaggatcttgttggtttcagcctgccctttccactcttcacggctctgcccattgtccaactgtttatcaatccacggaattaggctacctgccagcggaacaccaaattgatccgtcgacaatgcgccactgcgagtgaaatctgttacacgcttttcgatatccaaaattgcagaagccgggttttgcagctcactttcaacctgattatgcagcatgcccatttgcaccagcagctcacgcatatgacgagcaccgccgccagaagccgcctgataagtcgcgactgatgcccactcaaccagattattggcaaacagtccccccagagacatcaacatcaaactgacagtacagttgccgccaacaaaggttttaatgcctttattcagactatcctgaatatgctgatggttgacgggatcgagaataataatggcatcatcgctcatacgcagcgcagaagccgcatcaatccaatacccctgccagcctgtctccttcagtttgggataaatttcattggtataatccccaccttggcagctaatgataatatccagcgcattcagtgcctcaatatcaaaagcatcctgcaaaatgcccgctttcccggtaaagtcgggcgcgggttgcccatgctgggatgttgtgaagaagacgggattgatctggtcaaaatcacgctcttccaccatacgctgcatcaatactgagccgaccataccacgccagccgatcaaacctacatttttcatcatgtttaccctgtcttgaaagatatccgtcagctaccctgacttgtattaaagctgacaaaatatgataaaaggtgcaagtaaatttatatgctatggcaaccgtatttcagcaaagatccgcttaccatttacggggaaaatatcagtgaaatacagctggaacggcctgagctgagtcggttactgaaggactgtcatcctgctgattgaacagatagacaatctgacccgcctgagtaacagcaactgaataaccctcaaatatccccccgtaacaaaagctgtaataacggcaattagcaacatgctgatagacttgatgacaacaatgacccataaaaacgggcttagtcgcagggagcgtcagaaacagggttcggatactgggaaaatataaagggaaacaggctgatctggaacatcacagagaaaggtatgttccttatcacgattaatcatccagatcatactgaaaaacaacattactattactcataccatagaaaatataataattataaggatgaagaatgcttaataatataattccaccatccgaaatgaaactgttttgaccttcacaaatttctactggtcattgaccactatatataaagaagcaatacatgcgggtctttgtatagtggaaacacgtgaaataaaaaagcctcttgactgtatctatcatatttacaaatcatcctaaaaaagagcttgccatgaataagaactgcaaacgttatacagaatggtggttggagcaggaaaaattaagaacgaatgatgaaaccccggtaaaaatcacactggcaggaattaagttatctgttattcctcaagtatttcttccatctccattacaaacgcactctacaccattacttataaaaaacattatagatcatgattttactgggaaaaaagttcttgatataggaactggcagtggtattcttgctatttactctgcccttaatggtgcatctttggtagtagcaacagatatcaatgataatatattacaccatgctaaaagtaatgcttatctgaataaggttactgatatccattttataaatagtaatatctttgagtctattgatggtaaatatgactatatattcgccaatgggcccatttctcctgagtcttggtcagaaaaaacactttccgggcatacaatatcgagttacggagaaactatttttagtcagtatcgtaactatctgataaatgaaggggtaatgtttatgacattcgcagagtttggctcaacagagatattctacaagacacttcaaaaaaattccgttatgcacagagaaaaaagagaaacaaaatttggcgtatggtggagttttcacgaaataaaaaaataaaactgatgagaagccctaactcaacaccgacttatctggaggtatttatcctattgacatttactacagttatatttatttgtaattttttactgttgattccaatccagacaataaataatgttaccactataaaaacaaaatattcaaataataacaatcaatatataacaaacagattttataattccagtacaaataatagaatatcaacagcattgtaatcaatatcattttaaagttaaataagataatcacttaatatatacaaaaataaattaatttacatcaatgatatatatatttaagcacacaaccaaaattattgtgctaaaataaaattcaaatctcatatgtaaatcagtgaatccaaatatttcaggacatgggatcaatttttataattacattttttcaaggccagagtcaattttgatttctcataaataataaggcaataacacagtgaaattatggctaaaaaaacgccttagtatactaatcggattaacagcaatacttatcttcgttcacttgatcagtaccctgaccggtagtgcattgaatcatttcggtatcattcccagatacttccaaggcctgatcggtattccgctatccccatttctacacggtagctggaaacacttgttcagtaatcttcctgcattattgatgctaagtacgttactgatgacccactccattcgctattatgttcttgccagtctgtttattatctttatggaagggacactggtctggttatttggccgaacatctattcatattggtgccagcggctggatttttgggctgtggggattattgctggccaatgctttcttccagaggagagcaaaagatttcttctttgccattctggtctttgtgtattacggtgggatcgcctttggcttgttaccatggcaagaagatgtttcaacggaagggcatatttttggcgctattgcggggctggttttttcttggctcaccaagaaatggattatcacgaaccgttaaacaccgtaaaccctcgtccagtgcgagggtgtcgcaaaaggacgggggccgtcactaaaaatagatacaaaatacggctatcagccgtattttaaattattcccatctcagtgccgtatcatctacaggctgtcccaatacctctttatcctttttataatcatgtggaacatgccaattcgggctgcgcccctgacgaggaagaccttcatcacctcgcctcacataacccgattgtaactcaccaaaaatgttttcgtgtttcaacatttcatccggctgagcataagctgtcacagacttagcaccacgacgatccatctctttcagtaatcggcaaacataatctgcggatagatccactttcaatgtccaagaactgttgatatagccaaacaaataagcaaaattcggaatatcctgtatcaacgttcccttgtagagcatacgattattgccctgcagtttttgctcatcaatagaaatttcaactccaccaagagagcgtaatttcagacctgtagcagaaacgatgatatccgccggcaactccttgccagattgcagtaaaatgccattttcagtaaagcgtttaacctggtcggtcacaatagaggatttgccttctttcagtgactttaaaaaattaccattggggatcacacacaaccgttcatcccaaggcatgtactttggtgtaaggtgattcatattaaaacttggcccaacccttttgcgggctgacgacaataaaaacgatttcaacagcgtaggtaaatgtcggctggttttataaagtaaacggtgcataaagatattacgatttcggctgaatgagtaaacccagcgttttggtataaatttacttaaaaactcagcgattttatctgttccgggtacagacaaataataactgggggagcgctgtagcatagtgacatgttcggcaatatttgccattgttggaactaacgtggctgctgtcgccccactaccaataacaacaacccgtttccctttatagtctaacccttcaggccaatactggggatgaataacgggccctttgaaatcctcaataccggggaattcaggtaaatacgcttcatcatagttgtaataacccgtcgccgcgaccagataattacaggtaaaagttcgagtttctccactcgtctcctcaacagcggtaatgctccattggttagtcgtgccagaccagtccgcatgagtaatttttaacccaaactggatttttttatcaattccatactcttttgccgttttattgacgtagtttttaattgactcgccatcggcaaaaacactggtttcagaccaaggccggaatttataaccaaaagtcatcatatctgaatctgaacggatgcccggataacgaaataaatcccaagtccctccgatagcatgacggcgctctaaaataatcacctttttatcgggacattctcttgttaaatgacatgccataccaatgccagcaaccccggcccccatgatcaaaacatcatactggttactcataattgtctctcctacaaggttctcttttaatgaaataagtttccctcaatcaagacatgttattttttatttaataggacaaccatttgtatttatgagataggggtatcatagttagagacagggaattattgctaccgaccagacgcatggctaaagcaacctgaatataaccagtaaaatgagaactgtttttgaaatacattttctctattaaccaacagaacgcggatacagtttttcataatatccatccaacgattcactgctcatcttgcaaagatgcataaaattaggcgttttaataatcaaaatggaacagaataacaatatcaatgacatgccaagcagaatgctgttaacacttagaaactggatactgtaagtagaaaataacattcccaatggaatggggataatgcacagagataaaaatacagattccatggagtgcctttgtgaagaaggtgttgccgtcatcctgatagatgttgtgtttatgttataaataacaacgccaatgcctgcaatcaacatggatatattgatatgaatatttgactgcgatatggatacgccgaaaataccaagtgaaactaaaatagttccagtcaatgatgcataacctttaccgagcatctgattgaaaaattttactaaaacgctactccccaagaacattcccgcaccaaagaaaaactcagctacccccaagtcaaatgcacctagtttcatcgtattgatgatcaaaaaaggaataaagtaagaaaccaatgggacgatgacaaaattaaaaacaccagaaattgcacctaaccttaattctgtagggttgttctttaagatctttaaactcacctttgatgtatcagcttttttttctgatggcatcatagaaacccaaagaaaacctaagaaagagatgacgacactgcaaaatacaatgacgagtatatgcccatatgcaagataactaattaatattccagagatagccgggcctgatacaacgttcagtgaactgaccaaccctctagctctgaaagcaagatcggtgtttgtattatgcaatattcggctgatgatactgtttccaatcggttgggtcagtatagagaacagagatgtaacgataaaaaatattccccagtaaaagtagtttttactttcaataaagtacaggctggagataataagtaagcttaaaatacagaatgaaatcaaatagaatttagttgaaaacttgtcaccatacaaaccgaaagcaagcaaagtaatcacctgcaatgcccacgatataaaaagaaaatagcctaactcaacgaccaatccgagttgattaagcataatccatgtaaacaacattcctattgttttaatggagatagtgaataaaacatcactgacttggtatataacaaagttggtaacgctatactttttcatcaagttcattatcaaatttttcctttacttcattgaagcctgttactgcatttatgattttagttaatactggaaagtgcgtttttaatcatcacatttccagtaaaataaatatccatctattaagtttaacaaactaaaaaaatattagataaagaatgatagaataatgagttataaaatttaaaacacaaatatcttttaaagacataacagcagacagataattatgctatcatagatggagttaacttaattataaagataaatattacattctcatattattatggaaattatgtaaagtacaaaaatacataaaataaaaataactgcaaaaaagataattcctaccaatatatctgtaaaaataataagtaacgtaacaaataaaactaaaattactattgcaataataaaaatccaaaaaaactcttcggaacagtctaaaaataaatcttttaaccagtcgtaattaaacttttttttgtttttattcgaaaacatttatttactccaaattgatataatcaactaaattaataatgttgattgtattcattattttattaataaggctaacatcttttaataaaacaatacaatataaattaaaaaaatactcattcaatatcaaataatgtcagataaagagtcgtttttatttttattctgtataattttccaaagataatggacgaataaaatattctacatattattcagatagaacatgatgaattctagatttcaccataaaaaaatccggtcagcttttaatcagcataaccggatttagaaagtttgaaactttaatatcgcggttgcaaaccgtgttgtacgcctacattaacagcgtactacgacaccatttactctaccgtcactgacttcgccaagttacgcggctgatcaacatccgttcccttgatcaaggcaacgtggtaagacagtaattgcagtggtacggtatagaagatcggcgcgatcagatcttccacgtgtggcaaagagatgatcttcatattttcgctgttggtaaaacctgcatcctgatcagcgaacacatacaactggccgccacgggcgcggacttcttcgatgttagatttcagtttttccagcagttcattgtttggtgcaacaatgatcactggcatatccgcatcgatcaatgccaacgggccatgtttcaattcaccggcagcataggcttccgcgtgaatgtaagagatctctttcagtttcagtgcgccttcaaccgcgatcgggtattgatcgccacggccaaggaacagggcgtgatgtttctcagagaaatcttctgccagtgcttcaatgactttgtctttagacaacatgctttcaatgcggcttggcaatgcttgcagtgcgtgaacaacatcttgttctaatgctgcgtcagcacctttcaggcgccccatgtaagccaccagcatcaataatacggtcagctgggtggtaaatgctttggtagatgcaacgccgatttctgctcctgctttggtcatcagggcaaagtctgattcacgtaccagagaggagccggcaacgttacagatgaccagcgaagtcaaatagcccagttctttggataaacgcagtgcagccaaagtatcagccgtttcaccagactgagacaaagtgatcagtaaacttcccttacgacgtgctggcttgcggtaacgaaattcagaggcgatttccacatcacagggaatacctgccaaagattcaaaccagtagcgtgaaaccatgcccgcattgtaagacgtaccgcaggcaacgatttgaatgtgttcaacctgagacagtaattccgcagcattagcgcccagctctgacagatctatctgaccatgacttaaacgcccttccagcgtgctcttaattgccatcggttgttcgtagatctctttttgcatgtagtgacggtaaatacctttgtcacctgcatcatactgaacgttggattcaatctgctcgcgctcaacggctgcacctgtgacatcaaagatgcgaacggtacgacgggtgatctcaacgatgtcaccctcttccagatagataaagcggcgagtcaccggcaataacgccaattgatcagatgcgaggaagttttcaccaacgccaaggccaatcaccagcgggctgccagaacgagcggccaccagcacatcagggtgacggctgtccataattacggtgccataagcgccacgtaactgtgggatcacacgctgaaccacttccagcagcgcccccccctgtttctgttcccagtggataagatgggcgatagtttcggtatctgtatcagaaaagaaggtataaccgcgctcttttaataattcgcgcagtgcttcatggttttcaataatgccgttatgtacaaccgcaatatgttcagaaacatgaggatgggcattgcgctcattcggctcaccgtgcgtcgcccaacgagtatgagcgatccccgtaccaccaatgacaagctgtttatctgcttcatcagccagcacctgtactttgccgacttcacgcagacaggtcatacggttttcactgtcaaccaccgctagaccggctgagtcataaccacggtattccaggcgacgaagaccttcgatcagtatttctgcaatatcacgttgtgctactgctccaacaattccacacatgtgttttattcctaaaaacagggctgataaaagccccttttatgtcgctaacctgattgtgttccggctttgccggtccccgagctttgtagaagtggggattatttttatatttattttttcttaacaggacgttgccagtcctgaatatgcgtttgtttcacgcggctgatgaccagctcattttcagcgacgttttttgttactgtggtgcctgcaccaatggtcgcgcctttagctactgtgaccggtgcgacaagctgggtatcggaacccacaaacacgtcatcaccgatgatggttttaaatttattagcaccatcgtagttacaagtgatcgttcccgcaccaatattcacattattgccgatttcagaatcgccaagatacgtcaggtgacccgccttggaacctttaccaagggaggtttttttcatttccacaaaattgccaacatgcgctttttccgccagtttagaccccggacgtaaacgagcaaaaggcccaaccgtacattcggtagcaatttcagcattttcgatcacagtataagggctgatgaccgtgccatcaccgataacgcagtttttcaaaatgcagccagatccaatatgcacgttatttcccaatgcaacatgaccttcgataatgacattggtatcgataaccacatcacggccatgttctaatgtaccgcgaagatcgaaccgggcagggtccagcagcattacacctgccagcaataatttttctgctcgctctgattggtaaatacgttccagtgtggaaagctgaaggcgattgttaaccccttccatctcacttaaacggctcggatgaacagccttgatttggcggccttctttgtgagccagagcaataatatcagtaatgtagtattcaccctgagcgttgttgttatccagctgggataaccagcgcttcaaatcaccgccattcgccaccaaaataccggtgttgatttcgttgattttacgctgctcgtcagtcgcatctttctgttcgataatcccggccacttcgccattttcacgaatgatacggccatatccggcaggattattcaaaatagcagtcaataagccaataccgccttcaggtttgatttccaccagacgctctaatgtgtcttgagcgatcaaaggaacatcgccatagagcatcagaatgtcttcatcatctgcaaaatgtggcgctgcctgctgcattgcatggccagttccaagctgttccgcctgtagtacccagttaaggttttgattggagagagtctgcttcatcagatcaccaccatgcccatagaccaaatgaacattttgggtgcccaacgccattgcggtgtcaatgacatgctgaaccatcggtttaccggccagcgagtgcagaaccttggggagagcagaatacatgcgcgtgcctttgccagcggcaaggatcacgacactttttgcgctatttgcactaatagacataataaacctgacagctccaattttaagtatgaaagtaaacctgtttgcaaaataaattgctacatatttcgcaatgcaaaaaagccagttagctttcaccaactggctttttatcttactgcctatattacatccgttgttttgtcagttcgattacacgaagttttgcaatcgctttcgacaattcagcagatgcctgagcataatcaacatcgccgtgagaattacgaacgtgttcttcagcctcgcgcttcgcttcaagcgccttggcttcgtccaaatccttaccacggatcgctgtatcggccagtacgataacgccgtttggctgaacttcaagaactccaccggacaggtagataaattcttcttcaccaaactgcttaacaatacgtatcatgcccggttttatggcagtaagcagtggtgtgtgctgaggataaatacccaactcaccttcactgccagtcacctgaattttttgtaccagcccttcaaacaatcgtttttcagcgctgactacgttcaggaagaacgtcattgcagccatatcaacctcccgtcagccgtattacatcttcttcgctttttctacagcttcgtcgatggtaccaaccatgtagaacgcctgttctggcaggtggtcataatcaccgtccaggatgcccttaaagccacgaatggtttctttcagagagacgaacttacctggtgagccagtgaagacttctgcaacgaagaatggctgagacaagaagcgctggatcttacgggcacgtgccacaaccagtttatcttcttcagacagttcatccatacccagaatcgcgatgatgtctttcagttcctgataacgctgcaggatagactgtacaccacgcgccacatcatagtgctcctgaccaacaaccaatgggtcaagctgacgactggttgaatccagtggatcaaccgccgggtaaatacccagtgaagcaatctgacggctcaatacgacggttgcatccaagtgagcaaaggttgtcgctggtgatgggtcagtcaagtcatccgcagggacgtaaaccgcctgtacggaagtgatggagcccgttttggttgaagtgatacgttcctgaagaacgcccatctcttccgccaatgtcggctgataacctaccgcagatggcatacgacccaacagggcagatacttctgttcctgccagggtataacggtaaatgttatcgacgaacaacagaacgtcacggccttcatcacggaatttctcagccatagtcagacccgtcagtgctacacgcagacggtttcctggtggctcattcatctgaccatataccagagatactttatccagtacgtttgaatcggtcatttcatgatagaagtcgttaccttcacgggtacgttcacccacaccggcaaatacagagtaaccggagtgttcgatagcgatgttacggatcagttccatcatgttgacggttttacctacacccgcaccaccgaacagaccaactttaccacccttagcaaatgggcagatcaagtccataaccttgataccggtttccagcagttcctgagagctggacaactcttcatagcttggtgctgtacggtgaatcgaccagcgctcttcttcgccaatctcacctttcatgtcgattggatcacccaatacgttcatgatacggcccagtgtcgctttacccaccggaacttcaattgggtgccctaaatcaatcgcgtccaaaccacggcgcaggccatcagaggtacccattgcgatacagcgaacgataccaccgcccagctgctgctgaacttccagcaccagtttttcttcactgtttttaacctcaagagcattgtatacctttggtacgctgtcttgagggaattcgacgtccaccacggcgccgattacctggataatctttccagtagccatcttgaatcctctacgtaattcgtaaacctagctgttaaaccgcagaagcacccgaaacgatttcggtgagttcctgagtgatgctggcctgacgagccttgttgtaaaccaactgcaactctttgatcaggttgccaccgttatcggtcgcggctttcatcgctaccattcgtgcggcctgttcactagccaggttttcaacgacgccctgataaacttgtgattctatatagcggcgcagcagggtatccaacaacgccttaggatcaggttcatacagataatcccaggatttcttcttcagtgtttcatcgtctccggctggcagaggcaataactgagtcattgtcggaacctgagacattgtattgatgaatctgtttgtcactatatacaatttatccagacgccctgcgtcatatgcttgcatcatgacgttgactggcccgatcagctcggacaatgatgggttatctcccatccctgttacttgggcaacaatgttgcctccaacagaagaaaagaaagaaaccgctttcgacccaacaagcgctaaatcaacttgaacgcctttatcagaccagcctttcatttctatcagcaattttttgaacaagttaatgttcaaaccgccacataaaccacgatctgtcgaaacaaccaaatacccaacacgcttaacttcgcgctcgtcaaggtatggatgtctgtactccagattacctaacgcaaggtgtccaatcacgctgcgaatggtttctgcataaggacgactggccgccatgcgatcctgcgttttacgcattttggacgcggcgaccatctccatcgctttagtgattttttgcgtgttctgcacactggcgattttggtacgtatctcttttgcgccggccatatctgcttctccgaattcaaccagacggcccaagtttaatcaaactgggccgaatagtgttaccaggactgagtcgccttgaaggaatccaacagagctgtcagcttcgcttcgatctctccgttgtagtcaccagactggtcaatctctttgagaagatcagcatgttcacggttagcataagctaacagcgcagattcgaaactgaccactttcgcgatttcgacatcttccagatagccacgttcagccgcaaacagggacagagcctgctgtgcaacggacattggctgatactgtttctgtttcaacagctcagtgactttctgaccatgatccaactgcttgcgagttgcatcatccagatcagaagcaaactgggagaatgcagccaattcacggtactgagccagagcggtacggataccaccagacagtttcttgataatcttagtctgagcagcaccacctacacgggatacggagatccctgggttaaccgccggacggatacctgcgttgaacagagcagattcaaggaagatctgaccatcggtaatggagataacgtttgttggtacgaacgcagaaacgtcacctgcctgagtttcaatgattggcaatgcagtcagagaacccgttttacctttcacttcaccgttggtgaatttttccacataatcagcgttaacacgcgctgcacgctccagcagacgggagtgcagatagaaaacgtcaccagggaatgcttcacgtccaggtgggcgacgcagcaacagagaaacctgacggtaagcaacagcctgtttagacaggtcatcgtaaacaatcagagcgtcttcgccgcgatcacggaagtattcacccatcgcacagccagaataaggtgccagatattgcagggccgcagattcagaagcggatgcaacaacgacaatcgtattggccagagcgttgtgctcttccagtttacgaactacgttggaaatggtagatgctttctgaccaattgcaacatagatacatttgatacctgaatcacgttggttgatgatcgcatcaatagccagagcggttttacccgtctgacggtcaccgataaccagctcacgctgaccacggccaattgggatcatggcatcaacggatttgtaacctgtctggacaggctggtcaacggactgacggtcaataacacccggagcaataacttcaacaggagagaaaccatcattctcaagagcgcctttgccatcgattggctcacccagtgtgttaacaacacgaccgagcagaccacgaccaacaggtacttccagaatacggccagtacatttgactttcatgccttcggctaggtcagcatacggacccatcacaaccgcacccacagagtcgcgctccaggttcagtgcaattgcgtaacggttgccaggcagagaaatcatttcaccctgcatgacatcggctaaaccgtggatacgaatgataccgtcgttaacggaaacaatcgtaccttcattgtgagcttcgctcacgacattgaactgagcaatacgctgtttgatcagttcgctgatttcggtggaattcagttgcatatgctccagtccccttaagactgcaagacgtctgttaaacgatccagacggccgcgaatgctgccatcgatcaccatatcacctgcgcggataaccacaccggcgataacagacttgtcaattttgcaattcagcttcactttgcgtgacagacgtttttccatcgccgcagaaattttagcctgctgctgctcattcaattcagacgcagaaatcacttcaacattgatggttgattcaagtgacgcacgcaattgggtaaattgctggaagacttctggcagtaccagcaagcgaccattttctgccattacacgaataaagttctgagcatgctcatctacctgctcaccacaaagggtgatgaaggtattggctaacgtttccggtgccaatgaaccggaaagcagctcaccaacctgctcattgcgagtaacctcagcaacgaacgccagcatgttctgccaatgttcgagagattggtgctctacagcaaagtcaaaagctgctttggcgtaggggcgagctaccgtagcaaattcagacatgcccctccctccttacagttcagcgaccagtttatcaacgatgtcgctgttagcagcttcatccacggaacgttcgatgattttctcggcacctgcgatagccagcatcgcaacctgtttacgtaactcttcacgagcgcgtttgcgttcagcattaatttcagcctgagcctgcgctacaattttgttacgttccagctcagcttctgttttggcatcatcaataatttgggctttttgtttattagcctgctcaatgatagcttgcgcatcagctttcgcttttttcagttggtcggtcgcattggcttgcgctaagtccaggttctttttagcacgttctgctgaagccaaaccgtcagtaatttctttctgacgcttttcaatggccgccataattggtggccatacatacttcatacagaacaaaacaaacaggacaaacgcgatggcctggccgaggattgttgcgttaatattcaaagcacaatacctctatttcaattaatgaattgacttaatcttcagttctgctacttacttaccgccgacagcgaacatcataaataagcccaagcccacagcgatcatagggatggcgtcaaccagacccataacgataaagaactgtgtacgcagcagaggaatcagatcaggctgacgagcagcgccttccaagaatttacctccgaggatgccgataccgatcgcagcaccaatagcagccagacccatcagaatagcggcagccatgtacagcagatccatattcaggttttccatgacagtctccagtttgtttcagttaaaacacgattattgattgatagaaattaatgttcttcagatgccatcgacagataaacaaccgtcagaaccatgaagataaaggcttgtaacgtgataatcagtatgtggaaaatcgcccatggcaggctgagtaaccactgtgaccaaaacggtaaaagagccgcaataagaataaagatcaattcgccagcatacatattaccaaacagtcgcagagcgagtgatataggtttagatagtaagctgaccccttccagaattaagttaattggaataaacagtgggtgattgaaaggctgtaatgtcagctccttcgcaaaaccacgaattcctttcatcttaatgctgtagaacaggatgagaacaaagacaccgagcgccatcgacagagtgacactgacatctgctgttggaacaatacgcagagcaggcaggccgaaatagcgttcaccgatcaaaggaattaaatcgattggcagcaagtccaatgcgttcattaataacacccagacgaacacagtcaaagccagaggagctatcactttgctcttaccgtgatacatatcacgcacagtgttatcaacgaaaccgaaaaccatttctactgcagtctggagcttacccggcacgccatcagtagcgcgaaccgcaactctccggaatacaaacagaaacaatattcctaatatgacggagaaaaaaagcgagtcaatgttcaacgtccagaacgtcgtctcataaccactagcgtggggattgaccaactcaaaggtacgcaagtctaactgaaggtgcttcaggtgatgacttatgtactcctgcgaagttaaaacttctcctgatgcagacatgatgctttttacccttttattgttaaaaatgctaaccgttcattacggcaggtgcgatgatctgcacaatcagcaccgctaaataggctacaccaagtggtgcaaatgccgccttaaacactcccaaggcaactatcagcacagctatcgtaatgataaccttagccacttcgccaatagcgaagaaccatgcaatgcgtactggtacatcttcttcttttgctttttggaagcgggttagcagcataaaaatggcatttggcagccagcacgccaacccaccggcaaaagcagaagcgccccattcgatacttctggtacaaaaagccacactgagaataacaaaagtcattaactgcaaaagtaacagtttcagtgcaattctaccgctgtaaagggatacagacatgacttttgttttctcccgaagtacaccatcacatatcaggctttgctgaatgctgtataaaactgtctttgtttaagagtgtcaagtgacaaaaacgtgcaaattatacgggcagccaaaatgaattcaatccataagtagcgaaaaagtgaataattatttaaatttctaactttgatggtagattgctcacaaataccatttaatattctgcaacgattaatggtatgactgaaaaattaaacgtgatgtatatcacattcgaccaaaaacattagttatatttatcattaaatatgtgataaaaatcatttatttttttcaattaaaatcaactaattaatattagtgtcataaagatttatctaatatatcactaaaaaatgttaaatgtttattttgttctctttctctaaaatttatttataaaggaaattgataacctttttcgaaaagaaagtttataccaaaataaaatgaaggttatttttatgtgatctgttagtaaataaagttaaaacaaccaaaagtaataattagtaacgtccgtaacattataaatgtggttaacgtcactaattatttagaattttattgacaaacaacaaagttagtttgatttaagtacgaccaaatgacgctccccatctaactcaggaacttgcagagaaaccaccgtatcaagcgttattcctgaaggcagttgagtcaactcattttccggcagcacacctttcagagcataaaaacgcccttctgcgggtttaggaagatgacgacaccatgacagcatgtcttgcagcgaagcaaatgcacggctgatcaccccatcaaaaggaggttcaggaataaattcttcaacccgactctgtacgggatcaatattgcccaagcccaattcatgctgaacttgacgtaagaagcgaactcgttttcctaaactgtccaacagagtgaaatgagaatcaggccgtacaattgccaacgggatgcccggcaagccaggccctgttcccacatcaataaatcgcgttccgtgaagaaaaggattaacaactatgctgtccatgatatgccgaaccagcatttgttcgggggcacggacagatgtcaagttataagccttgttccatttgttgagcatatcaacgtaagcgacaagctgttgtttttgtgctagcgataacacaatgtctgttttcgccagcagcgattccaatttgttaagcaaaacttcgtcctcttaggcgctacgacgtaataaaccttgttttttcaaccataccagcaaaatggaaatagctgctggagtaataccagaaatacgcgaggcctgaccaattgaacttggtttatgatcattcagttttgcaataacttcattggaaagcccgttgacttgtttgtaatccagatcgagtggcaaagcggcattttcattacgtaattgtttttcgatctcttcttgctggcgggcgatatagccttcgtacttcacttgaatttcaacttgatctgctgcttgaggttctgtcagccccggagtaaaacgtggcagtgatgtcagcagttcataattcatttcagggcgacgcagtaaatcttcaccattggcttcttttgacagtggtgccttcagcatttggttgatttcatccaagctatcagaatgcgggtgtacccagatatttcgtaagcgctggcgttcttgttcaatcatctcaactttgcggcaatagtgctcccaacgttgatcatcaaccaagcctaattcacggcctttttccgttaaacggagatccgcattgtcttcacgcagcatcaaacgatattctgcgcgcgacgtaaacatgcggtaaggctctttcgtacccaatgtgcacaagtcatcaaccaatacaccgatataggcttgatcacggcgagggaaccagccgttttcatctgcggcataacgtgcggcattcaaacctgccagtaatccttgtgctgccgcttcttcgtatcctgtagtgccgttgatttgaccagcaaagaacaggccattgataaatttgctttccagtgtctgttttaaatcacgtggatcaaaaaagtcgtattcgatcgcgtaaccagggcgaacgatacgggctttttccatacccttcatggagtgaacgatctgcatctgcacgtcaaatggcagactggttgaaatgccgttcggatagatttcgttactggtgaggccttctggttcaaggaagatctgatgagcgttgcgatccgcaaaacgcatgactttgtcttcgatggaagggcagtaacgtggtccgatcccttcgatgatccccgcatacatcgggctacgatccaaattattacggatcacttcatgggttttttcattggtatgtgtgatatagcaagggatctgtagtgggtgttgatctacgttgcccatgaatgagaatacgggtatcgggttatcacccaactgttgctcaagctggctgaaatcaatggttcgtgcatcaatgcggggaggtgttcccgttttcaggcgagctacgcgtaaaggcaattcacgcaggcgatgggataatgcgatcgcaggaggatctccggcacgtccgccactgtagttttccagcccgatgtgaatttttccatcaaggaaagtaccaacagtcagtacaactgattttgccttaaattttaatcccatacgtgtaacaacgcctgtgatagtgttgttttcaacgatgagatcttcaaccgactgctggaagatcattaagttaggttggttttccaatgcggttcttacggcttgtcggtaaagtactcgatctgcctgtgctcgtgttgcccgaactgctggacctttgctgacattcagtgttctgaattgaataccggcctgatcagttgcttgagccattaggccaccaagtgcatcgatctcttttaccagatgccctttaccgatcccaccaatggctggattacatgacatctggcccaaagtatcaatattgtgagtcagtaataaggtttgacgtcccatacgtgcagcagccattgctgcttcggtaccggcgtgaccaccgccgataatgatgacgtcaaagtgctctggataaaacatgtgcgaaccttcaattgtgagaatgcttgatatgcattagggaggggattctactcaagtttagacgttagaccaagtaagtttgatcgccgttaattaaaagaagatcttttttatttaaagatctctttattagatctgttattaggatcgcgatcatctgtggataagtgatttttccatagaaagatcatggcgctgtaaaggatcatttgctgtgaatgatccgtgatccaagtcagtataagctgggatctaaatgcgtagttatacacaggtggtaaattgaaactgagttattaaatggataactacgggttaatccctgcttttcagataagttatccacagttgatcgttatatttttaatcggatcagagtaactttgcccattctttaacccaatcttcagcgggatcctcgggaatttcatacttctggatgtctatttccaatcgatccccgatcctttttgctccgcgatctttcaatagatgctcaaatgatttgatggcgccacagaatatgtcatattcggaactgccaataccgaccgaaccaaatgtcacgttacttagatctggctgttcttgtgcgatcgtgtctgccagaggctgaagattttcgggtaagtcccctgccccatgtgttgatgtgaccacaagccatagcccaccaaggcgcagatcatccagtgaaggaccatgaaggacctcagttgaaaacccgtgattttctaagatctccgccatatgttcggcaacatattcagcacttcccattgtgctgccgctgattaaggttattgtgctcatcatgatccctgttaaattaaagagcggctattgtacgctgtgagtctactgggatctacctgtggataatgtagttataaaccatttcctgtttcaaggcttgattgttcttatgattgggttttgcagggagatcagggtttctgttgactggatttcatcgattgtctggatcttgttgataagtacatcttgaagcgattcaatggagcggcacatgactttagtgaaaatgctgtaatgccctgtggtgtaatagacttcaaccacttcatcaagcatgtcgagttttttcaatgcggccggatagtctttggcgctttttaaaatgatgccgataaagcaacacacatcaaaccccagttgtttggcactgatatcaacacgagtgcctgtaatgatccctgcctgcttcattttttccactcgaacatgaattgtacccgggctgacggcgaattttttggctaattctgcataaggtgtccgtgcgttatccattaaagcgtgaagaatgtcacggtctaaattatcgatctgataaatttctgccatttttaacccctatttttgaatgatattcatttttatggtgtaaaaattattgtttataaatattactcgatatttttattatcagatattgaatttatacctcattctgttgcttaatctatatcaacaggacacagagtcactaaaaattttgagagcagcgccatgaaaacatcctttattgaaaaacagcagcagattagttttgtgaaatcatacttttcccgtctgctagagaagcaactcggtttaatcgaagttcagggacccattctgagccgtcttggtgatggtactcaggacaacttgtctggccatgaaaaagcggtacaggtaaaagttaaaacattgccagatgcaacgtttgaggtggttcattctctagctaaatggaagcgcaagacattaggtcgctttggttttcaagctgaacaaggattgtatacccacatgaaggctctgcgtcctgatgaggatcgcctgactcctatccactctgtctttgttgatcagtgggattgggaaaaagtgatgggtgaaggtcaccgctcactcggttatttaaaacagacagtaggtaaaatctacgaagcgataaaagaaacacaaaaagcagtaagtaaggaatttggtctggcaccgttcctgccagatcaaattcactttcttcacagtgaagagcttctgaaacgttaccctgatctggatgctaaaagtcgtgagtgtgaggccgccaaagagtttggtgcgattttcttgatgggaattggtggtaagttatctgatggtcagtcacatgatgttcgcgcaccggattatgacgactggacaacgccaaacagcgacggcttcttcggcctgaacggtgacattattgtctggaaccctgtattgcaagatgcttttgaaatttcgtcaatgggtatccgtgttgatgcagaagcactgcaacgtcagctcgagctaacttgtgatgaagatcgactgcaatatgactggcatcaggcattggtcaaaggtgatatgccacaatccatcggtggaggcattggtcaatcacgtttggtgatgctgctgctgcaaatggcgcatattggtcaggttcagtgtggtgtctggtcacccgaaattatcgaatctgttgaaggtgtattgtaaggattgactgcgaagggatccgagagtagtgactcagtgtcgccatcttcgcagtaaacggcttgtaatcccggtatcaaagcgccagatatgatcgaatatccgcatgataccgggctttccataatgggatagggaaactgcatggaagcggtgttgttggcgttgttgcaggttttgtatctgatggattagaacgtctggcaaccgctgggcaatgaaatctgaaataacaacagcgtcggcatctttccagatattttcttgcattttctcaatgatggcattcaggcagaatgccagatcggttcctcctttgaaagtttgccccaaaaaatgtaccgcctgtgttagtccatcttgtgacgttaagtcatagtgtatgagttctgtggaaaataatatgatgtggcagtgacgattatctgccagagcaatacgcatcagtgccagacaaaatgcttttgcacaatgctcgttgaacccgcccattgatccggaagtatccacgcacacaataaatggtcctcggggctgttctgcatgatcatggtgagtaaccggcttcaatatggttcttggctgccagttgtctccttgtaagcggtaggtcagtaactttttctccaccagccgccgataaaattcgtactccaaatcttcaattcccagcatggccagttctgtgggtaaaagtctcaggatatcgtcaccttgttggataccgctgacttgctctggcacggtatctggcattcgctctatctgggtgaatggttcaagggtgtcgctatcttcgggaattgatttagccgcttggctgcggccgagtaattgtgccagtttttccagttcaggctgctgtctgagaaattcagcatattgggtgaataatgcggtattgtgcgacgtcaggtgaagtcggcctttgctcatgtcccacaatcgccctgcggcgcgatcattttcatcgaatatcggatcgagattgccactgagaaccaatcgtttctggatctctgccaataattgttctttttcctgttccagcaattgcttatgaaaggttgttacttgcaggatcaggctggtgcgccagcgttgaataaacaggatttgtcctgcgtgggtgtgttcagataacgcttctcgcaatgtgtgggcgtcatgggtaaaaggagatttgatctgttcaagcttctctgcgagatcagagagttgttgataaaattcggtcgtattagccgttagtaattgctggtataactgaaattcttcagctagagaggctggaatgagtgtatcttttattctttgttgtagtgtttgctgccatgcaggtacatctttcaataatgcgcgcttgaacctagggaatttttcaaaaaaaatggccaattgaggggtacttaacagtgctaaaatgatctcctcgatcagttcaccttcattgatcgagagtaaaagatcgagcgttgccagagttaacatgtcactaccccatttttgatctcaattgtttcaatttttcgatcaattgcagaaagctttgttcaatgttggcaatccaatattcttcgataaataaacaaggttgatgctgaccgaacaattggcgctgatgctggatggcatcactaatagatatcagcttttcattccactcgttatttgttttttctattgttagttgctttgcttccgcttggcagagaatggcactgttacggctcatatccagcacttccagttgatgtttttcgttgatctcggccgaaattttcagtggaaaaccaatgccatttaagcaagcgagcacttctccactgctatttttgagtacgttttccagtactttcctatctatttcaatgaaattaacttcaatatcatgcagatgtaatgcgggatacagaaatagcgtcagtttttcatcattgatagttttgggaaatgagtagtgggtcttgcggccgaaaagtgatgaattcgtggttaactgtaagggatgaaggtgagtttcatctcggctggtttgtatccattgttggtatactccatccattttctgtagcaggaaacgctgttgataggcttgttctgttagcaaatcatgaaggaattgcggcagaagctttaaggcactcaggtcgtgccacaggcagtctttcaatagcaccaaatctagcggagatatggtatttttcccactgaagaatgcactagcctgcaataagcggatggcttttttccagcggcgatctgaaacgtaagggagattttcagaggcattcagttgctggcgtagctgataaatcagctcgaaaatgtagcctggcagggagacgtgtttaatcttacactgccattgatgaaattcctcatctgtgatttggaaatgggtaggtacaggattgtcattcccattgtttcgatcagtcagtaaggcacgaaaatttttcttttcctgaatgttgttcagccagattcggatcaacatacgatcgtagagggcttccaggctgctatcagcatcgggcagctcattggatgccgtgaccaataaccgcatcggcaggttttcttcttggttgccatttctaaatttcttttcattgattgcggtcagcaaggtattcaaaatagcggggcctgctttccagatttcatccagaaaaacaacttctgcttctggcaaatagccttctgtcaggcgctggtaacggccttcatctttgagtgcttgaatggagagtgggccgaagatctcttctggtgtggaaaagcgtgtcatcaaatactcaaaagcgtgagcattttgaaacgcaaattttagccggcgtgctatcaggctttttgcgatccccggtggccccaggagaaaaacactctctccacataaggcggccagaagacagagacggatggcttgtcgtctttcatataatccgctttctagatgctgacttaactgggatattttctcgaccaattgcatattatgtacaccatggttcgaatagttaccttcatttatttatttatagataaaattcaatctatgcaaagattttggtgattatttattgatccccagtagtgtgtttgaaaaatcgattcagtataacttattcaataagttaggtttttttatttattgccctgtttattaaacgttttaatcatgatcacattttcatatcaagcatgttgtctttgctatagggctttatatgatgacggtttagcgaaacgtttcgctttcgctaaggagttaataaaaaatgaaaaaaggcgttttattgcattctgatatttctgccgttatttctcgtttggggcacactgatcagatcacaatcagtgatgcggggctacctatcccgttgtccacccagcgaattgatttagcgttaacccagggaatacccgatttgatgtctgtgtttgacgtggttgtgcaggaaatgcaggttgaagcagccattttggctgcggagatgattgatcacaaccctcagatacatgaacaaatcatcaagcgcattgctgaactcgaaacaaaacagggaaatgcaatcgcgatagagtatgtgagtcataacattctgaaagagaagacagaaaagagcaaagcgattatccgtaccggggaatgttctccttatgccaatatcctcctttgttctggcgtaactttctgagggtatcatggagccattgctggagttaaaggaaattgataaggctttccctggggtaaaggcgttgtcgggtgcagtccttcgcgtttatcccgggaaagttatggcgctggtcggcgaaaatggtgccggtaagtccacgatgatgaaagtcttgaccggcatctataccaaagatgccggttcaatctattatcttgggaaaaatgtggttttctccgaccctaaatcgtcccaagaggctgggattggcattattcatcaagagttaaatcttatcccccaactgacgatcgcagaaaatgtttttcttggacgtgagttcgtcaataaactgggtatcatcaattggcaaaaaatgtatgaagaggccgataatctgctgaagcgtttgaatatccgttatagcagccgtcgactggtttctgaattgtccatcggcgatcagcaaatggtggaaattgccaaggtgctgagtttccaatccaaagtcatcataatggatgagccaacggatgccttaactgataccgaaacagaatcgctgtttcatgtcatacgggagctgaaagctcaaggctgtggcattgtctacatttcccatcgtctgaaagaaatctttaaaatttgtgatgacgtgacggtatttcgtgatgggcagtttattggcgaacagccagttactgctctgcaagaagatacgttgatcgaaatgatggtgggacgcaagctggaagatcaatacccgcgtctggatctgccgcgtggggaaaaacgactggagattgaaaacctatctggagcagggatcaaaaatgtcagtttttctctgttcggtggcgagattctgggaatatccggtttaatgggagctggtcgtactgaattgatgaaggtgatctacggagcattgccgaaaactaaaggcaggatcctgctggatggaaaacccctgactattcgcaatccacaggatgggctggctaacggcattgtctatatttcggaagaccgtaagcgtgatggcttagtgttgggaatgtcggtcaaagaaaatatgtccctcacagcgttacgttatttcagtcaaaaaccctatcgtttgaatcattccgcagaacaaaaagccgtaactgacttcatcaaattattcaatatcaaaactccctcaatggaacaatcgattggcttgctttctggcggtaaccagcaaaaagtggcgattgcccgtggtctgatgactcgcccgaaggtattgattttggatgagccaacccgaggagtggatgtcggtgcgaagaaagagatctatcagttgatcaatcagttcaaaaaagaaggtttgagcatcattttggtctcgtctgagatgccggaagtcatgggaatgagtgatcgtattctggtgatgcatgaaggtggcataagtggtgagttcagtgcggataacgcctctcaggaagcgctgatggtcgctgctgtcggcaaacaatacggtgcagttaaaggtaatgatcaaggataagagatatgaattctaacacagcaccaacctccagacgtttgctcacgaaagcctggttgatggagcagaagtcactgattgcactattgattctgattgttgtcgtttccttcctcagccccaattttttcacactgaataacttatttaatatcctccagcaaacttctgtcaacgctatcatggcggtgggaatgacgttggtgatcctgacttctggcattgatttatccgtcggatctctactggcactgacgggagcggtggctgcatctatggtcggtacggatgtcaacgcgctggtggcagttgttgcagcactggcattgggggcagcgattggcgcatgtaccggtgttattgttgcgaagggcaaagtccaggcgtttattgccacattagtgatgatgctgttattgcgtggtgttacccgtgtttataccgatggcagtcccatcaataccggattcagtgataatgccgagctatttggctggtttggtattggccgtccattaggagtgccggcgccagtctggatcatgttgctggtttttgctgctgcctggtacattctgcatcacactcgccttggccgttacatctacgctttaggcggaaatgaatctgcaacacgtttatcaggtattaacgttgataaaataaaaataatcgtttattccctatgtggcctattggcagctctgggcagtattatcgaagtggcccggctatcttctgcccaaccgatggcaggaagtggttatgaactggatgctattgcagccgtggtgctggggggaaccagcctggctggcgggaaggggaggattgtcggtacgctgtttggtgcgctgattttaggctttttgaacaatggattgaacttattaggtatttcttccaactaccagatgatcgtcaaggcagttgtgattttactggcggtcttggttgataacaaaagtagtaaataacctcaccctacaggaaaaaacaacatgaaaatgaagaagctggcaaccattctatccgccgtagccttgagtgcaaccatgagtgccaatgcactggcgaaggatagcattgcattggttatttcaacattgaataaccccttctttgtcacgatgaaagacagcgcacagaaagaggctgataaactcggatatgacctgattgtgcttgattctcaggataatccggcaaaagagctggctaacgtacaggatttgactgttcgtggcacgaaattgatgctgattaacccaacagattcagacgccgttggtaatgcggtcatcatggcaaacaaggcgaatattccggtcatcacccttgaccgtacggcgaataaaggaaacgttgtcagccatattgcttctgacaatcgcttgggtggcaaaatggccggtgattttatcgctgaaaaattgggtaacaatgccaaaatcattcaattggaaggtatctctggtacttctggtgcacgtgaacgtagtgaaggtttttttcaggccgccaaaaaccatcaattcaatatgctagccagccagcctgctgactttgaccgtacaaaagggctgaatgtcatgcagaacctgctgacagcccacccatcagtacaagccgtttttgcccaaaatgatgaaatggcactcggtgcgttgcgtgcgttgcagacagccaataaaaaagatgtgctggttgtcggatttgacggaactgacgatggcgtcaaggctgtacggagcggtaaattaagtgcaacgattgcacagcgccccgatcagattggcatcattggcgttcagacagcagacaaggtgctgaaaggtgaaaaagttgacgctactatcccggttgaattggaattagttatcaaaaaataatcagtattaccatgcagccatcagttttgatggctgcatcatcgctgaacaggaataaatgtaatgagtatggcaaaacttgccgtgatgggcagcattaatgcagatcacatcttgaacctcgaatcttttcctcagcctggggaaaccgtgatgggaaaacagtatcaggttgcatttgggggaaagggagctaatcaggcggttgctgcaggtcgctgtggtgctgacattacatttattgcttgtgttggccaagatgatattggcgagcgtatccgtcaacaattggcgaaagataatatcaatacctcggcaatcggagttattgaaggtgaaacaacgggtgtagcactgatttttgtgaatcagcagggagaaaacgtcattggcattagcgcaggagcgaatggcgcactaacatctgaatatttccaccatcatgagcaggtggtcaaagaggctgatgtgttgttgttacaactcgaaacaccgttggaaaccgtacagctagccgctgaaacggccagaaaacataacaccaaagttatcttgaaccctgcgccagcacagaaactctctgaacaattactttctttggtcgatatcatcactcctaatgaaacagaagcggaatacttaactgggatcgctgtaaaagatgatgtgggagcagaaaaagccgctcaggacttgcataataaaggtattgaaatcgttattatcacattgggcagccgtggtgtatggctgagtgaaaatggtaagcaaggtaaaattgttcctggatttaaagtcaaggcaatcgatacgattgcggcgggcgatacatttaatggtgctctggtaacggggttattggaggggaaagaaatagtatcggcaattcgttttgcccatgctgcggcagctattgctgtgacacgtcagggagcgcagcctgctgttccgtggcgacatgagattaatgcatttctggctgaacaggactaaccgtggctactatgaaggacgttgcccgtcttgcgggtgtatcgacatcaacggtctcttatgtaattaatgataaccgttatgtcagtgagagagtgaaaaagaaagtcaatgcggccattgatgagttgaactatgctccttccgccttggccagaagtctgaaaatcaagcaaaccaaaaccatcggtatgctggtcactaccagtaataacccgttttatgctgaaattgtcaggggagttgaacggaattgttacgagcggggatacagcttaattctgtgtaataccgaaggtgacgtgacgcggctgatccgcagtatggaaacactattgcaaaaacgtgttgatggcttgttaatcatgtgttctgaaaatgcggtactacccaatgattttttgctccgatatccacttataccgatggtaacaatggattggtcgcctttttatgtatccagtgatgtcatcaaagataactctctattgggaggcgaattagctacaagttatctgattagccgaggttttcgtaaaattgcctgtatcgctggcccacaagataagacgccagcccgtcagcgtctggctggatatcgaaaagcaatgaaagatgcccagttagagatccctgaagggtatgaaatccacagtgattttgaatttgctggtggattgtcatcaatggaacagctactccaattatctaaacctcctgaggcggtatttgcaggaaatgacgccatggctattggggcttatcaagccttacatagggcgggtctttctgttcccgatgatatctccgtgattggatatgatgacatttcgatggcgccttacatgaccccaccactgaccaccattcatcaacccaaagatgaattgggtaagctggctattgatactctgctctatagaatgggtaatccaggaagtgagccaaagcaattgattttgaagccaaaactgattgagcggaattctgtagccagacgctgaaggcattactttttaatcaaattccggccatcttctttcttcaataacaggaaaacaaaagaagaggctagagtaatcacgcctatcgtaataaaagtatagtggaagtgatccactgttgaaccgtattctgctgactcataaaaccgaaggattgcagcactgactgttactcccaaactgatagataactgttgagtaaccgccaataggctattgcccgcactggcattgttattattcaaatcaccaagggtaatggtattcattgatgtaaattgcgtggacattgccattcctaaaataaatagaggaatgatcaaaaagacgagtgatatctccggtgtctgtagcgaaaactgtgcaatcatcacaccaatgatcaccgtaacccaaatgagcgtgtttcgatatccaaatcgagtcagtaacttggtgacaaaagatttagcgagaattgcgccaatggcgtttggtgccatcattatcccggcaataatagccgagtaaccaaaacccacctgtagcattaacggaataagaaatgagagggaacccgtacttaagcgagtggcaatattgctggtgatgccaactgaaaaggtacgtgtttggaacaactggaggtcgatgagtggatttggatgcctttttgcatggaagatatatcctgacagcataatgatactacccgccataaccgcaacgggaacatagttaggcagagtattattaccaaataaatcgaagctgaccgaaagcatcaccagccctacactaaatagcatgaatcccagaaaatcaaaggggcatttaggcatggtaaagttgggcatgtgctttctggcataaataatacccagtaggccgataggaatattgatgatgaagatccaatgccaagttgcataggttactaacaatccgccaagcatggggcctaaaattgggccaagcaaacctggcatagtcacaaaattcagaacgggcaacaattcgctgcgaggatatgcccgcagtaatgccaaacgggcaacaggcatcatcatggcaccaccaatcccttgaatgacgcgggcagctaccaaaaaagagaaactgctggataacgcacaggcgagtgaacctaaagaaaaaagggaaacggcataaatgaatatccgttgtgtgccgaatctatcagccaaccaaccactgaccggaattaacattgccaccgttaaggtataactgacaatggctggctgcattgccagaggatgatgattaagactttcagcaattgccggcaatgcggtattaaggatggttgcatccagggattgcataaaaaaagctatcgcagcaatccagggcaatcccgacatactgcgtgcagatttgaccattagatatcctgttatattttaataatcgatgattacttactgggtatttttttccacttgtttttgttcttttaactgtatggatgtcacatttcccttctatttaacacattatcctactgtatagatttaatcattgttgtcgataacaccaatctttgatcgaaaagagagcgtaaatgccaattttgttgaaaaaaaacacgaacggaaagaaaattcaaaaaaactattgtcaggcggcgaaaagtccctataatgcgccaccactgaccgacgctgagcgaagacacgccgcggcggacagcgagagaacagcccggaaataaaggcttgacactcggagaggaaagcgtaagatacgcagcctcacgacccggaggacagcttcgg

SEQ ID NO: 16849 - DNA, 880 bp, Xenorhabdus bovienii
  unsure (1)..(880): unsure at all n locations
nnnnnnnnnnnnnnnnnnnnnnnnnnnnntgccgatgaagaaaatgtttttgacgatttcaaggaagcactaaacaatacagacggacagctagatagcatctatatccgtcgtcattgaagatgcttgatttttcatttgtatcagatcatgatcgcgctcatgaaaattaatctgacagatgcccaaaaagaagccctcgaattgatgcatgatacgactcgcgatggacgagtacgtgaccgcattaaggccgtgcttttggcctcagaaggctggactgcccagatgattgcccaggctttgcggatccatgaaagtacggtgagtcgccatctgaaagattacttctctgaggaaaaactcgcccctgaaaatgggggctctgaaagccgtttgtctgccgaacaaacgacagcattagtggagtatctgatggcaaatttgatgcacactaccgcccaaattgtggcctatgttcgggctcgatggcaggtgactttcactgttgcaggaatgacgaaatggcttcaccgtcagggtttcagctacaagaagccaatgggtgctccgcataaatttgatgcggataaacagcaacagtttattgaaacctacaacgcgttgaaagaagaatgtggccagaatacgcctattttgtttattgatgcggttcacccgaccctgtccacaaaattaagttatggctggatgaagagcgggcggaagcacgtcaaagtggttgaaaccacgggcagtcgtactcgactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16850 - DNA, 882 bp, Xenorhabdus bovienii
  unsure (1)..(882): unsure at all n locations
gagggaaggaaggaaagtttttngnnngacatcttnnnnnnnnnnnnnnnnnnnnnnnnnnnnnnnnnnnnnntactccactaatgctgtcgtttgttcggcagacaaacggctttcagagcccccattttcaggggcgagtttttcctcagagaagtaatctttcagatggcgactcaccgtactttcatggatccgcaaagcctgggcaatcatctgggcagtccagccttctgaggccaaaagcacggccttaatgcggtcacgtactcgtccatcgcgagtcgtatcatgcatcaattcgagggcttctttttgggcatctgtcagattaattttcatgagcgcgatcatgatctgatacaaatgaaaaatcaagcatcttcaatgacgacggatatatatcataatttaaccggagataaatctgttttaaggaaaagtttgagtggaattttggtaaacgaatctcttatctcaataaatcaacggaagctatcaggcgttcaaaatcgtaagtcacaatcttggcagcaatcgccctttccgttcccttaacgataaagtcaattggtgaacacgngtgaagttttcaggagcaatggcaaacggaacaggttcaataatcaataatgggnctgtggtgagtgactctgatatattcatgacatttataatgggatttcatgaaggattatatatgngcggaagtagtaaaattcataaattcgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16851 - DNA, 1136 bp, Xenorhabdus bovienii
  unsure (1)..(1136): unsure at all n locations
ngcattgcgttgcanntgcctgcaggtccgagttggcacgacgactacgttatcttctaggggttacgcatgaaaatatttagtggataattctttcatttttagagggacgctaatgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16852 - DNA, 1257 bp, Xenorhabdus bovienii
  unsure (1)..(1257): unsure at all n locations
nnnnnnnnnnnnnnnnnnnnnnnnnnnnnnnnntttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaagcgattattagcatttatatttgcattgttggcattttgatttgctaagtttgctagatggtgtcgtcatgagaaatttcgtgcaataataatgccccaccattccatcataagagttgattaaccatgagtacacctgcacaccgccgcacgatatttcagatcgcgtctggagcctgcttgaacctcatttgccaggacgtcaaggcgcttgggggcgtgtagctgatgaaaatcggcggtttattatcaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16853 - DNA, 42242 bp, Xenorhabdus bovienii
tgttttccgtgccgcacaagagcgttcagacatcgaaatcgttgctatcaatgatctgctggatgcagagtacatggcttacatgctgaaatacgattcaacccatggccgcttcaacggtactgttgaagttaaagatggtcagctggttgttaacggcaaaaccatccgcgttacatctgaaagagacccagctaacctgaaatggaacgaagtgggtgttgatgttgttgcggaagcaaccggtattttcctgaccgacgaaactgcacgtaagcacatcgctgccggcgcgaaaaaagttgttctgactggcccatccaaagacgacacgccaatgttcgttatgggtgtcaaccacaatgcctatgcaggtcaagagatcgtttccaacgcatcttgcacaaccaactgccttgctccactggctaaagttatcaatgacaaattcggtatcgttgaaggtctgatgaccactgttcacgcaacaactgcaactcagaaaactgttgatggcccatcagcaaaagactggcgtggtggccgtggtgcagcacagaacatcatcccatcttctactggtgccgcgaaagctgtaggtaaagttatcccagaactgaacggcaaactgacgggtatgtctttccgtgttcctactcctaacgtttctgttgttgacctgactgctcgtttggctaagccagcaacttacaaagaaatctgtgatgcaattaaagaagcctcagaaggcgaactgaaaggcattctgggttacaccgaagatgatgttgtttccactgatttcaacggcgaaaaactgacttctgtatttgatgcaaaagcaggtattgcgctgaacgataactttgtgaaactagtttcttggtatgataacgaaacgggttactctaataaagttctggatctggttgctcatatctctaaataattgaatagcatctgcgttcataaagccaccttaagcaggtggctttattttttatctattccgatttatctcttaaaaacattgagctattcttgctcctagtcaaccgccaactcaggtttacataaggtcatgacagatgcttgataaaattttctcattaccggttgtagaacaaatatctccttatatcagtcagcgaaatattgaaggatttccgctgattgttgtttcacaccctaaagtgcgcggcgcaatcagtattcagggggcacatcttattacatggcagcccagtggcgaaaaacctgtattatggttaagcgataacactgaatttaatacaggtacagccattcgtggtggcattcccatttgctggccttggtttggctcgacaagcgctcccagtcacggttttgcacggatcttaccttgggaattcagggcacaccatgaaaatgaaaacggcgtgatcttgacatttacgctacaagataacgccgatacacataagttatggtcacacgagttcacactcattgcccgttttaagttaggggaaacctgcgaaatagagctggagtctcacggagaatatcaagcaacatgtgcgctccactcttacttcaatatcagtgatgtcaatcaaatctgtgtcagcgggcttggtgctcattttatcgataccgttgccgataaaaaacagtacgttcacgaagatctgacttttaaaggacgaattgaccgtatttatactgaaccagaagatttcagcctactcagtgatacaccgtggaaacgaactattgaaattcaccattatcaccatagtgatgtagtttgctggaatcccggtgccgaactttccagcagtatgaaagatatgagtaaagaaggttataagaatatggtttgcatcgaaactgcacgtatcaattccccacagctatccagaaataacaaccctgccagactttctgtggttatccgttgccgcaaaaatccttgatggaaataaacgataagctgaactctgtcatgactattttgctatggctatcttgaagagttcagctttacatctttcttgacatgaacaatatctgtcagaaagtataagtaatacccgaccagatagtaccggagtatgagcgattggtcatcgggctgtttttaacttcgcttggtaaatgttctacacgccccatcatgaaagcagtccaattcttatcgaaggtgtaataaccagacaattcaagataagggctccagctatcgcccggtgtatattcagccagaccgctccgcacagattcgctctttttgatgccataactataacggttctgttttttgctatcccagacaacgcctacccctggttccaataaccagccgctctgctggaaactatataaataggcgaaatcagcactgataccgttactttcgcccagtatatcggcagctaatgaggcacgcagcaccccccaatcttcatgatgtttataagtgaaaccacccataaccgtgtcacgacgacgatccagttttttcatctgctcatctgtactatccttgggatggaaagcttgtggagaatagaacagatctacagaaagtttatcctttggctggttccagaggtaataacctgctgccaaagtctgaaaataaaagttttcactctcataagataccatgggaaccggcagtattttatctttttttttcaatccgttgtaaggtttagcttcatacaatgccgacaacccaatagaccattcgccagcatatgccacagaagaagacaggcaaagccccactactgcaataaacaccttattagtcattataagttatttcctgtcagacaaattgttgtgaaatcaggcataaagtgtatgtatccggtgatttattgccaagcaattgataatgatttttgatttaatcgcactatatgcataaaatccggaactggcagcttgatattaccattggttaaaagccatcaagttacaatgtcacacttagatattatctgaatattaattttgctgatgttataaagaaagatgcaggcatttattccaaatttcggtacggaaaaatgcctaaaagagataagatcagttaacaactaccggaacacgtatagctaaagcacagagcagttcataaccaatggttccggcggattccgccacttcatccactggcaagttttccccccataactccacggtactacctatttctgtttgtggacacggcgtcaaatcaaccgtcatcatatccatcgatatggcacccagtaactgtgtacggacgccatcaacaaggatgggggtacccgttggggcgtgccttggataaccatcagcataaccacatgccaccgtacctacacgggtaggatactgggttgtataacggctgccatagccaatttttgcccctttgggtaggtcatgaaccgcaatgatttcactgtgcaaactcatcgctgatttcaaacccacatcagcaatatcacgccactttccactcggggatgcaccatacaggataatacccggcctaacccagtcaccatgtgtcttcggatgccacaaaactgcaccagaattggctagacagcgaggaagtgagcccatttgcagacattcaacaaccgcaaattgcccatcaataccaatctcattatctgaattagcaaaatgagtcatcaacgtgactgaattgatattttttatgcgattcgccattgagaccacctgtgaatattcttcgggggtaaaacccagacgattcattccgctattgagtttcaaatagatatcaatggggttattcagtctggcctcttctattgccttgagttgccagtaactatgcactgtagttgtcaggccatattgatcaatgagctgcaaatccgaaagtttgaaaaaaccttccaataacaggattggcccttgccacccgtgttcccttaaataaatagcttcattcatatcaagcagcgcaaatccatccgtttgcatgagtgactgccatattctgtccaatccatgcccatatgcattagctttcactactgaccagattttgctgtcaccgactttctggcggataaccgccaagttatggcggaatgcatcgagatggatcgtcgccaaaataggacgtggcatgacgaccccttataatttatgccgtatgtaaacgatgcttcactcgaagcacttttgtattgaatccattgatgtatctaaataccgagagatcatctgccgcgatttccggcgtcttaccagaaattaaatcagacaataatttccctgaaccacaggccatcgtccagcctagcgttccatgccctgtgtttaaatagagattactatatttggttgggccgacgataggagtaccatctggcgtcattgggcgtaacccagtccagaatgtagcttcagcaatattgccaccgctgtggtagagatcctgcacaaccatttttaacgtttcacagcgattattcggcacattcatattgaaaccaaccatttctgccatgccaccaacgcgaatacggttatcaaaacgagtaatagctatcttgtaagtttcatccagcacagttgaggttggcgctcttgcttcatccataatcggcatcgtcagagaatagcctttcagcggataaacagggattttaacgaattctttcagcatgtcggtagaataagatcccatcgccaccacgtagttatccgccgtcataatgccatcatcacactggacacccgtgattttgtttccatccaccagaatctgtttaacctgattgctaaatacaaacttgactcccgcctcttctgccatttttgccagtgccttggtaaatatctgacaatcacccgtttcatcattcggcagttgtaacccacccgccaatttatgagaaacatgggcaagtgcaggctccactgatgccagttgttctgcggtcaataattggtaaggaacaccttcttgttccaatactgcgatatcattggcggcattatcaaactgtttggcggttctaaataattgcagagttcctccctgacgcccttcatattgcatgccagtatctgcccttaaccgtttaatgcaatcacggctatattctgccaatcgcaccatcctgcttttattcatggcgtaatggtctgcatcacagttgcgcagcatttgccacatccagcgtagctgaaacagtgaaccatcagggcgaatagccagtggtgcatggcgttgaaacatccattttactgctttcagtggtattcccggtgctccccatggcgttgcatatcccggtgagatctgaccagcgttacctgcactcgtttcttcagcggcactattctggcgatcaaccacagtcacttcatggccttcctgtgccaaataccacgcactggtgacgccaataacgccaccgcctaaaataaggactttcattctgccccctgttgatatgaataatatgtgcaagcataatatgctgaatataaaaagccaatatagaataatagactgcaacattattaatttaattttaggatttgaatcacatttttattacaaaacattgataatatcgtcattctaaatttgatcaaaaatgaataaaaatcaaattaattcaataaattaaataaggatttaatgctgacaatcaccttatttcactacctgttaaagtgatttttacggaaaaaaagaaacataaaatttacaattaaaaattacattaaaatactgacaaaccaaaataatcagaattaaatctctcagcaagaacaattgggcagaataataatttaaaaaattgaattttacagtttgtgtaaattttcaacatcaattgaaaaataaaaatactggggcatgaataagatggaaaaacaaccaaatgtaaaaaagcgcactaactaaactagtgcgcttttaaaatatgatgacagataaaaaacagaaattagaaatgcaatttgatcagctgtgacgtgcttctgttaaatcattcaacataacactctgcatgccatgccaaatgattccgctttctttaccataactacgcacacaatccatgattttgtcataggattgttcccgacacatcgtactcaattgctgatagaaattcagtgccagcatacgggcatcagggtttgagaaataatagcggccaacgcgggtataaagccctcttaatccattgataatcaaaccgtaaattgggtttcctgacgcaaaagccagcccacgaaaaatatcataatccacggcactgaaagattcggcggtatcttccacattctctttttctgccaatacttccaatgatttttcaggattatgtctaaatgcagtacgaataaaaatagcagcgatattggtacgaaccgccagtagattatcaattaactggggaacgcgatcatgatcaagccgtgccagcgtttccagaatattaagaccggatgtttcccagaagttattgacctttgttggctttccatgctgaatagtcaaccagccatcacgggcaaggcgctgcaacacttcacgtaaagtagtacgggtgacaccgatcaactcagataactcacgctctgctggcagcatggaacctggtggaaagcgattattccaaatgctttcaatgatatactcttccgcgaaacccgcagggctttgagccttaattaccatattttaactattccaaagcaattttcttagctaataataatcatcgatcataccagaatgcgtctgatcgacatagttacatagtaaataaacagcgaaagagtgaaaggaatcataaaaaacggaattattcgctgattaattatgtcctgatacccttaaattgctatcgtttagcgcgtactatgactctttagatttgtcccatgtatccacaaagaggaatattaataataatggaaatcagtattcgacatgcagtggtgaaaaactttctcggcaactcgccggattggtacaaattggctatcattgtttttcttattatcaatccactggtttttttctttgtcaatcccttcgttgcagggtggatgctcgttgtcgagtttattttcacgttggcaatggcgttaaaatgttaccctttacaacccggaggattactcgctattgaagcggtcatcatcgggatgacttctccaaaacaaataagtcatgaaatctccaacaatctcgaagttattttgctgttgattttcatggttgccggcatctatttcatgaagcaactgctactgtttgttttcacgaagctgctgttaactattcgctccaaaaaaatgctggcactcgcgttttgcctggcgagtgcctttctgtctgcgttccttgatgccttgaccgttattgccgtcgttatcagtgtctcggtagggttttactccatttatcaccacttcctttcctccagccaaaatgacaattctgacctgaacgatgatcagtttattgacagcgaagataaaaagcagactctggaacagttccgggcatttctgcgcagcctgatgatgcatgcaggtatcggcacagctttgggtggtgtaatgaccatggtgggcgagccacaaaacctgattattgctaaacacgttggctgggatttcgtgacgttttttgttcgtatgtctcctgtcaccataccggtatttgtctgcggtctgctggtttgcttgctggtcgagcattttaaattgtttggttacggtgctgaattacccgatcacgttcgttcggttttagaagattacgataaaaaaaccagtgaaaaacgtactcggcaggaaaaaactcaacttgccgttcaggcattaattggtatctggctgattttggcactggctttccatttagcagaagtcgggctgattggtctgtcggtaatcattctggctacggcattctgcggtatcaccgaagagcatgctttaggtaaagcgttcgaagaagctcttccgtttactgcactgttaaccgtttttttctctgtcgttgccgtgattattgatcagcaattgtttacgccattcattcaatatgtgctgcaatcttcgccagcctcacaattgtcattattctatctgttcaatggattgctttctgccgtttctgacaacgtattcgtagggacggtttacattaatgaagcgctaatagccttgaagaatggtttaatttcacagcaacaatatgagtttctggcagtagctatcaatacaggtaccaatttgccatcagtggcaacacctaatggacaagccgcatttctgttcttgctaacatctaccctgtctccattgattcgtctgtcttatggccgcatggtgatgatggcgctgccttataccattgtgatgacattggtcggcttgttgagtgtggaattctggcttgttccagcgactgagtatctgataaaactcggtctgatcactccattttaatcgctccgtaatttacctcaaactcagccggatggtgaaaatatgcactgtccggttttttgttgcccctttttagaaagataatatggttaattttatttttttatggtttttaaaacggcaaaatgagccatcatttatagttaaatttaaacgatgggaaaaacagaaaaatgtttcgatttttaaaacagagttcccaagggcgaagcgcatggttactgatggcgttaacagctcttatattagaattgacagcactttattttcaacatgtgatgaagttacagccctgtgtgatgtgtatttatgagcgaattgcactatttggcattttcggagctgctctgctcggtgccattacaccaaaaacgccactacgttggctggcaatcctgctatggctgtatagtggatggcagggattacaactggcgtgggatcataccatgatgcaactccacccttccccttttaatacctgcgaattttttgttagattcccgtcatggctacccttgaatgaatggctgccttctgtatttcaagccactggtgattgttcgatgaaacagtggtcatttctgactctggatatgccgcaatggttaattggtatttttgctgcttacttggtgatgggtgttttggttctgatcagtcagttttttactgttcggggtaagaactgaaaacataacttagttgcaaaaagttatttactgttatcagcttaacaagcttcggagatatcaggaataattgcaccacaataataagagacagcccgtaagggctgttccttaaaatatcgttaagctaacaaaatagcaaacacactacccaacatcgtcgtcggtgtgtttacaagaattatgggttatttttgacaacaagaaaactcaaatagacgtgcagccaccatccaacagggctcgttcatcacagcgccgcccatttgctaattggcaaaccggcgtttgatttccattgagctgtattgccagcactagaattccccctgcatcaaagcaggtcatactggcattttcactcagattgatcctcagatcagaatactgataatttttgtggcgtttagatgaatgatcagtttgttgcccactgcaacccgctaatacccatcccatcagaaaaaagctgcccaaaacgggcctacgttgcaaaaacattttttctcccactgcattaccgatacattagatatttctgtctcttagttcataataacgctcgcaaactaagcaataaatcaatgtccagtgcttttggaaaacaggtttacaaaaatttggtttgtgattaacatctggttattatacaaatagttattaaatatttcataatccatcaggtagtaaatgtacacacatatgtacaaacaaaaaagcactcaaagcatcctagttcaacgactgactctatagtattagacatgttttacgcttgccacaactttgatgggttcacattaagcactatgatcgctaccgactacctaaaaaaaagtcggagattgtggacggtgggaagggaagctactgtcactatagggcagaaatctgcccttaagatgggatatcacaccttgcggcaaccgtggtgatttccaccctagttgattaactccttgatttatccgagggggtcactttgacccaaccattagggaaataccaatggttactttatgtgctgaacaaaaggattaaattcattgtgtttcaacgtattacttgagcgtaaggggctgggcaagcaaacgccaaatctggcgtctgattaaatatcaatgggttattgccaaagtgggtatccccacttaaatgggctttcaaatcccaattggcgcaatatttcgctgatgggtatccgaaaatattcgcatacccaccagctaaaggtattcttcgatgtaactgagaagacggttaaatgagtccacgtctccgtttgaaacggaagcgtgcctgcaccatgcaggagatactatctatcaatgggttaaagacgggaaatcccacctttatacttttatgaagttcccacttttttaaccgcttggggtgtcatattgttttttaataccactaggttattataaccaaagcttaaatgaggtattaaaatgaaaaaattgcttattttattagctggaattgttttgttgtctgggtgtgctgaattcgaaaggattgatactttactggctgaaaagaaagctgccactacagacgttcaaaaatataactatttgatgcaagtctcaaaaggacaaacttacatctatgaacactcatccagaaaacccgaaacttttgaaagtatcagagatagatactttcaagaagctgggttaacggaagaaccaaaaattgtcaaaagagatttaatttataaatgctttaataaaaaaacttacccatatgaagattttgagtgtgtatataaattttactcaaaagagatagatatagaaaaagccactagaacagcagagaatcaaacggatagattgcaccaaatcagaatggaagatgcccacaatatagccaaaaccgtaaccgaagaaggtggggcagaattcacagaagtaaatataggtagattctgtcgtgcatcatccagagtggttgcaactgcttatgcaagcgttgtaaatacttatcatatttatgatctcgaagccgataagattatgcttcttggtcttacggataaagcttttgtacgccttaagaaaaaagtgacctcagataagcgaggtattgctatggtgcgtaacaatcctcaagatcaaaaaatagtttatgaggcatatgatatgctttgtaactcaaacccaaaatcatatattctgaattataagaaaatatttcgttgattataactctcatctaaatcttaaaacacatcaataatttttaacccgcaacctcctgcgggttaatcattcctttactctgcctgtttacccacttcaacaccattcaccgccttctgcctcaaattctacaccgactcagccggcatctggacacggacgtctaaccgtgtgccggcaggtaaatcacagggttcatcatccgtgtaatgcgtctgctcatccactgatttgatgcgccggttctgtaatcgggcaggcatacgtgaaggggctattcgcccctgattgttattctggttttgcaggccagtcgatgctgggtgcggtggagagatccaattgatagagcgctagtctgtagcgatgccatgctgttaaagcggtcttttcttcttcggttgccacatctaagtaaacagcatcctgaagtggctctattttttctcggatttcctttatcaggttccttttttcgtactccgcttgtcgttgcaatgcttcagaagaaagggggaagatatctccccatgttggtaggccatccgatcccgcaacacggcgtttcccttttggtgtgttttgagtgaattcaatataaaccgattcatcaactttcataccgtcctgcggccatgtgccagcatcaatataaccctgtttcagcacttccggataaaatacatcttctgaggggctgtaatagtaatagtccataactagtatcctattgcaatttatgtagatttgtttcagtccgaatatattaactaacatggcggtttgttttaactgatgagtcttgtgtaaaaatccatacaagaccctgtaagaaaaactcccgtcattgcttcggctgctccggccatgggatatcgggggcggtagtgcaatctacctgatagaattttacccgcgcctcgatgagttccgcgcctgataatcctaaaaaagccatcggcttcagtgagccatttttcgtattaggtttgtatcaggccgtcaggctgtttatgtcatcagtaatcagtctttgcaaaaccagataggtaacttattgaataaaagataaattttcctatcagttcagttttatcgttacttttcgaacacggttttctgtgttgtgatagcccaggctatccgggcaagtttattagccagcgcacaccacaccacgcacgaatgttttctcatcagttgcgccctgacccagtcggccagccttcctgactgataatcaattctttggataaatactctggcgcattgaaccagtaaccgtcgcaaatttttatcaccacgtttacttatgcctaaaagcgtattttgccacctgtagtgtactggcgaagcaccagacctgtggatgcagcaaaatcacggctacagccatactgcttaccatcgcctaactgcgatgacaaaacactggcggttatcggtccgacaccaggtattgtctgaagtcgctgtcctgtttcatcacgactcagctcctgttccagtgccgtctcaagctctgcgatctgttcgataaggtagagatagtgagcatgtaagcgcatcagcaactgcgtcagatacggaggaagttcattctctgccagaactgttgaaagccgttttataaccgcagtcccggtcggcatactgatgccaaactccagtagaaaagcatgcatctgattggtcgttttgactttatctctgactaacgattccctgacacggtgcagcacccgcattgcctgttgagcctcagttctgggttgcacaaatcgcatagaagggcgtgatgcagcttcacatatggcttcagcatccacaaagtcattcttgttgctcttgacaaaaggacgaacgaactgaggagagatcagctttgtctcgtggcctaaatcagtaatcctccgcgccataaaatgtgcgccagcacaggcttccataacaaccaccgaagatggacactctgccaaaaactgcattagtttggtacgcgtaaactttttacgcagcagtgccttaccagacttgtcctgacaatggacatgaaaagaatgcttgccgagatcgataccgatgagcgtaacgttttgcatgatggtctctcctgaaataaaaacaccctgtcagcgtacgctgacagggtggaattaaaatccatcgaactcatcacaccattcgaattcgtctttcatgagggtgatctctttttcgctgaaaatcagatttagcaatgatagaaggagctgtccgaccccgatcggttatccgatttaaccgaaccacttgaatttgttccgttatgggaattcccatgtcgggattttgaactactgcattttttgcaggagttggttttacggcgggtagatggcaaaaaacctcgcgagtgcgaggccttgaatctaaatgtaaggtaggattaacgccagttgaaacagaagtgcttggtttgatctacttgttttaagatactgcctaattttcgtgcttcatcattaacatactggactgtgtatatataatcagtatttccttcttttttaggtggggtagtaccaaaattatgggttgcgttatcaactgtgatatcaagacttttcttaagtaactctaccaccgtctgataattaccctcattagaagatacccttaaatacaggcccttataggtgttagaagattctttctccccccaatagaacattaagatgtttttaatatctgttttattgtggatttcagtcaaaataccaaaagtaggctggcttggaccaagccagcctttgttattcagatatccccaatcttgacctttcttatcatcaaacttgctaggctgcgtccctgcctgtaaaagagtcgaatacagcttagacgctgtcgtcatgatattttcagccaaagaacaaggcaacggatttgcactgcggcaagaaaagacgcgctattttttgcatagcgagtggctataccacgccagcgcttaagatgaaggaaagcattttcaaccaaatggcgaaaccgatagagttcacgatcatattctctggcggccttccgatttttccggctagggatatggacttgcatgccttgttgttctgctttttctactattgcgttgctatcatagcccctgtccgccaatagatgctctgcatcgagccctttaattaaggtctccgcttgtgaacaatctgctgtggtaccgcttgtaataacaattctgaccggcataccatgcgcatccacggccaaatgtatcttggtattgagcccccttttgtgagccccatatcctgattaccccctttagcgcctgccgcatcgggatgaaccttaatatggctggcatcaatcatcaaccactcgaaatcggggtcattaaccaattgttcgagcagtttttcccatatccctttatctctccagcgacaaaaacggcggtgggtatttttccagtcaccataatcagtatgtaggtctcgccaaggcgcacccgtccgtaaaatccaaaacaccccattgataaaacgccgattatcttcagctacacgcccccaagcgccttgacgtcctggcaaatgaggttcaagcaggctccagacgcgatctgaaatatcgtggcggcggtgtgcaggtgtactcatggttaatcaactcttatgatggaatggtggggcattattattgcacgaaatttctcatgacgacaccatctaatttcaccatggacaaataatttcatgcggttttttcgtaacgggttgcgatacgccgatttcctttaagaaaaccgaaacagcgttcgacaacattgcggtcacgatacgcctgttcatcaaattgcgtacgaccatcagcacggcctttttcattgattttataaggaataacgctctttatcctcaatttacgcagataaccgcagagttttccgcccgaatagcctttatctgccagcacggctttgccgcgccgtttcatgaaaccatttttgcgctgtatgccaatgccatcgagcaaagggatggcggctcgactttcatgggcttgccccaccgtcaaaagcaggttgaggggaaaaccccgtctgtcggttgccaggtggattttggtgccataaccaccgcgtgagcgacccagcgcatgatcgtcagagatatcgggaggggttttttcgcccctgcggcatctttactggcgcgaatattacggccatccagacaaatttcagaccagtcaatcaagcctttttcatcaagaatggatagtaatcgattaaatattttgttgataatgcctgattttgacccgcgattaaatcggttataaaccgttttccaggaaccatagcgttccggaaaatcacaccatggagctcctgagcatagcacccagaacatcccattcatcacacggcgatgttcaacatgtggacggtcctgcccgctttgaatgaatagggggcatgcaaggttctatcactatccatgcctcatcaggaatgtcgtaacgtgccatcatctttttcccgtattgaaaacaagttagatgataatactatcaacttacattaagggacacagcctagtactacagccgtaattgctctgtaagccgatgatttccccggcggcggtcagggtatcggcaatccggtcagcacggatatactctggccctcgccaccataaggggatattgcagggaatggctaacacaaagggcgggtatcgggactccagccagactcttagacgacggtcacggccataaacttcatccgcggtcacccagcgacagggaacgccggcatcccatgttcgttccagcatctgccgggctaacgggggtttcgttgcaaaagtgacgctggcggggatacccgcggcttcacagcgggaacgggcatctgtccactggcgaggcaggtataatgcccggtcaacaaaggcatgccctccgttgccggcgtaacaaagaaatacgcctatctggctgttttctacccgtccagcggtcccactatactgacgctgtaccccggcagaatgtgtcccttttttgataaaaccggtttcatcaaggatgagaacaccctgttcatcgcccaaatgttcagtgacataatcccgcaggatatcgcgggccatatcgacatcccaatcagcgcgttccagcaaatattgaatcccatcgggggtactttcccccacccattcagccagttgccagctattcttacgttcaacatcactgagcaatccccgaagataggcgaggctgcgttgtcgtgagccggtagagtgaaataagggagccagacgggtatgtaatgcctgtagcgcctgttcccagattttggcaggggatggcatgtgacaccgccttttatttaaggaagaagagccctatcatcgcacatgatggattacggctgtagtactaggctgtgtcccttaattagataaccgcctgtaaaagagtcgaatacagcctaatttcaccctggacaaatagtttcgagcggttttttcgtaacgggttgcaatacgccgatttcctttaagaaaaccgaaacaacgttcgacaacattacggtcacgataagcctgctcatcaaattgtgtgcgaccatcagtactgcctttttcattgattttatacggaataatgctctttatccgcaacttacgcagataaccgcggagttttccgcccgaatagcctttatctgccagcaccgctttgccgcgccgtttcatgaaaccatttttgcgctgtataccaatgccgtcgagcaaaggggtggcggatcgactttcgtgggcttgccccgccgtcaaaagcaggttgaggggaaaaccccgtctgtcggttgccagatggattttggtgccataaccaccgcgtgagcgacccagcgcatgatcgtcagcgatatcgggaggttttttttcgcgcctgcggcatctttactcgcgcgaatattgctgccatccaggcaaatttcagcccagtcaatcaagcctttttcatccagaatggacagtaaccggttaaatatcttgttgataatgcccgattttgacccgcggttaaatcggttatagaccgttttccaaggaccatagcgttcaggtaaatcacgccacggtgccccagagcacaagacccagaacatcccattcatcactcggcggtgttcaacatgtggacgtcccgcccgctctgaatggaccggaggtaaacaaggttttatcactatccatgcgtcatcaggaatgtcgtagcgtgccatcatctttttcccgtattgaaaacaagttagatgataatactatcaatttacattaagggacacagcctagttgaatcaataaattcaatgcctgtcggcttgcctttaagatgcgtaaaaaacgaactcaatgggataagtaccattggcatgacctcaagaaaacgggtgtagctaagcaatgtaggaaacgcttttctatgatataagtaaatgaatccaagataaaaattcttaaaatcacgctggtgtgacatatgaaaagcaataataatggtcataatttcactcgtactcattcgtccttggcgtaaacgttgacgttcaccgctctcaatcaggtacttttgccattgaggcataaaaatctgacaaaaatcgtcgacatgacaatataagttgactaaattacgcatagcgggttcctttgtgagaaatcattcttggtcgaaagatctgatcacggaactcgcttttagttcccttctttttatcccgagttcaggtttattaagtcagaaaatgagtaaagaaataacctattagtattcttattgaaattcatctcaattaaatgaatgatgattttatatatatttttttcattgaaagtaaatattaaaagacgtgttcttagagcacgccttttagtgattaaaataatgacaatcaatctggcattaacatcctgcgtcccgcattcaatgcactcataccataatccctgagattggcaaggccagtttgccacaacacttgtcccctgaaccgtttaccaatcatacccgcaagctggtcaataccactgccaatggtttcaatcattctagacagggtatgttctcgacctaaccgtctttgtagcccggtgccaataccgccagcaagaccaccgagaaagctgaaaataggttcaaagaacggacgggaaatgccaaactgcacggcttgtctggctagccccgttgctaatggggctgtgagacgacccagtaagcggccaagtaacccaccgccaaataagtgactcattgccatttcagcgccacggccagccaagtaacccgagccatatctgagtaaatgtccggaggggttgcttgcgacatctaacccaaaaccgacccaagagccataataggtccccgttccggcattgataccggcacgcgtactaccgctggttccggttaacattcctcccgcagccccgcccactgctgcaccaacttcgtgggtcagagtaacggaactccccatcatggtatcaatggttcccactgccgttcccgcaccaatcgcaccgcccattccactgtcagcattgttgattagtgcgcctattgttcccgtcgcagtgcctgccgctgtagctactgcagtaccttgtgtcgtggcgccataagatgcggcagaggcagcacctgccgctgcttgcaagagcgtggaacgtccttgtaagaaacgggcaagtaatcctccggccttttccaagatccggccaacattaaagcccaataaagcaccaattccgaatccggtagccgcaacacccaaaatgactggaatggcagccccgcggtaacggcaatcgtagcagccaaaccgccaatggccaaccctccggcaatggctcgagcaattttttgtccgcgcctcatggatttggacatgccttcatccgaacggcggagtaagagtgtggcaaaccagaaagtattgtgatttcgattcgaggagggggccaagccatcgttatcggtcaatgtgaccggattgttcctgaccattaggtacaggttcaagccatcaacggttcctgcgggatcggcactcagccagcggcctgcccacggttggtaataacggtagccataataatacagccctgtttcatcccgttctttgccggagtaacgaatggttttgtaattggcctcagtttggtttctggccgcccaaattgatgtaccgccaaacgggtaatattcttcctggctgatcacttacccttcattatccagttcaagctggctagagccgagcagattatcgtagctataacgaatctgattattaaatctgttaactctgtcatctctagtcacttgtggtcatgtttagtcattaattttaagttaatttattgatttgaaaaataaataaataattttcttgtttgtaataatcagctatagtcacaaatattcacctagagtcatgaaaaaaatgtacacacgagtgtacatgttctacattaaaagcagtgttatttttctaggagattaatatggctattactgattcatggctctcagagtcaactcaccttcttcgttcttttctactgtgatttttatctcaaattgttctttcatttttttatttcctgttttcagagtaagagagtccccagcaatggcgctgtaattaaatttgttttgttgtttttattattattctaattcggctatttgtatttctaactcagatattgtttcatgtaatgagttaattttattcattgcttttgaatactttttccgtagggctatcttttccctttctcgtctaacatcggctttcagttcttccagcacctgagcatgtcgctctataaactcaggtcgcatctttccacggcgtaatgcagaagtgccgtcttcctgaatgacttcttcggcagggaagttgcttggcctttcgtcggcgttgaactgcttttgcgcccgaacgtaagccagtttattcagtgcgcctttctcactcagataagtcttgccggaaccgcgaacgacatagacatcgcgtaattcgatagtgatatcttggttggtggcggtttcaatgggtttaagtattttcatggtgactccttattgattgaattattttctcttctttttttatttgctttctttctcttatttcatcgactgcattgacgtgattttcatgttcagcctcgataataagaggtaatacagaaaacagtcaggataatctatcaaggtcagtcattgcatcatcttgggagtattcttcactattaacagccgcgctagctaaattagcaatagatttcattccccttgttatcgagtaaatgacgtcttcgcttgatgatactaataactgtaaatcgctatcatccatatcgcttattctgatattactaacgcgagtgtgtttgtagatgtttttcattgatattctactcctctgactcgtgctaattccttgcctatattaaatattgcgactaatgtaatactaagtaattctgcaccggacagacttttatccgtatcaactaataaagaaacatatgttcttagattttctatttcactcccaacgccttccaattcatcgaatgcctgattatctgacataatatattctttatttatatcccttaaccgttgggctaaattacacgcttaacgatgtacaccacgacacattaaataagtatcctgttcggctccattctgagttgcagtgactacgggaaatattgaggcttcaatttcttctgcaatttcgacggctgcttgtagtttattgttcatcattggcctctttagcttttgcgcttaataattcaatgagttgtttagctatgttatttgctctgctattttccattttttctaatatcattaccgtttctaatactatgtgtaggtcgaaataatcttcctttgatgtgatattgttgaacattattctctattctcctgttattaactcaccacagctcactcggaaatgagctggagttagtcaactgagagccgcccactcacgatagtacttacgttcgacccaacacagttttgccaaacgacgacgaatctcagaacgcggcgcttcggatatagcccactgacgataacgttcaaatttttctttatgttcagccacaaatttcattggtgtagtcaacacagcacacaaaacccttttcactatccctgagccttgttacagcacggcgctggcgacggtgaaaccgttacctgttcagcgtaagatcaccggcaataaacaggtggatgcttacctgtgggtactggcagtcattaagaccaatgaacccgcccaccttgaggccgctgaggaagccttgaagaagctgaaaatcacccccaaggcagcccagcagaaatattctgactacctgatgaaatcgggtgcacatcctttccagatagcctttggcaccctgagcatggataacccacaaggttatatcaccagcgcgaaggagcaacttaactaccacctactgaagtaggtgggttagcgcacttcggtgccgacgactgaaagtcgtcgaaccacgcacctcgtaaacgcgcataggtcaaagaattaaagtcaaagtcaccgtctaaagacggtggttttaaacctttcatatggaaaaatcaaaaaggccagtcaggtgagggcatcttttgccagctacgaagccacactggaactgaccgaaccggagaaattaatgctggtgggggagctggcagacatttatgaacctttctactactggagcgaaacagaacaggcagaagggtgtatgcgcggtgatcgtattaacgaaacggataaattacgccaagcgacggcgaaagggtttgctgaacaactccccgaaccccacaccttgtctgatgttgttcgtgagttcctttattgggactggttatatcagatgcgtaatgtagcggacaaagaacttgatccgggcggatacggtgatggtgataggtattacatctatgacagacaagattatctcgaaggaaaactggccactatccaagccgtgaaccgccaagaggctatcgacgtctgtaaatgggtgctggaagaagaacggttccatgatcgtgagctgaccgacaaaattattcttaatctggtgggggagagtgcggatgcgtgatattcagatggtattagaatgctggggtgggtgggcagcaagtggacacagcagtatcaattattcatctattgcggcaggcttcaaagggttgctgccttccacgtcaaaatcaaggctatcttgctgtgataacgatggcattgctgtagatagcgcggtaggacgattaatcaaatcagggcgtacagatgagtttgagttaattgaattacattacatccacgacatttcgaaatcagaaatagccagaaaaaagaaatgctctgagggcaagatacgtcaaaatctgatggtcgcagaaacctttatagaagcctgtttaatcatggcggaggtgactttggaaatggacgcttggacacataaagagacaccaacagaaaaagtggcataaaagcttttcgtaacgaaatttacgggttattgtgataagagtgaaagccatgtcacacagcttatcgatttaacaagcctcgcccagtgcggagctttttattgcccatcgtctttcaaattataagcctcgctgcggtcgggattcgattgagatagaagtctgacctaagtaaaatttctggtgatttagtagtaggatgaaattacctttaactttaacgaataataagtgagggatttatgtctgaaattaataagctggataataaacaatgcccgtttgatcccgaccaatacaaatataataaaaaaattgatatcgaagttgataatgtggcaccaactggttctttaccatgggcattgattcaagtgtatttaggaaaagaggtgcatcgtagtggttggaatgcccctatagaacacatgcgtcttacccataaatcagaggttggtaatacagatgatggggctgcttatattgaaaagagtgataagggtggctattggtctcgttggcagccaacccaagaagatttgatggcttgtgattggagtttattgaaatcagaaccgaagccagataattgtatgctggaatttgatcttaagataggaactgaccaatatcaatatggtggcggcacggctcaagattgggggtatatgaccaaagctggggatataagtgtaggtgaatctacttttggcgttctggccgatcttcaaagcattataggtgttgggagcatctcaactttcagattatttgaaaaccccatcggtactttttataatatactattggaggttgacacccaaaaccagccagacttagagagtaaagctcttgaagtaacggcgaatggttcaacgtataatcttggctcaacctcaaattatacaactgatttcagctatacctctgacggcgcaaaacaactaggcgacctactgaaacaaaacgtaggtaatacgctacatttttgcttcaactggaagtaaatctacactctaaatccaaggcctcggactcgcggggctttttgctatctacccgtcgtaaatccaactacgaaaagatatctcgtagttcgaaatcccagacttgcgggatatttagatgaatatttcaatgtggcaaatagaagaaatggctgaagaaatcatttctggactttttgcagacggtaaaactccaatggaacaatttggtattaattggaagcaagctgaacgattagactcacgaaacgaggctcaactctccggtaattccagttagttcaaacttacttattattacttcgatactttttacgtaacctgaacccaagagtgataagataaatggctagtaaactttcaactgaattatataccagtggctgatactgcagcatacaaaccgaatacgttccggtgccaccgatacccattccggcacacctgctcgctgattgtttgcctccggtcattcccgacaaaatgacatggagtgacagtctcatactgaatgaacagttactgacggtgattgagcagtgcaatctggataagcaggcaatacgagaaattgaagcggagagaacgaaatgatgattgaaaatcaaatacccccaatgctgattgagcatcgagtgcaaactaatcaactatcatcctcacagtcgctattcaggatgtattgcctggcattgcagttagaggcggttatgggtgagatagaaaagcgagccaagatcatgagagcagaaaacaccttgccaccgcagagcaaatgatactggggtggcaggagtatgttaggacgcagtgtcagtgagatttgtttgaggtctgacacaagcgtgagaactgtattaaaaccacagcaaaattaaaatggtcttcctgatgtgggtgctatccatcatatggactgcaccctaaaaagttaaaatacgaataaggaaagaccatgaaatttgtagttaaaaatatcagctatctttcaaattatatgcctccagaagatatagaagtggagcttaggatttttacggatgaaaatagcagaaacttttttacagcttgggttgagtttccatatagcgacaacttgtctcttggcgagattaaagaaaaagctgtagaaaaagcgaaagaaaagtttaaaacagtatttagtcaaatttaagaacattccattacaccaacaccccatgccatcagttaacgctggtggcttttttgttttcatcctattgagttaacccatagaggccattatgactgaaccgaacccgaactatgaagcgattgggcactgcaagatattaaaggaaaagatagccgagcttagtattcagagagtcaggcgcattgaaaaactgaatgatgagattatgcgcttgcagggatatccctagagccatgttggctaaacggttcatcatcgaaaccatcaatgatcagcttaagaacgtcacacaaattgagcattcccgccatcgtagtttgcatggcttcatgctgaatttattaggtggattaatcgcttactgcttaaaacccaaaaagccatcactcaatatcacaagcgctgaaaaaacaggacttcgggtgatggcttaaaccgatctcaggttaataaataaaagacataaattagatttaaaacagtcaccaaataaattgttaggcggattcatataataaatgcaacactcagaaagtgattttagtggggggaagacataccgagtatagcaataaggggcaagtgatacgtacttatcagccttattatctggacgattggcgttatgtggcagatgatagtactcgcaatcatgtagtatgccgatactcactattacgatcctattggtcgggaaatactggtgataaatgccaagagatatctgcgtcgggtgcagtattatccatggttcagtatcagtgaaaatgataccgctgctgaaacgatgacacaaagttaacctcaaccttccctgccccattcgatgggcagggaataaacatcaccgacaataatcgttattaagccggataatttgctaatatttcagcaacaggctcagccagcaactctcctcgccatccacggagtaattcaggctgataatcgggtgacttcagtttccaatgagaactgagcaattgattgatttgccgacgggaagccaataattccacactaaactgctgggactcactaacctgagtgaccagcgatttaatttccttaaaggccgtacgatagcccggataatcaatgaggtttgtaatgagagccggacaggcttcatctggaatatctctgctctctgcaaccattaccagcaaacgacgcccatgacaacggatttcctgcccacttaatcctaaggcatccagctcccccaaagaagtcggcatataacgggctacctgccatagattttcttcgcgaataacaaaattgattgccaaatcccgttcccgtgcctgatttaaccgccatcccgccagttttttcaaacaggccagctgctttggacgtaattgccacgcgttacctatatctttgtaagcacattctggcatcaatatttctttgcggcgttgggcgatcagataactttcatcttgtgccgcatccatgtatcccgcctgcttcgttgccgccaccagaatatctgccaaaggcaataaataataaacatccgccgcggcgtattcacactgctttccactcaatggacgagctagccaatcagtgcgggactcacttttgtccaattccacgtgaagatattgagcaaccagtgttgcgaaaccacacgacataggatggccaataaacgcagccagtacctgagtatcaatcatcggcgttggcaaacattgaaagctattccaaaaaacctctaaatcttcactaccagcatggatgaattttaatacatctggatcagtcaacaactcccgaaagggctgccattctgaaatatcgagaggatcaatcagagaaagttgttcgccatcaaacagttgtatcaaacctaattggggataatacgtccgtgtgcgtacaaattctgtatctaatgcaattgttgcgtgtttttttgcccgttcacagattgactgcaattgagcatcggaggtaatcaactgataattcaaaacatcattctcttagccattcataagacttgtacaacaacgccggtaaaaaccggcgttgttgatgtgataggcaatcttaaaatatttaccctttaaaaaatcgttcttaaggctataaacggctaaaccgtctcccttaagacaaccatctataacatgatcaattcgccgctgtcgcagcattattcgcttttgctaattcttcgttacgcagttccttgcgaagaattttacctacatttgatttcggtaattcatctcggaactcaatgagtttcggtactttatatccggtcagataacgacggcaatgcgtcttaagctcgttctcagttaaactctgatccttacgaaccacaaatattttgacggtttcacctgagttatcgtttggaacacctattgctgccgactctaacactttaggatgggaagaaacaacatcttctacttcattgggataaacgttgaaaccagaaaccaaaatcatgtcttttttccgatcaacgatatgtaaaaacccgctttcatctacattggcaatatcccctgtcgccagccagccatctttcaatacttcagccgttgcttcagggcgattccaatagcctttcatcacctgcgggccatgaacccacatttcccctgcttgccccaaaggaacttcattgccatcatcgctaaccagcttaatttctgtcgaaggtacagggaaaccaatgctgccactataatgagtcaggttatagggattacctgaaactagaggtgcacactctgtcaacccatagccttcaagtaaatgacaccccgttaaattttgccatttttcggccactattctctgtacggccatgccaccgccaaccgacaaacgtaatgaggagaagtccagtttctgaaattcagggttattcaaccatgcattaaatagcgtattcactcccgacaaggcagtgaatgagtaacgcgacaattctttgaccgttccattgatatcccgaggattagtaatcagcagattttgcccaccaagttcaatgaacaacaggcaattgaccgtcaacgcaaaaatatggtaaagcggcaatgcggtgacgactaattcttgtccgggagccatcagcggagcgtaattagcctttccctgttcaaggttcgccaacatattccggtgggtcagcatcgctccttttgccactcccgttgttccgccggtatattgcaaaaatgccagagcatcgccgtccacatccggtttaacatactgcatacggtaacccttgtggatcacgctgcgaaacgaaatggcatccggtaagtgatacttcggtacaagccgtttaacgtattttacgacgaaatctacaagagttcctttcggacgggataattgatcccccatgcgcgtcagaataacgtgcttaaccggggtgttgaaaacaatcttttctaaggtatgcgcaaagttagaaacaataactatggatgatgttccgctatcagtaagctgatgttccagctcgcgcggagtatacaaaggattgacattgacaactaccatccctgcacgcaggacgccaaagagagcaacgggatattgtaataagtttggcatcattaatgccacgcgatccccttttttcagccccagtccattctgtaaataggctgcaaaggctcggctacgctcttccaatttacggaaagttatcacctcgcccatgttgataaatgcgacttgatcggcataacgtgccacagcattttcaaacatttcaatcaacgacaaataacgatcgggatcgatttctgccggaacatctgccggataatgttttagccaaactttttccaagttgaatactcctgaaatctaattgctgtataaccactgaccatgaaacaaaaaccagacctgtatatttaacaaattattaactcagcgtaccagtttgaaaagaaacattgttcaggttggcgatatacatcactaatttaatactatatgtctctgccaaaaaataaggcagcttctgctgccttatttttttattatttatcaatgagttaattaaataaccaacacttggatgtataacgctttgattatacactgatttaatcatttttgacttaaactaacttcattattctaaatagtaataagcaggatgaaccaataaaggataattattaggaagataatagtaaacaaagaaatgaaactttgaggatggcctcgccacttactttatgaggccatttattttgtatctgcaaactttatccgtcagacaggatcattcggtcaaaatcgtttcaacaagcactacctgagtctggcttaagacactcaatacctttccgccaaagcgtccttcatactcactatctggccccagtctgaaaaataaggggtaccataatagttccagaaaacagagttaccaacaggtggtagatcaacacgttcagattcataccagcgtttaaaaccgacgacattcatcacgacataattatacggactattccccaccatccctttttcgaggtctgtaattgaacccaccactgtcacataatgatctttaaaatcatttggttccaaaaaaccattcacataggcataaactcgtccaagagacggtttattcaaaagcggagctgcattacttgccagtggtaaagccaaaatttctagccgagtcctgtctttttcatttaagacactcaataccttgccaccaaagcgcccttcatgcccaatatataattcaggtgtatttttgacagaaagcagattttctacgggtgttttggtcgttccttttattgcatcaggaaccgatacacaacctgtaagtatcattgctattgctcccgccaatgcaaccacttgcagcatgactcgatagtgcgtccccttaagcataagctcctccattgcagtaaaaatcacggaaaaaattaacctgagcatctatattcatggacatcatttcccatcacaagttgcatcagctttacataattacgtttatttactttaacggcctggtaatttcttccatgtcacttcattgcgcagataaacgggttcggcatgttcaactaccgttgcttctcctgctttccacatctgaacagccagtggcagcatatcttccgcatgaggtaaagtaatgtcactttttaccaaatctaaatgagtgtccaataattgaggataggcttcccatccagttccggcaattgcccaaactccagttaaggcattcatgacggcctgtgcctgttcaggcttcaaaactgcctctgtttcatcaccctgccattcaccttgtgaattgcgggtatattgcccccaataaacctctcccatacgggcatcgatggcaaccagaacattttgagcgccttttaggcgaaatgccccctgtgccatcgttttgagcgatgaaacaccaagcatcggcaactcagctcccaacgccagaccttgagcaatgccaataccaatccgcaccccagtaaaactgccaggccctcgaccaaacgccagcgcatccagctgttgcagactcaaattgccctgagacaataccgcctgaaccatcggtaaaatgcgttgagtatgttcccggggagaaatttcaaactgtgcctcaatgacactttcgttccaaagtgcaacagaacaagcttcagttgcagtatcaatagctaaaatccgcgtggacatgccttaactccggcaagaatagaattcgaaataagggggctatactaccatagcccctgagattttactctgactctgttggacgtgatttaagaaatgccaccgctttcgataaatcacgtgtacggcgggcaggcggtaagctgttaagaaaaatttcaccatatgggcgcattactaaacgattatcacaaataacgaccacgccataatcatcaatatcacgaatcagacgccctacgccctgcttcagactgatcactgcatcgggaatctggacttcactaaaggcatctccgcctttaagctggcaatcttcaatccgtgccttgagcagaggatcatccggcgcggtgaacggcagtttatcaataatgacacaggacaatgcatcaccacgaacatccacaccttcccaaaaactacccgtcgccaccagtagcgcattacccgcagaaataaactgtgacaacagttgtcctttgcttgtttctccttgcaccaacaccggcaatgtcaggctggcacggaactcttccgccagaccgcgcatcatctgatgagaagtgcaaagaaaaaaacaacgccccttattgctttcaattaatggcttcaacatacgtgctaaccattttgccccgccattctggttcggtgagggcaaatggcgcggaacacacagtaacatctggcgctgataatcgaaggggctgggcaagagcaacgtctgggcttgcttcaatcccaagcgtgccgtgaagtgttcaagctgttcattgacagataatgttgcggacgtgaaaatccagcaaccagactgttcacggatcatgtcactgaatttatcggatacagatagtggcgttagtgccagcagaaaatgtcgtccataactttcgaaccaatagctatagttgggtatagtaacgtcgatcagccttttaagacgattacgatagaccgttgcccgttcaaaagcagcatccaacatggccgagcgccccaaagagagcttcattacgtcataacagagttccagtgcatcatccaaccgtaccagcatccgctgtatctgtggctgctgcaaggcttcacggagattgccccgataactgttctctcccagggacaggcgaaaatcctgcgcactttggctgaggcgatccgcacttttctgtagttgggcctgatcccgtacttcggtacggtaggccatgatgatatctcgtgataaatccatcaattggcgactactcaattgctgaccaaaatactggctggcaatatcggggagctggtgtgcttcatcgaaaattaccacatccgcacgagggattaattcgccaaatccggtatctttcaccaccatgtccgccataaacagatgatggttaacgatgactacatccgattccatcgctttgcggcgagctttcagaacgaaacattcctgatagcgcggacaatcactaccgaggcaattgtcattagtactcgttactaatggccagacagtgctgtcttctgcgatttggtggcaagtactgatatcaccatcttctgtctgagatgaccaacttctcagcctaaccacttctgccagcatctctggctcaagttgagaactgccaagtgattgctgttcaaggcgctcaagacagagataatttgagcgccctttcaataaggccagactgcccgtaaacttcaacgcatcagcgacggtcggcaagtcacggttataaagctgatcctgcaacgccttggaacctgtggaaataatcacttttttgcctgaacgtaatgcaggcaccaggtaggcaaaagtcttacccgttcccgttcccgcttccaccaccaattgctgctgtttttttattgcagcgctaatggctaaagccatttcccgctgtgcgtcacggggcttgaaaccttgtattgccttggcaagtacgccatttttcgcaaaatcgtctgacacgaaccgtctctttacaataaaatgtggcagaattatgccaatactgagtagtaatcaccagccaattcagcaataaaactgtatacattaacaggagatttaatgactattgaacgcattgatccagatacccgctggtcagaagcggtcattcacaatgacactatctattatactagcgtgccagaaaaactggatggtaatatcacagaacaaaccgccgatacactggcagcgattgatctcatgttacagcgcttgggttcagataaaagcaaaatcatagatgcgacgatttttctggcagataaatccgactttgccggcatgaatgcggcgtgggatacatgggttattgcgggaagcgcacctgtacgctgtactgttcaggctgaactgatgaatccaaaatacaaagtggaaattaagatcatcgcagccctataaccttcatttttcaggtttgctatggcattgagaacctttcaactcactcaatgccattctacaaattaaatttaaaaaatcgccatttaaggcatcgcacttaagccattttaatcataattatgccaattaatagcagcacaatgccaccccaacctttgacattcagtctttgattaaacatgatccaacctgctgcaactgtggcaataatcccgaatgcgccccaaagcgcgtaagcgatggaaagttcaataccttttactgcttgagccagcgcactgaatgccgccaaaacagccaccagcgataaaaccccgatccagaagcgctgaaaaccgttggacagtttcagtaaaatattcgccactatttccagtagaaccgccagaacgaggaaagcggcatgccaccattcaaatggtgtcaacatgctatgcctccttcatttgataattcgaggctttttttgtaccggatttaatcagtgcaattccggctatcaacagggccaatccaccgattttcatgggtgacagtgattcattgaaccacaatacgctaaaagctgtaataaacaggatgccaatcccttcccatagagcataagccactcccagagcgacctttttcacggcaatggccagcaaaatataagaagttgtgatcatggtgtacatcacaatcatgccggtaaaatcacctgaaacactggcttgtttcatggacagagtaccaatcacttctgtcaaaatcgccagtgcaagaaatatccaataaatcatttttttctcctgaacataccgtattagcatgccaagacatcaaaccattaatgccaataaaattatttaaaaacgtgatatcagaattagcctgacattttggcgaaaaactagaatcgtccggtgaaaaaccggttagcaggagaagaccctaaagtgcaccgcaccagtagtgttcgctagataagatagcggagagaaaaagaacatatgtactgcgttgaattttgctactttgttgaattgtgacgcttttggcgctattcatgatgttttattctttcatcacacgataatcactgtatgatatactacgaatctccatattagtggtgttaatggtgggtatatttctagcatagcctaaaatagaaagcaatgacttgagttccgatagagcgttgaaattgataacaagtcagtcattcagccgaatatcaaatccagctgaatgtataacacgattaattattttttgttattaattttgttgttactcaaattcattccacgagcacccatcacgggtaatcatagcgatggaagctactggcccccaagttcctgcttgataaggcttcggtggttcgttatctgcttcccaagcgtccataatggaatcaacccatttccacgcttcttccacttcatcacggcggacaaacaacgcctgaataccacgcatggcttccagcagcaatctctcataagcatctgcaagatgtgtctgactaaatgtttgagaaaaactcaggtcaagtttcgtggtctgcaaacgatgcttgtgatccagtcctggtgctttattcaggacttcgatatcaataccctcatcaggttgcaagcggatcgtcaatttgttctgcggcaattgctgataagaattggcaaataaatttaatgaaggctctttgaaatagacgacaacttcagagcattttgccggtaagcgcttacctgttcttagatagaaaggaacacctgaccaacgccagtcatcgatatcaacgcgaatcgatacaaaggtctcagtcttgctgactttattcgctccctcttcttccagatagcccggcacttttttaccatgcacgaagcctgcggtatattgcccacgaacggttttttcccgcacattggtctgatcaatgcgacgcaatgaacgcagtattttaactttctcgtcacggatgcggtctgcggttaaatcagacggtggagacatggcaatcatggtcaggatttgcagcaggtggttctggatcatgtcgcgcatctgtccggcctggtcaaaatacccccagcgcccttcaatacccacttcttcagcaacagtaatttgcacatgatcaatcgtacgatgatcccaattattggcaaacagtgaattggcaaaacgcagcgctaataggttcagtacggtttctttacctaaataatggtcaatgcggtagatctggctttcattgaaatattttgccacttcatcattaattgctctggaagaagcgagatccgtccccagtggtttttccatcactacgcgattaggctctttattcaaccccgctgcccccagcccatgacacacggagccaaaggtattgggtggcatggcgaaataatgaatagctggcaggctgtcctgtttgagtattttcgccagtcgagtgaaatgttccgtttcattgacatctaaattacaaaactccagacgtgtactcagttttttccacaattctggatcaagtttttcagacataaatgttgccaacgcttcctcaaccaccttcgtgtaggcttttttatcccagtcagcgcggccaactccgataattcgggtgtctggatggatataacccgctttttctaactggtaaagggaaggcattaatttccggcgtgctaagtctcctttcgccccaaaaatcactaaatcacaagcctgagctacggatgtcaccgccatgttgcatctcctcaattacgggatattgtaatttttttacagaactcgcgggtaatgtactcttttgattataagcagtaaacactcatttattcatgtagactgctagagtaaatcctatcttccccgttttctgggtacgattttcacgttaaaactgtattgtggtcgatatttataccgcactgtgacaatttactgaaaatttccaacgtttaagaagtaatcttaccaagttgaaagttagacacccgtcatattttcatgaaaaatatcaacttattcattttttgccactgccagccttcaataacaagtagtatattttcatgaaagttacatagatttctcctgttaatgaaatcgttaaaaccaaaggttgaactgcgtcttatgaatacactggaacgcctccaaaatagccttgatattttaagtaagtcagaaaaaaaggttgcgcaggtcatccttgcttcaccacatactgccatccattcaagtatcgccaccctagctaagctggcgaatgtcagtgaacctacagttaatcgtttttgtcgtcgcctgaacaccaaaggattcccggattttaagttacacctggcacagagcttggcgaatggtacgccttatgtaaatcgtaatgtggaagaaagtgacagcgtcatgtcttataccagcaaaattttcgaatcggtgatggccaatctagaaacggttaaaaataatctggatattgcggccattaaccgtgcggttgatctgctgacacaggcaagaaaaatctctttttttggattgggtgcatcagccgcagtagctcatgatgccatgaacaaatttttccgctttaatatccctatcacctattttgacgatattgtcatgcagcgaatgagctgcattaacagtgctgaaggggatgttgtagttctaatttctcatacaggccgaaccaaaaatctggtagaaatcgccagattagcccgtgaaaatgacgcaactgttatcgccatcacctcaacgggctcaccgctggcacacgaagctaccctgcccattttgctggatgttcccgaagacacggatatttatatgcctatggtttccagaattgctcaacttaccatcattgatgtactggcaacgggctttacattacgccgaggctcaaaattcagggataacttaaagagagtcaaagaagcgttacgcaattctcggtttgataagtatgagtaaaccagaaaaatagactgtgtttttgttcactatttatcggctctctaggctggtagcataatggaaagtctccccccgtcagtatcattcttattgcggggttgataatcaagaatctaaatggttatcttacggtaatcaaaaaccctatacttcacaggtcaacggagtaatacatgtccagacggctcagaagaacgaaaatcgtcactacgctaggccctgcaacggatcgtgacgacaatttagagaaagtcatcaatgcgggagccaacgttgtccgccttaatttctctcatggcactgcggaagatcatgttcaacgtgctaataaagtgcgggaaatcgcagcccgtttgggctaccacgtggccatcctcggcgatctccaagggcctaaaatacgcgtatccacttttaaggaaggcaaaatattcctgaatattggagataaattcctactggatgccaatcttggtaagggagagggagataaagaaaaagttggtatcgactataagggattgccgtctgatgttacgaccggtgatattctgttactggatgatggacgcgttcaattgagagtcctggatgttcagggcatgaaagttttcacggaagtcactgtaggcggtccactttccaacaacaaaggcatcaataaacaaggtggcggtttgtcggctgaagcgctgacagaaaaagacaaacaagacatcattacagcagcaaaaattggtgttgattaccttgcggtttctttccctcgctcaggtgaagatctgaattatgcccgccgccttgcccgtgacgcaggttgtgaaacccaaattgtcgccaaagttgaacgcgcggaagctgtcagcagcggcgatattattgatgaaatcattctagcatctgatgtcgtcatggtcgcccgtggtgatttgggcgttgaaattggtgatcctgagctagttggtgtccagaaaaagttaattcgccgcgcccgtcaactgaatcgtgtcgtaattaccgccactcaaatgatggaatccatgatcactaaccctatgccaacgcgggcagaagtgatggatgttgccaatgcggtacttgatggcactgatgccgttatgctttcagccgaaaccgcggcgggtcaatatcctgcggaaactgttgcagcaatggcgcaagtttgtctgggcgcagaaaagatgccaagcattaatgtgtccaaacatcgattggatattacattcgacagcattgaagaggccatttcaatgtcaaccatgtatgcagccaatcatctgaaaggtgtcaaggcgatcattgccatgacggaatcaggtcgcacagcacgcatgatgtcacgcatcagttccggtctgcctatattctccatgtcacgccatgaatccaccctgaaccggaccgctctctaccgtggtgttacaccagtttattgcagcacccacactgatgggatctccgccgcaaacgaagccgtcaatcgcctgcgcgataagggttatctgacttctggtgatgtggtgctggttactcagggcgatcaaatgggaacgattggtagtaccaatacctgtcgagtgcttgaagtagagtaattggctatcaatgaatagcatcaggggcagaatatgctgcccctgatattaaaaaatcagagatctttccttttataaggctctatatcccctactttccgtgttttaagcagtttcagtatccacgtatactgttcaggattaggacgcaccaattcctccagctcctgattcattcgacgggcaatataagtgtcattctgcccttcaatatcatccatcggcggacggatataaatatccaactgatgagtctggcaattatagaccggaaataacgggacaacggctgccctactgactttcatcaagcgcccaatcgcgggtagtgtcgccttgtaagtagcaaaaaaatcgacgaattcactgtgttcttcaccatgatcctgatcgggcagataatagcccaagtgcccctgacggatcgacgcaataaacggtttaatccctgcttcacgggaatgcaggcggccaccaaaatgagtacgaactttattccataaataatcagcaacaggattgctctgatgatggaacatgcctgccactttttggtcacgcgcagccaacagcatagcaggaatatcaatagcccaaccatgaggaaccagtaaaatgacattcttaccttgtgcttttaacgagtgaagtatttcttcaccatgccaccgggtgcgctgaagcgttgattcagcgccctttagacaaagctccgccagcatgacaaaagactgaggcgcggttgcaaacattttgtcaatcaacgcttcacgttgctgttcctgtagctcaggaaagcaataaaccaggttgattttcgccctgcgacgggcacttttcgctttcttacccgcccaaatacccatcttggctaacagtggatcacgccattttaccggaacataagccaatcccgccaatactcccacaccagtccaaagcccccaataacgaggatgcaaataggatagatgaaacgttgggacatatcccagtttactatctgtatctttctctttattcatgagctaactctgatggttccaaaacaagctttcaatacacaagcttccaacaaaaaataatataaaaacggatgatatcaatcatccgcttttatgtctgttaataatcgagggggcaatgcattcaatccagcaataattgaggcttgatatccctgactttagctatatattccgaacgctctttaccgtttaatccgccagagcgtggtaatttagcagtaagtggatttactggctgctggttattccagaattcaaagtgtaaatgtgggccagttgagcgccctgtattacctgacagagcaatacgttcaccacgcttcactttctggcctggtttcaccagcaattttcttaagtgcatgtatcgagtggtatactggcgaccgtgccgaatggcaatgaaattacctgcggcaccatcaaacttggagacaatgacttccccatcccctacagccagaacaggtgtccccacaggcatggcaaaatccacacctttatgtgcagtgatcctcccagtaacaggatttaaacggtggggattaaaagaagaagataatctgaattgtttcatagtcggaaagcgcaggaagccacgttccagaccagacgcattgctatcgtaaaagcggccatcatctgcgcggaaggcataataatcatttccgccactatgcaaacgaacacccattaactgactctgttcactttttccatccagcatttcacgtgacatcaacacagaaaagcgatcgcccttacgcaatttacgaaaatctatctgccattgcagcgcttttgtgatatctcttgcttcgccactggttaatccagcggaaagagcactaccagaaaaactgccatctattttgcctttgacaatcgtatttttccactcccctttctgaaatgcacttgtttctttaaagacatcaccttcacgggtataaatacgggtttcacgccgtgatataccccatgttaacgtttttaaattaccattatcatcgattgtccatgataatgactgcccaatgtttaaatcgcgcaacgacttatactgattggctaataaagccacatcagatgaatcaatcccaaactgggtcaaaatagaacttaaggtatctccaccggagacaacatattggtggggaaaatttacagttgtatccgaaccaccctcgtcatcgccaattccttcatcagggagctgctcatcgatatcgcctatcgaatcgtcggtcgcatctgagatattatttggggtactcagaataatactgcctgttctttcttcttgttcatggtaagcaactggccgccacactgcgacagctaaggtgactaacgtcagagaaccaagcatgagcttatgcggtctcggcaagttgttgtataccagaacgatagttttaactatctgctgcactaataaaattccttattgtactaattcaggcagctcgcgtattgttcagacaactgagttataaatttcatatagctgtctttatttaatactatgccacttcccaatgggtctagtgttcccgtacgtacatcagtaccttttgctacggtatgaataacggctggcctgaattgaggttcagcaaaaatacatgtggctttctgctcaactaattgtgttcgtatataatgtaatttctgtgcgccgggctgtatctcaggattaaccgtgaacacacctaacggagccaacttgtaatgtttttcaaagtaaccgtaagcgtcatgaaaaacgaaatatcccttcccttgcacaggtcttagaatactagcaacatttttgtcagtttgtacaagctgtccattgaatttacgtaggtttacttctaattgccgcttttgttgcggatactgctcgacaagttgaatatatattgcctgagccacctgcttcgcaatctccggagaaagccagatatgcatattatattcaccgtgatggtgatgttcgtgatcagcgtcatgtttaggctgactcgattcttctaaatcattttcatcttcattatttttcaatagtaatggtttaatggtggataattgagcaagcgccaactgtttgttctgcgcaattttggttatcggcttcgccagaaatgtttccatatctggaccgatcc

SEQ ID NO: 16854 - DNA, 50092 bp, Xenorhabdus bovienii
  unsure (1)..(50092): unsure at all n locations
aggatgtacgattaaggttccatcaatgagaattaatgcgtaccaaccatatgaaacgtagtaatcagatttttttgcaagaaatagctacttttttactgtccggttagccctggtcttacgtacaggttattttattccacgttttagcttttcggaaattccggcggttccggcggaaaacccctatctcagtgcgatgaccaaaatcagcgacgcacaatgtgacgatggaatgatggttgtaaaactcgcagagaaaaatgaaccgactgagtggcgctgccctcaaggcttcgctctgctgggcgatacaagtaaacctttcataccgtggccgaattacacgacaggaaaaagtgtcgagctgacatctgcgatttatacgctgatggatagcgccattaagccagaacagcacaaaaactaatactgctctactcccagggcaagcgcacgaacgaatgtagatcacgtttttgaaggcaattcgattactaagcgagcaaatcacccatcattcagggtattaacaccctaaaaatgtgatctggatctgttcatgttctcgccctggctctacctcgggttccaccgaagaacccggacagaaccaaaataaaatcaggacgtaagaggaataattgattatatagtacaagaaatagacttatccacatcgttgtggataagtcagatattgataacaattttaacgatactgatgaagggtaatcgcaatggcttacactgatgcattaaagcgtcttgagtttttagttagtgaggcgaaaggcgcagatagagagctacttgataaggcaaatcaaatgattagccaatcactcgaattgcagaaagaagcgttcagtgtgattggtaaagcatatgattctgcctgtaatgataaccaggaacttgaggatgatattctaagccaatttatgttcatgaatgattttgacgaaattgaaaaagagagtcagaaagaagaagaaaagaaagaacatgagagagagtgtgaacttttgaaaataagccgtcttgatccctcttgttttactgaaaccaataaggcactacacgactgtgctggggagattgttaaaaaggcgagagcactgtttaaatcagaacctgtaatagctcaggtatggtcatatcgttatggtggctatgacatgatttcatgtgaccttttttcagcagatcgcacgcttagtatgcctgtcactatttccgctgttgccagacagatgcttgaatattttgatgagccggaggttttcgatatggcagaggctgttcatctcgcagggctgattacaaaggccattgatgcaaaggttattgttggtttggggcgaaatgaagttaactctgatgtacttgcaaaaccgctaggggaaggtcacaccaatggtgaaattaatctctggaagcaggagtgatagaaatgaaaattattagtgatgaagagtatcagtaatctttaagtacattcactgaactactcaattccccatatccgttttaaattaactaatcaaggggattgaaacaaattcccttatagtacgttttggggtttcgggagcaacggaacagtaaacacggttaagcggtcaatttaaatagccaaaaattgggtggccaacttacatcgtgaattgctatttttagccagcccatctacgatagccaaatgacctatactcattttgaccaaggttacggcgagagcatcataaaacttataccagtctgtttttaatgatattggctactctatttaaccgcttaaccgtgtttactgttccgttactccccaaaccccaatgccgccgtgcatgatggtggtcacattctgtaattaattggcttttttagttagttaatttattaagtggtatacttaacatgtcagttttctccgagtttgctggcaaattaggggtcagtttggagaacggaaatcattgtacgtttatgtgggatataactattttgtcacaccacatttggcgggatgactgagctcggtttaaccctcaaagtttacagaattggggattgttccacagaacccctatatggatgcgctggatatcgacattcgttataatacctccgtcgcagacagttctgttattgaatccatcagcaaaacgctggaaaaggtactgctaaaagttatgaatgagctgttagagggacaccaacactcgagtcatctcacagacaattcagaggggtaatcgttatgtcagaagaacctatggctaaatttcatcaatggtggagtgaatacaaacgtgatgttgctcccgctcacccgggggcggtatgcgtatcgacagtgtcaaaaaatggcgcacccagtgctcgctttgtcggtttgaaatctgctgatgataatggatttgtattttgcacctggtttgattctcctaaaggtcagaatttggccagcaacccacatatcgcgttaacattctggtgggaagaaaaaggcaggcaggtaagggtggaaggcacggttgaacacgtcagcgagcaggaatcgaaagaagaatgggcctcgcgatcgcgtgatgcacagcttgctactctctgctttaagcagagccagccgctggactccgaaaatgacctgcatgcaaattacagtcatactcaggccgatactgcaggctggcctattgaaaaacctgcgcgctggggaggttacagggtgataccaacgtcgattgaatttttaactttccgcgaaaatcgtatgcatttacgcgaatacttccgccggaatgacccgctttctggctgggaaaagacattacttcaaccgtgaattaaattatatatcacgaattgagaccttgtttaagattttgtttaatcgccacttccgattaaacgtgaccgcctaaatgccttttcaaaatgataggagtattaattaaccttatatcttgattatcacttttacagagcgataatcccctgactgatcatcagggatgctgttgtgagtttgttattattaacctgaacctgaaatgtgtcattcaatggagttcgtaattcagagtaaaccacaacagcctcttctttatcgcctttaagattgaacggtatcttgtgcctcgagcatctattttataagtctaatcatggcgatatctcctgtgtctctgacaaagaggataaccttatgtctgataacatcgtagtcggtattgatatcgccaaacacaaatttgatgtcgccgtttgggcaggcgaaaatcattacaaaaggaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccatgcctttggtaaagcggaattactccgcaataaaaccgataaaattgacgccaaactgatagcacgttattgcgccagtcagcatcctccggcatggcagcccgcgccgctttgtgaatgccaattactggctttagtccgccatcgcaataagctgaatgaaatgcttttgacggaagaaaatcgcctctccgtggcggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgcgctggcagcgatcagttgcaataaagtagtgaaaaagcagtgggaacagctgacagcacgccataaaggggggaaagtcggtgtttgtgcagtgatgcgtaaactcttacgattagcctatggcgtgatgaaatcaggcacattatttaacgcagaaataccgcttgcagtttaatgactgagacggtatctgaggtttgcttaagaagggaactcagtgcctgaggtacgatcaaagtttttgtcaaagaaaacaaaatcgtggagatcctcaggcatgtctaatttagaagaactttactgctgcgtcgatgacttttgccaaaaatttattcctctctggcatcaacagttaattgaaaatggcttgctcaaacgtcgtcgcgaagcttccctttctctcagtgaagtgatgacgctcctcattttattccacatgagccattatcgtgattttaaaacgttttatattcagcatgtcaaacactaccttaaagccgatttccccaggttggtcagctacacccgtatgttaaccttaaagcaaagggcgctcattcctctatgtgcttttttttcgtcacgcaaggctgaaacccaggggatcgcctttattgattcaaccaaaattgctgtttgtcacaacctccgcattccccgtcatcgcgtatttaagggcgtcgcacagcgagggaaaacgagtacaggctggttttatggctttaaacttcatttggttatcaatgattgtggtgaacttttagcggttaatctgacctcaggaaataaagatgatcgtcatcccgtcaaagcacgggtgcaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataaactgatgttaagaaagcgatttttgatagaaacggtcgtggatcagctcaaaaacatttctcagatagcgcattcaagacaccgtagtcagctcggttttttattggaaatcgtcgctggcttaattgcttatacattccaacctaaaaaaccgagcttgaattaacgggattgtgatatcgctatttttaaacgaagctgaggttagttaaagtcattctattcctttaccaaagtgtccgaatttattaaagcacaacagtattaccttccataagtttcctgaaatatgatgtcgtcgtagcccgatgagaagaagtgcagcacagcaccaccaccggatgatttgaatgaaaaaatttcaatttctgttagcgtgtcacctcccataaagagcccctcaatgccctgtcggctcagttcccggtatgccgcatgcgcgtactgactttgtggcagactgagagggccagcagcaaaaaatgaacaggcgctaggcgttgtaatgtctgccagaaattccttctgaaagatgaaatccacaatccggtcgctgtcacgaatctgcggcagcgggcgtcgcaccattcttccgccgacgtcagcaacaattacggtctccggtatgtatagcggcagctgaagtgatgcattagccggcagggggaaacagtcagacttacccaccctgacaccgcgcgcttttaataagctgttgagtacagcgcctcccgcaatgacgcggtcaacgtgacggaggcgggggtggtgaaaaagaaactgcagcttctctttcttgttgcctcccagcagcaatatggtcggtctgttgctataaagtacagaatgtatgcgctcaagctcctgcagctgcgtcattacaccctgtgagtaacaccagggaatgagagacttaatggcacagttcgacgcattttttcggtgtaacttggaaaaacctcctatcaccagacggtcgccagggcgagccagttcgccagcaaacgttgagtcattctgctgctcctgtgcgtagcagcgcgtatttcccataagtgctattccgccacggggcagcctggcaataaattcctgtgctgcagcccccacgcattcaggaaaatagctcacatgttgctgcaaacgctcgctcagcagcgatgcaagccagggggtggattctgctgtacccttaaagtagtctccctgatggttgtaaataataatggtttcccggccgtttatcagcggcagtatcgattctgcatcttcatcaattctgggatgactacgcaccccagaagaaatattgatgcctgcactgaacaggatcactgacgctccgctcatgccatgcgactcagtacacgactgaagcgacccaccagttcatccatctcggattcggagataaccagtggcggagtgaacaaaaaggtcagggcatcaccgtccttaccggataaccgacacgggtagagattaattccctgctgatgtccggcctgcacaaattcttctgcacgctgacggccaagtgtcgtctccacagcccagagcagtccctgccctcggatatcggcaataatgtctgcatcgcccagcatttcctggagcagtcgcccaaagtaagagcctctggctctgattgacgccattccgattttattttccagcgtgtccaggactgcaagtgccacccctgccgacaacggattaccggaataggtatgtccgacgaaatgaggtggtgacagtgatgccagtgaatcaccaatctgttttgaaatcatcacaccggaaataggggtaaagcctgcacctaatcctttaccgatgatggtgatatcagattctgtctcccacgttctcatgttgaaccattcgccagtgcgacccaggccggtgacaatctcatcagcaatcagcagaatatcacgagccctgaggcctgctttcagctccctgaagtagtcagggtgcggaatcagcacgccgcctgaagaagccgtaatgggttctgcgaagatgcacgcgatatgttcagcgccaactcggtcaatcgtttcaaatgtttcgctcagacatacccgcagccattcatccgatgaacagctggcaggcttgtgcagatcataataaggcggcagccgtaaatcgcttacagcaggatcaattactttgtttagcaggttgaccttacgtgcgcggtcatcgccataagtcagagactgaatagtgttgccgtggtttgagatgcgccgccccagagcaagcgtttttttgttattgcccttgatccgaaagtaatccatggcaatgcggtaggctgcttctgatgcctcagaaccgctgttcataaaaaaggcatagcctttattatcatcagatagcgctaccagcctggctgctaaccgctccgcctcatcgctgcggaaatgaaagcggtaagcaaaatggagccgcttaatctgatcctgcatggccgcgataatgtcagggtgacaatggcctaaatttacggtcatggggccggatgtggaatcgatataacccttgccgttttcatcaaaaagccatattccttttccatgagtgaccttgggaacatctggctgatagccggtaaacggatacatatacatataaaccgcctctgtaaagtagtgagataaaacagtccttttcgtctgtgtggtgttcttataacttcagtgagtcagggtggcatcttcctgcagcagcaggacctgtaactcgcttttaactgcagtcatgcaggccagtaagtcgttagcaacatgatgattgacgttaggccggatagaaccattctgaaagaacatgatcccttctgaaggttgacccacgcagaaaaaaagttcacgtttgccgtcacggttaataaactgaaaattacgggtgatattaaatcctgaagcagcgcactcaacgccgcgccgatctttatgcacccagtaactggcgattccggcgtcaataagatcgcggaaaagactattttttgctttcttgacgctgaaattatgtaatttggcatcgatcatggcatcaacgcgggtatattttccggcatggctcaggctgtgaagccagacctggtcgtcctgaatctgaatattcgactgggcataagttacatccacgacatcagcctcaattaacgcctccattttttccatcagcgcaatacagttgccgttggccgcccggttatgcacggcataaaaatctttgagcatgttgttataagaagcgggggaaattcctccaaaatcaatggcatatactactgtttgtcttaaatcacgaaacacgtcatcacacgcacccttgtaaggattatacagattgccctgctcagactggcggcgatcccagtgcatgaatgcaagtaaccgctcacgccacggtgtttcgggtgaaaaatccatgtttctgatggggtcaacgaccatatcccagttaaagagatgagcttcaggatcggccttatgtgcccacgggctgggggcggacagggcagacagggaaaatcgttgcagatttagctccggtcctgcctcttgtgcgctgatgacatagacatagcgttttacgatagtttcaaccggtaccccgtgaaaagaagaggtaatcccgtcattaaggaagcggcgtacaagaaaaatggcctcacacgccagccgttctgtggcctgcgtcagccagttgattgcgctttctttctgtaagtttaccgcccggttaccggcaatgaattgctcgaccaaagggcagctctctgctttcataagggctagtacttcaggaccaaacagaatacggtagtagcacagctgaagttcgagcatcagaagagggaaaacgtggacgtcaaaatcaagctgcaaagcgtggttttcaggtgagctatccggatgcgcaggctctccgagttgctgccgcatctggtcaataagagagcgcgtgaagaaataaccctgatgctcatattttgccagatcgacctctttggcattgtgtggccggctgtaggtgaaatagcctgagcgactcagcgcatagagtttcttgggttcattaccgctggcctcataacgcagcttccctttatcgcgatgaaacctgccacctttgttttcagtgtagtaaaggagtgtatcaatcgctgtcagtcccataccaataacggcgatgctcttgtgctgccaatcagggacgtcaaacagtgggtaggcaaagttgtagtattcggtgatctttttcaaggattcagccagatagaagttatcttttgattcctgatgaccggtagcaagaagaaccatatcaaactcagccggttcaggataaaattcacctgtcagctgatattttccgtgtgatttactgatacgtttaatggtgtctttaataagtgttacaccgattccagcctgtctgacttcattgacaagcgcgtcacagatctcaaccagagattcgccatagagttcacgggtcggaaagtcatcggcattcagcttgtatctttcactgtgcgtggcctgatattttttttccagccactcgctgaaagttacgcgcgtactcttagaaaaaaaatggctggaagtattggttttgtccggcgcaaaagaaagctgaccaacgatcctgttaagcatactggttttagcctgcgcaggagaatgaggccagccggaaccaaaatagccatgtctatcatacagtgtaacagatacattgtcgcgcacattcagttccttaaaaacactatgcagaccattaagaaaatacatgccgtttgggccgccgcccacgattgctattttgatcatcgttttctccgatatatattgctatcagtgagtgggatataacgtttatatattaagtgggatacaaatatattttcagtttcttacatccctactggttatatttcgcctctagttcatccatataacgttctgttgttaacgagaaaagctcatccagggaagatacatttttttcaacattaataagtgatttttccctgtagatgcgatcggcagtttctttcatgctgcgaacagaactccggataaggtgatttgcccatatgagattgctaatgccgtgattaacaaactcctgatattctgtattatagtatttggtgggcacagcgaagagcggcaatttcccacgccagcgttcagaaaacgtaaacacctcaccagcgtcagattttttggagtgaattaaaatggcatcagccccggcttctttataagcctctgcgcgttcaagagcttcttccatgggatgtcccgaaatcaacgcctcgatacgtgcgaccacggtaaaatcgtcaccgcctgtatctttagccgctctgattttattacagaactcgcttacgggtgccagcgcctgattttcaccgataaatgaatttactttaggaaacattttgtcctcaatacacatggcatagatgtttatttgcttaagttttttaacaaagcgcataacgttcaggtaattaccaaaacctgaatctccatcgacgagaatagggatattggtattatcggccatctgctcaagggcattgattacctgagaccaagacgcctcattcctgtctgaaagccccattgcggcactgattgaaaggcctgacgcccagattgcttcaaatccggcatgttcaacgatttttgcgctaagaccattatgtgcttccataaactgtgtatattcaccgcgggccagacgttgctgaatgctcatagttacctcttgcattgttgttaaaaaatcagattataaactcacgattacgtgaaatctccgaaccattaccgctcaactgacgctcaagatagtcaataatcaggtcggcaattttttcctgagactcatgggacatcgcaccaatgtgtggtgttccgataaaattattaagagtaaaaagcggcgaaggctgtctctcatgctcaaatacatcacttgctgcgccaaaaaaaaatctttcttttaaaacgttatacaaatcggtttcatttaccacaccaccgcgagcaacattgattaaaacagcacgctgaccgagatgtgaaagctcctcagcgccaataaggtcacgcgtatactggttatatggacagcagacaacaataatattgcaatgactgaacatggtgcttaagttgctgtgcaaagttatattctgattactcaattccttcacgcgatcacaagaatactcagataccgtacagtgaacatccatgtggtaaccgctggcaatgtcggcaatttctttaccaatactgccaaaacctaccagtcccagttttttataggaaagttcaaagcctaaaagtgattttttatcccagatattctccctgatttcatttcctgcacgaaagatgtgccgatataaacaatgcatcatgctgaaactcagctctgctactgctctggcgttcgtactcggtgtgttatagaagagaattcctttttcatttaccttttcaaggtcaatattatccgtgccagtacctgctcttattattgtgtggatttttttcgctttgttcagcagttccatatccacctgagctccacttcttagtaccaatatgtcatattggcctatttgcgaaatgagttcttctcgacttatcggatgttttaccgtgacatcataattacgttttaaaaaagaaagaagtttttcatgtaccggatcaacaataagcaatttatctttagattccataacgactcagccctgtctcttcatcaaagcccatcatgatattcatattctgaattgccgttcctgctgcgcctttgatgagattatctataacactgacaatgcgtagttcccttttctcagatacaatatcaaccgagatatggcatgcattagaaccaattactttggaaagctgcggataaataccgtagtctttttctatcccaactgaacctttttcttgtccgattatggatacgaacgggttatcagaataatattcactgagaatattcagtatattctctctgtctgtaggaatgtcttcttcaagtttcgcggctataaccataaatatgccgcgggcaaagttgccatgtgaagtgatcaaggaaacgtccgcgtttttatcggtaacaattttaataatttcttcaatttcctgcgtatgacggtgaccattaagggagtaggccagcatattattcgtcatgttgtaatgcagcagttctcgcttggagctgctacccgcgcctgatgttccattcacggcgcttataaaaatattctgagtttttaagatattgcgtttgataagcggcaacagtgcacagagggctgcattcacgtaacaacccggattggcgatataatgacttgttgagatattttcacggaactcctcaggatagccatactgaaacttcctctgaagtgcaggtgccagatgtggctttccataaattcgtccgaactgttcaggatcagcaaaccggaaatcagcgccgagatcaatgatacgggttttccctcctgcaaagcgggcagcaacttcctgagcttttcctgaaggcagtgaaataaacactacgtctgggcagatgccaggaagggattccagagaccatgtgtttttattcacccccgtcaggttgggatgaatagtttccagggggatgtccgcttcacgcgaaattgaatatatttccccaatctcaggatggtacgcaagtaggcgaatgatctctgcacctgtccagcccgtggcaccaatgacataagcaattaatttcatgacaatactcctggttcatttataagaactttgcccttactggttttattcagcatgaagtcccgaagctcagcgaatgttataacgtctgttattatctttttgagagcagaatcttttgtagtggtggactgctgaataatttgtatggctttagccaggtctctccggtcactcagaaaagagccgcgcagcgttatctcttttctgactaacatgttcatatctatgttcacatgagtatcaaaataggaaatgagcaccacctgagcccccggacggagtagcgcgatatagttatcgatgttcagggcttccccgccggctatgacgagaatatcaacgtcggagtctgctatgtctgacatgtcagtttcggctctgaaaccaagcgtacgggcaaactcgcatcgtgaaggagttttatcaatgagtgttacctcagaaatgtctttttcttcgcggcagaagatggcgctcagaagccccatcgcaccagctccaataatcgtcagacgcgcattcggtgaaaacgttcatgttgttaagagcatgaaccaccaatgcttaaaggttcagaaagtacatattcattatcttcagctgtcctattttgaggcagggggagaacagaactgtgatgtactgtcatggtccgggtaaatgctccgctgcttccggccgtgttgtaagtcactttattcaggcagtgattactcagctcacgtttacagttggggcagctaccgcaggcaccataagagaggcctgtaacccactgcccttcatgaaatgcgctgattccggcagcattggtgacccgtccaataaattcatgccccagaattgccgggtactgcttatacgggtgagtctggttcaacaccatgtgatcagaaccacagattgcggctttaacgatctctacctgtaagaaacccggaggcatctggggaataacttcgggttcatacgcctggttacgtttaccgtggcacatcagagagtaaaacatggttatgctccagtgatttcggtcagaagtgtggcgatgatgtcatgatctgattcactcacaagcggatcgttgacgatatttcccgtcactcgtttccttatgtcctcgcctgacagcttcagggatgcgagctgctgtgcagcactgtccagtttcagtttgcgtatcacatatgccacgtactctgatgcactcaggtcttcggtaatctgaacgagctgaggagaaactttgccgtaagtcatcagcgcccgtacccagtaggggtagatcgcggctaaacctctgccgtgggaaaacgaatagaatggagcaaaggcttgttcgaagcggtgaggcaggcaggtactgttgtgacagacgcagatgccacccagtaaagcgctgtaagcggcttcagtataaaagtgttcatcaagttcacccgcggcataccgttcaatattggcgttaatacgcttcagtgattcaacagcgagagattctgtaacagggttaaatttaactgagtgcagagcttcgatagcgtgtgtaaagctgtcgaaaagtgtctcgcgcagaacagcatcaggcattgtactacctagggaagggtcaatcagtgcaacgtcaggaaaaatagaatctccgcgaacgccatctttaatgtttttctttttatcaaaaataatagcgcccttagtcacctctgaacccgtaccaaaagtggtagggacagcaatgtgaaaaatttttttaataaccttgtcaaaagtttttccaaccgcatcagaaatatctaccgagttgtccagacaaatggctgctacttttgtaaaatcaataatgtttccgccaccgatcgagacgattgaatcgtagttaccattccgcaggtgattctgaatagcgcagagcgattcagttgttgctttgaaatcactttcaagaatccatggggtgtatttaacaagcccgcccctttcttcaatcaggtttttcataacgcaaaatcgctcagaagctgacttactcatcacaagcaaagtattacttttatctgctgcagagagatattcagtgagacgtctgagagcacctttttcaaaaatgatacgcacaggcaatgcaaaactgaaattatccaaaacagaaagagccgattcaccagccattggttctatctccttataaggaaaagttattaaaaattgcaggctcttagaaaataaaaatacaagactcgcctgcctggtggacaggatgaaaataaaaataatctgtactgggtatcctcattttcattaacagagcttaagcaaatagtaccaacaaaaacataacttaaaatttatgctatagaaacatttaaatgattactatttgattttttctataacaatttgaaattaatatgtttatttataccgctaggcttattagcgcccgaaagccctgattttgagatttttcttatctttgttgcttactgtttataggcttttaactaaaaaaataaaattagtttttttaataagtccatgaattatcttgaaaaatgaaatttactcgatttttttaacagagtaataaagttcttggctaaaaattcgattcagatacgcgttcatttggatgttacataatgaaacttattgttgcgattaaggtgtgagtcacctccaagacagggcgagatctcacatttttggtcatgactctagatggtgtcgtcatgagaaatttcgtgcaataataatgccccaccattccatcataagagttgattaaccatgagtacacctgcacaccgccgccacgatatttcagatcgcgtctggagcctgcttgaacctcatttgccaggacgtcaaggcgcttgggggcgtgtagctgaagataatcggcgttttatcaatggggtgttttggattttacggacgggtgcgccttggcgagacctacatactgattatggtgactggaaaaatacccaccgccgtttttgtcgctggagagataaagggatatgggaaaaactgctcgaacaattggttaatgaccccgatttcgagtggttgatgattgatgccagccatattaaggttcatcccgatgcggcaggcgctaaagggggtaatcaggatatggggctcacaaaagggggctcaataccaagatacatttggccgtggatgcgcatggtatgccggtcagaattgttattacaagcggtaccacagcagattgttcacaagcggagaccttaattaaagggctcgatgcagagcatctattggcggacaggggctatgatagcaacgcaatagtagaaaaagcagaacaacaaggcatgcaagtccatatccctagccggaaaaatcggaaggccgccagagaatatgatcgtgaactctatcggtttcgccatttggttgaaaatgctttccttcatcttaagcgctggcgtggtatagccactcgctatgcaaaaaatagcgcgtcttttcttgccgcagtgcaaatccgttgccttgttctttggctgaaaatatcatgacgacagcgtctagtactacagccgtaattgctctgtaagccgatgatttgcccggcgacgataatgacattgttgtgctcggtattgatgccatcgtcgccagtctgaccaatgtaaaacctgttcgattgtctttcccgctttttccatccgctttgacaacagcttacgcagttccgctacactgagcggaactcggcctaccggtgttttttttctcctgtatccgcagaaccgccaggactgcatgggccagtaacgacaaggtaatatgccggtgccaactctgccatcgccgcacttcgtagtgatcccgcccacattcccctttggtttcctcaaagccactttcgatttcccagcgacaacccgccacctgaaccagcgtattaagatccgcctgttctcgcagggcatacaccacatagtaagtccgctcctgtctgttatcccggctgcgccgaaccaacagataatgaccataacgccggtcctcttcacttatctgtaaacgccataacggcacgacagcccagtcatactcacgctcaccttttgtccccgttcccgctgaccgtgttttccagtcagcggcagtcaacgtatcggcaatccgttcagcacggagatacttgggtccttgccaccataagggggtattgcagggaatggctaacacaaagggctggtatcgggactccagccagaccctcagacggcggtcacccagcgacagggcacaccggcatcccatgttcgttccagcatctgcctggctaactggggtttcgttgcaaacgtgacactggccgggatacccgcggcttcacagcgggcacggtcatcggtccactggcggggcaggtataaggcccggtcaataaaggcatgcccgccgtggccagcgtaacacagaaatacgcctatctggctgttttctacccgtccggcggtcccactatactgacgctgtaccccggcagaatgtgtcccttttttgataagaccggtttcatcaaggatgagaaccccctgttcatcgcccaaatgttcagtcacataatcccgcaggatatcgcgggccatctcgacatccaatcagcgcgttccagcaaatattgaatgccatcgggggtgctttcccctagccattcagccagttgccagctatttttacgttcaacatcactaagcaagcctcggagataagcgagactgcgttgtcgtgggccggtagagtgaaataagggagccagacgggcatgtaatgcctgtagcgcctgttcccagattttggcaggggatggcatgtgacatcttctttgatttaaggaagaagagccccatcatggcacaatatgtgctacagccgtagattttcgcaaatcaacgtgttatctgatcatcgctaaattaagaaactatgtaatttcaatctttttatggcggatttcctatcgagaaatagtgttcacggctgtagtactagcattttttttgattaaatgtgctgatgttgttttttttaaaaaatgactggctttttaaaccctgtcgttttctgtaatcgatttcatttgaccgcgaacacacaaagctgtcatcatgaaataaaagcaaaaagagactgaaaatttatttaattgtttgattttgtttcggagcatacgaactcccctctgcagaagctgtcttggccatgtaagataagggcgatgcccgaggctgttttccgaaaggctgagagtatggtgaggcagcaggttgtgttaatatcccttgcaggaaatgaaaagatcctgaaaagatattatgctaataactctattaaataatgtaacttattgttgacacattcagagtatatggacattgatatcctcagctttatgccggcattattgcctgtagcgctttctcccggagccagcttcactcttgtcatgagcagtgcgctggctggcggacgaagcgggctcctgcggacgcttgccggtaccgctgtaggtatatacagccatgcacttctaattggacttggcattaccgctatcattatttcgttaccgggggtgtataacgttctagaagttgtgggaacaatttatcttctttggttagggttcatgctcatcagaagcggcataaaatctaagccagacaacaccgtcagcagcccgcattccatcacggcagtagatgctttcattactaacatattaaacccaaaggctattattttttacctgaccgtcgtttcccggtttgctggccagcaaggaggggtaggcagttatctggtattagcttccgttcacgtggtggtgatgagcctctggcttgtcatcgtaagccacatcctgatcttctctgctaaaagcagtaatccggtattacttaaaaaatatgtcaacatctcaggagggttgctgctgtgcgttttctctctgtgcagtcttttcaaataacgcggaccatacggttctgtcgcattaattgtaacggctcgcaatcgaaaacggtcggactcgcatttatccggtttttcggctcacgctcattgcaaatgaaaaccgtcacggactcacattacctgcaaatgagcttgcatttatcttttccggctcgcattccatttcatccggctcacaataactgaaaatgaaatccatcatatcggcaacccaaccgccaacattctgtcgcgcaactctgccgtgcgaaccggatcgagctgattgttaaacaatgccctgatttcagcgggtttggcatcaaattgttccaccatatctttcagacgataaccatggcgtgttaatgtgggttccagatcatcaagttgtcgcgagagtaccgattctatcagtgtcgccgttatgggtttttcaccggtctgataacccgcttccatggccagcgtcagatgcaactggacctgtaatggagtacggagtttcatcgccagtaaatcaatggcatctgttgtcagtatgtcttgcgttttccctttacccatactggttttaagcaaccactgaatgtattcccgttggctgccggtgatcccgtccagcgtgaaaatatctgtgcggtatccgatttcttccatagtggggttgtaagccggacaatggcattcggttaaatccttatcggagcatcaaaagaattccatcgtgttctgggtttcatcgatttccgtgggtagtgcctctttggtctcacccgttgtatcattcttgccataagtgcataaagcgtgtaatagaatgattttaaatgttttttatcttaccttgtattagcagagggagatgtttgacgataaaaaacaaacagttttttgaattcagcttctgttttttacccaggctcggcacaaagcggactgccagttaagctattccatgctcaataatgccatagaataaggtgcatgttattagctaccgtgaacgagctgctcacgtaggagcgtcaatgtcttccattgccgcttttactctgagaattgtctggcgcgtggtgctgaattcgcgtgcaatcgcgctgatactctttccctcgtttatacgcaaaaataccgtcttcttttgttcgtcactcaggatcggcgggcggccaaaacgctttccggatgctttagcccgcgcaataccagcatgagtacgctcgagtaacagatcacgctcaaactcggctactgcagagataacttgcatcgtcatttttccagcaggacttgtcaggtcaactcctcctaatgccaggcagtgaacgcggatttctgagtctgcgagtaactcaaccgttttcctgatatccatggcgttacgtcctaagcggtcaagtttcgtgacaatcagcacgtctccgttttccatacggtcaagcagccgcgtgaatcccggtcgctcacccgccgcaacagatccgcttacatattcttcaatcagtcgctgaggtctgatagcaaatccagccgcctcgatttcacgacgctggttttctgtattctgttcaagggtagacaccctgcagtaagcaaaaactcgtgacataacgttactttgtgtacgaaaatgatgtactaattatagcttatgtacgaaataaaaaacacttactttcgtacagtgtcgctgcaggttgtccgaaaccgaccgttttagtacatgatatttgggcatacataaatgtcacattccgtttgttaattttcgaaagttggatttatatttgaatctaattttgattcatatatagtgttgattatttttttattagcatgcactattgtatatcgataaaattaatcaataggataataaatgaatgaatcttttttgagtcacttaaaggaagtatatcaagatcgtgaacgagatctcgttacattaagtgtgcgtgtcagtgttgaggagaatgcggccattcaggatttggtagattcagttggctgtaaccggcaggatcttctttatgaactaataaaaaaatacgcactcagtgaatgggaggtgatgagaaacgaagaactggatgccgaactcagtggcggaggtgcatctggtgataaccatacgaagacctattttctgcttaacacaaacaaagccaatagtgctaaggatcaccaatttatgattgaaaatggctttgctgctgcatttgaagaaggttatatccagaaaatagaaaaaatccatgaaggagatactgtctttttgtatgagtcaggcgtaggtattgttgcttacggctcagcaacgggtagggtactgaaaacagatcatctcggtgtgaaaaataaaacctattatcaaaaactggatgggtttcatgttctggataaaccactgcctgccaaaaaaatttgtactctgcttaagaggaaaattcctttcgtacaaacacttatcaggcttaaagatggtgaaaagcttctgaaataacggcttgattgcaagcctctacagtgacttgttaggtcagcgaaccggaagcctcatgatgaggcttcttacctgtataacttaataaaaaagcgacatattatccattcaccgcttaatgcgacagaacctttaaaaccctacgatgccaatcgttataataaccagatttctcttcacctctttcaccagttccttcaacccactcttcgaattctgggctatcttcaaaacgctctggctctgacattatgatttatccctaaattattccattcataataatgcagattttgtctcaatgatctaaatggggttgtaggggccagcgtgggcgactgggtaagtctattcaatttaaacccctactgcgtatggcactttctatctttgacgtactgttttttcagagttctgcaattgtcctgaataaaatgttaagttccaattttaggaagatttatgacttacgttaagttaacctgtgtaagttaagttattctatgtgagataaatttactcaatggtgaagccatgaagagtctgtaccaacaagcgagaatgagtagagacgcaaggtttgatggcaaatttttcatctgtgtaaaaacgactaagatattttgcaggacaatttgcccagcaaaattgcccttagaaaaaaacgtgatttatgttactgacagagagcaagccatagggcttggcttcaggccatgcctacgctgtaagccagaatttgcgcctaactacagcgaaattagtaaaggtagcttgctttataataaagcgtctcaaaaaataataagcggagaatggttaagcctttttatcccagaaatagccaaaaaattaaacacgtcacagaggaatttaaataaaattttccgaagtagtacaggcatgagtgcaaaagaataccaaaataaccataaaagtatcttggcaaaagcgctactgcaaaattcaaatttaagtctaaccgacatagcaagtacttgcggttactcgtctctcagttcgttttattatttaatcaataaatatttgagagtaaatatgaaatctataaaaaccaacaagcaagattgcagtgtgaagaaagtcataacctaccccctaagccacccgtatgactgggatcacttcttatcatttcaacaaaagcgactcgttgaaggaatggaatggattcgcggtgaaacatatgggcggacttttaacacactaaattgcaaagggcactttgaagtatgccccgcaaaaagcggactatcgatatccattcaaacaaataatatgggttcttttgggtgtatataccaaagaatcattaaaatgtttgatttggatgttaatttaacatacatagaagattttctttctaataagtacccagaaataaaaatatcaaaaggtttaagaattcctggggtgtttagtgaatttgaagcgggtttaagagcaatttgcggacaacaagtcacagtatctgcggcgaccaagttgttcaaccaggtcgtgcataattttgggtgtacggatactaatggtcttgtttatatgcctttaccaattgacatcgtagatgatagcaacttggctatattaaaaacggtaaacagcaaaaaaaatactatccttgctttggcaacgtggtttgcagaaaatagccctgagtcacctgaatatgacataagtcatatattgtcaataaaaggtattggcccttggacactagattatataaaattaagagcaaacaaagatccaaatatatggatgggttctgatttaggaattaagaaggcgataaaaaaatataataattttgatcatgtaaagtcgcatccctggagtagttatttatctatccaattatggaatataacctagttactttttagcttcgtaagtaataacgataacataaatttaattaaaactataattttatatttatagggtgactccttatatgagtgaatttagctacttatctgctccaaaatcgagcagagacagattaggtatatataggttttggtatgatgtttaccatgaagaaatgaaaaggaaaattacagatctcgatcattctaaaaaaataatatatgactactttgagccggaatccgacatattcgtaattgaatctaacaataaagtaattgggtcggtacggttaagtacaaggagccatttttttaaaaccccctacgcaccaatgctggggaatatttctcaatttgatttttacttcttatcaaaagtcattatccaaaaggagtacagaaaaacagggctagctacaaacttacttaatatcgcagttgaacatgtaaaaagtaaatcgtgtgataggattttattagattgcagtgattatatgatcccatattttataaaaaaagggtttaatctgttgttagatgaaacaacccaaagcatacactatggtgatgtttatttaatgtacaaggaactataatgagcataaaattagcagccgaaataaataatagcctctatgaaaaaagaataaatagaacaatgccttttttgggagtagatgaggttgagcaaaaaatagcacaagaaaaattagcgggttcgaccataggtattgcaggggccggaggaattggcggtgcaatggcggtgagacttgcacgatttggtgtaaaaaaaataaaaattgcagatcctgacactttcgattactcgaatataaatagacaacttggtgctaacatacccaatattggtaaaaataaagcacaagtcgtggcagaaatggctttcgatatcgggcaagatgttgaaattgaggtttttacagatggcataacacgagaaaatgccagcgagtttgtttcagggtgtgacctggtattagatcaggtcgatttttctctgattggtgaaaagtatgctttacaccgtgcttttagaaatgaacctaagtgtagatgtatattggcctgctcagtaataggatggtcggctcacctctataagtttacgaaagacagccttcccatagaagaatggtacggaatagaagatgaaacttcaatagccagcttggctgacgaaataagtaaaactgaaaaattgttaaatttatggtcgccaaggtttccactatttccgtcaaaagaaagccttttaaagtggattagcgataatgataccttacccatatttgctggatcaccgccagttgccgagggtctactcacgcaaagagcaatattgtgcctaattgacaaagagcaccctccttatgcagcaacgctacctcctatccctaatatttatatctatgatgcggcacaactatctgggtcggtttatttttctgatggagaaataaaaaataagctggaaatagaaaactttaataacttaaataagtgataatatgagaaacgataaaacccaccaagacattatagagagcgcaagcataacttctctcatgcgataccttctttcatctgatgatgaggcggttcctaaccctgataactatgggaagtattttgtaaacggaaagtgggaaggataccttaaagatgtagattctgcgaaactagaattacaacgcaagttacccggctgtatgtattatcacttgattagaactttaaagtttgacgatagtttaattaagtgggcgagtaatgagaaaaattctcaaattgttattttaggtgcaggttttgactcaagagcaatgaggtatagtaaattgctcgacgagcataatgtttctgtctatgaaatagatttatcagcaatgcttgattttaaaaaagaagttattgctaaatataaattacaacactgtgtgggctaccaccatatcccttgcaactttaatgacaaaaatttatccggttgtatgttagatggagggatttctaaaaataaaaatactttagttttgtgggagggcgtcacttatttcttaccggatgaaataatccagagcactatagtagaactcagagaactctttaaggaaaagcttcagataacgttagactatgcgtttagggactatattgaaggtgatttaaacttttatggggctaaagagctacacgatgttctagtggaaatttcagagccacacttttttggcctgaatttcaacgaaagtgaaaaatacttcgcaaatcttggttttaaaaccactgagaacctaacagcattaatgctagagtcaaaatatttaagggatggcttcggaaaatccgcaggacttcctcacgtttttaatgcaatgacagatatagttagaggataatagagtgaaatatagcaaattatttaaagacctacattcaaaaagtaacttttttgtattaccgaacgcatgggatgtcccatctgctaagttttatgagtcgcttggctacaaggctgttggtacgtcgagcgcggcactttcatatctaaatggaaaaagtgatggtgaaaatattccattttcagcagtcttgtctcatgcaaagaaactactatccgagattaaagtaccactatcaatagatattgaaaaagggtacgcctcttcggcaaaagaaatcgcagtaaacgttctaaaacttgcagaacttggttgctcaggggtcaatatagaagactcacttaaaagcggagatcttttacccgcatctgactttgcaaaaatactcgaaagtattaaatcagaactaatcgcgagcggctatagtgattttgtattgaatgccagaactgatacatatttaagtggttctgttggagaaaagattagagagacaatcaaaagagaaaacgtttaccgtaactgtggagctgactgcttgtttgtaccagggctagtaagcatagaagaaatgcaggatatttctaaagtcacggagcttccacttaacgtaatgaatatgcctagtatagctaatataagtgctttggcagaaagtggtgtaaataggtttagcttaggtaactcagtttttgatgatgtgtactcctatttccagagtgtggcatcaagatcactgaaagacggtaatttttcagcccactataatcacccagctcttaactagttataagggagtggccttattaaaggccacttttaggaacctgagagagcctgtataccattttgtgtaaataccttttcttagtagtgaccgtcaatgcgatcaccgaactcaataataaaacgactcatcgccattcgccagtcttgaagtggcatcgtccatttctttgaggcggcttggattgccaaccagatcacttttttcacggagtcatcggttaggaatactttacgcttctttatcgcgtgtctgatgacgctattcagcgattcgatggcattcgttgtatagataaccttacggatttccgttggatattcgaagaacgtggataaattattcccgttagcctgccaactgcgacttatctgcggatagcggtgatcccaggtttcactgaacgcttccaatgcttgaagggctgcttcttctgtcggggcctgataaatcgttttcagatctcgcgtgacggctttgtaatctttccaggccacgaaccggagactattacgtaccatgtggacaatacacaactggatgcgcgtttctgggtaaacggcgtttatcgcgtccggaaagcctttcagaccatcaacgcaagcaatgaggatatcattcagcccgcgatttttaagctctgttagcacgttcaaccagaacttagcgccctcattctcggctaaccatatccctaaaagctctttctgcccctcaatattgatacccagagtgagaaagacggatttattgatgacgcggttgtcctgacggacttttagcacgatacaatccagatggcggatggatgaaacctatatcaaagtgaaaggccagtggaaatacctttaccgggcggtcgataccgacggtcagacgattgactgcctgctgaccgctcgccacgatgcaacggcagcccggcgttttttccgtaaaacgatacgccagcacggcagacccgccgtcgtgactctcgataaaagtggggccaataccgccgcgctcaccctcctcaatgcggaaggtgagcctcagcaggggattgaaatccggcaaaataaatacctgaataaccgcattgagcaagaccctcgccatgtcaaacgtcggatacgacccatgttaggctttaaatcgtttcgccgggcccaaacgattttagcgaggatagagcgcgtttcgatgcggcgtaaagggcaatacttacaatcagaagataagacattggcaccggcagagaagttttatcgattgactgcataaatagtcatcattcccacctccgtacaaactttctttgttaatgcgacagaaccccttgcagttcctctttaaaaaatgctgctcccagcaaagcaatcaggaccggtataaatcagttaagcagcagcgcatttgatgctgaggtttgatgtagtccgacatagaccagtgaattaaacgccaccactccgaaaagggatagtctgataatcagccacttatgggtcagatacagccgataatcccggcacataggtttccaggcgaatggcaaaacacagaccattgcaatggcccatcgccaaagtgaaagcgtcatggggggcgatgttgtgaacagcgcgaccggtgataaaattaccggcccagaacaaaggaggcagtaatatcaacagcagcgctggagaaatgaatggttttctcgcacgaggatccatgcataactacggtggtattggactgaatattttgcccggttaagcccaggcaaaatagcaatgacactggcgcatttagccccggaagccttgcagagatgtggtggtagcagttgaaccaccacaaacaatgaccagcacgtttttcattccactggcatcgattttctgatcatagagaacggccagagatgcaccacatgcaggttcaaccagagtacggtggtcatccaggaaggccaggcaggcacccaccgcctgtttatcactcaccgttaaggaaataatttcccgttcactcgcgaggttaaaagcctgctgacacacctgacgagcaccgagggaggtcgccactcccgtcagttcaggcagagataccggatgaccagctagtaatgcagcgtggaaagatgacatcccctcagtctcaaccacaaagacagggatgttcagatcgttgcggcgaaggccttcatcgacacctgcgagaagaccgccacctcctacggagaggataaccgcgtcaggacgtaaaccttcagccaccacttcgtcgatcatggacgcatgaccttcccagagaagtggatcatcgaaaggatgaatgaacgcatcattatcgttcagtagtgacagtgccagttcattcgcttctgcccaggtttttccgtgtactttgacatcagctccttccagacccagcagatgacgggtgcgctctgatgtggattcaggcacaacaacactgacaggaacccccagtttggtgtccggcataagcaacggccagtcctgcatttccgcccagaagaagaaaatgaagcgggcgggcaccacgggcgtaatgctgctcgcaggcatgaccaaccccacggatcttaaatgagccggagggttgcattgcctccatcttcatccagacgcgggtattattcaggcgacccagtggcagtgactccagcaggggagtattgatactcaaagacatgtggttaactccgtaaatttcgggggatcaggccagagcctggacttccagttcgacatcgagatcgcacgccagacggctcacgacggttgtacgcgccggaaatccgtcaggaaaatgagtacgatatgcgttattaaacgcctggaaatgacccatttcggacagccagaccgaattttgtcgaaagaagacccacatgttttcagcgctgcatcaacatgttgtaaaacgagatgggtctgttcttccacggagccctgaacaggctcccgcttatcattcatcgataattgccctgacagaaaaaggaatccgttagcttcgacagcgcgtgaaaacggaaagggtatggaactggcgtattttttcattggtttttccggcgggtgcattattcatcaccgcttttaagttcatccagatagttataaatggtatagcgggtgaccccgagtgcggctgcggctttctccacaccacctttgataagaaataggcctttttcctgcatattctttaccgccattaaattggctcgtttggtatccgttcggctgctgccggaactgagtgcagtcgtggtactgatgatgtctcgcatcagatcttcaatgttgtcgtgactggcctcagacgaagcgtcttcctgcgtggcaggctgcacgtctggccggatacccgccagtgactggagaagcctgagagcctcatcaatgcctgagttatccacattgatacagagtgcagcgtaaggtttgccggtgtggtcgcggtaaagtgcagtgctacttcgtaatgccttaccgtcacgagtgagcgtttcgtaatccagcaataaagaaacaggttcgtttctgttctccattgcactgataaacgcgcggtcggtacgcataccggccagtaccgaatcgccttttttgcgcccggtcacacctgtgttaacaatctcggctattgaaaaggtcggatcccgcaggtcatgaaggacaatttcggcattacctgccagtacgctacccagtgcacgtacagttgccgacagcatgttaatcatgtcctcggcataattttgttcatcaaaaacgttcataacatgaccaacgttaaacatgttgttgaataacaatatcagtaccagaccattaaatcaacaaagtgttgatcatgaaatgacagctatttccaaacgaacagcaatcgatggagactgtttgtgacagaatcacccaatgtaaaactggaaaagccgaggataaccagaaaagcgcaccctaaagtagtggagctgcgcgggcagtgtcgcgttaacggcggcaagttagcaaaagtggtgttgccggttatttaggcagccagcaaatagaattgttccgcgggtgataatccatcactttgtggatgttgatattgccctttgcgtatcatgtgaatcagttcgatgccggccaggagcgtctgtgcccggcgaaacaatttgaaccccagcatctgtcgtatccgacgtttgatactacggtgatcttgctcaaccaggttattcagatacttgctttgcctgagggtgatgttttcctcttcaggtttgtcggcattgagcgtggccagagccgcagtattggcgccgcttttattgatcgtcaccctttcaggttcgctgtggtgaggcccagtgggagcgaagctacaaaatgcgacatttggctttaactttttgtattaccaaatattttttcgttttctaactcgtcgtcgagtagacccgcagcattgttgagcgaacgataaagcgttgcatggtgacagttaagaatccgggcagtatctcgaacagagctaccttctgaaatcaaccttcgccccaaagcgatctgctcgatgcttaatttcgtcgggcgaccgaagcgtactcctttcatcttcgctgcatgtcgacctgcccgggttcgttcagagatcagcgctctttcaaactcagctatgcctgcaaatatcgtgaataccatcttgccggatggtgatgtggtatcagcccagggttcagccaaggaacgcagacccacattgccatgttgaaaaatgtcggccagttccagtaggtctcgagtcgacctcgccagccgatccaaccgactgaccacaacgacatctccttcacgtaaatgctcaagtaagcgcgtgagctctggacgttttcgtttagctcctgatatcttttcttcataaatgagttggcacccgctgcacgtaaagcagcccgttggccatccaaatgttggtcatcggttgaaacgcgtgcgtaaccgatcagcatcgtcatacctcaagtaaatctgtcgtaaatatgtattgttaatataaactttcgcaccatacttttgcgccaagaaacagcctgattttcgttgactctttgatttgtcgcaaaacttacaagttacgcgacatttgtgcctgagttcatgttgtcaaaaaacggcttacttcatcacccagcgatagaaggaaagcgctgcgatcaggatgcgggtcagtgacatatggaggcagctcgttcatgaaggtaaaatggccagcatcttcaaccaaatgaacatcaatttgggtttggtccccaatcgtttccttgagaaatacagtttgcgcaggaggcgtgatcgcgtccttgccggccgcccaaacttgaatcggcacgtttacggatgtcaaagagccggggcgtctgaagaaatctgtaggtggtgtgaaaagcaccaaccgatcaagagttagctcccttcctaatttcagtcgatctcccgccaaggttgaggcttcggctccgacttgcatcagcaagatcacagttccaattgaatgcccgacacctgcgattgatataccgggcgagcaatatgttttcgcggccagagtgagccttcggctacgctccaatagttcggcttttgtcgggatggaagacgccaacatctcgaaatgcggcgcgacaaccgaaatcccatgctcggcaaaggtctgcaaaaggcccaagtgtcgcaatggattccctccaagccctgtaacgaagagaacgcatcgagcggcggattcggcttgtagaatggtcacttcaaagtttacatcacttccgagtaaagctgtttttgttacaaatctatttcccacaagaattatcctacttctggaacaatggtggtaaaggagctttctcagcagcagtactgggatgacgctccctctctggacgaaacaagtgtcgcataatttaggatttatgcggaaatggatgactcagcatacgtttacccattttgcctcggacatcaggcggtaagtgccagtcgctgattcatatccaactcgatacgcccatacggattaatatgttgatatatcaagggggtcagtccacgccagtcttcttctgtcatacggctacgccatgtcggttcagacagaacactctgaatcaacagcgtattaatatacacgaggctaatttgcaacagatgtaatgacagcatcgagagttcctgatcttctgtccggtttgttgtgaactcactgtgctcaccatagaaaataaaatcattagcgctgttccagttttccacgacgttcagtccggcattaatttcacaacgcagggactcatcgtgcaaataacgacaaaggaagatagtcttaatggctttgcccaactctgccaatgccttatatgttggatgttgtgcattgttacgagtgaaacgccgtaatatggcctcggattcagccgtaccaatcctgagtgcgactgtatatttgataatttcatcgtactgctgctaaataagttcccagtcgatcactcgggttaaaatcggtgtcagattagggtacaaggcagcatcctcttttccgcacaaattcagcttttgccgggcagtacctttcaggcggggcagcaagtcaaagtccagaacataactgaaagcaaaagccacctcactctgtccatgactgtcaacatattggtgatttatctccatgtcggtacagtggcgaagcactccttccatcatggccgatacttccgatgatgaacagcgacgtagttgagaataaatacacgttgagtgagtatcgacatgccagtaaatcattacaccccgtccgccataatgtgcatgccattctgtcatcagattctgatcataagccccgaatttacgggagtcagcggcacaggacgtggttgcattgccccagatggcggggtgacgaatatggaaagtgccattaacgatgtgtgaaattgcattacgtagtgcatctttctgaataaatcgtcgtttgacataacgcagttcatcataactgacactgggttgctggctggttacgcgttttagtcccacgttggtgccaaggccaaacaaacataacagcatacgacgttgtaatattttaggttcaaggacttcccgactggctgatgttcgaaataacgatgagaagttttcacgtaagtcgacttccttaagaatatcgattaactccaaatcggcccaccgttggccgatttcacgttttaatgccgatgtattgggtggttcaacctgtttgtccagtgacgtcaggtggattctgttcttaccctgttctcggaggcgaagtttggcattttctggcagaccgttattcaacgtactgagccattgacgcatcgtatccttaatgtggccgatgaatgttgacgcattagtgggcacctgtagcatggaataataatgctcacggttgatggcaaaatctgcgggaagatcctcagccggatcacggtatcgatcggcaccctccacccaaatttctttgttgcgcagactcttacgtagagcacgtaaaacacagatttcataattgatacggttgactcgttcttctccgagcttattttttactataacaatatcccgccacgtcttctgaataataccgtcaacgggcacgtcacccacatcatagaaatactgattgctgtcccgctgggctttaataacctgaatggcattaataaccggacgatacagcgtattccctgatttaaactccagccgatccaacaccggcatcagcattcgtcggtagtgagagccataagaagaacgtatggattcatgcacttcgtgttccgtattaacccccagggttttgaattcattgaccaggttttgcaacgttttctgtgcaacaacgggatagactacgtcttttatgacaccattcggctgatcaactgtcacttcggccatgcggaacagtaggcgagccttacctcgtacttttttatacgcagcaaactgctttttatccaccttcttttgtgcacgggcaccgaggttatggatcagtaccattaacatctcaatcaacgcatcaatcagttgttgccggcaacgccagcaaaacatggcgaccatactgtaacgaatggctgagggatgacgacggagctctctgattgattcgcttacacatcgttgctggaactgcatgataaatttatggggtatcccctgaaaagtattcggttgtaaggacatgtcatcgagaaatttgagctgagaaatgacagtaaggacgttttcaaggctgggttttcctggatcggctttgagcccgctgaacgaaacacttgaagttttagctgagccggatccctctccagaaagtaaatgattgatagcgattttgctatccatcgagagtcggttaaagattatttcttgttgttcagcctcaaatcggcgaacgacagagcgaataatccgatccagatggtcaaacgcaggaggctcaatcaattgctcatgacaccagtcagtcacaatatctctaccatgcaaagcctgcggatttaacgggagagtaaactccactaaccaatgagtaagccgtgcggtatcggttttattaggtagtctgactttcaaataatggcgaatactttggcgatgtcgttgagcctgccggccttgaagaggatagatatcaagggatgagaatggcacttcgacttgttcagcgatatatcgaacaatgtctgggggtatttcgtctattgactctgggtatcggccttatatctgtctgaatttaagctgaatagcaaatcctaagcggcctttatcagtcatccgaggaagtaagaaaagttcgtcatccagcagggtccaaatatccctattaccaagtggctcacccagcgacgccataccaactccctgaatcatcagtaggaaacaattattgcaaccatttcatagatgagtgatttttactcagacgcaggtcaaaaaagccaaatatcgcattttgtagcttcgctcccactgagccaatctcgaggagatgatggcagagcgcggcattggggtcgaccatgccacgatacctcgctgggtgttacgtttggtgcccctgctcggcaaggctttccgacctcgcaaaaagctcgttggctcccggtggcggatggatgaaacttatatcaaagtgaaaggtcagtggaaatacctttaccgggcggtcgataccgacggtcagacgattgacttaacctgcggaaggctcaccccctcctccaaatgcggaaaggtgaacctctcgcccccggggggggggtgatcggcaaaataaatacctgaataaccgcattgagcaagcccctcgccatgtcaaacgtcggatacgacccatgttaggctttaaatcgtttcgccggacccaaacgattttagcggggatagagcgcgtttcgatgctgggtaaagggcaatactcacaacccgaagataagacattgtcaccggcagagatattttatcgattgactgcataaatagtcatcattcccacctccgtacaaactttctctgttaatgcgacagaacccttaatacgacataaccgaattattcatttagaatgtccgtcaactttactatcaactgaggtttacaatgcttatttccagccttatggctattgccgcggttctgattatgggggttataagccctgggccgagttttatttatgttgcccggaatgcagttgcgtactcccgtcttcatggacttgtcacagctctgggcactggtgtaggagctgcagttttttccttggtagctatgctcgggctacagaaattattaaatgcagttcctgaattatttattggcttgaaagtggcgggaggtgtttacttgttatggcttgcattcaaaattttcaagagtgcatctcaccccctgactttagctctacatgggcaaaaaggatccgaaaaaactttgtggatgacgtttagagatggtcttttgacgcaattgagcaatcctaaaaccgcaatcatttttgcatctatatttagtgcgcttctcccagaaaatatcccagtggcattttacttcgcagtccccctgatgagtttcctgattgatgcaggctggtattcccttgtatcgctcctgctttcggctgaaaaaccacgtcagatttacttacgcattaagtgtgccgctgacagagcatccgcgactgtattaggagttttaggtatcaagctaatttactcttcaatcggcaagtaattatttacttgccgacctgcattaaataatgcaggagccgatgatattccgctgcgctcgttcggcttcggtgagcgctagcgactcgcggaaaagttacatacggagtctgggataacagcaagaggagcgtgaattacttcttttttgtatctaacgaggcaatttgcttcccatctgggtaaaagttttcaactgacaaccaagcttcaaaattaggtttaatcttcataaactcatgatctaacattgaaaaccatgcagtatctctattgtgccctttaattactgctgcttgtctaaaaacaccttcaaatgtaaaaccgaatcgtagcgcacttctttttgatgcctcatttagattattgcacttccactcaactcgacgataaccgagatcttcaaatgcatatttaattaataaatatacagactctgtagccattcttgtttttttcaaaaaattagaaaatatcacatagccaatctctataacgccgttatctttatcaatccgcatcatcgcaatagagccaaccgccttgccagaacggatatcaatgatagaaaattgatacggatcaacaccattagatatgtttctcaaataagaaataaactccattttgtctttgaaaggctttgctggcccaggcaaataagtccagtcgctaaagttaaatggctcacagaaacacttataaagttcatccccatgattatttatatccattggtattagctggcaatactcaccagtcagagtattaccatcggggagatcagctccatgccaatcagaaacagaaaaacctattaactgaccaaattcattcttaaataattccataattttcactcttcctatttagataaatccacatatatttaccataatatccgttttggcgcaccactccggacgggttcaggagaccataaaaacaaactggtacgtcactcgtcattttcgagggttcttccacaggccccctctaagacagtaagaaggtcagagtctgacactcgtcgttccctttgcgatccctttcttctattacctatgaacaggccttttagctgcggagaaataccagcaaaaaaactgagatactgcgattgtcctgatttcatcgactaatgacctgtgagcatgtcacggcttatcccttcctcctcttatagtaaagccactcgcagccaccctgcccgataacaccaaacgcagtggctgagcctcaaaatcagatgaatcactggagcaatcaatgaaattaacgcaaatccgcaatgccactctcgtactggaatatgccggtaaaaaattccttatcgacccgatgctggcagaaaaggaagtctgggatggatttgccgggaatgctcgcccgcacctgcgtaatcccatggtcgccttgcccgtgtctgtggaagatctactggctgttgatgccgttatcctgacccacacgcataccgaccactgggatgaagcagcgcagcaggctgtacccaaagacatgcttatttatacgcaggatgagagtgacgcggcgctgatccgttctcagggctttcttaacatccgcgttctgaaagaggaaaatcattttgttgacggactgacgatttataaaactgacggccagcacggcagtaacgaactttacgccgatgcccaatggggtgaactactgggtgatgcatgcggcctggtcttcacacatcatgatgaaaaaacgctttatatcgctggagataccgtctgggtcaagccttatgcaagaagcctgcagcgcttcaaaccggagattgtggtactgaataccggctatgctgtcaacgacctttacggtccgatcatcatgggcaaagaagatacgttgcgcacgcttaagatgttgccgaatgcgaccatcgtggcgtctcacatggaatcgatcaatcactgcctccttacccgcgcggagttacacgagttctcacttgaacacggcattgaagataaggttcttattcctgcagacggtgaaacaatagctttctgataagccaataagattgattcaggggaagaatgctattccgacaggtcacctgttatcctctggtcagttgatattaacaattttgccgccggtggtccggtggctcttctttacggtaaggttaacgttatgtctgcattgacggtcgccgtgattgccacggccggattcagcccgtttcacttttcagtaccctgcattattttcggacagtctatgccgcagccggatttattctgcgtggaaatctgtgctgaaaaatcgggcgtcgtcctgtctgatattggcctgtcaatcaacgtggaacatgaccttaagctgctcgaaaccgcagacattgttatcgttccctactggaatcatccggaagaaagaccctctcaggcactgctggatgcactgataggcgcatggcagcgcggcgcagaagtggtggggctttgcctcggcgcttacgtgctggcgtattccggcttgctggatcagcaccgggccgcaacacactgggagttcgaacaggacttcattgaacgatttcccgccgttcgtctggacagcaactcgctgtataccagcgatgaacgccttattacctctgccggcaccgccgccggtattgactgctgtctgaatattatccgggatcattacggttcagcggttgctaaccgtgtagcaagaagaatggtggttcctccttatcgggaaggcggccaggcacagtttattgaacgtccggtcccggtatcaacgcgggataataaaatgaacgaactgattgaatatttgcggagaaaccttgataagccgcacgatctcgactcactggcgggatttgtcagcatgagcaggcggacacttacccgtcatttttttaaggcaaccgggacaacgctgggtgattggctaaacgctgaacgtcttcagagaagtcaggagctgctggaaactacggacagtagtattgaaagcgtgtctgacatggccgggtttcagtcaccgatctctttccgccagagttttaaggcaaaattcagcgtcagtccaagcgaatggcgccgggcattccgcggtcctgtacctgttgatcacgaaaaggcctgagcggaagctaagacatcagaatagttataaaaactagcaacctgataccggaataaaatttgttcctgaaaggaatgaattggctcattctttaacgtcgatttcaaaaggattcagggctacttttttcaaacgataataggttgcccgcgaaatccccgttttgttcatcacggcttcagccgtcattttttgatgtataaattgcagggcaatcacagatttactatggggttttcgtccgaatttaacgccagcagccatagctatcagccggccatcgttggtacgctcaagaatgcgttcccgttctgcctcagccacggcggccagaatctgtatcaccattttccccatagttccttcggtactgaggccgttctccagaaaacgtatggcgatcccctttttaaagcaggcatccacaatgtggatcatatctgcggtattaggtgtagcggcccgcatttatccgcttttttagcccacattaattgtaaatgaaaataccttccggctcacaataactgcaaatgaaattcatcatatcggcagcccaactgccaacattctgtcgcgcaactctgtggttcgaaccggatcgagttgattgttaaacaacgctctgatttcagcgggtttggcatcaaattgttccaccatatctttcaaacgataaccatgccgtgttagcgtcggctctaaatcatcaagttgtctggaaagcactgattctatcagtttgacatgattggtttttcaccagtctgataaccagcttccatggctaacgtgagatgcaactgaacttgcagtggggtacgcaatttcatcgtcagcaaatcgagagcatcagtcgtcagaatatcttccgtttttcctttccccatgctggttttaagtaaccaatgaatgtattcccgtcgcctgcccgtgatcccatccagcgtaaaaatatcggtgcggtatccaatctcttccatcgttggacgacgcaggtcattacgcagtttgggatgaccggctaaaaccaccgataagcggcctccaccgtcttctacaacttccattagtcgtttgagtccagttaaaatatgcccgttaagatcatgagcctcatcaacgaacaaggccacggttcgtttacctttagatgaatgaaacgtagcatgtggatgagacaaaaacaaccctaataagacacaaaaactgtctcattgcattgtctttatggggtagacccataagagataacaggccagttcagggaagcgggtttcatttgcaattatcgtgagccggatgaaatggaatgcgagccggaaaagataaatgcaagctcatttgcggttaatgtgagtccgtgacggttttcatttacaattaatgtgggctaaaaaagcggataaatgcaagcccgaccgttttcgattgcgggccgttacatttaggatgacggaaatacccgagtatcgccaatcgcctggagccgttttcgttccattgagcggtgcgctgggaaaagctgcacttatcggtcatgactccaaagcgttaacctggtattcttatgcttttttaaggggatctcaaaatgacggtgacgatagaagttgcttgccggtattgtaaccaaaccgaaccggtacgcaaacatggagcaggtaaagccgggtttcctcgttattattgcaagggttgccaaaaaaccttccaactcaactctcgttacaatggccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaacatcaaggcaggttgcttatgatgatgtcaccctcatttgtgaactggatgaacaggggtcttttgtgggcaacaaaaaacaacgtcattggctttgatatgcttttgatacaaaaaggaagcaggtcatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgacccaacgtatcgaacggcataatctcaatctgcgcatccatatcaagcggctggcaagaagaaccctttgttattcacgctcaatagaaatccacgaaaaactcattgggacatatattgaaaaatatcattataacgctttggagtcatgaccacttcatccatcactttgttcagattaatacgtcgcacactactggcaaactttattgtcttttttcgttcttgtgggcgagctttattgttcctgcacatttgtgcatgcacaagattttagcctagtccaaattactcacgaactaagtattgttcgagggcatcatgaccttctttgtctactattgtttttagcgccttattcattcttccagaccccttatagataatcttctttccgttaatcaaatatatttttggttctacagtcggggaacgtctacctaccatatgtttctctaaatcatcaaggccaataccttcattttttagtagttttgctgtctctctgattttggtttgtctctctgcttcctgccgttttttgatatcttcatcagctattacatcttccaaaactgctttcgcatcggaaattaggatgttgatctgatcagcagtcataccgcgcaataccttttttctgcgagtgaactgattaagaaattgagaaacgtcttcggctgtaattttttgagtgtcattcatgcaatatacctacttagaaaatggcttcgctatagggacaaaatcatccccttgcagcacataaaaatcgcagtcctcaacccttagacgttggaacgttttagcatcaacaagagggaatccgtcagaaatgtcattgggttcttgcgaaatgagcactggtactggttctgaattagttcctattacaattgcgtaaagcgctgtgtaataaggtaaaacctgtttaattttgttatctatcttagcgaaaatatttttattacggtaaatctgagttgtgattttcccgtcaccaaattccggcgctggaatatcatcaaccacatgctcagcagtgatttttgcaatatcactttttacccttgaaaagccggttagcaaattgactattttatttttcttctgttcttcctgctttgatttgattttactcatcgctcatttaccaaaaccaagtttagttaattttgacacagtttttttatgccatcaaattgcatgtatgctaatctaaggtgatacaaatttatattatatactaacagagggttgaaatgagaaaattaatattggcctctttattttcttctttttttattccccttccaagttactcgtttatgggctgcttcataagtgccggacaacagtatggcgtatcaccactattgatccaggctatcgcggaaggtgagtctaagtataacaatcgagccataaacttaaaaaactcagatggaacaactgacgccactatgatgcaaattaattcttggtggcatgataagccagttttcataaaaaacaagcttagcagacaaaaactaatgaaagatccgtgtcttagtataaattttggggcatgggtacttgctggaaatttttctatcggtggtgttaattggaactccgtgggtgcctataacgctggctgggacaaaggcaaggcaaccgcaaggcaaaactacgttaatagaattaaactcatttatgagcgtttgaagcgcgagtctggtgtctcgccatcttcatcagaaatgaatgattcaaatttaggtactcttactgctgaattatcctttccttctccgatgcatgacaaatcaaccccaagtacagaactcgtaactaaatcatttttccattcaagaaatagcgatatgaaactagtgggtgacatgtgatgaacgataaatcattacttttatatttcgcatttcctattgtcgttagtttaaataaaatatttggactcattactattccaacaggtcttttgatcttcttaaatctcgtcaatgttgtccttcttcattttattttacggcgaatttttgtaacgacttggaaattcggaatctatctacatctatgtacgcttctacttttagccgcaaccttaaccattcaaacaaacggaagtgattcttcgttactcttaaaatcattttggtttgagttcacaatttttagtggtgcctggttgttgctcttctattccctgttcactgagcctgaaatcaagacaaaaatgagtatcgatttagtgcatgcacaaaaacatgataaaggtaacaacgatgaatagtatctttctaggttttctacttatagcctgtggcgctggctttctagcattgattgggtactttgtgaatagcaaggatcaagtgtccaaaggcagtaaaaatatccgaacatccttacttcctcccgacttagaaaaaaaacgcatgatagaacgcgaacaaaccgcctctcttgtctcggttcctgaagaaccttatgtgcctacaacacactcggctgattcagcatctgacaccggaaccactccagacagtatccccgactaatacgacgagaaaataatcatgaagcttaatgtatctatatcagtagcatgcgaaccattacaaatccccgttaaacaggcaattataagtatggatcggcatctatattctttttatatatgtgctgttttatggatttttacctttatgataatattcagagtcaccaaggaatttcgaggtcgccatataaaaactcatggcagttataatcatgggtgatacatcaacactaaaatttatggttattgcctttattgtgatttttgttgtaatttttaaacgaaaaaaattcaatcgtcacaaggttaaaattgatagtgcaaaaactgttataaacaagctatttacatttagcaatgacggacaaagaatggcctaccttaaaaaaattgatccttatgtttttgaagaattagttctatttggctttgagtatcaaggccatacaatagaacgcaataaacgttacagcggtgatggaggggttgatgggcgtatttggattgggcgtcaattgtacctgattcaagcgaagcgttataccggagccatacaaaaacagcatgtgatagattttataagtctggttaactctcatggttgcaagggagtattttgccatactggtacaacaccagatagcgtaaagaaaatagttaaagaatcagattgtattgagctaataagtggtagtcacctactcaatttaatttcaattagttaatgtaaagcagctgagaaatagttaacttccacagctgctttacattataatgacctttgtttagttggtttagattgttctatttgttgattattatttgggtattcaggagtgttaatctctttcttagctgttatatctacaaatttcgaaacagccttattaacggctaactctaaacgtgtaatgctcttttcaaatggattaagtgacttcccccatagctcatcaaattttttaatatcagttttagttacagaaacttttttattatctaaagccattttctgaaaaccagtatttgttctcaacgtatcaaataacttttctttattatctgtgataatagtaagattgtgggtagagcgagttaacgtgttatgtaaagcattctgcgtagcaaagtgcttcttccatgattccatgatggtaataacttgtttgtatgcagaatctttcacctgatagtgattatgcgtatatccccattcatagtgtttccattgctgtgtatttaatgtgatctgctgtccattctttaatgtcagcgtcaaatctcctgtgcttatattaatatccttcactatagcttcggcatttttaggtaaataaccacctttatttgccccctttttctttggcaacggaaaagctctagttagtctaattttttcacccttaactatttctctactttccactgcatatgaaataaacccattccccttacttgttggtatatccttagttttaataattaacgatttatcatcagataaagatttaagttctaaagtattattcttcttatccacatccacaatcgtgaacttgtcgcctttgattccattttgcgtggttgattccgcttccaataccatgtctgctttatagaatctcgcttcttttttctcaaatggatctaacataacctggcgataaacagtagtttcaatcccatcatcgacaagtgatttttctgcctttaatccgtcccttatcatgctgtttactgcatgccgtatatgatgatcgggtagaataatcgctgtttgttcacgttcctcaatgctgagattaaggtatgtgtctttaaccacgccaatacgcgctgttttcgcctctgccgttatccggctatcaatttcatgaaccattggtgataatgccgtgagagaatcttctatttggcctttcactaaggcatctgaagctttattaatttcgggattgtgggccataactacagcattaaagttaaccgtatgcataccatgatggttaagtagtgtcggtacagccccccaggacagtgcgttttcatttttatctgccaccataatcaaccttgccccagagaagcgcgccaatcgctgtaagcgtagtgtttcctctgcccctaatgttgatacgttttctacataccaaagttgcctacgtcccttgagcggttcacccttggcgatgcttttctcgattcgatccatgtgaaagaaaatagacatggcattcttcataccatcctctttcatctgctttatccctgtattattggtactaaaggcatgaactttatattcttggtgctctgcaatcgacttcccgaccgttcgtagtaaatttttatgacctgtgttagcctccgcccacatcagttttctatcaaccaatttaaataaccgcccagcttctttccgctcctgttcgcgttgatagttaatttcatccagccgctttctcttttccttggtctgttccgctttccatttatcaatgtccctgtcgatatttccacgtttatggagtggaatatttaaaactccgtggtctaatgccatcttcacaccctcgctgttactgttgtttattttctgttgtttttttggaaagttaactaaccaactataatactcctattcacgctttttacttttcaatcatgttatatatcacttcataatcagtagccttattgcaatgcctaagtttgttaataaaggttacattataagctacatgattcataaccatcgctttttcaatttcagtaaaaagtttttctctttcagatagcggccaccataaatcattattattaccacttaacaaataatgattacaaaaatgaaatcccaacccagcattaagttcacatacaataacagtgatacgctgacgagaaagagataatttatctatgacgtggaaagattgattttttttcttaattgacattgtcttactcctgcgccaatcgggacgctaccgtgaatcgatacaataccgaatcaataaatatattatacgactaatgaccctatttttcaacatatatttattgattcctaatggaaaaaatacttttttcagcgtgacatgactgtacctttagcgattttcagacaatccctgaacatcctaaaattagcctgactcaaacactgcggggtttgggttttgatgcgcgtagcgcataagaggaggcacgttatagtttcagaaggcacccgaacgttatccgacgacgcaaaaaggggaacaagcagataatcccataacccctcctccgccctgctaaaccttaattgcaccagaacacaccgcaacacgatagctggactgtcagagacaaaaaaattgaaacggtaggtaactcaatttagaatgactggctcaatgtcagtcattctaaaaaagggctaaatttttgtattaagaatatatttttttaactcttttacganaataaaaaaaaggggactcattaagcccctgtggagtgaagttttaattctagcgcttttgtgatttttacattgcgctaaatgggggatttcctttttctgatagcgcatgataaagcccttctctagacatccccacttcttctgaaagctggctcatgttttggctcttgctatatcacccaatgcggaaagccccaaagcaggatcgccatcctctaaaatttcgttaagatacatttgcattctttcctcgctatttaaatgctccgccaatatcgtattcttttaatttcattttcataattcccccctcaatttctttataaattaattttgctttattaatatctttctgttgtgttgttttatcgcctccacacaacaaaatcacaatcacattgttcttaattttcaaatatactcgataaccttttccttcatgtattctaatctctgaaaatccatctcctacgggttctatatcaccaaaatttccgtttttcattctcctaatacgcgcttgtatttttgtctttgctcttaaatctttaagggcatcaatccaatcatcaaaaatatctgtcgttaataccgttaccatttcatgccccttttaaaccaataatcagagtatacacatataagctcaatatgtcaaatatatctgacatattaaaggggcctttctgccccttatgctcatgaatggatagtgattttttgtcgttcttcctttgccaagtcaataaaaatttttaagtcctttacttgcatcaatgggaaagtaaattttttcccctttgcaaatgctcttgctgctgctatcattttttctgacataaattttacctctcgtaatttagtgtcttggtgttgggttgttggagcaacctaacacctcatttaactgtcaattttacctctctgttattaactcaccgcagcccactcggaaatgagctggagttaattatttaaaccttgaatttggataaccaactagggccgagttcatttctaatttgttgcaatgttccactgacactggacagcgaatagggatattttgagttcatccaatgattcagcagtttagatttccatattctaccatataaatttatcacagattgaatcgcgtgtttttgttgttcgttcatcctcacactctcactgttactattgttgatttgtacctacggtgctagttatttactcctgcgctaatcatggttttatcatgaataaaatcattgccgcttcaataaatatattatgcaaataaaaatccactaaattaatttttcattaaattttttcaatgaaaaagccccttataggggctataaatttatttataatatttatttaattgttgtactcttcggcttatttcaccttgcagaccattaataaatatatctttacctacagccagaagatcaccttttctatatgcctctggtgtatgttcatgactgataatatcttcttcgtactcttgagatagcatagaaataacttctgtgatcaatttatcggaataattacgctcgatataaataaatttaataccaccaaaaacatcattaaatgatttatatccatattcgtaagaattggtcgtcttatcaagacatccattctgaaaacggcctataatagcctttatctcctcttgcataggcccatcttcccaactcacataaacagaatcatggctacgtcttttgaccgaaaatttcacgccattgaaatgcagtttcagaattttgctgatatttctaaccgcaagcacctgtttgttttctccagcttgataagtttctaattctgcaaattcaggagatttacgaataagtaattcagctagttgtttggtctgttcaatatcctttttacgctgggaaatttccttcaacgatataacttgatcaataggcttccaacgcgaacgtacaatactgcc

SEQ ID NO: 16855 - DNA, 169791 bp, Xenorhabdus bovienii
  unsure (1)..(169791): unsure at all n locations
nnnnntgaaaatgccggttttctcatggaccgtactgtgtaccaacgtactgattattgcagcattcccaatcctgacagccactgttgcactgttaactctggatcgttatatgggcacccatttcttcaccaatgatatgggcggcaatatgatgatgtacatcaacctgatctgggcttggggtcatccagaagtttacattctggttctgcctgtctttggtatcttctctgaagtcacagcgaccttcgcgaaaaaacgcctgtttggttatacctcgctggtatgggcgacgattgttattaccattctgtcgttcgttgtatggctacaccacttctttacgatgggctctggtgcgaacgtcaacgccttctttggtatcgccacaatgattatctctatcccaactggggttaagatcttcaactggctgttcaccatgtaccgtggtcgtatcgaatttaaaaccccaatgctgtggactgttggcttcctcgtcactttctccattggtggtatgacaggtgttctgctggccgtacctggcgcgaacttcgttctgcataacagtttgttcctgattgctcacttccataacgttattattggtggtgtggtatttggctgctttgcaggtaccgcttactggttcccgaaagcgtttggtttcacactgaacgaaaaatggggtatccgtgcattctggttctggatcaccggtttcttcgtagcctttatgccactgtacgcgttgggcttcatgggcatgacccgtcgtttgagtcaagatatcgaccctgcattccacactatgctggttgttgcagcgggtggagttgtcttaatcgctcttggtattctgtgtcaggttatccagttctacgtcagtatccgtgaccgtgaacaaaaccgtgatctgactggtgacccatggggtggccgtactttggaatggtcaacttcatctccgcctccgttctataactttgctgaagttcctcatatccagactcgcgacgcatggtgggatatgaaagagaaagacactgctcataaacgtccggctaaatatgaagaaattcatatgcctaaaaacacaagtgcgggcatcattatcagtgcgttcctcctggtcttcggctttgccatgatctgggatatctggtggctggctatcgcaagtttcgccggtactatcatcacttggatcgtgaaaagctttgacgaagatgttgattactacgttcctgtagctgaagtcgaaaaaactgaaaatcagcattacgaagaactgagaaaggcaggtgtgaaataatgtcgactcaaacccttaacaacacagccgcccatgagcatcatgggcaccatgacgtaggctccatgaagatatttggcttctggatctacctgatgagtgacttggttctgtttgcaagcctgttcgccacttatgcagtactggccaacggcacggcaggtggcccatccggtaaagatatttttgaattgccatttgttctggtcgaaaccttcctgctactgttcagcagtatcacctatggtttcgccatgctgagcatgaacaaaggtaaaacgggccaagttaacctgtggctgttcattactttcttgttcggcctcggcttcgtttcgatggaaatctatgaattccataaactgatttcagaaggttttggccctgatcgcagtgcatttctgtcatccttctttgctttggttgccactcacggtatccacgtaacttgtggcttgatctggattattatcatgatggttcaggttgcacgccgtggtctgactgaagtgaatcgtactcgtctgagttgcctgagcctgttctggcacttcctcgacgtagtatggatttgtgtatttactgtcgtttatctgatgggagctatgtaatgagtcatccaaatacttctcattccggtgccgaccacggcagtttcaaaacctacatgattggttttatcctgtcagtcatactgaccgtaattccattctggatggtgatggatggcagtgcttcccagagcacaatcctgcttacagttatcggcatggccgtgattcagatctttgtacatttcgtctgtttcctgcacatgaacacatcgtctgaagaacgttggaacctcgtcgctttgatattcacattgcttgtcatcgctatcgttgttgtcggctctctgtggattatgtacaacctgaacatcaatatgatggttgattaaagagttgacttgaatgattaagcaatacctgcaagtgaccaaaccaggaattattttcggaaatctaatttctgtggttggaggttttctactcgcttccaagggcgtaatagattacccattgttctttgctacgatgctcggggtatcgctggtagttgcatctggttgtgtatttaacaactatatcgaccgcgatatcgaccgaatcatggagagaacaaaaaacagggtccttgttaaagggcttatcgatccgaaaatcagcctgatttacgcctcagtgctaggtattgctggcatagtgctgctctatgtagcagccaatgccttagcaatgcagttagccctcatcgggtttgtgatttatgttggggtttatagcctctacatgaaaagaaaatctgtttatggcacgctggttggtagtttgtcaggtgcggcacctccagttattggttattgtgcagtaacagggcagtttgacacaggggcattgatactgttgctaatcttcagtttatggcaaatgccccactcttacgccattgctatttttcggttcaaagattatcaggccgccaacattccagtattgccagtaattaagggtatttctgtggcgaaaaaccacatcaccctgtatatcttggcctttatggttgccaccttgatgctgacaatcagcggttacgcaggttacaaatacctcatcgtagcagcagcagtgagtatctggtggctgggtatggcattatcaggttataaaactgctaatgatcgtatctgggcccgtaagttatttatgttttctattgtcgctatcatgtctttgagcgtcatgatgtctgtcgattcaacagcatctccagaaacgctgctgacttacgttcggtaatatcaagagggctgggtcttcccctgccctcttttcctttcccttatctctttattcatttacaacttgtttatttataaacgttattttttatccatataatttaattactattgattactaatgagataattagcattttacaatgacatgttcctatttaagtgaaatgtcatatcgaattttttgaggtatccatgaacgataataaaatgactccgcttgaacttcgagcaacgtggggcttaggttccgttttttctctgcgcatgttaggtatgttcatggttttacctgttttaacaacctacggcttggagttacggggatccagcgaaaccttgatcgggattgctattggcatctacggtttaacacaggcaatatttcaaatcccattcgggttgctttcagacagaatcggtagaaaacccctaatcatcggtgggctgctcatctttgtactaggcagtattattgcggctttgagcgactctatttggggtattatcatcggcagagccttacagggtgctggtgcaatatctgctgcaatcatggcattactttctgatcttacccgcgaacagaatcgtacaaaagctatggcattcattggcattagctttggtattaccttcgcctttgctattgttgtcggccctatcatcacgcaccaaatagggttaaatggtctgtttggagcaataacgatcttggccagttgtggtatcttgatcaccttgttcgctgtaccgtctgcgcataaacacatactgaatcgcgagtctggaattgcccgtggcagttttcgacgtgtgctctctgatcctcagctactaaaactcaattttggcattctcagcctgcatactttattaatgtcgagttttattgccctccccctaatcatggaaaaagccggctttccaccacagaaacactggaaagtttacttaattaccacactcatttcttttattgctgttttacccttcattatctacgcagagaaaaaacgccgtatgaaacaggtatttttactttgcatcggactgttattcatcgccgaattagttttatggtcagtgggttcacacctttggggaatttttgcaggtattcaggtgttctttctcgcttttaatatcatggaagccattttaccatcactcatcagcaaagaagcgcccgctggttacaaaggtacggcgatgggggtttactctaccagtcaattcctcggtgtcgcattgggaggtttcctcggtggaatgctctatgaacagcaaggcgcatcattggtatttatgggaggtattgtgctaaccgcactctggtttattatcagcctgacactacgtcaaccaccttatgtcagcagcatcaggattgtcttacctgagcaattgaataatcctgacatcttagaaaagaaaatattgtcacaggcgggtgtgaaagatattgtcatcgcattagaagaactcagtgcgtatgtcaaagttgatacaaaacagaccaatcgagaacaattagaacaacttgtgctgtctcataaataaccaccgccgtttgtaataaaacagtacggtgcatggatataatcccctagcaccgtactatgtctgtattgggtaatttacccaatatcatactttaaacataacactttatttgttggttttgcctttataatagaaaggctccatgtcaattttcttaatcaacaatgggcaccccagaccttcacgagctgcattcaccaatggccctctgtcctggtctgctgtccaagtgaatactccccctagatttttttccaatgcatattttgctttggctttcactgtacgcggtgtatccagtgatataaacaatttactgttttgattataaagatagtctgcatccgcaacttcatctgtataaagggtaaaaccatttctatcttgacgagattctagattcagataattatatatcgtgtcataccattctgttgagccggactcaaatgtcccagtagtcgtacccgttccaggactatagctgcccgataatggtgaataactggtaatattagtatttttgccattacgagaatatccagcataaccaatattgatagcttgagatggcacaccaacactgagtagatactcaaccgctttttccacactattttcactgcccggataacggcgcaaattagtatggtgccttaacttatcagcccacggagtaccaaagaaatcataggtcatgacattgataccatataatccaacctttaataattcaggtattttggatttttccataatatctggtacggcagagcaagcgatgctgattttaatatcagaacgtcctgcgttcttaaatgcagaagataaatcacggattaggtcaatataatatttaccatcctccgagtcgtgcgggttatcatttcctttcgctccaggatattcccaatcaatatctacttcagtgaacatggggaagcgtttaaagatatcgatcaaactggaaataaatttggatttcaattggctgtccctgaccatattgtaaaaaccattactcatggtccaaccaccgacgctgaatgacattaccagttcatggccttgcgcccttgctgcatcctgtatttttgccaacccacctagcactcccatagatttgtcctgattgaaatctctgggcatctgaacgtcttgccacctagggaaagtacagtttacataagattgacaatcgccccattcatcggtaaatgtgacttcgccattattgtaacgaccaaacttcggtgctgcccgagaaattaacgcttttttctcaccttgatcacctactatcccacagaaaccgataatcaatttatcataggcgaaagggttatcaagcaagtgttgtagatcaatacctcttccccgtgctgaaggggtttgattaccttgcaggcggctatcatattgtgaccagtcagtataataacctatgaccttaggtttatttttaacgttatatttattataaacgggtaaagcaactcttccagatgtataactaaattttgttgtttctgttgccggaataaaatgatctaaacggtaagattcttcactgagaggatccaactgagttaactttgacataaactctccttttttaaaattagaattacatgtctcactatataacttcggtcatcatcctaactcacgcatttttaactttatacctcatcatttattagtattatattatgaatagcattctataaaaaaatagaaatctactcggaaatcattttaaataaaaataatcaagtttatttgatggaaaatttattaagggaagcattagtaattactgaaattactccgcttcccttaaatattttggtcaatccaaaaaacaaatccgtcgattaccgaaagttagtcacggaaattagtaaactggaaaggttgccccaactctgcaccacgaaccagtgtcatcacactttgcaggtcatcccgcgctttgcccgtaacccgaacttgttcaccctgaatctgtgcctgcacttttagtttgctgtctttgatcagcttcacaatcttcttcgccaatggtgtatcgataccttgcaggaaggttgcctctacactataggttttaccactgtgaaccatattttcggcaacattaagcaccgaaccatcgattccacgtttggcaaatttttcacggagtatgtcaaccaattggttgacttgaaagtcagattcactcgcaatcttaactgattcgttcttctcgtttaattcaaaactcgcattgacgttgcgaaaatcccagcgattggttaattctctctgtgcgttctctactgcgttacgcacttcctgcatatcaacttctgaaacaatatcaaatgatggcattaccagtcacctcctgcttatcaataagttggcatgataaccgctttccattattggcaaaagatctatactcgggaggttctgcgatcttttggcatttacgctactttttaaggtcgtttgatttgagatcgtttgatttaaggccgtttgaaatcagcattgtttcgaggttctccataaaagcgcctctcatctcaaggaagtatatgaaaatcaccgttcttggctgtggtgctataggtaaactgtggcttgtggccttatcccagcaaaatcacgacattcaagcatggataagggttccacaaccttttgtctcggttcgtatcgataatttcaatggtaaggtatttgatcaacaattttctgccaatgacgaaaagcatctcgccgaaagcgaattgttgctcgtttgtttaaaagcatggcaagtttctgatgccatcaataacctcgcccctaaactttctcctcattgtccgatcctgttactacacaatggaatgggatcacaggaagaatttttacctttgcccaaccccattttacttggtgtgaccactcacggctcctatcaggaaaatggcattgtttaccacaaatcgcaaggtattacccatattggttccgcaacggctaacgccgataaattcagttttctggcggatgtcttacactatgcactgcccgatgtggcatggcacaatgaaatccacaccatcagttggctcaagcttgccgtcaactgtattatcaatccactcacagtaatttatgactgcaaaaatggcaatctattgcagcatactgcgcaaatcgatttactgtgcgacgaaattcaccaagtgatggaacgcgataatctacatacgaccaaacaaatgcttgttgattatgttatgaatgtgattgaacagacttctgaaaattactcatccatgctacaggatatacgagcacaacggcatacagaaatagattacattacaggttttttactacgccgagcccgtgcttatggactgtccatcaaagaaactactattatttatcaatgtattaaacgaaaggaggaggaatatgaacgcctcagccctcatctgcctggctcacggcagtgaagaaaccgaagccgttatcactattgatttactggttcgagcagagattgatgttaccgtagccagtgccgcaacagatggtgccctcatactaacctgttcacgtggcgtcaaaatcgttgccgatacacctttggttaatgttgttgatgaagattttgatgccattatcctatcaggaggaataaaaggagcagaatgtttccgtgatagcccgttagtggtagaaaaaattcgaacagcacacagccaaggcaaaatcattgcagcaatctgtgcatctcctgccatcgttctggaatatcatcaactctttcctatcggaaatatgacaggttatcccagcatgcgggataaaatcgcgccggaaaaatggatcgaccgtcgggtctactttgatgaaagggtcaatttgctgaccagtcaagggcctgctaccacttttgattttgcactgaagctgattgaactgctgaaggggaaagagaaggcagcggaggttgctgcacaactagtattgccacctggcgtcaataattaccagcatcagcaataaaaatcggatttgcacaggctgcttacagaatattattcctgtaagcagttctgctgccctgatttcagatcaaggccgataaatcttcacgttctcaaaaccttgctctcgcagataaagagcctgtaagcggctcatcacgcctctttcacaataaagcaggtaatttttctcttttggcagatcaccaaactgagtgcccaatttatagaaaggcaatgactgaatttcgattccatccacacttaatgggcgatcatcttgctcatctggcgcacggatatccagtagcacatcactagtggaaaattcagtgacagtttccacttcaacaacctgttcacaggcctgctgtgcaatctggcggatatccagattctgagcttcacttaccacgcgatccagaatctcaaaatcaaaattggcttcttccgcttcgattttagctttcaccgctttcacagttgggctttttgaaataacgccacaaaattcaggcatggtacgagcaaagtcttccgtgccaatctcacgagccaatttaataatgtgctctttatcgtgagaaatcagaggacggaggatcagcgtatcagaagcattatcaatcagtcttaagttagtcaaagtctggctggatacctgccccaaagcctctccggtcacaattgcctgtacaccgtagcgctccgcaatcctggaagatgccctgaccatcattcttttcagtacaacgcccatctgaccgtcatccactttttcgaggatctccgcgacaacgggctcgaaatcaacagcaacaaaacggactttatgggaactaccaaaccgattccacaaataatgggcgacctgtttcacgccaatttcatgagcagcaccgccaagattaaagaaacagtagtgtacgcggcagccacggcgcatcagcatgtaactggaaacaccggaatcaaacccacctgaaatcaacgacagtacatcttcctgtgtcccgataggaaaaccacctatcccttcatggcgggctttaaccagaatcagtatatcctgttcgatctctaaatttaccgttacatccggatgcgttaatttcactttggcggattcaatatgctgatttaggccaccaccgacatatcgttcgacttcattggaagtgaagctatgcttacctcgacgctttacacgcacacaaaatgtttttccatgcagcaaatggccataggcttcgtaggtttgttcgaagatatgatgcaagtcacgaaaatctcgttcttctacttgcaagatatggtgaatacccggaatacgtgttagtgcatcacaaatttcagcaccaaggttatcatttttagcccgaacttcgatattatcccagtggcggacaacagcaatctcctctgataatgttttcagcacattgcggatattgctggcaaggattttaataaaacgtaaccggacggtctggctcttaatcgtaatttctgggaataatttaatgataaacttcatagtaagatatagtagtcattcaatgttgaactatcacaatcaatatcaatgattgttcttaagtgttcagttagatagggcgtagagtataacaccaatctcactatatcgactgtaaaaaaacagcggtaacgaatgatttatttcttccagtgtagtagggtactctgcaattctgtagcgaacttgcttgactgtaattcgttaaataatcataccttaaatcattatgtctaaagcaaatcaaacatcagaaatcgaacagacaccagcgtttgaaacttccctgaaagagctggaggaaattgtcactcgtctggaatcagggaaacttcccttagaaagtgcattaaatgagtttgaacgcggtattcaacttgcaaggcagggacaaaaaaccctccaacaggcggagcaaagagtgcagattttattgaatcatgatgcacaatcgccacttgatgaattttcgcctgacgctgagtaaatttatgtctgaacaatataagactccttttgaagagcaattaagcgcttgtcagcagcatgtcaatgacaagctgatagcaacattttcttcattaccttttttggacagcccattagcgacagctatgctgcatggcgcggtactaggcggcaagcggttgcgcccatttttggtttacagcgtgggcgaaatgtttggcctttccagagagagtcttgatgctcctgctctcgccttagaatgcattcatgcctattcactgatccatgatgatttgccggcaatggacaacgacgatttacgccgtggtcaacctacctgccatatcaaatttggtgagagtctggcaattctggctggagatgcattacagtcattggcatttgagatactggcaaagcaagatatgccaaatattgccttatccgatcgccttgcaatggttgctgaactggcaacagcgagtggtcttgctggcatgtgcagagggcagtcactggatttggaagccgagggaaaacagatcgaccttgctgctctggaacaaatccatcggcataaaacaggcgcattaatacgtacagccgtcaggcttggggcttacagtgctgggcaacgtggccgtgaagtactccctttactggatcaatatgctcaagccattggcctcgcatttcaggtacatgatgatattctggatgtcattggcaatacagacgttatcggcaagcggcaggggaacgatcagcaacttggtaaaagcacttatcctgcgctattaggtttggaacaagccaagaaaaaagcgagggatctctatgaagaagcgctcgccgcactcacggaactggaaaaacaatcctataacaccgtgatcttaaaaaaactggctggttttatcatcgaaagaaacagttaaaaaagtgagccataacaatcaccgatcatattagttactagttacattaatcactggttatattattcatcggttataatagcaatccaataatcaataaaatggcctcatgaggcgaacccagaaattacacactgataacaacagggttcttaatattcaacttctaacgggatagcattttaacgggcatagcatgagcattgatatagcgaaatatccaacattggcattggcggaaactcccgaagaacttcgcctgctacccaaagacactttgccaaagttatgcgacgaactgcgtcaatttttgctaaacagtgtcagtcgctccagcggccactttgcttccggcctcggcactgtcgaattaacagtcgcacttcattatgtttataaaacaccgtttgacaatttagtttgggatgtcggtcatcaggcctatccgcacaaaatattgaccggacgccgtgatcacattaacactattcgtcagaaaaatgggctccaccccttcccgtggcgagatgaaagtgaatatgacaccctatgtgtcggccattcatccacttcaattagtgctggattgggtatggccattgcggcaaaacatgaagacaaaggtcgcaaaaccgtctgcgtcattggtgatggagctatcactgctggcatggctttcgaagctatgaaccatgccggggacatcgatcccgatatgctggttatcctcaatgacaatgaaatgtccatttctgaaaacgttggcgctttgaataaccacctggcgcatcttctttcaggcaaattgtatacaaccctgcgtgaagggggcaaaaaagtcttttccaacctgcctcccatcaaagagttactgaagaaaaccgaagaacatctcaaaggcatggtcgttcccggaacgctgttcgaagagctagggtttaactacatcggccctgtcgatggccatgacgtattggctctgacccagaccctgaaaaatatgcgtgagctgaaagggccgcaattcctgcatatcatgaccaaaaaaggccgtggttatgcccctgcggaaaaagatcccatcggttggcatgctgtccctaaattcgatccggctacaggttccttgccgaaaagttcagatacccgcccgacattttccaagatcttcggtgactggctgtgtgaagaagctgcccatgataaaaaactgatggcgatcacccctgccatgcgggaaggctcaggtatggttcgtttctcccgtgaataccctgaacaatactttgacgtggctattgccgaacaacactctgtcacttttgcggcagggctggctattggtggttacaaaccgattgtggcaatttactccaccttcctacaacgtgcttatgatcaggtgatccatgacgtcgccatccagaatctgcccgtgctgtttgccatcgatcgtggcggcattgtcggctcggacggacagactcatcaaggtgcattcgacctctcattcctgcgttgtatcccaaatatggtgatcatggcacccagtgatgaaaatgagtgccgtcagatgctgcatactggccatcactatcagaacggcccggcggctgttcgttatcctcgtggaaccggaacaggtgctgaactccagccactggaggcattgccaatcggtaaaggtatcgttcgccgtcagggagaacgcattgctatcctgaacttcggaacgctgctgccagacgcattgcaatccgctgaagccttgaacgtaaccgttgttgatatgcgctttattaaaccactggataaccaactagtgctagaaatagcagccagccatgatatgttggtcactctggaagaaaacgccatcatgggtggagcaggcagcggcgtcaatgaactgctgatgcaaacaggtcagcctgttccggtattaaacctcggtttgcctgatcactttatccctcagggaacacaggaagagatccgagctgatttagggttagatgccactggaattcaacacgctatcgaaaaatatctggctaaataatcttcaaaaaaggatgtgtgctctttgcagcaacgcatccttttttcttctgctctttccttttcaacttcaaaatttttcaaaaaactaatcagttatatcaatcttcaatataaccatttcacaactgtcttctcatttttgaaatcactacattaattttaattaaaatcaatgtgataatacacattcaatttaaatggttattagtcaaagagacatgaattaataaaaacacaaaataaaaattaaggttaatttaatgaataattccaatgccctacctcattcacaacaattcctttttaatcctaatgaaaattggcttgattggcgctggcagcaaaaaaacgccttacgtgatgaggccgctttacgttccgcctgtggtggatggagtgaagaaatagccttacgtatccaacaaaatttacaggggcaaaaaatgcagatcaccccctactacctccgtcaaattttagccaccaaccaatctgacgacatcacggcaaacccactctggcgacaagtagttccattctggagtgaagaggaactgaacggctacgatggagaaacagaaaactgggaactcaatgatgagatgaaaactcccatctgccagcataaatatgataatcgggtcatattgcgcatggtcaatgcctgtaactcctactgccaattctgctttgaagctctgcgaaccttgaaagtggattccggcaaatccaatgcaggccgaagctctttccaacaatcccttgaatacatcaaaaatacgccttcagtagaagaagtgatcctgagcggcggcgatcccttaatgctgacagataacaagctggatgaatcattggccgccatccgggaaatccgcgatgacctgttaatccgcattcattcccgcgccttgaccttcaacccttaccgcattacagatgctctgatagaaacattgaaaaaataccgcatcaatgccttcggtgttcatgtctgtcatccatttgaactcagcgaagaatttcaaactgccgttcgtcgcatccaaagtgccgtaccgattgttttttccaacatgcctttcctgcgtggcatcaatgacaacgaagaaacactccacaagctatttatcgatctgtatcgcatgggcgtaaaaccctactacctctaccactttatgcctttctcaccaggttcttctgaatataaagcctcgatcaacgatgccatcgctatcatgagtaaactcaaacgtcgcatttcaaatatcgccttaccggaatacgttctgccgcatatgaaaggcaaatttactgttcctctgtttactcatccgcaagagatgccctattttgaaaccctcaatggcaaacgttattaccgctttatcaactggcaaaacgaacaatgtgaatggctggataactaggctttagccacttttctcactgttctataaaaaacgaataaagcttatttattttaaggatgccaaatgaaaccaaacgccattttatttgttgatatcgatgatgccgaaatcacgcgatatacctatcgggagccacactttgccgcagcaaaagaaatggggctgctttgcctgaccgcagcactgcaaggacgccagcatacagagcgacttttcgctgatagtgacgaagctttttatgtagaatcaatgacattggatgccttacgggatctcgttagcaccttactggatacctacaacctgcgtgctattttatgccatgcaggccatgcatctgccagtgggcaagtcggctgtattgttgccgaaatatgtcaggaaatagagttaccgcactcttcttcccgtgccattgccacctgtaacaacaaattcctgatgcgtcagacattacagcagcatggtgttcgatcaatacgtcatgcactgtgtaataacgaagaagaactgtgttcacaagccaatttgattggctatccgttaatcgccaaaccaccgttcggggcgtgttcagtctttatcaaaagatgcaacaactgggctgaattactggctcattaccaagcatttacagcccattacgcgcactctaactacaccgattttatgggcaatcaacaagaatgtgtgacgcctaaaggtgaaaaatacgttagcattccaggaaaaagcctactgttggaagaatatattgatggcatagaaggtacgattgagtgcgccattaaccagcacactatatatccagtcttgatcaatgaaaaattgattctgacagagaaaagcaacaccgtgctggaaaacctactcattactccacctgtgtcattttcaccatcagaacaggaacaaatcaaaaactacgctatagcttgcctgaatgccgttggtttaaacaatgcaattgctcaccttgaatttcgtatgacttccgaaggccctgtcattattgaaataaacccacggctcggagggctgtttgtcaactcggctttccgtgatcttgcaggcctgaacccttatcagctttatctttccatcctcatacaagatcaagaagttgatttccaacttacccaagcttgcaaacaagcagaacaagccacacaacattactcaatgattgttatgtatccagatacaaacggtcattttaaaggcatcgaaaaccttcactatctcaaaaatcaaccatgcatactcgaatgtgtgtcttacaccaatgactgctatatcaacgcggaaattgaagagcattatctgattaagtgctgggcaaaagtcgaaggagcatcccatgcccatacgttgcacagcaatatgctagaaaacgtcaaacccatcattattccagaatctgatctgacttcatgaggctgctacacgatgaacattacgaatatctcagcaaatttaataaacgaacattattgccatattccacatttcagtgaattgatttcctgtgattcagaagcaactaaaacgtttaaaggccattgggataatctggttctagatcagaatttcaaagactatacccacagggagaggcgtattctgcgttaccactatcgccccggcacagaaatctccttccagctcaatcaagatactgaatatcgatcatcagtaacctatgacattgaatacaaaaaaggtgccaatcaactcagttatgctgaagatacatttatttttccatatgaaaggtttaaaaccacggtctttagacggtgactttgactttaattctttgacctatgcgcgtttacgaggtgcgtggttcgacgactttcagtcgtcggcaccgaagtgcgctaacccacctacttcagtaggtggtagttaagtaacgatccgatcatgcagcatattctttcaatggatattgctattttaggagatcgattaataaaaggttgccactattcgattgatattcatcaatttcgtgttaaagcgtttgcggggaaagaaagcccaacgacttcaggtattcatcaggacgggcaggattggatctttatgcactttatccaaggccataatatcgcacctgtaatttccgaagttcacgcaaccgcagatgaagcacctcctttgctacataccgcgatggaacagtttctagaaacactcgcaataaatgacagacaactttatcatcgagcgagcaatgttggacaaatatctcctacaatcacggcatttcgggatctgttgctggtgactttccggcaacgccctgaacaacaagagagctaataatgtcaagccaggaaattagtttgaatttgcgttggtctggtctaaatgccttgctgatcgtcagtgcacgattcgtatctgattttggcgcattcctgaatatggttgcgctatccacctatgtttacctgcttagtgatagcgtcatgcacgtcagtatttttctggcctgccgtgttgcaggcgggatcatcgctagcctgataggtactccattcttcaggcgatttgccggacgctggccactggtctgtttcgatttattgcgggtcattctgctatccctgttattggtgataccagcttcacagcagttactgatcttaccgatgatcgcttttggcattggcttaggcaactcgatgtttgccatcgggctgaacagccaactcccatactgggtacacgcttcccaacgcatatcaaccaactcctggctaacatccgtcgccgctacaggcgcagtacttggcagtttggtatccggtttgttggtcgccagcagtggttatgaaatagtctttatcgtcaatatcattacctacctgctggccgcattcttgattattcctttgcgtttcctcacccatcctgaacagaaaacatcacgggaacggggtaacgaatggcgtgagttaatccgcggcttacgtggtactccgatgctggcaggaatgctgttcctcagtttggccgacaccctcggcagcgccgctcataacgtgggatttcctgtcatttctaagttacttacgccagataacgccagtaccacaatgggcttactgctggcgacatgggcggtgggaaaattcagtggagcgcgtctgaccagctacctgctacgcaaccgcaatttattgaagatggagaaactcttttttctgggcgttgcgttgatatcgaccgggtttatccttactttccaacaaaccagccagctttggctactcgtatttgcagtctgggcaggtatcggagacggaatagcagaagtcagcctgatttcacgggcgcaaagtgaaccggaaagtttacgcttgccgattttcagtttgctgacactgatgcaaatgacgggattcggtataggcatgttgctggtcgcacctttttacgtctggctaccaccttctgtcgtgatcctgatattccacggtttgccgcttactgtgctagttatcatcctaatatggatgcgacgttttactacaagtaaagcgtaagcctcattgcagttatcaattttaaaatcagcaccgaagtattctatattgcttttcggtgctgattttccagagagcttatcaatgacgatagacaaacccgccggcttgccatttttcgcctactgatttagggaggaaagtatatctggcggcgtcagcctaatatataggttattaaatccgtgtaaaatccccaattccgtataacaatgttgcacttattatgtaaatccatctaaatttataataaaacaaaatacctttataagatgaagataagtacatccaccaaaacataattctgacataaatagatattgttaaaaattatatcccaataatgctaaaagcaaaattcacgataccacataagcatttatcaaaaatataacccacacatcattaatatgaatttttcatttttaagcatctataccctataaatttcaagttgcaattaacaaaatattcttgggaaataaactgtttttcattcaagaagtgatctgcattccatttttataatccaattcgaatttgatttgcttaatccttaatcacaatctatttattgttcaacaatacaaaaacaatgcattaacaataaccgcaaattaatccaacaatataacaactcaatttcgtttatttaatgggggaacaaagtatgcagcaagccatcaatttctggccactgatcgggattgccgtcatcatgatcgggtttatccttcgttttaatcctgttctggtcgtaacggttgcagggctagtcacagggctagccgcccatatgccaatcaccgaaattctggaaaaactcggctccggatttcttaataccttgaatctgttactgacaattctgtttcctttggtcattgttggccttctggaaagacatgggttaaaagaacgagcccagcgctcaattgcccatatcaaaactgccacaaccgggcgtttactaattgtctatctgttcatacgagaaacgtctgccgcgctagggctgaccagtttaggcggccatccgcaaatggtacgtccattactggcaccaatggctgaaggggcggcagagaaccaatatggtcatttgcccgatcatgttcgccaccgtattcgcgccatgtccgccgcaactgataatactgggctgttcttcggggaagatatttttgtcgccttcggtgccattattttcatgcacaatttcatgctggaatctggtggtatccagactgaacctctgcatattgccttgtggggcattcctaccgccatctgtgctttcctgatccactcggttcggttatatcgccttgattaccatcttgcccgcgaaattacttccctgaatcacatgaaattgactagcaaggaagcaaaataatgtttcagttacagtatctctactatctggcgggattcattctgctcattgtcgccgtgatgtcgtggcgcgatcgagccaatcctcgccgcttgaccacaggcctgttctgggggctgtatggcctcatcttcctgataggaaactggagctaccaattgatggctatctggataagcgacgaagctcaagcccagaaaatcgtccatatcagtgttggtgtactggtgatcatcatagcgttattggcgggatttggtggagtacgtgtgggaaactaccatcagcctacaacggaacaaaaacagaaaagtgcagagcgcctcggcaatcggttatttttgcctgccctgctcattcccgttgtcacgatggtgggtgtcctgctgtttaaccatattccgggactacagcaaaccgttttcggtgcaggcaatcattcaacgttggtgacgttattttccattaccttcggttgtctggctgggttaatcatcgcattgcacatgaccagagaaaacatcatgcaaccgatacaggaaacacgccgtctattggattctatcggctccgtgttcattctaccgcaaattctggcaaccctcggattactgtttacggcagcaggcgtaggcaccgtcatttctcatttaactgaaaattatctggctgtcgataatcgatttatagcggtgatagcctatgtgctcggcatggctctactgactatgatcatgggaaatgctttcgctgcctttcctattgtgacagccggtattggtattcctattttgatcttgcaacatggcggtaatccagccgtaatggccgccatcggtatgttctccggctattgcggtacgctgatgacacccatggcggcaaatttcaatctcgttcctgccgctctgctggaattacctgatcgtaatgccgtaatcaaggctcagatccccaccggatgcaccttactgattactaatgtgtttttactctattttttgatgttcttataaaacaacaatacggaacgattatgaaaactattttagtcactgcttttgatcctttcggtggtgaagctatcaatccatcgtgggaagccatcaaaccattacaaggtagccaagtttctggtgcaaatattgaaatttgccagcttccctgcatttttgatacttctttagaacacctttatgcagccattgataagtaccagcctgaactggtgatttctgtcgggcaggctggcggtaggacgaatatcaccgtagagcgtgtcgccattaatatcaacgatgccagaattcctgataatgccggcaatcagccgattgatacccccgttattgttgatggccctgccgcctatttttctcgcctgcctattaagacaatggtgaatgcattaaatacagcaggtattccggcgtcagtttcccaaactgccggaacctttgtgtgtaatcatgttatgtatggcttattacattatctggctcagaatacctcctctgtgcgcggggggtttattcacgttccttatttgccagaacaggcggcaaaatatgccaatcagccaagtatgacgctggaattgatgacgttggcgttgaaaacagccattgaaacagcctggaaaaatacatcagatattgctgttacaggtggggctacgcactaaaaaaagataggtagacgcgaggcgataaaaataaattagccactgagtacagtggctaatcggtcatttatctcaacgataaaagcgagaatttagaaaggcaataatgggcagaaattcagcaaccaaataacaataactgcgaaaattgccgcaataatgtcatccagcatgatgccgattccaccttttacgtagcggtcgaaccagcgaatcggccacggtttccacatatcgaagatacggaacaccacaaaagccaccaaaacccactgccagttgaggacgggaattgccatcaatgtgatccatatgccgatgaattcatcccagaccacacaacccggatcttccacctgcatggcatcggccgctttctgacaaatcacgcagccaatcaccgttcccagcagaataaccaaccaaatgccccattcaggtaactgcactaacaacaaccagaacggaattgccgccaatgagcccatcgtacccggcataatcggcgataagccactaccgaaacccgtagccagcaaatgccacggattacgcatccttaagcgacgttttgcatcatccatgagttccctccgtctgatcattctgtgcctgttgtaatgcctgacagtcttctatcggttttttttcggtcttaaaatggtcgaagcctttcagatccagctcaatttcttcattgttgttgaaatagcggataccttctgattccggcctgatttgcccgacacagcggaaactggcaccagtatgtgccaatgccatatttagtgcaccacggttaagttcaggtacggtgaagcacaattcataatcttctcccccccccagcgcccatgttaatgcttgctctggtgtggcatatttctgcacagcctccgaataaggcagcgcatccagattaatacgcgcaccacattggctggttgtcagaatatgactgagatcagaaatcaaaccatcggacaaatcaatcgcggaagaggccagattacgcagtgcctgcccttgtaaaacccggggctggggacgaaggtgacgtttgaccagccagttgtgaatggcgctatcttccacagcaaagcgatcctgcaacagtgcaagccccgcagcactgtcacccaacgttccggttacataaatccagtcaccgtttttcgcaccagcacggcgtaacgccctgccagccggaaccagaccatgtaccgtcagcgtcagactcatggggccttttgttgtatccccaccaatcaactgcatgccataatagttcagttgttcaaacagactatcactgaaccgttttaaccaatcctcattgacgtcaggtaacgttaacgccagcgatgcccaagccggatctgccccaactgcggccagatcactgatgttgacagccagcgccttataagccaaatcttccggggaaatgtcagggaggaaatgaacaccagcaaccagcgtatcggttgtcaccgctaattcttgtttctctgcaacggtcatcagcgcgcagtcatcaccaattcctagattcacatcacgtcggcggatgacatggcgattgaaataacgtgcaatgaggtcaaattcaccacatgccataatagaattccaaaaagtgactgacgatgagcacatgaggccgggaaaccggcctcatgtatgaaatcatcgagttataatggggaactcctggcaagcaatcactttttcttgcgtgctgccgggccagctttatccaacaccccattcacgaatttatggctatcttcagcaccaaacgtttttgccagttcgataccttcattaatagccactttataggggacatcatcacgaaagcttagttcaaacatcgcaacgcgcaagatggctttttccacctgacctaactcttcaagctgacgggaaaggtaaggagccatcaaagcatccaattttgcagcattgaccgctaccccagtcagcaattcacggaaataggtgatatcaacaccagttacgtcctgctctgacaaaaactgaaattcaatatcagcaatgtcatttttggataattgccatgaataaattgcctgaacagcacactcacgagcacgacgacgagcagcaggtttcacaaaattccccttaattaaaactaaaaaattcagcctttaatggctttgattacattgatcatttctaatgcggtcaaggccgcttccgcgcctttattgcccgctttagtgccagcgcgttcaatcgcctgttcaatactttcggttgtcagaacaccaaatgccacaggaatatcactggacatcgctacactggacagtccagagctgcattcaccagcaacatattcaaaatgggctgtaccgccacggataacggttcccaaagcgataaccgcatcatatttttgagtctcagtcagagccttaaccgttaacggtaattcataagcacctggaacccagactacagtgatattatctgaagaaacctgaccgatgcgttccagcgcatccacggccccttccagcaggctgtcattaatgaagttgttaaagcgggcgatcgcaatggcgatgcgggcttctggagctgcaacaacacctttgattacgttcatagccttccttataccttattcatatccgcaggggcgcggatcttatcacattctttttctctgcgtcttgatttatgtccaaacttgaatcaatacgctggccgcaggcgaagacgcacatcaggaccaatctgccggacatcaaacagcgtgaattcaggcgcatccgataatttttgtagctcagggagagcaaatagcccacgggcagtatttcccagcacttttggcgccatatagaggattaactcatccactagccccagagataacaatgctcccgccaaaacaggtccacattcagcccaaaccgaatttatctgacgtttacccaattgcatcatcagcaaaaccagatcaacacccccgccgtaggcaggcaatataatatgatcgacattgccaggccactgctgctcatcggtgtgagtacgtgctaaccaacattgccccgcctgctgtacaacttgatgctgtggtgttacgcgattctggctatcaacaatgatccggattggctgacgtacttgctcttgaggataaatcgcctgtatttcggcctccaattcatgccagcggacagtcaatgaaggatcatccgccaataccgtggcactggagctgagaatggcactacattgcgcccgcaactgctgcacatcctgacgggcttctggcgacgtaatccacttactttcacccgatgccagcgcagtccgtccatccagtgacgcgcccattttcagttgcaaataagggaatcccgtgcgcatacgcttgagaaatcccttattcagcgcttccgcctgcgccatcaacacgccatgctcaacggcaatacctgcctgctgcaatttatacaaaccacgccctgcaacctgcggattgggatcttgcatagcggccacaacacgactgataccggctgcaatcaacgcatcggcacagggaggcgtcttaccgtggtgactgcacggctcaagggtgacataagccgttgccccttttgccttgtctccggccatgcggagagcatgtacctccgcatgaggttcaccggcacataaatggaaaccttcaccgacaatgtgatcaccctgaacgatgacacatccaacattcgggtttggggatgtcgtaaaacgtccctgaatcgccagttccagcgcacgggacatatatttttcatcgagagtcatagtttttgaaagcctgattttttgaaagcctgagattttagaaagccagtatattcaatcttgtagtctggcaatctcttcgccaaattcgcgaacatcttcaaagctgcggtaaacagatgcaaaacggatataagctactttatcgagctttttcaacgcatccatcacgaaattcccgatcatcttggatgggatttctcgctctcccgttgccctcacttgtgacttaatatgtataatcgctgtttccacatcatcagagctgacaggacgtttttccagtgccttcaacatgccacgacgcaatttttcttcgtcgaaaggctccctaatgtcatcacttttaatcactcttggcatcaccagttctgcgatttcaaacgtggtgaatctttcatgacattcgagacactgacgacgacggcgcacttgtgagccatctcctaccagacgggaatcaataactttagtatcaacggctgcgcaaaatgggcaatgcatattgtttcctgacagttaaccgaacgggaagacagtttaccttgaagtgataatgaaaaacaccctgtaagtaagtactcacagggtgtttaaacgatatcagaactagatcgtgtcaggctattaaggaagaatggaaggctgatccgccccttctttctcaactttctgctgaatcatatgctcacgcttcattcccagtttcaaggccagtgcagaagcaacatagatagaagatattgtaccgatggaaaccccgattaacatcgccagtgagaaacctttcagcatttcaccaccaaagatgtaaagcatcagaacaacgagcagcgttgtcgctgaagtcatgatcgtacggctcaaagtctgagtcagggaaacgttcatgatttcatacgatgtgccacggcgtatcttacggaagttttcacggatacggtccgataccacaatactgtcgttcaatgaataaccaataacagacatcaacgatgccacgatggtcaggtcaacttcaatgtggaataacgacagtacacccagtgtaatgatcacgtcatgcgccagcgcgataacagctcccaatgccagacgccattcaaagcggaaaccgacataaatcaggatgctaattaacgcagccagcagagccattgctcccgtctgcgccaactcgcctcccacacttggcccgacaaactcaacacgcttgacgactgcatctttgtcgatattcgcgttgataaccgagataattttattacccagttcctgccctgcattgcccgtcacaggcggcatacgcaccatcacatcacggctactgccaaagttttgcagtagcggatcggcaaaaccgtttttcgtgaggctttcgcgcatcttatccagatcggcgggtttactcaggttaatctcgattactgtaccaccggtaaaatctagcccccagttaaacccacggacacccatcgtaatgatggaagcgaccaacaacagtaacgaaatcccaaaggcaacgttgtcccagcgcataaagtcgatgactttacgcccatagtttaattgttcaacagtgtaatcctgtgccacaacgtgctccttaaattgacagcttattgatacgcttaccgccgtacagcaggttcacgacagcgcgtgttcccacaatggcagtgaacatcgacgtcgccacaccaatgctggtcgtgatcgcgaagcccttgatggaacccgttcccactgcatacagaatcacagcagtaatcagcgtagtcaggtttgcgtcaatgatactggagaacgcacctttgtagccttcatgaatcgcttgctgcaccgtacgcccgttacgcagctcttctttgatacgctcgttaatcaaaacgttcgcatccactgccacggcgagggtcaatacgatacccgcaatacccggcatcgtcagcgtcgcccccggtaacaaggacatgacaccgacgatcagcactaagttagccagcagagcactgctcgcaatcaatccgaacttgcggtagtaaatcaccatgaacaggatagaagagatcaagccccacagacaggcttcgagcccctgctcgatattctgtaagccaagggttggtccaatagtccgttcttcaacaatctggatgggtgcgatcaaagcacctgcacgcaacagcagcgccaactgacgggcttcattcgggttaccaattccggtaatacggaaactattgcccaaacgagactgaatggtggcgatgttaataacttcttcttgcttcaccagaaccgaacggccattggcatctttcttgccactgtccttatattctacaaacagcgtagccattggcttttgcaagttgtctttggtgaagttagacatcgcactaccgccagcaccatccagcgaaatattcacctgcggattaccgtattcatcagtactggaagtggaatccgtaatatggtcaccggtcaggatcacgcgcttgtacagcacaactgggttgctatcacgggtatacttcagttctgaatcacccggaatacgtccagatattgcggcattctgatcaacattgctgtttaccagacggaactccagcgttgccgttgcaccgaggatttctttggcacgggcagtatcctgaatgccaggcagctcaacaacaatacggtctgcaccctgacgttgaaccagcggctctgctacacctaactggttaacacgattacgcaggatagtgatattttgctgtaccgcataggtacgagcttcacgcaggcgatcgtcactcataacgactttcagcgtactattcgcgccagtggagaagactaaatcacggtgacggggttcgagataactttccgctttggaacgtgcatcattatcgcgaaaacggacttccactccatagttatcaagcttacggacagaggaataaaggatgccttgatcacgcaattcagagcgcaggctatcaatgttctgttcttgtagcttactcagcgcagtttccatatccacttccatcaggaagtgaacgcctccacgcaggtcaagccccagtttcattggctcagcacccactttacttagccaaagaggtgtcgcgggcgcaaggttcaatgccacgacatattgttctcctaatgcggaaaccaatgcttcacgggcacgaagttgaacatcagaattattgaagcgagcaaggattgccccattttccagtgcaatggacttgctcttgatttgttctttttctaaaacattacggacttggtccagcgttttttcactggcggcgatgccccgcgcgccagtgatttgtacagccggatcctcaccatataggttgggaagtgcataaagcaaaccgatgaggatcgcagcgatcagcatcagatacttccacaaaggataacggttcaacacggcagttcccttcgggaaaatcggaaaattaaatagccttcattgtacctttcggcaaaatggcagcgacgaaatcacgtttgacagttatttctgtggtgtcattcagggcaattacaacgtaacctgtttcagacactttagagacacgacccactaaaccaccagaagtcagcacttcatcacctttggcaatggaatccatcagttttttatgttctttggtgcgtttttgttgtggacgcaggatcatgaaatagaaaatcaaaccgaaaacaaccagcatgataatcagagaatatgggcttccctgagattgcgctggtgcgccagcagatgccgcagcttcagaaataaaaaaactcatcaaatttccctcattgttatcgaaaacattgttgtcaaaaatattgttatcgaaaatcgacagtggctcgatcaaaaaccagcccgatatgctacacatattgaggctggttagtcacgccaaattatatatttaacggcggaacgggtttgccgatccgctgataaaactcttcaacaaactgttccagtttgttctcttcaatggctttacgaattccggccatcaaacgctgataataccttaaattatggattgtattcagccttgcaccaagaatttcgttacagcggtcaagatgatgcagatatgcacggctataatggcgacaagtatagcaatcacaatgctcatccagcgtagaagtatcttccttatgtttagcattgcgaatcttgatcacaccctctgtcacaaaaagatgtccattgcgagcattacgggtcggcatgacacagtcaaacatatcaataccacgacggacaccttcaaccagatcttctggtttaccgacgcccatcaaataacgtggcttatcctgtgggatctgcggacaaacatgctccagaatacgatgcatatcttcctttggttctcccacggccagaccacccaccgcgtaaccgtcaaaaccgatttcgaccagtcccttcacagaaacatcgcgcaaatcttcgtacacactgccctgaataataccaaacagggcatttttattgcctaactcgttaaaacgctgacgactgcgtgccgcccagcgtaatgacatttccatggaacgcttcgcataatcccaatctgcgggatatggcgtacattcatcaaaaatcatgacgatatcggaacccaaatcatattggatttccatggatttttccgggctgaggaaaacgggcgtcccattgatagggttacggaaatgaacgccttcttctttgattttacgcatcgcaccaaggctgaagacctgaaaaccgccagaatccgtcaggatagggccgtgccactgcataaaatcatgcaagtcaccgtgcagtttcatgatttcctgaccggggcgcagccataaatggaaagtattccccaacagaatctgagcaccagtttccttaacttcttccggtgtcatgccttttactgtgccgtaagtccccacaggcataaatgcaggagtttccacaacgccacgatcaaaaatcaggcggccacggcgggcattcccatccgtcttttgtaactcaaatttcacttaacctccagacatcagaaaaacagtctgatgttatgtttaaacatcgttcaagccagccaagctggaattacgatactttctctttcgctgccatagggttgcgattaataaacatcgcatcaccataactaaagaaacgatacttttcagctaccgcttttttataagcattcatggtatttttataacccgcaaatgcagaaaccagcatgataagcgtggattcaggcaaatggaaattggtaatcagcgcatcaacgacttgatactcaaatcccggataaataaaaatttgggtatcatcaaaaaatggcgagataaggccattttggctagcacgagccgcgctttccaatgaacggacggacgttgtgcccacggctacaaccttattgccacgcgccttacacgccaataccgcatcaacgacattttgcggaacttctgcatactcagcatgcataatatggtcttcgatggtctccacccgcacaggctggaacgtccctgcgccaacatgcagggtaacaaaagccatatcgatgcctttttcacgcagtgcggccaataggggttcatcaaaatgcagcccggcagtcggtgccgcaacggcaccaggacgttcactgtagaccgtctgatataattcgcgatccgattcttcatcagggcgggcaatatacggtggcaacggcatgtgaccaatttcatccaaaatggtcaatacatcacgatcatcatcaaaacggatttcaaataaagtatcgtggcgcgccagcattgttgccctgatgctttcatcttcgcccagcagaagctctgcaccttctttcagtgccttggacgcacgaacgtgagcgagtactcgcttattatccagcatcctttctactaaaacttccaatttcccacccgtcgccttgcgaccaaacagacgcgcaggaataactcgcgtgttattgaaaaccagcagatcaccggcttccagcttatccaacacatcagtgaaaataccgtgcgtcagccctccggtttcgccatcaagggcaagcaggcggcaaccactccgctgcggctggggatagtgagcaatcagctcttctggcagttcaaatgtaaaatcagcgacacgcattttatctgtatcattcaaaaaaacaggcggactagtctagtgccgcacgcgcaagggtgcaagaaagaagcatattagtttcactatttccggtatactctcgctatgaattttctcgcacatcttcatttggctgcattatcggaaagttccttactaggcaatttaatggcggattttgtccgtggctctccaaaaggattattcagccccgatattgtagaaggtattcgcctgcaccgtaggatagacagcctaacggacagccatccattggttaccgaagcacgcacactgtttcgtagcgagtatcgacgcgtagcttccattacccttgatatcatctgggatcatttcctttctctgcattgggacaaacttgaaaaaaattactccctgcctgaatttgtacatcttgcccgtagtcagatagaaccgcatcttaccgtcacgcctgaaaaatttcaggagttgaacaaatatctctggtcagaaaatctacttatccgctatgccgatatgtcatgcattgccaatgtactgaaaggcatggctcacagacgccctaaattatcggcactggcaggatcgtatcaagatatcgaaatgcattatcttgattttgaagcgctattttggaaattctatccacacatgatggcactggcgacaaataagcgactgcttgagcaagatatttcgccagaaccttgcactttttccaaatagctttatcttatctaggctaaaaggaattaaaagcaaattattgataggcaaaacctattatatcaattggtattttatcctttattgctttaccctaattccttatgctgtaacccgtttctacataccccctttttaaaatcacaggagtcaattatggttctagtaacccgccaagcccctgactttacagccgcagcggttctcggtaacggtgaaatcgttggtaatttcaacctgaaaaaacacctgaatggtcgtccagccgttatcttcttctggccaatggacttcacttttgtttgcccttctgagctgatcgcgtttgatcaccgttatgaagaattccaaaagcgcggtgttgaagtcatcggcatttctttcgactctgaattcgttcacaacgcatggcgtaaaaccccaatcagcgaaggtggcatcggcgaagtcaaatacccaatggttgctgacatcaaacgtgacatcatgaaatcttacggcattgagcacccagaagcgggtgttgccctgcgtggttctttcctgatcgacaaaaacggtgttgttcgtcatcaagtcgttaacgatctgccactgggccgtaacatcgatgaaatgctgcgtatggttgacgcactgcaattccacgaagagcacggcgaagtttgtcctgcacagtgggcaaaaggtcaggaaggtatgggtgcatcccctgaaggcgtcgcaaaatacctgaccaaaaacgctgacaaactgtaattcccgtcagagttgtctccattgatagcatcacgttattaatgaattcccctaaaccagccgctctgtcggctggtttttcttatctaaaatttctcattttattaccttgcgcacaaaaaattgcttttcaaaaatcctaaccgttagataatactgattacaaaaaattaacattgatatcacagctcacggagtcctactccaaccactcattcttaggagtaccatcatgttaaaagcatggaaaattccttttgtcgctgtatcgctcttagtttcctcctccctctatgccgcttatgaacctgccgttgaagccaaacaaggcgtggtagtcagttcacaatacttagcttcacaggttggcgtcgatattcttaaaatgggcggaaacgccattgatgccgcagttgccgttggttatgctcaggcagttgtcaacccctgctgtggcaacattggtggcggtggtttcatgaccattcatctggcaaacggcaaagatactttcattaacttccgtgaaacagcacctgctgcggccagcgccaatatgtatctggacaaagacgggaatgtcatcaaaggtgccagtctgtatggctataaatctattggcgtccccggcacagtgatgggattagatgccgcactgcacaaatacggctcaatgacccgcgaacaagtcatggcaccagctatcaaacttgcgcgtaaaggctacattttgactcgtggtgatactgatattctggacaccaccgtcaaacgctttactcaagatccagaggctgcccgtattttcttgcgcaaagatggtacacctttccaacccggggataagttagtccaaaccgatttggccaatacgctggaactgattgctaagaaagggccagatgtcttttatcatggcaaaattccccaattagttgaagagtcatcgaaaaaatcggggggaattatcacagcagcagatttcgccaactataacatcacagaaacaacaccagtcacttgcagctatcgcggttataaattcatctcttccccaccacctagttctggcggcgtcaccctatgcgaaatactgaacattgttgaaggctatgatctcaaatccatgggattcaactccgcagcttatatccatacattgacagaagccatgcgccacgcctacatggacagaaatacctatctgggcgatcctgaatttattaaaaacccacttgatcggctgttaagtaaaagctacgcagaatctatcagaaaagagatcgaaccaaacaaagcgacaccttcaaaaaatgttcagccgggcgttggtccccatgaaaaaccagaaacgacccattactctgtcgtagataaagatggcaatgccgtatcaaccacttacacaatcaacgggcgttttggtgccgtcgtgatcgcaccgggaaccggctttttcctaaacgatgaaatggatgatttcacgaccaaaattggtgagaaaaacctgtatgggcttgttcagggagcgaccaattccatcgcccccggtaagcgcccactatcatcgatgagcccaacactcgtgactaaagataacaaaatctttctggtattgggttctccaggcggatcacggattatctccatcaccttacagactgccttgaatatccttgattttggcatgccaccgcaagaagctgtcaacagcccgcgcattcaccatcagtggctgcctaatgaagtctactatgaacagcgtggcctttcgaaagataccctgaatgtgctggaaaaaatggattacaaaatggtagaacagacaccttggggcgcggcggaactgatcatgattggattgccgggcgctgtcggtgtgtctcccaccaactcatcaggcaatgactcagcggtatcaggcgtggttcgtgaaggctatatctatggctccaacgatgtccggcgacctgctggtgcagccattggctactaaaaaagcagtgtaaaaggttgatataaacaaatcgatgtaaaaaacaagggtgagcagtttgatatgctcaccctttttacaggtctcaggctatcagccttgatcctgctgcactttatgctttgggactttgctttctcctacgatgagatcgtagagagcacacacaaccacagccactacagttggcaacagccatgccagcccttgctctgccaacggcagatgaattgtccatgccggcagtaagtgagacagatactcagacgatttggccgcatccaaaaccccaaacaacaggctaactaccatagcaggcgccagaatgcgagtgtaattattccaccagcgtattgtgaaactcaacaggatcagcacaatacaaggcggataaattgctgtcagtaccggaatagagaatttaatcaagtggtctaatccaagattagagaccaacatagagaaggttccgaggataaaaaccagcgcacgataagacaatgacaaataacggctgaaaaattcagcacaagcacaggtcaaaccaaccgcagttaccatgcaggcaacgaaaatcaacaccgcaaggaagaagctgccataaccaccaaagacattctgtacataagcatgcagaatcactgcaccattttcagccttcggcaccaatgtgccactactttctcccagcttgaacagagatagatatactagtaccaagcccaaccctgcaatcagacctgcccacatcgtatagcgagtcaatagtgaagaagattcaatacctctggagcgcgctgcattgacaataacaatgccgaacaccatcgcacccagtgtatccatcgttaaatagccattcacaaaaccatttgagaacggaatttctttataagtttgaatggcagggatgggatcacttgctggccacaacaccgcagcaattcctaaaatgcccagtgccagaattttgatcggagccagcacgcgcccaacactgtccagtaatttccccggatacagagaaaccaagatcaccagtgaaaaataaacgacactatagatgaacaacggaagtctgccagaacccattagcggagcaatcccgacctcaaaggaaacagttgcagttctaggtattgcaaataaagggccaacagccatatagcaaacagtagccagtatcaaacctgctgttttaccgataggggaacttagcgcttcaatcccgccaccgactttcgccaaagcaatcacagtgatgaccggtagaccaacagccgtaagcaaaaaacctagcgcagcgatccaaacattctcaccagcctgcaagccaaccatgggcggaaaaatgatgttccccgcgcctacgaacaaggcaaaagtcataaagcctaatgcccaaatatccttagatgataaacggtatgccataatgattgttaatatattgttgtcaaaagaattgcatgtgcaatagtcagtattgcaaatacttgaattttcactggcgaaaccggattctgatttgacaataagtgatcaacgtaataatcactggtaatcgggaaatacagaatgatagtggtaattacagctagaatcgccaacaactgcccacaagtaaaacttttatagcgccaaaaggcaagcatcaaaccaaaaagcagtacaatatactaaagtaatatttaaaagcagtcattcttattatctatcattgaatgcacactatatgatttgcactttttttgttcatattgatgaataaatcatttttctgtctgcatcgtttaccactaaattatcttaaacttattgttttttaattaaattcggtttggcagaaacaataagcccgggagccaataaaaaactgaatgtggaaccttttcccaccgtactcgaaacctcaagctgggtattgtaatgatgcagtgcatgtttcactatcgccagccccaacccgcttccccctgtttgccgcgaacgagcacggtcaacacgataaaagcgttcagtcaggcgcggtaaatgttcagcactgatccccaaaccattatcctgcactttaaaccctgctccctgagacgatttactccagctaacctcaatacgcgttcccggtggagtatgattgacagcgttataaaccagattcgacatggcgcttcgcagttgttcttcgttgccgaaaactttcaatttttcatcaatattaaacacgatatcctgctggttattcgccaatgccaacgcttcctgctgcaacagcaccaataagtcaggcacatcaaccacctcgttcatatccacttgcggcccggcttcaatcctggagagatgcaataattgcttcaccagaccgttcattctccgtacctgctcctgcatcgtactgagcaccttctgatttgccctatcgttcagttcctgctcctgcatcatctccagataaccttgcagtaccgtcagtggcgttcttaactcatggctgacattagcgaaaaaatcccggcgggcattttccaacaatcgtttttgcgtaatatcacgggcaaccatcaatagcagctcttctgaataaggcatcacccggaattccaccatacggccattattcaactcaatagataaaggacgggaaaaatgacctgccgtaacatagcgactaaaatctgggtaacgaagcaaattgaagatatgctgaccattatcctccggccagcggaagcctagcaaatgctgggcaagacgattacaccagaaaatattgccttccgtcgtcatcatcacaatcacatccggcaatgactcagcgccgctgcgaaagcgcttgatcaataatgccagttcccggcgccgcttacggttacgctgctgcaactgataaataccgtaaaagatcggctcccatccgccacgccccgctggaggtaacatactgcgatccagccataaccagtcagataatttcaataaattgtagccatgccataccagtgccagaaataacgcaataaccagcagccacggtaagtatccgataaagaaagacaaaatgaccgcaggcagacaaaaaagaacaagccccaataccaacttcttccaggataaacgttcaagcacgttattctctccggcatgaaaatagattattgccaatcagcaccaacgaaaaacagatgcattaataacgagtagaaaagcgataccctgtaccacgaaccgtctgcaccattctatcgtgcctccctacttccaacgctttgcgcaaacgccggatatgcacatcgacggtgcgatcttccacatagacattagtgccccacacataattgagcaattgctcacgactataaacacgctctggatgcgtcatgaaaaaatggagcagcttgaattccgttggccccatttccacattttgcccctggctggaaacacggtgggaggaagagtccagtatcagcccatccatattgataatatcttccgccgacatgggggaagtgcggcgcagaaccgctttgatacgggcaaccaattccttgggagagaaaggcttagtgatatagtcatcagctccgacatcaagaccacgaacgcgatcttcctcttctccacgagccgttaccatcatgacaggaatatctctggtgctgctatcacgcttcatctgcttaataagctgtattcctgaacctccgggaagcatccaatccaataacaccaaatcgggataaggctccgacaagcgcccgacagcaacatcatagtcttctgcttcaacggtctgatagccgttttgttccaacaccaaacaaaccatttcacgaatctggacttcatcttcaactaccaaaatgcgtttagccatggttaatcccattaatattattgaagtcagaaatattcactttaagtcattatgagtcaattttatgacaaatttatgaaaatcctatttctcaattctcaaactgcaatctattttgcatagaatttatgagtgctttgtcatatttcattatgattgcgaacccgctcgaaaattcgtgaacaaagtcagaatttcacacgacagacctcaaacactcattataattagcgcttgaaacagataagcaagactcttgggcaacggtaggaaaacatgcgaatcattcatacgtcggactggcatcttgggcaatatttctttaccaaaaatcgtgccgcagaacatcagcactttttgcagtggcttattgagcaaatcatacggcatcaggttgatgcattggttattgccggcgatatttttgatactggctctcctcccagctatgcccgtgagctttataaccagttcgttgtggagctacagcccactggctgccagcttgtcattcttggcggaaaccatgattccgtcgccacgctcaatgaatcaaaatcgctattctcttgtctgaatacgacagtaatagccagcgcaggcaccgacatccagcagcagataaaagtattgaatcaccaaaatggcgaagcgggagccattctctgtgccattccttacctgcgtccacgggatatcatgaccagccaggccggtcagtcagccacgcaaaaacagcaggcattgcagaatgccattactgaacactatcaccaactttatcagcaagccgatacattacgggaacaactcggccagccattgccgattattgcaaccggacacctgaccacagtgggcgcttctacctcggattctgttcgagatatttacattggtacgttggacgcattccccgcacaagcgttcccacctgctgactatattgcattagggcatatccatcgcccacagatcatcgctaaatcagaccatatccgttacagcggctccccgatccccctgagttttgatgaagtcgggcaagaaaaaagcgtctgtctggttgattttaaagaagacaaatttgataacgtcactcttttgcccatcccaaactatcaaccaatgcagttgatccgtggaaatctgcaacaaattgaggctcaattgcagacattcaaaacatatcaaggagaacgtcctgtctggctggatattgaagtcgcgactcaagattacctgcctgatatccaaaaacgcattcaaaccatgactgcgaatctgcccgttgaaatcattctattacggcgcagaaaggcggcacgccaaatctccctgtctgaaacaaataaagagacgctcaatgaactcagcgtacatgaagtcttcgagcggcggctggcactggctgaaattgaagatcagcctcagaagcaacgcctgacaaccctgtttaagcaaacgctggatgatatttctcagcaataatattgaggattcgcgcacatgaaaattcttagcttacggctgaaaaatatcaactccctgcaaggtgaatggaaaattgattttacggcagagccttttgccagcaatgggttattcgccatcacaggcccaacaggtgcaggaaaaaccaccttactggatgccatctgccttgccctttaccacgaaacaccacggctcggtactatttctgctacccagaatgagttgataactcgtcatactgcggagtgcttggcagaagtggaattcgaagtcaaaggcgtagcttatcgtgcattctggagccagcaccgcgcccgtaaccaagctgatggcaaactccaacctccaaaaggcgaattggtggacaaaaaaacgggcaagattttagccgataagatccctgataaaaaagaaaagatcgctgaaataaccggacttgatttcaaacgttttaccaaatccatacttctgtcacagggtgattttgccgcatttttaaatgcagatgataaagatcgggctgatttgctggaagaactgacggggacagaaatttacggcattctgtctcaggaaatttatcaacgtcataaacaagcccaaactgaactgaatattcagcaggccaccgcttccggcattgagttattaaccccagagcaaatagaaaaataccagaacgaacagcagcaacttattgcgacagaaactcaactcagccaacagattaaggcttttcaatctgccgaacagtggctcacccggcaagatgagttacaacaatcaataaccagcagcactgcacttttacaacagactgagcgaaccatacaagacgctcaacctcaattacaacaacttgccgccagcgaacccgcagaaaaaatccgttcactatgggatacgcaaaaccgagcctttagcgaaaaacaacgagttactgaacagcgtataaaaatagaacatgatcgccagcaacaactttctttgttacagccagttcaacaacagcttaccgatttggaaaaaacgcagggagaacaccagcagaagcaagtccaacaggaaaaactcatcacagagcagattatgccactcgatcacaagattgatactcaatcaaaagatctgcttaccctagagaaggaaataaccgggcaaaaccgtgagctggcagaaatttccacccaataccaagtagcacaaaatcgcaaagatacgctgcataatgaacaaaaaacgctggaaacatactacgatcagcacccttattgccgtaatttagacagcaaactccctgagtggaaacagctattttcacgtcaaaaagagaagcaaatacagatagccaaatttacacaaaaaacacagcagattagcactgaattagctcgtataacccatcacttgagtacattaaatacagagttagccaaacagacagagcaaaaccagctactgcacgacaatctgatacttaccgaaaaacaactgactgatttgcagaaaagtcatccaccggaacaattgcaaaaacagttatcaaactatcagcaacaactgaaatcacagaatcaacttgagatattattgcctcagatccggcaattacagaccacaatctcaatcaatcaaacccagtcagcacagtatcaggcattactggaacccttgccgatgcagatcagcgtactagatcaacagctaacggagaaacagcagcattatgaagatcttactgatcgaattcgtttggaacagcgaatcaccagcctggaacaggagcgttcacagttaaaagaaggcgaagcctgcccactgtgcggttccacacaacaccctttagtcgctgaataccagaacattgccctgtcacaatcagaagaacgcttaaaatctctacgtcatcaaatagagcagctacaaacaaaccgttctgccctacagcagaaacagcagattcaacagcaaaataatcaacaattacagcaaaatacggctcaattaaccgagaaactgacagaaacaacgcaacagtggaagcaccactgccaacagttacaagccgctgaattaccgatggaaacggaacccgtgaacaatttcattggtcaacggcaatctgccgctcaacagcatcaaagacaatacgaagcattattacaagcagaaaaagcacaccaagcggcggaaaaagcgctatcggccaaccgtgaacagcacaaagcatctgaacaaactattgagctggaaaaggtcaaattggattcacaccaaaaacaactggcagaaaatacggcggatcttcgacagtcagaaactgaatacacaaccacgacagagctattagtcagcgatttacaacatacgccttttgctctgccctctctgcaagaagtcacaatctggctgcaacaacgcgaaactgagttaaaaacctaccatgattcacgcgaaagatggcaacagttgcagcaagaacaagcggctctgcaaagtcaatcgaatgaattagagaagcaaaaaaccaagctgacagtccaccttcatgccctgaacagaaaacagcagcagcaaaaacagttactggagcaaacaactcaggaacgtcatcacttatttggagaacaatccgttagcaccgttcgtcagacattacagcaaaaaactaatgagctgaacatcgcttgcaaacaggctacttcacacctgcaacagcgacaaagcgtgatgaatcaactcactggtgcagctagtgaaattgaaagaaacagcaataccgccgaaacacaatgcaaacttgccgccagcgctttccaaagcggattggaacaacagggatttgccgatcaatctgcctttgaacaggtcctgctggaacctgaacaacgggaaaagctgcaacaattgcaagagcagcttacacagcatcatttgcaagccaaaacacggcaccatgaatcagaaaccgccttacagcgacatactgaaacacagccccaattacttgaacaatatgaaccgacgcaagtatccgtgatattagctaacattagtgaagaattgaaacataacaatcaacagcaaggtgaagtcaaaaccatactgaacagtgatgctatgcgtcggcagaaacaacaaacactcctggcacaaatttcccacttacaacaaaactacgatgactggagttacctcaataacctgattggttccgcagacggtgctaaattccgccgctttgctcaaggattaactctggatcacttaatccatctggcgaatattcgactggaaaaattacatgggcgctacgatttgcaacgcaaagatgatggagggctggaattgcaaatcgtcgatacttggcaagcagatgccgttcgggataccaaaaccctctctggtggcgaaagcttcctcgtcagcttagcactcgcactggcgctgtctgatctcgtgagtaacaagacccagatagaatccctattccttgatgaaggctttggtactcttgatccggaaacccttaatatcgctctggatgctttggatcacttgaatgcgtcgggaaaaacaattggggtcatcagccatgttgaagcaatgaaagaacgtattcctgttcagatcaaagtagaaaaagtaaatggcttgggggttagtagactggcatcagaatttcgggtttaaacgctaatcgtttaaggcttggtgaatcatccatacccaatggatttcgagttgcagcgcgatggtgagtgtataaattcccaaaagcatagataacgatgtgattggaaaaaataagcatggccagcaaagctgcaacttgaagtatgaaagatgaaagagcctgactgaacaggctcttaagttccaattagcttagtgctggataatataaagatcttttgtcgaaatataccccatgggattgacataaaacccaccaacataaggctttaccattttcgcattaacataataataaataggaataacaggtgaatctgtggtgatgacatctaatccttgttgataatacgatctatcattagtctctcctgctttttttattaaagcatcgtaattatcattttcatatagtgaagtatttttaatttgccctgacataaacatacttaaaaatgtcatagggctattataatcggcaatccatgctcttctgataacatcgaatttaccttgatgcatattatcaagcatcactttccattcttgattctgcaaagtcgcatcaacaccaaggttttttttccacatggagctaaccgcaatggcaattttcttatgcgcttctgaggtgttataaagtaagttaaatctgagcggattactctgattaaatccggcctcattcaataatgttttagctttttcaattcgctgagcctgagtccatgaagcataatcaggttctgtaaatttaaaccctccaacattgggaggaacaatcgtataagccggcttctgcccttgacccaatatcttattagcaatcacttctctatctacagctaaattcagtgcctgcctcaccttcatattatcaaacggtggttttttattattaatttcgtaaaaataaacgcctgtttgaggagatatatagatttgatcgttgattgttttcttgagtgattcaaaagaatccaatggaatagtttcggtaaaatcaacttctcctgctaaatagcgattcaaagcagctttttctgaacctataacaagataagtcactttattaatcaccgtatttttatcatcccaataatgggaatttctgataccgatgattttttcattcaccatccattcagacaatttaaatggcccgctaccgacaaaagactccggccttgtccatttattgccatattttttaatcactttttcattgagcggaaccataacaggatgggtcaatatctgtaaaaaatcccccatcggtttatccagactgacttctaacgtcatatcatccaatgcttttactccaagctcctcacctttcttcttgcctctgagcacatcatttgcatttacaatagccgcattctcaagataactaccgtaaggagaaacaatatcgggatcaaccaggcgccgccaactaaacacgatatcattagcagtgattggtgtgccatctgaccatttaatatctttcctaagatggaaaacccatattttgttatcacgggtttcccaacgctctgccaatttcggctctatattaccttttctgtcggtataaactaacccatcaaaaaaatcatgaatgatattgaattcaacattacttgaaactttgtgtacatctaatgaagcaggttctgaagcatggttacgcacaacctcctgcttagaggccaattttataccatcaggaacaaccgcagcatgggacaatgcaatatttcccaacatcatcgcaatagcacaagaaagtatttttatctttttatttattgtgattttattcatattttattctccataatcgtatttatttttacatttatcttaaatccttcgtggcaaaatatttactatcatttaatacttaatgatataaaggtcttttgtcgagacataacctcttggatcaatataaactccacccaaataaggttttaccattttcgcattgacatagtaataaatagtaataactggcgagtcgtcagtgaaaatatctacagcctgttgataataatcttttttattcgtctcccctgcttttaaaaccagtttgtcgaaattttgattagaatattttgatgaattttgcgtgctatcagacataaaaatatttaaaaaactcatcgggctgttgtaatcgccaatccatccatatctggcaacatcaaacttcccttgatatttattatccaacataactttccattcttgattctgcaatactgcatcgacaccaagattctttttccacatagagctgaccgcaatggcaattttcttatgcgcttctgaggtgttataaagtaagttaaatctgagcggattattttgattaaatccggcctcattcaacaatgatttggctttttcaatccgctgtttttgtgtccaggatgcataatcaggctgttggaaatcaaagccaccggttttcggtggaaggagtgtataagcaggtctttggccttgtcccaagactttattggcgataatgtcccgatccacggccagactcagtgcctgcctgactctaacatcattgaaggggggcttttgtgtattaaattcataataatagacgcccagccttggagaaatataaatttgttcacctgagtttttctttaatgatgtaaaggattccaatggaatagtcagagtgatatcaatttctcctgcgaaataacgatttagatctgctttatctgaagagagaggaagataagttactttattaataaccgtgtttttatcatcccaatattgaggattcctgacaccgatgactttttcattaacgacccattctgacaatttaaatggcccgctaccgacaaaatactcaggttttgtccatttatcgccatattttttaattgttttttcactaacaatcaccataatcgggtgagccagcatctgtaaaaagtcgcctactggcctgtctaacttcacttccagcgtaaaatcatccagcgcttttatacccaaatcttccgcaggcttcttacctgtaagtatatcattcgcgttaactacattggcattaaccagataactgccataaggagaacccattttaggattaagcaggcgctgccagctaaataccacatcataagcagtaatagatgagccatcagaccatttagcaccttttcttaaatgaaaaatccaagtttgattatctttcgtctcccaacttgtcgccaattttggtatgatgtcacctttattattggtgtaaaccaaaccatcaaaaaaatcatgaataatattaaattcaatatcgctttcgactttatgtacatccagagatgcaggttctgaaccattattacgcacaatttcctgtttatcagccagttgcgtacccggtgggacaacagcggcatgagacaaaactatacttcccataataatagagatggagcaggataataatttaatcgcttttttcgttattaactctattttattttttttcatattattcaccataattatatttatctagtaagtagcctgcggcaacaagctactcattgttgtctaatgtttaataatatacagatcttttgtggaaatataatccattggattaatgtaaagcccacctacatacggttttaccaatttattactaacgtaatagtagataggaatgattggcatatcattggtgaaaatattcatggctttttgataatagattatatcattggtttcacctgctttaatcaccatctgatcaaaatcgctattttcatataagggtacgttatgactacttcctgtgatgaacgtatccaagaaagacatagggctattataatccgcagtccatgcgtatctgacaacatcaaacttgttttgatgcatattatccaacatcaccttccattcttgattttgcaagttggcttgaacaccaagatgttttttccacattgaagtaacggctatagcaattttcttatgcgcttctcttgtattataaagcaggttaaattgcagtggattatcttgattaaagcccgcttcattcaataatgctctggcttttttaatacgttgttcttgtgtccaagaggcagcttcaggtggtattaaattgaatccccccgtatttggcggaataatatcataggcaggtcgttgaccctgtcccaatactttattagcaataacgtctctatctacggctaaacttaatgcctgcctcaccctaacatcatcaaatggcggttttttagtattgaagacgtaatagtaagtactcaacatgggagcaatatgaacctgatcgcccaattttttctttaatgacgcaaaagaatccaatgcagtagactgggtgatatcaatttcgtctgcgagatagcggtttaaatctgctttttctgatacaagagaaagataagttactttattgattacggtgttcttatcatcccagtactgagggtttctgacaccaaccacgttttcattcactttccattcagacagtttaaaagcgccactagaaacaaaaacgtctggctgcatccatttatcaccatattttttaacggctttttcactgataggcaccaaaatcgggtgggtcaacatctgcaataaataagcgacaggcttctctaatttgacttccaaggttaaatcatccgtcgcttttacacccagttcttgttttttcttcttgcctgacagtatatcgtttgcattgaccacaaaagcggagccgaggtaactgctataaggagatcctatctctggatcaagtaagcgttgccagctaaaaaccacatcgtgagccgtaatcggtgaaccatcagaccatttgctgccttttctgatatggaagatccaaatctggttatccttcgtttcccagctttccgctaatctgggcacaatattgcctgtgctatcggtgtaaaccaaaccatcaaaaaaatcatggataatattcaactcaacattactttcaactttatgcacatccaaagaggcaggaaatgaaccattattacgcacaatttcctgtttatcggctaactgggttccgggcggaactactgctgcatgagattgtgcgatatttgccaatataatcgctatagagcaggtgagtattttggttgttttattttttataaacttagctatgatatttttcatttttaccatctccattattgtcattattttttattacatcacattaccatttcgttgtaattacgaattaaattaatctattcatgtaataagatcctgtttaaacagactcttattttcgatacaatctagtgtttaataatatacagatcttttgttggaatatcccctaacgggctaatatgaaccccgccaacataaggttttactaatttagtgcgaacataataataaacaggaatagcaggtgaatcttgagtgaggatatcaagtgtccgctgataatatattttgttgttagtttcatccgcctttaatacccattgatcaaattctttattactatattgcggtatgttattggtatttcctgtggtaaaaatatctaaaaaagatgtcgggctattataatccgcattccatgcgtatctgacaacctcaaaatttccttgagacatggtatcgtacagtgatttgctttcttgattttgtaaaacaacttcaacaccgaggttctttttccacatcgaactggctgcaatggcaatttttttatggccatctgaagtgttatacaacaaggtaaatttgagcgggttattttcattaaaaccggcttcattcagtaacgctttggcttttgcaacacgctgttcttgcgtccatgaggcataatcaggatgttttaaataaattcccccgctacctggataaaccacatcgaaagcgggtttttgcccattccccaataccttgtcagtaataatggctctgtccaacgctaaagtcagtgcttgcctgacccgaacatcattaaatggcggtttttgcgtattaaaaagataataataaacactcattatgggcgaaatatggaattgatcgccaaacttctttttgagtgttggaaagaaatccgatgggccaccgttggatatatcaagctctcctgccatataacgattgagatcagctttatagtctgacaatggcagataagtgactttgttaatcaccgtgtgcttatcatcccaatagtaaggatttctgacacccacaattttttcattcactatccattcagagagtttaaaaggcccgttgctgacaaaaaattcgggttgtgtccatttattaccatattttttgacaaccttttcactaatgggagacattgccggatgcgctaccatttgcaataaatccgcttttggcctttccaaagtgacttctatggttgcatcatccagtgctttcacaccgagttcttcgggttttttcttgcccgataacacatcatatgcattcaccacagttgcctgaaccaaatagctaccataaggagaaatagtgtcaggcgtgaccattcgccgccaagagaaaaccacatcatgagcagtgatgggtgaaccatctgaccatttaataccttttcttaaatggaacacccacgttttattatcgttggtttcccaacgttcagctaaggcaggaataattttatcttttttatcgatagccaccatccgttcaaaaaaatcacgcagaatatcaaattcactgctgctgtcggatttatgagggtctaaagagacgggttctgaaaaattattacgcgtgatttcttgtttatcggccaattgtgtaccagaaggaataacggctgcataagagtaagttacacttcctagtataagactcacaatacaggttaatactttagcaattttattttttattaagctcaccataaaattctgcatattgatattctccataggtattttgattattattaataaatattacatatatcactgttaccttaatgatcatgactattacagttaatgccttcgtgtaattcgcctgtttaatttacctaaactccgtcaaagctgtttacacgtaacgtaaaaagcaacgccagataagtagcgttgctcttaattatcagaatcagcacgatacttacagtatctttgatttgcctgttttacctacagtaattttctttatctcttactgaggtcacattattttctatttatatcaacgatgcgatcctgttttggataaataatcggagactttttagcgaagtagttaacgacagcctctatatcagggacgctgtaaacaggatcggttccctctttaaatacagagaaattactgcctcccgttgccagatattcattggccgccacgcgatatttcgcttttaagtcaacgggcttaccattgattttcattgagctgaccatgacacgttctcccacgggttttgagctatcccatgcgtattcaaaactgtgagatatcgccagaatttgtggccgtgaacgatcccactgctgttccagcagacgtttgatctgctcgccagtcaatgttttggtcaccagcatattcgagaacggctgaacggtataaattgcattgtacgtcacatcgccggcgtccatcggggcgcggataccaccgccattcacaaacgcaagttgcgctccgcccgccttttttggcgcggtggtaaataagtgagcgtcagcaatcactttacccaacgaggattctccaccatgggttgtctgttgagtcaaattgctttccagtttgccaatcacgcggtttgccagcggagtggcaattttttcataggcagccaacaaattggtaatttgcggatctttggcatatttacgattatcaacccagatgtttttcgccttgaaatcaaccacatctttggtggttttatccaatttcagatccaatctggtgatcaacgcgccattggattcggcagaagtaacggatttaccattaatcacgcagttatacgcctgatgagtatgaccgctgatgacgaaatccacttctttatccaaatgattgacgatatccagcactttgcctgtcacgtcattacaggcgttaacgtcaatccggccaccttcacgtttttgagccgctccttcatggatcaaaacaccaatcgcttttacgccttttttctgtaattccggcaccaacgcgttgatagttttgacttcattggcaaaactcagcccttctgtgccctgcggggtgacgatggctggcgtgccttccagcgtcaagccaataaaggccacaggaattccgtcaaattctttgatcacatattcagggaatagggttttgcccgtcttatcgacggtgacgttagcggacaaatactggaattcagcgcccttgaatggcgttggcccctgacagccggttactgggtggcaaccgccattttgtttacgcagcaactcatccttacccttatcaaattcatggttgcccacggaagtcgcttccaacccagcaagggacagggcttcaatgctcggctcatcatggaacatggaagagagcagcgggctggcgcctatcatgtcacccgcagcaaccacgatattattcggattctcttgcttcagttctttcagtagtgttgccatatgttcgataccccccggctgatttgggccgggtgctttcagggcgccatgaaagtcattcaaggccagtactcgaacatcgactctatttgctgtgtcatcagcgggtttagttgcacatcccgccgccgtcaatgccagaacgataggcaatagtttaaaaaaacgcataataagaaatcctttatcaatgaaacaatcagcctgccccacagggcaggctccagtcagatcagggtttatttcttctctgtcagatcaatttgatagatagcaaaaccaacatcatcatttttcaggtatttcacaggatattgagcgtgcgatttgatgaatattgcggctttctcggttggagacgtttcaaagcgcacatccagttttttatccgtcttgatcggcaggaatgaccagttgttttcagcctgcgttgatactatgcccttctctttggtgattcgggaaatgtaggaggccagaatagtacggttttcatcaggtgaagcgaaggcgatgtggttatcacccgtaccagcaaatttaccgccgtaaccacggtagttattggttgcaatcaagaaagttgctttcggatcaatgggtttaccctgataggttacctctttgattcgattcgcctctttgttgatcaactgacattcaacgtcatattttgcgggctgagtcaggtcaatcttataatcaacgccactgatggtatcgaagttataggtacggaagccatcccagttcagtaaattttgcggtttggcagagtttggatcaatctggttatatattcccgctgaacattccagccactgaacgacgtcagcgccgctcgctttcactaccaccagagtattcgggtagagatacaggtcggcagcgttacggaaagtcagatcccctttttccacttcgacaaaatcagccggcgcatttttgcgtccacccactttaaatggcgctgcggcagctaataccggcagatcggccagatcaggatctccctgaatgaaacgcttggtgtaatcaatctgggcatcattgacgatctgaacggtcggatcgctctggatcagagccagatagctatacatattcgcagaggctttaccgataagtttgccaacgaacttacgggttccttcattctctttctcaataatggcagccagtttgttatcccgctcaacccgcgcttttttgtgggctttgtcgtaaattgggcgcgcttccgccttagctgattccgttttccattcgccgctgtcgttattgatcaccagatcaacaacgcccaagtgatctccccactgacccggcattacggcaggaatgccattgaccgttccattggcaacatcgacgcccttgatgccagcatattccttactcgggaagacaccgtgggcatgaccgaacatgatggcgttaataccggaaacttcactcaaatagtaaacagagttttccgccatcgctttgtaaggctcttgggaaaagccagaatgtgggatggcgacaaccaagtctgccccttcttttttcatttgagggacgaattttttcgcagtctcggtgatatcgttgaccaccactttgccatccagatttgctttatcccaaatactgatttgaggtggcacaaagccgatatagccgatcttaatggtgtgttctttgccttcacgatctttgactggggtatcaacaataatgtaaggcgtaaagtagtttttgcctgtcttggcatccatgatattggcattaatataagggaatttggcacctgcgatggcctgtttcaggtaatccagaccaaagttgaattcgtggttaccaaagttacctacggtatagcccatggtattcatcagtttgtgggcaggatggacatcaccttttttaaggccttttgccgccatgtaatctgccagcggactgccttgaatcaggtcaccgttatcaaccagaaccgcgttggttgcttcagctttggctgctttgattaagttcgcggtacgaaccaaaccaaactgctcagtaggtttatctttaaagtaatcgaaatcaatcagattgctgtgaatatccgatgtttccataacgcgtaaatcgactgttgcagcattcacattgaatgccaccagcattgccaatgttgaaatcttcaacacattcttcatcatgtaccccctctattgaatgatgtggaagagccgatcaattggctcttcccataacattttgtctagaaatacaaacgtgcccctgtttccaaaatggtttgttttttatctttgtaaaccggattatcactgcgggcatcatcatatgccatttcaacaaacaggcgcaggttattgtacttagaaacggcaaagcgtttatctacaccaaccgcataagtctgtttttgatagttaaatgtattggtatccccatcccgtaggtaataacccgcatacattccgctttcgattttatcccagtgccatttcacacccagaccatacaggtttgctttccaatcgcctttcacggagttcgacttgagtgcctctgccccgccttgtttataaatcaggcctgaatttttggagcgcgctataccgtagtccagaccaatcgagaattcacaccctgggaagtaatactccatgccgaaagccaagaggctatcttggggcgatttcgccgaatctccttgcgattcccctgttgccgcagaatagccgccatcaaattccagaccaaagtctgatttataaaaaccaacgacagaataggcatggcgaatatctccaggcttgcgctccttatcagaaccggatttaccactataggtcgctgcgaccttgaagccctcataacgattggtttcgacaaaaatggtctgtggcagacgggtcatgaagttgtttctaccaacaccgtttttctcattacctgtagcgcgtcccaatacatcgctgaaataaaatgcacccgtgttgccatagccatagctggattttttcacccaatcgataggaatataagttcggccaaattggatctggccataatcccgatgagaaaaaccgagataaccgacacggttaaacatatcaaagccagtttcaaagttatcactattggttttctgggtatcagaaccccactccattttgccaaaggctttaatagccctggtgagttcgtggctgccagagataccaatacggctgccatcatcacgcattctgatatcacgatcctgactggttacctgtgcttttagacggaactgtccactcagctccatctgagttcctttgtcattgtatacagtggcggaattagcactgccagaaataactaataaacccattaaagcggctaacggtttcatacttttcataataagacacccacaaaatattaagtttaataatttggttttctttcaggtaaaacgtacccctatcgcgagacgtgccgcaatatatttgggacaataaatctccgtcacgattttttcgtgaaaaaagaaaatcgcttaaaaaatgacaatgctttaatgttctttaaatttatttatattacatctttcctttgaatgttttataaacaccgctctagagtcattaatcaaaataaggcgcaatagcaatcaatttgcttttaagcaaaaaaattattgaatgtttaaattttcagttccatgacacattgaatccattttattacatactttaataataacttaaaaaaatcatttttttcgtgaagaaatccacattaacacaaatatatgtacaaaaaattacatagatatgtgattgatatcacaaaaaataattattttccatttttacctttaaactgcatcatagcaatccacaaaaacattttttatcaactgacataaataaagacttttatttactccatctcataggtattgttattcgtaaatttaatatatctatattttttacaacttaaataattaataaagttaaagtctaataagagaatcaatgattaaataaatatttttccattatcataagaatatacgttataagtaacttgaatgggttaatttatggtttcaaaaattatccgtaacataaaaataaaatttaaatatataaataagttttcaaaatgctagatcactttcttactcctcgcaccgcgaggagtaagagggcttcaagcgctaaatacattactattatgaaaaggcatttatttaaaaaattaattttagctatatataatgaaagctcaaaatcggttcggcggtacaggatgcatggggtattttacgggtttaataattaatttaatgaatgaaatacgattttttgtgatttaggacgagtcttaagacaagattaaagaggcaacactggaaggtgagtttcccggttatcctgatagaaaagcacagtggattgatgaaggggatatatgacctgatatcgatagcgacatgtttaattcatgccgctatctgtgttaattaccagagtacgtagttatttatgaggccacagccaagcggcacctcgtaccccactggagtcaccatgcagtgcttttttgatcggcgttgcgcactccccaccaaaaacccactcttgaactaaaccgggtaaggtctggtaaaggcgatcgacgttactcatgcctcctcccagcacaatgacatcaggatcaagtaaattaatgacttgtgccaacgcccgtgccagacgtctttcataacggcgtatagccaattcagctatctcatccccctgtaccagcgcttccatgatttcatgacctttcttacgaaccccacttaagcggaagtaatccgtcatgaatcccgttcccgacacaaacatttcggtacaacccggtttaccacagaaacaacggacttcttcttgatatgcccgatcttcctcgtccatccacggtaacgggttatgtccccattcccctgccagaccatttcctcccgcatgtatcttgccatcaaaggcaatgcctgaaccacagcccgttccaataatgacagcaaacaccattggcttacccgctgcggctccatctgtcgcttccgacactgccagacagtttgcatcgttggcgacccgcacttcacgccccagcaaggcagaaagatccttatccaggatctgcccgttcatccagactgaattagcattttttacttttccggtaaaaggagaaatggctccggggatgccaatacccaccgttccccgctggccggttacctgttcagcatcggcaatcagcccggcaatcgctgccagtgtttgctgataatcgttgcggggcgtatccacccgtttgcgaaacaatgcctcaccctgatcgcccaaggcgatcacttcaatcttggttccaccgagatcaatacctatacgcatagcttacctttttctatttctattgttttctatcgttatttagagctgattaaattatgttactgcataatcattgcctgagccgcactgacaatcaagcgttatagccactctttatgctctgaaattgatgaagttctagggcttcgtcacatgattcgttattatgcccccttacgttttaagatgttctttgtcacgatgcgcaaaaatatggggtagctgcatgttatggttcaaaaatttaatgatttaccgtttaaaccgagaaatatcactttctgcggatgaactggaaaaacagttaagctcattggcgttcaccccatgcggtagtcaagatatgatgaagacaggctgggttcctccgatgggcgctcacggtgaagcgctgactcatgccacaggtaatcagatcctcatctgtgcgcgcaaagaagaaaaaatgctgccttctccggtgataaaacaggaactacaggccaaaattgcccgtctggaaggtgagcagcaccgtaaactgaaaaaaacagaaaaagactcactgaaagatgaagtgatccacacgctgctgccaagggcgttcagccgtttcaatcagacgtatatctggatagataccgtcaacaatctgatcattgttgacgcagccagtgcaaagcgcgctgaagataatctggcattactgagaaaaacgctgggatcactgcccgtcgttcccctgacattcaccgatcctattgaattgaccttaaccgaatgggtacgttcaggcgatttgcccgccggttatgctttgatggatgaagctgagttaaaagccattctggaagaaggtggcgtgatccgctgtaaaaaacaggcattggtgtctgacgaaattgcgacacatattgaatctggcaaattcgtcactaaactggcattggattgggaagaacgtatccaattcatgctgtcagatgatggttctttcaaacgcatcaaattcagcgaaacactgcgtgatcaaaatgacgatatcgaccgtgaagatgttgctcaacgattcgacgcggattttatcttaatgacgggtgaattaagtgcacttatcaaaaacaccattgatgcgttaggcggtgaagcagaaaggtaattttttctgttttcccgtattcactgattatgtgaatacgggaaataacaaaatgataatcatgcagccagagattaaatctggctgataaaatcagaaccgataaactaaaccaacccccagaacattatccgtattgatgttcacttttttggtgaagtcattgtctttcatcaggttgatcttatattcagcataagtgcccatatttttgttgaaattatagaaggcaccgacagagacgtaattcactaaatcttcagagcttttagcagccagcacgttagtctcactgtctccagccaaatctttgcctttagaataaacataacctattgatggacgcagaccaaaatcaaactgatactgagcggtcagttcgatgttctgagttttatttgcgaacaaaacataattatcgagtttaccaaatcgggttaaattacggccttcaccatacatagctgccaggtaaacattgtttttgtcatatttcacagacatcagccatgcttcagtattgctccctttggcgacaaccttcgtttggtcagtcccatttttttgtgcggaagttcggttagagttgccatatgatgcagccatactgataccattaccgaaatcataggagctggaaagaccaaaaccatcaccattttgtctcaaaatatcatcacggccattaatggtgctgctgtcatttttagtctgatattgcagggcaaacttaagcccgtccaccaatccgaaaaagtcagtattacggtatgttaataaccctgtcgaacgccccatccagaaattatcggtcgcagctatggagtcaccaccaaagaatggcaattcatccgtccatgcgttggtgtcatataccacaccatagttacgcccataatccagtgagccgtacttgccgaatttcaacccggcgaaagccagacgtgttctgttattcttagcaccttcggtttcagacccgcttgcgcccatgttgtattcccaacgcccgaaccccgtcaactgatccgtaatctgggtttctcctttgatccccagacgagcgacagaattatcaccattctttttattccctgatttggcaaaatagtgctgaacatctgccttgccatataaatcaattttattaccgtctttattataaatttcagcggcatttactgtgccagcgatgaggagagccggaattaccattgctattgcgttgtgttttatcattatcataatcctcattaatattgttatttatttagccactaccaataaacacactttctaagaaaaactttctctgaaagaaaccatttaggtgggcagggttttacacattcttgttactcacaggttaaatttgtaacaagcaacgacgatactaagatccaaaataacgttttgctaacaaaaattaacaaaaaatgccatcctgtgaaggaaatcacatagcaggtataaattcaatcaccaagcagcattaattatgataataagttactaaaaacagtaagttagaaataataaagaaagtaacaaaaagtaatctctatcattaataaatctattttctcattgctaattacgatagattccgtagtaatcatctttgacatcattgacaactgactgtaagtcctgtaactggtgagatttgatttaagttcatttttatgtaaataagtaatgtttgtttttaataggatcacgccaataaagtacaaatattaacaattcataaggtgctaaaatggaaaaaaatatccacgcccacgaggtcgccccacaattcctgaacaagaaatacgccagaaaattcatgaggtcactctttctctcctttttacccaaggctatagtacgaccacgatggatgtggttgcccaaaaagccggtattgcaaaaaaaacactctatcgttttgtcaaaaatcgagaagacttgcttgagcaaattgtactgcgctggacagatagctgtacccctacttttgagaaagatgccagtagttttaaacaggcaatgaaattattagaaaaacatttgagagaaatagctcagaaattactgtctacagatgccgtggggttattcaaattactgcaatctaatttcccttttcgggaagtgctactagaaaaatatcaaaaaagtgtttttgaaagagacaaaataattttggccaattggctggagcgccaatatcaaaaagggttactgagaaaattgaattataatattatcagtgaattagtcctttcaatggtcattgcagaaccactcagacaaatggctctgggtatcacgccacctctgccagaaacagatattactcctcaccttgcagcagcaataacgttgcttgaactgagtttggtaaagaaataacgcttttttacttgttaatacaatcttatggcaataacaccattggcgctgaaatatcaatgctctcagcgcccatttcccagccaacctgcattttctgatgaaacggaatcaagcagacaagcgagcttccagccacgataaccattggtcaatcccttctcctgtggacgcagacagtgcaatcacgtcgatatcggggttaatgcagcgggcggcttgaatacaggcctccaattcaatattgagataaggcaggagatcgaccttgttgatgatcatcaattcagcttcagcaaacatcatcggatattttaacggcttatcttctccttcagtgacagacaacataacaattttatgctgctcgccaagatcaaaactggctgggcatactaaattcccgacattctcaataaataataaactgtgttcggccggcttcaattgccgggtagcttcacgaaccatttcggcatcaaggtaacatcccttccctgtattcacctggacggcctgaattcccacagctcgaatacggtcagcgtcatggctcgtctgctgatccccctcaatagcagcacaggcaactttatcccgtaatctattcagtgtggccatcagtagtgttgttttacctgagcctgggctagatatcagattcagcgccaaaatatggtggagggtaaagtaccggcggttgcactctgcaatgtgattattctggcttaatacatccagttcaatttgcagcatctgcttttggcaacggtcagatacaggcacatcaaattctggcatttgttcgttgccgtggtaatgatgatgtacatcaccattatggtgatagtagtggtggtggacgataataggctggctgctgttttgcggaatgtctgcatgaaattgtctgggtttcttatctgccaccgcggcataatccccactctgagaatcagttccctgctccggataagaatgagcaggttcgcccctttctccataaccatatatgctcatcactcagctcctactcaactttaatgaatatcggtatcacgatactgaaactaaaacgtatctttgtttctcattgagaaaaatctgctgattttcagccagacaccaaacactataaatacatccaatagcgctgattgatacgggggagattttttataaatcaccacatttataaaaaatcagatcaatgacaaacaaaaaacgtttcagtaataataaaaataagactagccgcaaattaacatgctgtctattcacattcatgataaataaaatgattatttcattatggcatcacatcaattacgttaagaaaaaatcattaatcaatatcagaaaaacaaaatagaaatcacccaatcaatatttaacattaatattatttgacatagtcaaagtaaaataaacaaaataaaaccaataatccttttaaattccaattccaatattaacaacaagaaataataactaaaattatttatataatttattaatgttatattttatataataaatattaaattaaataaattacttttccatttggtttatcaaaatagaaaaaccagattacgccactgaaaaattatcacctcagttccatttcatactcataggatttatttatttttctatgcggaaaaatctaatcagataggatattaacgaacagaatcattgttcatcttgagatcagaagaggaaacccatgaaattccccttgcgccatctactattgctcaccactttgacctgtagtttttcatcaatggctgtttcaacgaaaaatcttccccttatgccgtggccacaacagatttccgtgcaacaagggcgttttgatctcagcggacaactgaatatcgaaataaccggagatgacatgcaggatgccatatccctatggcgaggccggattgaagcccaaacaggttggatcttgccacccaataaccgtcttccttctatcagggcagtccattccgttgcctcttcgttccccaccatcaaaatcatcatcaccaataaaatgcccccgattccccaacccgacagcgatgaacgctaccaactgatcattgataaccgaggggctactctgcaagcagagagccgatttggtgccatgcgggggatggaaaccttactgcaattgctgcaaaacgatgccagaggcacttacctgccgttggtcaatattaccgataatccacgtttttcatggcggggcgtgatgctcgattcagctcgccattttttgcctgtagacgcgataaaacgtcagttggatggtatggcagcagccaaagtgaatgtctttcattggcatttaaccgatgatcaaggctggcgttttgcttctgactattaccctaaattgcaacagctcgccagcgatggcatgttttacagcaaaacccagatgcgtgatgtcgtcgctcatgccgcccgcttgggcatccgggttgtacctgaaattgacttccccggccacgcttctgccattgctgttgcctatccagaattaatcagcgctgacgggccttatcagatgcagcgccaatggggagtccacaaacccacacttgatccgagcaatccacaagttcatcagtttgccgatcgattaattgctgaagtcgccgacatcttccctgatccttatattcatattggtggtgatgaagtgaatgcctctcaatggcaggcttccaccaagatacaggcattcatgcaggaaaaaggcctgaaagatcctcatgccctacacgcatggttcaatcaagcgttggaaaagatccttgagaaacatggccgcaagatggtgggctgggatgaaatctatcatccggcactgcctcatatcatcgtcattcaatcatggcagggacaggattcgctggggaaaaccgcagatgatggctatcaggggatcttatccacgggattttatctcgaccaaccgcaaagtacggcatatcactaccgcaatgaaattttacctcaggtactccgtattgatgagcgcgtgaaaaaagaggaaacggcgcaaagctggtcattcaatatgccccgtttaaaaggcaacccgattacgggcagttttactttgattgaggatggccaaggtcaatggcgcggttttattgattttacggggaaatcgcgtcgtgccgtcaatgacattgtctggcaagggaacgtcgtcaggtttacgctggatagttggatgggagaaactacgccagtgatggatctcaatcaaaaacagaaaaccgcagacggctatattttggtgggcaatgtgcgctatccggtcacaggagaaaagctggacagtgttccaacgggtcaacttcctgtcgtgccagaaagtcgccatcagacaaatattctgggggctgaagctacgttgtggtcagagaacgtgaccgctgaagtactggacattaaactctggcctcgcacctttgccatcgccgagcgactttggtctgccaagaatatcaccgatgaaaagaacatgtaccaacgcttgcaggcgatagatacgtggacaaccgtttctgtcggtttgcagcagcaggcaaatagccagcggctgatgacccgtttgacaaacagtacggatattacaccattgcagattttggctgaggcggtggagccggctcagtattactcccgccatcatgccaaatttcaggccggtaattaccatcaatatgaacccatttaccgttttgccgatgcactggggccagaaagtcataccgtcagggaaatagatacgctgatcgatcgtctattggcgaataagcaagatcaacaagcagagcttgcattacgtgatcactgggttcgttggcagaataatcatgattctgtaatgaaaatcgtcaaatcgaattatatgatgcgtgatctggttccggttgccaacgatgtcagcgccatcgccgggcttggattactcatgctggatcacctgaaagcgggaaaaaccttgacgctcaaacagcggcaggatgcgcgaaatttgttagcacaaggcgcacagatgcgtgatgaagtaataatacgggcagtatatcctctagaaaaactgcttaattatctggatcgccaaactgattgattaagcaggtaaagagtaaagatcaaatctgttatgaaaaaggctgagaaaccctgttctcagccctgtttttaccgtctgatgaagaaatattttttatttcaacatcttttacttcaacatattgtattgcgatgccagattatcaagaaaatccaattggctgttgatcaggctggttagatctttctgattgatttggctgcccgataaatttcgtagttgattggcgaataaattccacgcttgttccagtttgaccgcttcagcgaggagaattgtgcgctcttcgtcgatttgtatcgtgtctgttatgccagaaagacgttgctctgtttcctgtaacgtggttttcagagtgtcagattctttggtcaactgatctatttgttcactgagtttaactcgagcgtcagctagctccgcatatttcagcccttcggagactttgcccagtatttttctggctatctccacaccttgtttaatcgcctgtttgatggcttcttttttaggctgggtgaaatccaatttatcgatgtcattgccgctggggataaaatctttaaacatatccgcaatattattctggcggataacatcctgactttcgataattttagcccgatccgcatccagtttattttgttctgcggctttctgctcgatagcgctctgcaattcctttttttgtgattgagcttgcgccagaaggtctcccagccgctctgaaatcaccatattgcgaatgtcgttaattttgccagtcagttgattcgtttcatcacggaaattggaaataacatgatcgatatctttcgccaaattctgaatcaattgctcgcgttcttccagcagagcactgcgatcgtcatcattcagatcggggtctgccaaagcctcatcaatttcagtaatcgtttgaaaatattcttgcgtggccaactgtcttagagtgggttccaattgcgatagagaactgcgtacagcttcatcgaaatcacggcaataaagacttatccgcttggttttttcctcgataattgcaatacccgatgtttgtcgttgcgccagacgccagatattatttaccgcttgattcagggcttttatattgatttctggatacacgatttctttttgtgagatgatattttcagacattttacaattccttgttattttataagcaattctgagaggagattagctattgagctttttatattctgccaaggcttcatcgaaagttttaactaattgcgccgcagaaccttgaacttctttccaaggactaatcacttgtttaaatgctgtcacgaaagaggtgagtttcagtgcatcattaatttcggcaaacttatccttagaggtattaatttgagtcagcatgttgctccacataaagtccaggtggttcagagcaacttccgcatccagcatacggatatcaatgtcaccaaactgtaagaccaaattttgaatagacgtttgtaatgcgcttttacctttaacttgatcttgcaaaccgctgacttcatcaatcagtgcatttttccgtttacgggctttttccgctttgtcaccaaaaatgccgccggtaatagccagcccgataataccgcccggtgcaccggaaaatgataagccaacgtatttatcgtagtcttttttgagttgatcaatctcattatttttctcagtaattttcttattcaaatctttgatcgtgatagaaagattattatcttccatcagttttttcttattattgacctgtggctgtaatccatcagctttcttgccgtttgataacgtgccaccaatcagtgtgcgcttaaaatcagatactgctgttttgacctgttgagtttttacctgttgactctcaatatctttcgccatgctattgaggatattccccaattcgactgatatttctttatcgtcattggtataagttatttcagccaattgcttctctgttaaatctcccagcttcgtttttacacgttgaataatcggcatctcgttaataatgctgattatatcttctcccgttccggtaatttgttttcccgcactttccaggttgatactctgctgctgaacattctcttccacgccgctccagctaagtgcatggttatgaatttctttaaacaaatcggtaatatctgcgggtttcaatccagcgatatcaatatcattgtaaccgatataactctttacggtttccaaagtaaaagggagtgacaaactgtgtttaacatataatttaatactaataaggtcttctttagtaaagattccaccaggacgggctgcaccgtcgatttggctcgtcaataattttaaggtgatggcaggaagctctgctccatttatcgtactttctgctgaaaactgacttaatgacatatcgttctccattaatgatgattatttaaatgaaaatggtcaatatattaagataaaaacaaagcacaccaatatccataacaattaagttagtattgtttcttcatgagttaccttaattgagggttaatatacctttgtatttttccatctggaaataattttatttcaatgtgttattaaatgagtatttacgttgccgttaatgcgaaaaggcagtccttttatccacaaatatactttaatctggtagttttattttatttatctttattaagtaagcatatcaatataaataaaattagatttatttattattttcttaacaggaattattggtttattttattaacacacaatttttagtggttttaaatcatattatatacccatcgtaattgaagatacttgatttttcattcgtatcagatcaagatcgcgcccatgaaaattactctgacagatgcccaaaaagaagccctcgaattgatgcacgatacgactcgtgatgggcgcgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacagacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgtgtataaacagcaacactttattaagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaacaatatctatttctcggaggcaaaaacattccgtgaaacgctgcatcacttttttcatgtcacattgccagaaaaagcgaaagaactcaccacccggttgacagataatttccagactttaattcctgcatcttcaagttaattgcgtataataagggttataactcacaatttccatatagttaaagtgggtataatataggtaaggagtaaaataatacctcgatataaggatatagaataatttttccaataaagaattattcaattccatatttggtgttttcaacaaacctgcttttatataaagtctaatttaatttggtgaatgttaagggataaattattatttaatgattctctatttattataaaaatatcaccaatagtttattttaaatattaatttaataaccaataaatttttataatataaaagtcatgatgacttaatctgaattctgaattctgaataaaaaaattaaactgcccgatatcactattcgggcagtttaatttcattttcagataaggcgctaatgaaacttattgagcggcaacggtttccattcctaccaagccaactttgagatagcccgctttacgcagggaatccatcacactcatcaaggtttcataatccaccgtcttatccgcttggaagaaaatcgtggtttctttattggactgagttgtctgatccaatactgaagagagcttgtcacgctcaatcaactgctcaccgacatataactgatgatccgctttcacggtcagaaagaccggtttctctggtcgcggttgtggtttagctgacgatgccggtaaatttaccttaatatctaccgttgccaagggtgctgccaccatgaaaataatcagcagcaccaacatcacgtcaataaatggcgtgacgttaatctcatgcaattcaccgctatcgtccaaatcttcattaagacgtatcgccataattgattaccttgcttctgctttttctgctttgctgtcagccagatcaagatcacgacccagcaacaaaattgcctgtgccgccatatcccctacttgaccacggtatgacgaaataacacgggcaaaaacgttatagatgactaccgctgggattgctgccaccagacccagtgcggtcgccagcaatgcttctgcgatacctggagcaacaacggccaaattagtggtctgtgagtgggcgataccgatgaagctgttcataatcccccacactgtaccgaacaggccgacaaacggtgaaatggcaccaatggtcgccagatagccgttaccacgccccatatggcggctgattgcagcaaccgcacgctccatgcggaatgaagtacgttctttggtgcctgatttgtcagtgcttgcagcagacagagcgcgttcagactgagcttcactcaacaacagacggctgatactttgcttgccgaaatctgaagcaattttcgctgccacatccagattggctgcatcagccaatgcccattgttccttgcgtaaacggcgacgagcaattaaaagttcagtacctttggagaaaaagagcgcccatgtaatgacagaagcgatcaccaaccccaacatcacggtttttactaccgcatcggcattttgatacatgccccaaacggaaagatccgttgcaaaaccaccggacaggctttcagactcgtccacaggttcagtagatttcgtttcagtcgcgggttgagcatcagctttctgggcatcagttttcggttcacccgtttgctgtgcttcagtttttggaacatctacctgcggagcagtagaaagtgcgggtgctggtgttgccggtgcggctacctggacggctgcctgattttctggcgaaatcgctgttgtgacgggtactgtatcagcccatgctgaaccggttaatccgagtgctaatagaatagaagctgtcaaattacgcatcagttagccttactctctttcttgtgaattctgttacttagcaatgaattgcatttacgcatcttgctaatcctaatatgccctgaatcaggcttctcattacgaggggaaaaagtccgacgcaaatgatatcagacattgagcgatttgatagtaattatcattactatttaacaaaaaagtgataattaaaggaataatttcatcaaagtgttcttctgtttccatttcagatcaccttgaattttcgtcaagttgttcgaatctctttgcacaaactgccctaaatcttttaagttgctaatcattattcgaacaatcagcgaccggcagctaagggaaaatcatatgaccgaaaagaaactggagaccttattggtcagtgcaggcagaaagaaaaaatatacccaaggtgctgtcaatcccctcatccaacgcacttcatccatcattttcgacaccgtcgaagacctgaaacatgcgttgaaaaaccgggctaagggtgagttattctatggacgccgtggcacgctgactcatttcgcctttcaggaagcgatggcggagctggaaggcggcgcaggctgtgctctctatccttccggcgcggcagcgatcacccatgcgattctggcctttgtggcaacaggcgatcatgttctgctgacagggagtgcttatgaaccgacgcaagatttctgtaatcacattctcaaaaagatgggcatttccactgattattttgacccgatgatcggagaagggattgcatcactgattaagccaaacacaaccgtcgtctttcttgaatcccccggctccctcactatggaagtgcaggatattccggccattgtgcgcgctatccgccagatcaatcctgagattgtcattatcatcgataatacgtgggcggccggcattctctttaaggcgctggattttggcatcgatatttccatccaatcggccacaaaatatatcattggccattcagacggcatgctgggaacggctgtcgctaatgcacgctgctgggatcaactcagagaaagttcgtatctactgggtcaaattgccgatcccgatacggtttatacggcaacccgtggattgcgtacactggcaattcgcttaaaacatcatgaagagagcagcctgcacatcgccaaatggctcgcccagcggccagaagtcgccgaagtttatcaccccgctttgccttcttgtccggggcatcattatttccagcgtgatttcaccggcgccagcgggctattttccttcctgctgaaagtcgaactaacccctcaacaattcgctgagtatctggataatttacatcatttcaaaatggcattttcatggggcggatttgaatccttgattctgggtattcagcctgacatgctcactgcgctgcgtcgatacaatcccctcaaaaagacgggaacattattccgcgtgcatattgggttggaaaacccacaagacctgattgatgatctgtcagccggttttgcccgtattgcacctctttagccccaaaagaccgtactccagaaatctttacaaaaatcatggctgtctttctattgcagatagccacggttgatttcctctcttcataaactgaatcaaacccgatgctgaatcaaatcaactccccttccgcgtttttgcggtacactggttggcatgtatttttaatgactcgcagaaattacaggataaataatggaaaagttaagcgagatcatgcatgcactctggcaacatgattttacccaactcgccaatcccgaggtcatctggattatttatggtgtcctctttgtcactctggttctggaaaacggcttgctgccagccgcttttttgcccggcgataccctgttggtactttctggcgccctgattgccaaaggcgtcatgagcttcatccctacggttatattgctgaccatcgccgccagtctgggatgctggctgggttacttacaggggcgctggctcggccatacccgaattgtcaaaaactggcttgcccagcttcctgtgcaatatcgcgagcgtgcccacgtattatttgctaaacatggcttggccgctttgcttatcggacgctttttagcctttgtccgcactctcctgccaacatttgccggtatttctggtctaaatagtaaacgttttcaattttttaattggttaagtggcttcttatgggtcatgattatcgtgagttttggctatatcttgaatcagatccccttcgttaaagcacatcaggatctggtcatgaatattttgatgatcctgcctgtcattctgttgttcagcgggcttttcgcttctctgttgatgtactggcgtcacaaaaagacatcatcaaaaaaaagtaagtaaacatacttgtcgcttacctctatttaaaatactgtcgatatagccaaaaaatttacctatttcactaaccatatttcggttgtcagtcatcataaaactgatgataaacaatacattgcatcacgttttatttatcccgaagtcgttatactcgatccagaagtgacgtaacctaaaggagataaaaaatggatcagcagacaattattaagctcgttgatggcaatcttatgccacaattggggctaggcgtttggcaagcgagtaatgatcaggttgttaaagctgttcgcactgccctggaggttggctatcgttccattgatactgcggcgatttatcacaacgaaagcggagtcggaaaagcattaaaggaaatcgacatcccgcgtgaagaaattttcgtcaccactaagctctggaatgatcgccaccaagatgccaaagcagcattagaagaaagtttggataagctgcaacttgattacatcgatctctatttacttcactggcctgttcctcatcaggatcaatatgttgaagcctggaagcaacttattgaactgaaagaatctgggctggctcgtagtattggtgtatgtaattttcacattgaacacttacagaaattgatgtcagaaacgagcgtcgttcccgcaatcaaccaaatcgaattgcaccctctgatgcagcaaagacaactgcattcatggaatgcaactcaccatattacgactgaatcctggagcccattgtcacaaggtggaaaaggcgtctttgacaacccattggttcaacatctggccattaaatatcaaaaaacccctgcgcaaatcgtgattcgctggcaccttgactgcggcatgattgctattcccaaatctgtcacgccttcccgtatcaaagagaactttgatgtatttgatttcagattggaaaaagaagatttaacggctatggctgaattggatattggcaaacgcatggggccaaaccccgatacttatactggcgatcacgtcaaataatataaatacggataagattcacttgaataaatattccattgtttaatccatataaggcctgaactcgcaaaaatagagttcaggccatgcaaatgctcatccgcatctcacgaacaaaccgccattcaaacaccaaaaatcattagaaaaatcgatattataaataataactatgttgattatttatttatattgtctggtctaggcttatttcattgcttcaaataacattaatataagtgacatgcataaaaaatgcggccaccatgatagtaacctatattaatattcacaaggttaaacttaaataatatttaaggtaaatgataatgacttacatcataatttctttattaatgctgatcccttttttctttttggtgaaacggttcctattatcaaatcatgttcatcataatgtatctggcattattctgacggtagttgcgattgctattcatatgtatatctttcgcttcgatagagtcccgattgtcagcgtttccattcccaatatcgtcgcttacggctctatcgtgattgcactgttacatggcatgatctattccgtctgctttagactgtattttgacaagggatcttatgatgagcattcaaggagtgattaataaatcggcttccctactcgttggataatcaactttggggaagccatcttttcagcaggatactgtcaaagctgacggtattttatccggtaatttttgcgtgcatttcctgtacagaaatcacctgctcagtgggatctgcgctgagtgccatggtagtcgcaaaaccgccattcagggtggtgtcatagtgcactttatattgcagtgcgctacgacgcagcagttttgaatcttcaatggcctgacggcctgcggtggtattaacgatatagttatattcaccgtttttgattctatcctgaatatgcggacgtccttcatgaactttgttcaccagacgtggattgatccccgcttcacccaacacaatcgctgtaccgtgggtcgcatccagttcaaagccctgtttgagcagtttggcggccaaatcaacaacgcgcgctttatcttcttcacgtacagacaacagggcacggccgttcttgcccatcgtggagctgctgcccagcatcgctttggagaaggcttcagcgaaagtacggccaacacccataacttcacctgtagaacgcatttccggccccagaatggggtcaacaccaaggaatttattgaacggcagaaccacttctttcacagagtagtacggaggaatgatttccttagtgacgccctgtttcagcagagattgacccgccatcacccgtgcagccacttttgccaacggcagaccggtcgctttggaaacaaagggaacggtacgtgccgcacgcgggttcacttcaatcaggtacacttcgttatttttcactgcaaactgtacattcatcaagccacggacacgtaattcaaaggccagtttttcaacttgctggcgcatcacgtcctgaatttcttggctcaacgtgtaagctggcagtgaacacgctgagtcgccggagtggactcctgcctgttcgatatgctccatgatgccgccaatcaagacacgctcaccatcacagatagcatcaacatcgacttcaaccgcatcatcaaggaagcgatccagcaatacgggggcgtcattggatacgctgactgcattctggaagtaacggcgcaggtcagtttcgtcatagacgatttccatcgcacgtccacccagcacgtaggatgggcgaaccaccagcggatagccaagcccattacctttctcaaccgcctgttcgatggtggagacggtagcattcgcaggttgtttcaaaccgagacgattaacagcctgctggaaacgttcacggtcttctgcacggtcaatagcatccgggctggtgccgataatcggtacaccggctgcttccagctcacgcgccagtttcaacggcgtctggccgccatactggacgattacacctgttggtttttcaacacggacgatttccagcacgtcttccagtgtcacgggttcaaaatagaggcggtcggaagtgtcgtaatccgttgaaacggtttcgggattacagttcaccatgatggtttcgtaaccgtcttcacgcagtgccagtgacgcatgtacacaacagtaatcgaattcaatgccttgcccgatacggttcgggccgccacccaataccatgattttcggcttgtcatggttcggattggattcacattcgtcttcatacgtggagtacatgtaagcagtatcggtcgaaaattctgccgcacaagtatcaacacgtttataaaccggatacaggctgtaatcgtgacgtaatttgcggatctctttgccagatacaccgaccagtttcgccaaatgtgcatccgcaaagcctttgcgcttgagatgacgcaggaaatcaaacgtcaggccattaatgccctgttcttccacctgctcttccaaacgcaccagttcttcaatctgtaccaagaaccagcgatcaatgttagtcagattgaaaacgccatcaacagacatacccgcgcggaaagcatcggcaacataccagatgcgttcagcaccggcacttttcaattcgctgcggatcttggtcagtgactgtggatcatccagattgactttaggatcgaaccctgtcacgccaacttccagaccacgcagggctttttgcagagattcctgaaaagtacggccaatcgccatcacttcaccgacagatttcatttgggttgtcaggcggtcattgctgccaacaaatttttcaaagttgaaacgcgggatcttggtaacgacataatcgatagaaggctcgaaagatgccggtgtacggccgcccgtgatgtcattcattaattcatcaagggtataacccaccgccagttttgccgcgatttttgcgatcgggaagcccgtcgccttggaagccagcgcagatgaacgggatacgcgtgggttcatctcaatcacaatcaaacggccatttttcgggttcacggaaaattgaacgttcgagccaccagtttctacaccaatttcacgcaataccgccatcgaagcgttacgcatgatctgatactctttgtcagtcagtgtttgtgctggcgctacggtgatggagtcacccgtatggatacccattgggtcgaagttttcaatcgcacagatgatgatgcagttgtcatttttatcccgcaccacttccatttcatactctttccagccaatcagtgattcatcgatcaataattcgttggttggggagagatccagaccgcgctcacaaatttcttcaaattcttcacggttataagcaataccgccaccgcttccgcccatggtgaaagaaggacggatgatacaagggaagccaacgtcttctgccactgccagcgcttcttccatcgtgtgggcaataccagaacgcgcagtatccagaccgatttttttcatcgctttgtcaaaacgctgacgatcttctgctttatcaatcgcgtcagcggttgcaccaatcatggtcacgccaaattctgtcagtacgccctgacgttccagttccagtgcacagttcagggcagtttgcccgcccatagtaggcagaattgcgtctggacgctctttttcaatgattttgcgaaccacttcccaatggattggttcgatataggtcgcatctgccatttccggatcagtcatgatggtagcagggttggagttcaccagaatgacgcgatagccttcttcccgtaacgctttacaagcctgagcgccggagtagtcaaattcacaagcctggccgataacaatcggacccgcacctaagatcaggatacttttaatatcagtacgttttgccatttttcttctgctcctgattacttggtgttctgaacgtggttctgacgatgctgttcaatcaattcaatgaagtggtcgaacagggaagcggcttcatgtgggccagggcttgcttcaggatgcccctgaaaactgaatgcaggtttgtcagtgcgatggataccttgcagtgtgccatcaaatagtgacttatgagtcacacgaagattcgctggtaaagtgctttcatcaacggcgaaaccgtgattttgtgcggtgatcatgacgacattgttctccaagtccttaacaggatggttgccgccgtgatgaccaaatttcatttttaccgtttttgcaccactggccagcgccagtaactggtgccccaaacagataccaaatactgggatctcggtattcaggaaagcctggattgcttcaatggcataatcacaaggctctggatcgccggggccattagacaggaaaatgccatccggtgccattttcagcacttcatccgcaggtgtttgagcaggaacaacggttacgcgacagccacgatccaccaacatacgcaggatgttacgtttgacaccgaaatcataagccacaatgtggtacggcaattcttgctctttacgagcttccggtagcccgtctgccaatgtccagcttccctgtaaccacgaataagattgtgcggtggtcacttctttcgccagatccatgcctttcaagccggggaaagctttcgctttttccagagcaacctgagcatctgcctcattacccgcaatgatacagccgttctgagcacctttttcccgtaacaggcgggtcagcttgcgtgtatcaatatcagcaatggcaacaatgttgtggcgtttcaggtaatcagacagattttcttcactgcggaagttgctggtcactaaaggtaaatcgcgaatgaccaggccttgggcttgaatagcgggggattcttcatcagcggcattgatgccggtattaccaatatggggataagtaagagtaacaatttggcgggaataggaagggtcggtaagtatttcttgatatccggttattgaggtattgaagaccacttctccaacagccacaccctctgcaccaatggcgcgaccatgaaattgggttccatcttcgagaaccaatatagctaacttaatcaaaacgccctccagaatgaataacaagtcgcatccgatgcatattaatgcagaaataatccattgaatcaatgccaattgatgatttttgtcaaaattttggcaaattgcgcgcattctaatgatgagagaggggcttgtctacaaaaaacaccttttttattggcttttttacaaatctcagccctacattgagtgaacacacctaaaaagaacaaaaaagtaggttaaaacagtcgattaatgtgaaataaaattttaaaacagaaaaacagtgtggtttttccattccaatggcaaaaaagtaacaaaaagtcagattattaccatgaaaacgaataaaaattcagattattataataaaaaccaaatgaatcgaaaaattacgcaattacactaaaataattacgtaattacaattagttataacactaaataattataaattttcaagattaaggacgtctttcatatcataaaggtcattgtttttagcattcaaccatattgcagctttaatagctccattagcaaaggtcatacggcttgaagctttgtgacttatttctacacgctcaccaatatctgcaaaaatcgcggtatgttctccaacgatatcacccgccctcaccgtcgcaaatccgatacttttcgggtcacgctcaccagtatgaccttcgcgggcatagaccccacaggttttaagatcacgccctaaagcatgggcgatagattcgcccattgccagcgctgttcctgacggagcatccactttatgacgatgatgagcttcaatgatttcgatatctgtatactcccccatcactgtggcggctttttccagtagtttcagcaccagattaacaccgacactgaaattagcggcaaagacgataggaatatcacgagaagcgtcttcaatcgcctgtttgcctgcgtcatcaaaccctgtcgtgccgatgaccattgccttgcgatactggcggcagattgcgaggtaagcgagtgtaccttctggtcgggtaaaatcgatcaggacatcaaaatgctcaataacaccatgcagatcatcactgatggtaataccattcttgccgatacctgccagttctcccgcatctgttcccaccaatgaagaacctgaacgctccagcgccgcaccaagcgtagcgccatctaactgctggactgcctgaatgagatgacgccccatacggccacttgcgcctacaacagcaacgcgaatatctgtatcagccataaggcccccgttataaatcgtttttaattgaggtgataaagcaaattgtttaacagcttaactggcgaggactggcagcgccagcattagaggctaaccattagaaaaacagagatcaggaagagtgttataaaaaatgctaaacagcagagatattatgataagccacaggctatataccgggatttagactctcaggtgatacctctttagccgcttttcactatattcccggtcactatcccaataaaataaaagaattaccaatataagccagttggtcataatgaaatggtgtatctccggagggagttatcgtgtatcttttttcatttcatcataatacaccaattttccatatttcagtgtagttaataattcacaagaaataataaaaaatgaaataattttcaattatttcaataacaattgaaaattaataagaaaaaattaatatagaaaataattcaaatatttagtagaatgctttaaaatagttgcatacaatctaatatatagaagaaataatttatgaaaactctgttcttagaggggaatgctatttaccaaagaaaaataacatagtcattatgttattttttgatcatatagtttacataggagcttgaataacactctaattgaacgctttttgctctaattaagctctataaaattcaatgattttttaaaaatgctaaaagacttctctcttaatttaacaaagagggattgtatttatcatataaaaatttaattaataattaatttaatataagtcatttaggttataaaaatatatgagtaatagatacaaaacagttgttgttttaggtgctggtccaattggactattttctgcttttaaaatattagaaaataatttttcagaaaatgtattaattttagataaacggttgaactctgctcatacccttaagggatgggcagaaagatcaatggttgtacaattccatagaaagcttttttctctatcttaccttccagaaataatgcaaaagtgccctcatggagtgcttaaagaagattatgaagataatcggaagaaatatagtgacttagatcacatgagcataaaaaacatccaatcaacaatactcgaaaatatagaaaagaattataaaaatcgtttttttatgatgggtttaaaagatatatccactgataatgatattatttcaatttctatttcttcagatgactatgagagtaaccaaattttaagtaatttaagtccggaattaattgtagatgcaactggctatcattccattttaatgaataaaacaataggcgttcattttgaaagcgagtatgaatatggttcggctctaaaaataacttggccagaacatgaaatgactcatattgaaaataaagaaactgagtttcatgattgtcatgaaaacacactcttttttagcgaaggaaattcatcagtagctgagttttcatatccctctgataaattcagtaggttttttgaagaatgtgggtattctataaatcacatgagcactaaattaccctttctaaaatttgacacaacacctttttcaataaaattaccaccattcttagaaaaaataacatctcttaagaagaacgattttctatataaaagagcagttgatttattcaatacgattagaaaaaataaacttgctggtattaatggattagaattcattaattatttgcaaggtttcaattggtcagaggcagacaatcttgctttagtcattcgtagaataatagataaaagagtgactgtagaaaacacatatactgaccttgaagaaaactttttagatttaacgaaaattagagttacttttgtaccttctagagccgagagatggctatcaacaaataaagtaacaacaaaaattaatcttatattttcgaatgataatggtaagttacataatcaagtttgttcagtaacagcttgcgctgtcggagatagtctagctaacacagactttagacatggtcttggcatcaatcgaggatttcacacagcaactagattatttcaagataaaacagatccagaatcagtaaggcttgaattgataaaaaacagctactctatgctagatgttataaatgataattcaatatttagtagagctatttcgtgcagagattggcttaccctatagtaaaaatccgccttcatagaaagcggcattgatttcgccccagagggcgtactcaaatccctaaaatcaagtctctgccacttctgctactttaaaatctaaaggccaataaggcagagccaaaacctgttgctgaccacttccacaggaagtggttttcagctaaaaataaatattattaatgtgaggtgcgtgtatgtatatagatatattaattataatatctgcatttgttggaagtatcctatctgggctctttggtgggggggcgggcttgatttttacacctacaatttatttatttttatcttataccaacccaaattccagttatatcatgcaaactagcatcacaacgatgatagcttctttaatgatatctggtctagttgctattgttaaacatcacaaatacaaacatattgattggaatgttctaaaatggtctgctccactaattataatggggtcaatactaggttgttttactataactgttgcttcaagtcaatcggttatatatatcttttctttagcaacaataattttggcgattaggtcaacacgaaaattaatttctaataatccacaaaataatacaaatagagatcttggttggtcattccgttatattggtggttttttactaggattaatatcaactttatccggatcagcttcatttgctgttccttattatgagagcatcggtttaaatattaaaaaatcaatagggacaacaactgttgtagtctggttgtattctgtatttgtactaatatttatgatatcactcggtctaaataaaaataatttaccacctggaaatataggttttttaaattataattacctctggttattcataataccaacaataccaggagcattgttaggcgcaaaattagccaatgttcttccggaaagaaagctaagaatttcctttacagcactattgtattttattggattaagtatgttattttcataatgcatctacttttgataacctgtaagcttgggcattagcaaacctatatataattgcaacaaggtgagagtgtatgtttttggtcatatgttttaaattaaatattgataaacgtatactcccaccctaaaattgttgtggtttaataattcttgacatctcacaagcttgctattttgattaatatcaatgtgagatatcaacatgaaactgaaaaaatacgccgatttttctcctatcctggctattataaagacatctatatcttcaaaagtcttcagctccgcaaagtgctcgagatagatgtctcttgtcctagacaaatctttaatttttccgttggctagaatggcatatttagcaaacaattcagaatgacgggcttcgtcattaactgcttgagcaagccctatttttagaaaaaaatcattggattgtaataacagtcctgccgcattttccattccaagtatttctacattgtctgacagactggcgacagtaacagcagtatcgcgcaaacgttcggggattagatcattggcaaccaatttccagttcaattcacagtcccaagtctgccgtggttttcctacctgataaagggcataatgcttatcgttcaaaaaattaatttcactgagtttatatgagttatacatatctatgcttccttttattattttttttgttgaataaaatgaaataaactaaggtaataccgagaataatactggttatacggaaagttgtgtctatgccataataattggcaataaaacctccggtaatcggcataattattgctaccacagcggataacatctgaattatacctgttgctttccctacgttttcgtaacccaccatgtttctgacaccataacgtacggcaaaaaaagtaattcccgatgatatccctactagcactatggccacataaaaaactaaaacagaagtggtatttgaagataagaaaccaaagcaagtaaacgctacaacattggtaaaaatggaggaaagtagaactgattttgccattatttttttgatcagaaatgaagccaatttagttcctgcaaaaccgccaagccccattaaagaaatgataacaccaatactgttttcattctgccctattgctttaaagaaaattcccaacatgtcattactgagataaaaagctagattcgaaatcgtatatgcggtaacaagaatactcaatttctgctttttcaatatcatttctaaaaatgaatatgattctgactgtttggtaatctgagaaatttctgagcagtgatattgtgtttggtcaaaaaatgaacttagcgctgctagcaaatttaagatgacggagagtccgatgacaaaccatattccccaaagaccatatgtgccgacgacaatcaatggaataattatcctactgaaattaattaaatatccatagatttcataaaaccggctagtttcttcatcattcttattcagttttgtatttgaaatattaattccacacctggccgcagttttaataaaagctgcagcataaagtacgagaatactatgccctaaacctatggatggcattacacacacattaactgcaaacaacaatattctgaactgtcgaatttcatatctatcaaaagcttccccaaataaataactagaaaagaggaaaggtaaagaaaaacatgcaccaagaattcctaactgaagaggttcggcattcaataaatagcaataatattaaatattgcatagtccagatatgtgtcaagttcattagcgcctatgccaatatattttatcatttttggatttccattatttaaatgatcgggcaggtataaatgtattttacacccgttcgggtatcacaaattaattaagcacataatggttgacaatctataatatcctccctcctatccagagatagtaagattattattttcttgcaaggtaaattataatataggcaactcatgctaacaatacaagtgatgctaatcgtttttttttaagaaaactcgtcatacattgtctgatttatttaatatgtgtaatgattgaaagttaattaacattgcattataaaaatataaaaaaattatattaatatatacatggtatattataacattcaatataatatacaatatgtattacattctgttatatattgtatgttgttatttataatttaaataaaccttcataataatgcattcatattttggttataatatcaattttctgattggtgtataatactcctacttggagaatattcagatggcaaaggttgaagttgtttgctcatccaaggggacttgaccttttttctaaagtgttgattgaaagagaaagggtaaaactcactaaagggctttcagggagttaagataaacgggcgttatgtttaatccgttgccgccgttggcttagagggcgatttttccattttatgtagttaccataattagatgttagttaagatttgaaaatataatgataatacaaattttttgaaaaattttacatttgttctttattactcttaattctgatgtggatgttgaattttcaaaaacattaccatgagcaatatcatgtctttttctattgatattatcaaaaaatgactcccaaagacttctgtcttttgattgtattaactgtgttttttttgttaacgcaaaggtatctaatttctcttgttttgataaccttttctttacggatatatctatgatttttccgaatttttctatttccttatctgtcatagaaaatacgttatcaaatatcgttccattcagttgtttgaatattttttttgttcctaagttgtcacatattgattcaattattcttggttttggatttttatttttgcttggtaaaaaagcatcgtaagataatttaaaattaccatgttgttctaattctttaattaatatttccacctttttattattttcctcattttcttcgtatccaataaaattcctgcagaattgtcttttcattgcattgggaagtagtttaaaatccattttttctatatctgaaatgaagtttttaactaattccttataaaaattttccatatgtgatacacataataccatagccgaacgacatagactattatatgtatcaatatggttatatatgtgttcatctgccaaatcaattatgtaatcaatctctctccattggtcattaagcttacttatatagttgacagtaaacactctcattatttatataactccgtagctttaatcattctagttcttaattttgatatatcgttataacttccagagcacgcatctacgtagccaggatcgttaaacaaaaaatcagtgagtgattttcttgttattttttatctcctaaaaaatatattttgcaaactgtgtcatatacagcaacattgaagtttgattttttcttcacctcaccgattgtttttttattgccccagtttgaaaatggtttttcaatgttgctatttgcaattcttttgaatgtttcttcaaatttacttttcatttcttttagatcattttcacttaacccgttaaaaacctccattttatcatttaggaattttttaaatccgcctttatattctttatatccatctttgtaatgtaacgaaaagaatctaagaatgatttcctgatcatccatttttgctatttttttatcgctcaaatttgttgtgtttttaaaatcactatttgagcataattcaatgaggagatctttaaatggccctctatagatggcatttcttagttcttgtgattctagttttaatgcacctgtattaagtctttcaaatatatcatattttacttgagaatcaatagttgaatctattcttagacatttaatggttctttcttctaatcttcttattaagaacgcaggtaaatctttatagtaagcatcatttaatgaggataatacctctaatccagataaagggtatttatttttcataaattcatatatcgcagtaattctctgttgaccgtcaataactgaatatctatattgttcatcttcatcatctatttcatcatccacatcaacgtctaaagatatatatacatagggtatggggatattaagtattaaactttctattagccgagatgaggcctcaacgctccaacgatgtctgcgctgataatcaggattaagttttattgttttacggtctattttttttactaatgtctctaagtcatactctatgttctgggttcttacagttctttctttggctttttctgtaaatcagataattgatatttcaatgtcattttataaacctcaataaaataaattagttagtattctacatcattacttacaactaagtgaactaaaacaattctatgtttgtagtaacctgcaatcggaaatttccgttgtagctttagctttaaagctactacatgtcatatgaacacgatcaaacactacctcacttccgataaccgggatttgtatatcgaactcttgaaaggcattcgcgactctatagcgaaatcgaagatctcgtcacgggttaaccggatggttaccggaaatttcggtgatcataaaccttgtagagagcgtgtctgggagcttcgcgtagatcaggctattgaatgtctgaaggactatttgaagaggtgattatgaccaaagcacgtttacatgatgatacaatggtgcagcttctccgtgaagatactgagtttgcacagcattatttgcatcaggcattcgttgatatggatgaagaaggcggacaggaagcactccttatggcattacgccatgttgtagaagcgcgaggaggcatggcgcagattgcagataaagcgggcgtttcacgtgagacgctatatcgaacactgtcgcctaagggtaatccgacattgaaaactttgcgtaattgggattcagacccctcatacgtcagagcagaagaagttaaaatatattcttattctatctgttttatccatgattaagtctgcctttgtcctttgtgtaaaagtatgcttgttaagatcgacgttctctacgatgaaataatcagggtgttgagatgtaatcctggccttgtagcttttggtggtacgtacaaggaacatcctgttatagaccaatagattacgactcactacagagactgataaaattcaataacgcagcactataatagtgttagttaaattacagcgttaaaaattaaaatataaaactctcccatttaaactgacacagcaattttatacaaaaataagaaaccatttcatcaagcaacgtccttatgcgcttgttgcaaattatctaataaataagccaatataggtgtaatgtttgaaaatctcacagcagctgcaagtgagctaatccctggaaatatagacagttatgtgactggttcaggtgaacacagccaactacgccgcaatttgaaagatgaaggacatacataatcagataagtttcagttgataattgggcaatcatttatggcaaaacaggaaaacgtaaaagaatacaccaatttttttcatcttaaagaattcggtggattggaaatgcttaaggcaagctaccataagcaggttttctcccgtcatgtccatgaaactttttgtataggtgttatagaagaaggggcacaacgtttccaccgtacaggcacagaacatatcgctcccaaaggcgatattattctggttaatgcagatgaaattcatactggttcttccgcgggagtggcaggctggtcatatcaggcaatctatccaccacctgatttactgctttcattatcacgtgatttaaaacatgctgatggcgctatcccttggtttccctctgctgtcgtgcgtgatcccggcttggccgaacaattacgtatgacttttgatatattggcacaaaatagcaatatgttgcttaaggaaacaatgctgctatcttcactttcctggttgataatgcggcatagtcagacgcgtattacaacacaagagctgccttccgctgaacgacaaatatttatgaccaaaaaatatattgatgcttatgcagaaaatgatatttctctcagtcaattggcagagatggctcagcttagtcaatggcattttctacggcagtttaagaaaaccatcggcgtcactccccatgtttacctgatttttgcccgtttacgcatggcgagaaggttgttattggctggccactccatacttaatacggctatccgctgcggattttctgatcaaagccatttcaatcgtcattttaaacatgcactgggtattactcccggcatatttgtacgctccctgcaaacaccttagtcagcatcttttattaacctatttggtcagtattttaccatatcctgacaacatatttttttatcgcaattttattcaatactcctgcactctctattcgtaagctgattcatctacaactattttttatcttactgatatggcttttgttatggaaaaatcattaactgatacagaaactgtcgtccagccagccattccatcttggcgaagttttttgtctggcatgtatcatatgttaccactttgcctgtcagttattccctgggggatccttgctggctcggttgccgtacaatcaggattaacgctagggcaaagcatcggcatgtcagccatcctgtttgcaggagctgcacaattagttacgcttgggttactggcatctggtgccagtgtattcactattattatttcggtcttttttatcacagcccaacattttctctatggtttaactttacgggaatatgttgctatcttaaaagctcgctatcgattacccattggctttttgctcactgatgagttgtttgcgctaagttgcgctcaacaaaataaatcctctttaactcctagttacttaattggggcaggattgtgtttttatctatgctggaatctctttagtttactggggatcgtaatggcttccaccattcccgatctggcgaaatatcatctggatttttcaattgttgccacattcattactatcgtcattccgatgattaaaaaaatcagcatattttgtggtgtctgtttttcattgactttgtccatgctgttatcttatttacatgttgaaggcgcaattatcattgcgggtgtcagtggcatgttcttttctgtacttatcgccaaactggctaaggagtcaacatgagctggaccttgatttttgttttagccagcattgtattttttaaccggtatatttttctagaacctaaaatgccggtaaagttacctagaatattaaatgaatccctaaaatattccgcaccttgcttacttattgcaatatgtggccctattattttaatggaacaaggagaattaagagaattcactaataatccttatttatggggagcattactaaccactatttttgctttttttatccgaaacctcgtcgtatgtgtcattatcagcctaatcggcgttttatatcttatccgctattttatagataggaggacataatgaagacaggcattgatttttatagtgagtctactaccatccggaatacatacaaaatattaccctttcaaggattatggagttggttaacaggaaaagatattcctaacaggaaatcattatggaaatctagttctattgaaatgatatgttggtctattagttgggttgtggtcggcactctagttatttatttcgcacttaatagtgaattgaagttacctgttaaaattataatttatttaattggtgtattattttccacttcaggtgccagatatattgttgcaactatcattcaccaaggtgtacatggaaatttactctcaactcaaacacgcaataaaattatatgtgaaattttatctacaatattaataacccagccttatagttcataccgtcaattccatatctatgagcatcatggcaaagatttttcaacaatagaagataaggatctcgcagcaatatataaattgggatttacgcctggaaagtcaaaaaaacaactctaccttaatttacttttaaccctattcagcccctattttcatttgtcatacctttatggccggattaaatccaacttaataggcgttcctgtttaccgattcatcatgacaatcactcagtttctatttttgggttacctggcttggtttattggtatcataccttttgtgctgtttatcatcgttccctacgtgattgtgtatcaaatagcgtcactattacatttaataactgaacatgtttggttattacgtcagaagaaagaaactgttcgtgatagccatattaataactctctagggcgtttctgtggctcaccttgtcccaaaagttttgcattaagatattggctatcttggataatatgggctatcaaacacttattctatcatttacctgttcgaatgctggtattgcaaggttcactgatttgtcacgactggcatcaccgcacaagtagcattaaagaatggtatgactacacagtattaagggaagctaacgcagaaaaactggccaaagaaggtaaatatgactacattgagttctggggtttccacaactgcctgaattacgtgttaacaatgatcagtaatgccgaacctgtagaagttagcaatttaaaataccgacttaattaaaaacattttatattaaaaaatattattgcatacactatgaaaagaaagttgttaattctatactatttccattaaaaattatgggttatcatttaatgcgaaaatcataaggtctaccataatcgacttatttattcatggtagacctttaatatcttggaaagaatattaattaaaataaatttaattaacctctttcacctcaactctcaattcttttggcacttcaaagacaatattctcttcacggccatgcagttcggtgacggtatccgcgccaaaggccttcaaacgttcaataacctgctgaactaagatatccggcgcagatgctcccgcagtcacaccaatggcgttcacacctttgatccactctgatttgatatcatccgccgaatcaatcaaataagcaggtttacctacccgctgtgccagttcagccagacggtttgaatttgatgaatttttcgagcctaccaccaagaccacatcggcacctgatgccaagtcacgaactgcttcctgacggttagtcgtggcataacagatatcatctttgcgtgggccaacaatgttcggaaaacgtgcattcagcgcatcgatcacttctgatgtgtcatccacagaaagcgtcgtctgagtcataaagcagaggttattttcatccttaacctgcagtttccacacatctgccggtgattccaccagatacatgccgccttcagggttattgtattgccccatcgtgccttccacttcaggatggcctgcatgaccgatcagaattgcttctttgcctttgcgactcgcccgtgccacttccatatgcacttttgtcaccagtgggcaagtggcatcaaatagcatggttaaattacgagagcgggcttccgcacgaatagcctgagaaacaccatgtgctgaaaagatcagaatcgcaccatcagggacttctgcaatgtcttcaatgaaaatagcgccacgttccctgagattgtcaacgacatagcgattgtgaaccacttcatgacgaacataaatcggtgcgccatacagttccaacgcacgctcaacgatgctgatggcacgatcaacaccggcacagaaaccacggggattagccagcaatatttgcatgattttcctccaactgagggtcaatctccagcacttcaatgtcaaaagtgatgttttggtcagccagcggatggttaaaatcaacgatgatggaaccttcagccacttctttgactaaacccggcatttcactgccattcatggcagtaaatagcatgatggttcccacttcaggaataccggcatcggcaaaatcacggggtgtaaaatattgcaccaaatcaggattgggtttgccgaaaatggcttctcccgccagcgtgaattgatgtttatcacccactttcaagccaagaagctgctgttccaatggctcagagaggctaccatcacccaagcggaataacgcaggcttaccttgactgtaagtagagtctgccgttgagccatcatccagctttaatgtgaagtgtaataaaactgcactgtgcacttgcacctgcgttgacatattgctcacacctattactcaaaaaatgattgcacatatacccgttgaaactgattgggtatagatgaaattatcagccccagtaccattgaccggggctgatttcttattgtgatttcgatgctgttttcttgtcatccgggctgataaagctctctatgatgatgaaagctgccccgatacagatcgcagaatctgcaatattaaaagtaggccagtgccattccccgacgtaaaagtcgatgaaatcgacaacaaagccatgtaccagccgatcgaacaaattccccaatgccccaccaatcaccaaggcgtaagcagcattactcagtttctgcttggcactagagcggtacatcatcaccagcagtacagcagagatgatgatagccaccaatgcaaagaaccagcgctgccagccgcccttatcagcgagaaaactgaatgcagcccccggattctgagcataagtcagattgaaataaggtatcaatggagtggattcatacagtgtgaaatgctgcaacactaactgtttgcttcctaaatccagtatcaataccactacaaccagccaaagccagcggagaccagtggaacaaatgggtttattcatcaggcaaatttacgctcttcaccgttaccggcaacgttagtcacacagcggccgcaaagttctgcgtgttccgccaccagccccacatttttagcatagtgccagcaacgtggacatttctctccatccgctttgcggaaagcaactttcaagcctttaagttcactctgctgtgcatcgtcacctgctgcggcataagtggcaacttcaacctgagaagtcagcagaacaaaacgcaattcgtcagatagtttgttgagttttcctgccaatgcttcgtcagcatagagggtaactgcggcttccagtgaactgcggatatgtttatcagcacgagcctgttccagaaccttgttcacttcaccacgtacttccagcaattcagcccagaaagtatcgttcatatctgcgccatcttccagaccaaacagcccgtcgtaccactcttcagtaaagacatactgggcgcggttgcccggcagttcattccagacttcatcagcggtgaaggaaaggatcggcgccatccagcgcaccagtgcttctgcaatatggtacagggcgctctggcagctacgacgagccagaccatcgctcttcgcggtgtattggcggtctttaatgatatccagatagaatgaacccatttctacggagcagaactgcatcaaacgttggacgacggagtggaaatcatattcgtcatagcatttgaggatatcagcctgtgctgcctgagcacgacccactgcccaacgatccagcgcgaccatatcttccgctttcaccatatgttgttccgggtcaaaaccattcaggtttgccagcaggaaacgagcggtattacgaatacggcggtacgcatcggcagagcgtttcaggatttcgtcagaaaccgcgatttcaccagaataatcagtggatgccacccacagacgcagaatatccgcacccagtttgttcatcacatcttgcgggctgacggtattaccaatggatttggacattttgcgtccctgctcatccacggtgaacccatgagtcagaacttgacggtaaggtgccttgcctttaatcgctgtagacagcattaatgaggacatgaaccagccgcggtgctgatcggagccttccagatagatatctgctgagttgccgtggaattctggacgagcatctacaacagaggagtgagtacttcctgaatcaaaccaaacatccagcgtatccggtgccttcatgtaatcagcggcgtcagcgcccagtaattctgcggtgtccagatcccaccatgcttgaataccatcgacttcaacacgcttggcaacttcttcgatcaactcttgtgtacgtgggtgcaactcctgcgtttctttgtgcaggaacagggacattggtacgccccatgtacgctgacgggagatacaccaatccggacggttttctaccattgattcaatacgtgcctgcccccagcccggtatccactcaacgcctttgatctctttcagtgattgttcacgcagaccgttctgatccatgctgatgaaccactgtggagtcgcacggaagatgattggttttttgtggcgccagcagcaaggataactgtgctgtaattttgctacgttcagcagagcgcctttttcttgtagcagttcaacgataatatcgttcgccttgaagacaaatacgccatccagtgaaggataagtaccagagatatagcagccattcggcccgactgggttcgcaatttcaaggccatatttcaggctgatggagtaatcgtccggaccgtgaccacccgcagtatgtaccgcacctgtaccggcttcaagcgtaacgtgatcgcccagaattgcaggaacgtcgaagcccatgaatgggtggttgaagcgcagtagttccagatccgcaccagtacagtcactcagcacttgccatgaagtcatgcccgcacgctgcatgacggattcaaccaattcggccgccaggatcaggcattcgtcttctattttgaccaactgataagtaatttcagcattcagcgaaatagcgcggttagctggcaatgtccacggtgtggttgtccagataaccagagagatcggcaggccaagcgactgtatatcaaatttggcatacaccgcatccgcatcaacagccttgaagcgaacgtcaatggaaggcgaagttctgtcgtaatattcaacttcggcttctgcaagggaggagccacagtcagtacaccaatgaacgggtttaacgcctttcagcaaatgaccgttaccgatgatacgacccagcgcacgaatgatatcggcttcggttttgaaatccattgtcagataaggtttatcccagtcgcccagaacccccagacgcatgaaacccgctctttgtacttcgacctggctcattgcatatttgcggcactcagcacggaattcagcggcggaaaatttttcccccggcttgccaataatctgctcaaccttgagctcaattggcaaaccgtggcagtcccaaccaggaatataaggcgaatcgtagcctgacaaccctttggacttaataacaatatctttgagaattttattgactgagtgaccaatatgaatatcgccgtttgcatagggagggccatcatgcaaaataaatgtttttttacccgatttagcttttctaatcgcctgatacaaaccttctttgtaccaacgtttcaacatatctggttcgcgcttggctaaatccccgcgcatcgggaaccctgtttccggtaggttcagggtgtctttatagtcactcattatagattctcagttccaattttccgctagatacatgactcggatcgctgcaaaagataatcccttgcagcaaccacatcatttgcgatttgctgtttaagcgcatcaagcgaagcaaaccgctgttcatcacgcaattttttgcgtaataccacatcaatatgacgcccatacagatccatttgggtatcaatcaaatgcacttcaagttgctggcccagacccgaaactgtgggtcgattaccaatattagcgacacccggtaagggtttatcgcccaatccataaacttccacagcataaacgccctttacaggggcaaccagacgtttcaacggtaagtttgccgtaggaaacccaatggtacgtcccaagcggttaccgtgaacgactctgccacttatgctgtaaggatgccccaataatgtttctgccaacgccagatcatcatcttgcagcgcctgacgaatagcggtactgctgatccgcagaccgctgtcacagaagctgtctgtgctggcaacatcaaaaccgtattgtttacccgcttgttgtaaatagtgaaaatctccgaggcgatttttgccaaaacggaaatcatcccctattgccagaaacttaacacccagtttttccacgagcagccgtgaaacaaaggcttcaggtgaattagttgcgaaatttcggtcaaatttcacacataacagataatcaacgccatactgggatagatatcttattttatctctcagccgtgtcaggcgggctggcgctttatcgacagcaaaaacttccaatggctgcggttcgaaaatcatgaccatcgtcggtaacccggaacgcagcccttcttgtttcaaatgtttcaataaagcctgatgcccgcgatggacaccatcaaaattaccaatcgtcagcacgcaaccatggtgacgcgcccggatattgtgtacaccgcgaattagctccatagctggctcaataccgtggaaattgccggattataccttgtacagcgcacaaggttaacccacgatcacaaagggtttttaattaataacctgattcttacaataaaaacaggccagatgcccgaaaaatatttaatttatctcacttcttagtgattcattgagttttttgttgcgaaagactgtattccctttcagtaagctgataaaatcctgtcccatcacaacgtaatcagcgtcgctgtacaacggcgcttatttacacaaattcattgacaaaagaaggctgaacatgcatatttctcggcctttgaattgtcctcgctagaatatatttgggagttggaccttggctaatatcaaatcagctaagaaacgcgccatacagtcagagaaacgccgtcagcacaatgcaagccgtcgttctatggtgcgtacttttatcaagaaagtatacgtagctatcgcttctggcgataaagaagctgcacagaaagcattcaatgacatgcaaccaattgttgatcgtcattcctgcaaaggtctgatccacaaaaataaagcagcacgtcataaatctgctctggcagcgcaaatcaaagcaatgtaattattgtttttgatcatgctgaaaaaaccggcctagtgccggtttttttgtacctgtagttttaagtttcagtgatattttttgaggggcgcactgaataacgcagaaaaatccttgttacaaactcgttgaacagccggatgctgaatcatgcgctccgcaaaaatgacataatattcttcctgcacggcatccaatcgaccaatttcaacaatatcgctatcaacgaagatgtcactggcatagaaagaaggcgcaatgaaaatagcgttgtgatacataccaaacgctttcatcagcgcagcatcatcgaattcacccagcacttcaacttgcaggtttttattgcgtatccatgtcagaagtttcctgcccagcatcgaacggcgaccggggatcagtaaacggcgctcttccagacattctggaaacggtttttctgggatcggctgacggcagtaaaagctgacgctgcattcgcccagtttcactgagaacagcccttcttgctgagaagagtcaaccgggcaatctgacaggatcatatcgagcttatgctggctcagttgctcgagcagcatttcatgggttgattcaaaacagcgcaggtggattttctcatgctccacgactgtggtttccagcactttgctgactaagcgcttggacaacgcatctgctacacccacatcaaacagcaggtttgattctcggctgtaagtgacgatatccagcatttcgtgactgagcataaacattttatctgcataacgaaaaaccaattgccccaactcagacggaaccaatcctctcccttgacgcttgaacaactttccactcagacgttcttccaaagccttaatctgaccagtaatggtctgtggcgtcaggtataacgcctctgctgctccaacaacggaaccttccttgcagacatgccaaaaataataaaggtggttaaagtttaaatgtgaaacccgcatatatttttatcctaaattaatctattcatctgcgtttggcgatgttttctcttcggcaaaagtatattcaatagcccataaccaatgacagctgcggctgttgagccaatcaatatgcccaagcgggagtaagtactgaaagcgtcatttaaaccttcaaatgccaggccagaaataaagatagacatagtaaaaccgatcccacacagtaccgagacggcaaagatctgcctcagatcaattttctccggtaatttggcaacgcccagttttactgagatccagctaaacagaaaaatacccagaggcttgccaataaacagaccaagtgcaatccccactggcaacatccccgttaacccgttcaatgttaccccctgtaacgagacgcccgctttggcaaaagcaaataatggcaggattaaataagctacccacggatgcaaaccatgctcaagggattcagaaggtgaatgaccttttttgcaacgcaaagggatcatgaacccaacgatgacgccagctaatgttgcatgaacaccggatttcagaatacaaacccacagaacggcaccgaccatcagataagcagatgttttagctattccgcgccagttcatccaaaccagaagcgctatcatagcccctgccaggccgagagcagttaacgaaacggttttggtgtaaaacagggcgataataatgataacacccaagtcatccataatcgccagagcaagcaaaaagacttttaatgctgttggcacacgttttcccagcagtgccatgacacccagcgcaaatgcaatatccgtggcggcggggatagcccaaccctgccgagtgatttcatcaccaccgttaaacaacaggtagaccagcgccggtgcgatcatgcctccaactgcggcaatcgcagggaaaacggctttgtcacggccagccagcgaaccttccattaattctcgcttaacttccaacccgacaatcaggaaaaatacggccattaagccatcattgatccagagcaacagcggtttgttaatttccaatgcggcaaattgtaccgcaactggaaggttgagaaattggtgatagataccctgcaatggcgtattcgccaaaaccagtgcaacaatcgcagcgataatgaggataattcctcccgctgcttctaactttaaaaactggcgaatgattgcagtcatggattgataacctatgaaattgattgaagcactaatgttatgacagtcatgatttcggaaaaaatcgattatttatgcgatatgaatcggtataatcgaattataacattgagaaagtaacattttttctgtgatgggtatattgatataagtatcaaaagctgtttttatcatcaacctattaacgtaatgactaaaatatagccatgacaactttcctattattatctgtacttgctgccgccttgttacatgctagttggaatgctttagtcaaaatcagtgctgatcgattcttgggtatttcaattatcgtcttttttgccggtctgatttcgacatccggattgttctgggttggattacccacacccgcctctctaccgtggttaatactatcttccatcctgcatattggttattgcctgttcctgagccgctcttacgccactggagatttaagccaggtatatcccatcgccagagggtgtgcaccgctcattaccatcttattgagttggataatattgcaggaagtattaccgccctttgccaggttgggcgtcggtttaattatcgcaggggttattttgatcgcatttcctcacggtaaaaaatccatccggatggatcgcaggacattaatcgcagcactcacaacctcaatatttactgcctgctataccttatctgatgggattggctcccgtgccagtgataacgccttaacctatatcttgtggttattcgctattcatggctggtcaatgggcgtgattatttatttcaaataccggaaaacggctggacaaaatgtccgtcaatactggaaacaagggttattaggtgggctaatgcagttgttgagctatggtattgtcatttgggcgatgagtcatgcttctattgtgatagtagccgcactacgtgagactagcgtactgtttgcagtgctattgtctgtctttattctgcaggagccatttagcaaaatacgattattggcctgtgtcgtgattgtggcagggattatctgtactaaattggggtaatgcgctattactaaaaatattcccctgattatcaaagcaaaaagataatcaagggaacgattattctcgatcttacaacgatgccgaattacttagtcagatcatcaaaaaacttcttcacgccgtcaatgaaactcttggagcgtgggctattggcttcgccactcttgccgcccaaagattcacccagcttacgcagtaagtctttctgttcgtcgttcagcttcactggcgtttctaccacgacacggcacagtaaatcgccctgagcgccgccacggacggatttcacgcctttgcctttcatgcggaacaatttacccgtctgagtttccgcagggattttcaggctgacacggccatcaagggttgggacttcaatttcgccgcccagtgccgcaattgcgaagttaatcggtacttcgcagtaaaggttgctgccatcacgctcgaagatatgatgcgccttgacctgaacctgaacatacaaatcacctgctggtgcaccgtgttcacctgcttcaccttcaccacccaagcgaatgcgatcaccggtatcgacgcctgctggaattttaacggacagggttttgtatttctcaacacggccatgcccatggcatttgccacaaggcgttttgatgacttttccacgtccatgacactgaggacacggctgctgaaccgtaaagaacccttggcgcatatgcacttgccctgcaccctgacaggttgagcaggtttctgggctggtgcccgcttttgcaccactgccatgacaggtatcacaggattccagagttggaatgcggatctctttggtcacaccacggacagcttcttccagtgtcaagtccatattgtaacgcaggtcagagccacggctaggacgctgctgacgacggccaccaccgaagatatccccgaaaacgtcaccaaagacatcactaaaatcagccccgccaccgaaaccacctgctccaccacccataccaccttgttcaaaggcagcatgaccatattggtcataagcagcgcgcttctgtgcatccgtcaggatctcatacgcttctttaatttctttgaatttactttctgcttctttatcaccctgattgcgatcaggatgatatttcatcgccagccgcttataggccttttttatctctttctcttctgtggttttggaaatgcccaaaacctcgtaataatctttttttgccattgttttgtttacccttgacacgcacacacgggcgtagagttacctcaacgcccgtgtcagttaacaagtaacaggcgccctgttactttgcccgctaagggctattattttttgtctttaacttcttcgaattcagcgtctacaacgtcgtcatcttttttcgcggtgcccgcttcagcagcaccttcctgagcctgttgctgtgcgatttccagaagtttcttagaagcttcaaccagtgcctgaatcttcgcttcggtttcagctttgtcttcgccttttacagcaacttccagctcagaaacggctttctcgatccctgctttgtcatccgcagtcagtttatcgcctgcttcttcaacttgcttgcgagtaccgtgaatcagctgatccgcttggttacgaatttgcaccaattcttcaaacttacggtcagcttctgcgttcgcttctgcatcacgtaccatctgctggatttcttcttcgttcagaccagaagatgccttgatggtgattttttgctcacgaccagagtttttgtctttcgcagaaacatgcaggataccgtcagcatcgatgtcgaaagtcacttcgacctgtggcataccacgaggtgctggctgaataccatccaagttgaattgacccagagatttgttatcaccggaacgcttacgctcaccctgcaatacatggatcgttaccgcagactgattgtcttctgcagtagagaacacttggctgtgcttggttgggatagtggtgttcttcgtgatcagcgcagtcatcacgccgcccatggtttcgatacccagagacagtggcgttacgtccagcagcagaacatctttcacttcacctgacagtacaccgccctgaacagccgcacccattgcaacggcttcgtctgggttgacgtctttacgcggctctttaccgaagaagtctgcaaccgttttctgcaccattggcatacgggtctgaccaccaaccagaatcacgtcttggatgtcagatacagacaggccagcatcgttcagggcgactttcagcggctccatggaacgcttaaccaaatcttcaaccagtgattccagttttgcacgagtcactttgacgttcatgtgcttaggaccggtcgcatccgcagtgatgtatggcaggttcacgtctgtctgctgtgcagaagaaagctcgattttcgctttttctgcggcttctttcagacgctgcattgccagtggatcgttacgcagatcgaagccttgctctttcttgaactcatctaccagatagttgatcaaacggctgtcgaagtcttcaccacccaagtgggtatcaccgttggttgccaaaacttcatacgttttttcaccgtcaacttcgtcgatttcgatgatagagatatcaaaagtaccgccacccaagtcataaactgcgatggtgcggttaccgacttctttgtccataccgtaggccagcgctgctgccgttggttcgttgatgatacgcttaacttccagaccagcaatacggccagcatctttggtcgcctgacgctgtgcatcgttgaagtaggcaggaacggtaataaccgcttctgtcactggctcacccagatagtcttctgctgttttcttcatttttttcagaacttcagcagaaatctgaggaggggctattttctgatctttaacttccagccatgcgtcgccattgtctgcgccaatgattttatatggcatgatagaaacgtcacgctgaacttcttcgtcctgaaaacgacggccaatcaaacgcttgatggcgaacaatgtgttttgcgggttagttacagcctgacgtttagctggttgaccaaccagagtttcaccatcctgagtatacgcgatgatagaaggtgtggtgcgatcaccttcgctgttttcaagcacacgagcagttgtgccgtccataattgctacacaagagttggtagttcccaagtcgataccaatgattttacccatctaaacgcctccacaaagaattcatatataagtcaagttacttaacaatatgaggacggatgtttgtttttcaatggcactgattgcctgaaattcctcatttttatactttcggctaaacgccgaaatgtcgctagtaaccgcggttgagacttaaatgggggtcattcattcaatcatcaagggttgcgttgaaaaaaattaagtttaataaaaaaattcttttccagcccattgtttagtttatgccatcacattattatgcgccgccctttacggtttattggcgctgtcagatgccataaagcctttttaatatcttgttttatttgttttttccagaggaaatatgcattctaatcagttggcgaatccaggcccgttgggtttgatgggctttggcatgacaacaattttgttgaatttgcacaatgcaggttttttcccattggcatctgccattttgagcatgggaattttttatggtggtttggctcaggtgctggctggcattattgagtacaagaaagggaatacctttgccgcaaccgcatttacctcttacggtatgttctggctgagtctgatcggtttgttgttcctgccagcaatgggtctggcaggcgccaccagccatgaattcctcggtgtttacctcgctttatggggtattttcactctgttcatgttctttgggactttgaaagctaaccgggttctgcaatttgtgtttggcagcctgacgctgctgttcgcactgctggcaattggcaatatcacaggcaatgccagcctcctgaccttcgcaggttatgaaggtattgtctgcggggcaagtgctttctatctggctatggctgaggttctgaatgaacaatatggccgtactgttctgccgattggcgaagtgaagcacgcctgacagtatcaggcaagcaacgctagctagactctattcaacaggatgagccatcacgctcatcctgtttttttgcgtcactttttcctgacgcgcaaatgtaaccccaagagtatgcctacagcagataaaaccagaacatagtaagcgggcgcaaactgggtataggcctgtaacagggtgacgaaaatcggggtcaacccaccaaaaatggcgtaagacatattgtatgagaatgaaattccactgaaccgcacttccggcggatagctctgaaccataacaaaaggcacggctccaagcacgccaacggagaaccccgccacagcataagcactgaataatctgcccggttcatcactgatattatggtagaaaaaccatgaagctacagcgagcagagcgcagcctgccactaaaaccagactggcgccccatttatcgcataaatgaccggctaatatacagccgattgccagcatgataatcgccagactgttggctttcagggtgagtgactgctccagatggaaaacagtctgcatataggtcggtgccatcaaaatgacaacaacaatgcccgcagagagcagccatgtcagcaacatggaaacgatgatggcatgtttatggttcaagatcacagatttcagtggcagcccttctgccagtgccttacgttcctgcatttccctgaagacgggcgtttcctgtaaccagcgacgcagatacatagcacacaagccaaaagccccaccaataaagaatggcagacgccatgcccaatccaaaacttcctgcctggtataaatggaggtaatgatcgtagccaccagcgagccaagcaaaataccaatggtcagcccggcagtcagcgttccgcaagcaaaaccgatgcgtttatgaggaacatgctccgccacaaatacccaagcacccggcacttctccgccgattgccgctccctgcataatgcgcatcagtaataataaaacaggggcagcaatgccaatcgtatcataagtaggcaatcccccaatgatcaatgtcggtaaggccatcagcaagatactgagcgaaaacattttcttacgcccaatcaaatcaccaaaatgcgccatgatgatcccccccaaaggacgggcgagataacctgccgcaaaaatgccaaaggtttggagttgccggagccacacagggatatccgcagggaaaaatagctcgccgagcacaacggcaaaaaagacaaatataatgaagtcataaaactctaaggctccacctagagcagccaaagacagagttttgtaatcttgtttatttaacgcacgattatgatgttgcgacataagttaccgatttatagttataaaatagggattctatgattttcaccaataaccctaccagactttaaagcagataaaaataagacttattcgatattttaagatatttattctgaggcttgtcattgattttattctgataacacatgaattcatatttgttttaatccggagagtcatcagatgggaaagaggaagagtacgcagtccatatgttaaatacagtcagaatacctgagcactccccatatataccccatcaatttcagtaaattatttaggcaaatattgcttcagcagtgaaatcacagtttcaatatccggcagggaaggatgcccaaccatcttttgcagtgatgcgtcaaagttttcatgccaaacaggttcaataacgtgatagccatcatcattcaactgactgatattacgacgtgttgcatttttttcccacatgacgctacccattacgggaaagaacagtaccggaaacgtggaagccagaatgaccgtcgtcaaacgattgggagtcgcaccatgagcagcactcgccatcgtgtttgccgttgcaggtagaactgccatgagatcatgatcagccacaatgcgagaaggcttatcggttggccaatcctgtggtttttctccgctgataacccgatcggcatagagggcaacggtttccgctggcaaaaaggggatagcgctgcttgtcatcaataccgtcaatgtacagtcaatcgccgccttaatagccgaaagatatctgggaaggagaacaatatcgactgatcccgtggctccaattaaaatcctcggttttattttttgattagtttcatcatatttcatgggtaaattggcctttttattatcagaatgtttttgatgatcagaatatgttgttagcgatattcactggcatattccagccactcatccagcgctaccaggcagaaatgtctgccacgctcctgccattcccgtgggtatcccaaagagacttccacatgggcaacaccatgaatatattcgatattgggaatgtgcaaatgaccatataccaccatgtgtaccccttttcttgatgcccactggcgagttttttcactgccacaccaaatagaaaattcggtattgcgcaaggattcggtcggttttcggataatcggaaagtggctcatgagcacaatgccttcaccatcctgaatgtgattcaagcgtttttcggtatattggatacgttcccgacaccattcgataatatttttatggggataggttttcaggaagaactcatcggaactgatgatgccgcagcgacgggcgcgttctatagcctgatctgccgtataatcgatcgcatttctgaatgaataatcgtatagcgtaaatatgggggcaatggtcacaaatgtaccatcccccatagggtaacgatggaattcatcttctggagtgagcacattgtgctgtcggcagatgtttaccagatgctcataacgcagtactccgggtaatttcacaggatctctgggactgcaccagagttcatgatttcccggcgtccagattacctgtgcaaaccgttgggaaagtgtacttatgacccatgtaaagtctgactcctgttctgcaatatcacccaccaacaagagccaatcgtccggtgtcgatggtctgaatgaatcgactatcgcccgatttgctgcatgggatacatgtaagtcactgacagccaacagcatggtctcacctcactatgactaagttctcggaaaaatcagggcgttcccggaggtgcttccccccagccccattttggtacagtttcgcggcgtgatggtgcggcgtccggctgggaattggcctctgccctgcgtgaaccccattcgatataggccgcaaaggctgaacgaaactcaggatctgacggaagaccgatttcatcggcagacttcatcagtaattctacccacctcgtccgttgctcaggctggatgcttctgcccctgtgccgactcagcatgactttgaaaccaccgcgctcatcggtatagcgactttctccaccgagcacttcttccagccacatgccaacatgaccggggtgatcggctttcatatttttaaacaggggttcaagcagttcgtctttttcaaccttggcatagaagacttccataaggtgcatgagtttctctctgccccccatccattcgaataaggttggcttttcatttgccataacatacctctcatatgaatacatgaatgacgtcgtcattctgactatgacgattttttggtactaattaacccaactccagagaagcaatggctcttaatttctccaaatgtccctttggtatgacattgcccttgtacattctgaatgtgtaaaacaattcccgtagcccatactcttttgccagcgggataaattgattgttatcggtttcaggtgcatcaaatgtcacagcttcacctgccggtacttgcgccagcgcagccctaaaaagtgtttccagtacatcgacgttatctgcatggaaaggcccaagccgatatccatctgtcgatttgcgtatcccaataatgccagtgacccctgtatctgaacgggtacagaagccatatcgtccttctccccagaaccagtctgtcagcaatctcccacgacaaacacccgtacattcagcatcgtacttaatgacatcagcaatattcgcctgggttatcggtaatgcctctgctggttgaataaccggttgaatgatgacaccagacattctgaaagtacgatagtgaggaacaaatcctcttttttcatacaatgatgagatatggctgttcccatcgcagctaattgtgcggtgttctgcgtaggcaatactcgatttccatatttttcctgcacagacatgattacggaattcagggggaacaatataatgcccagcgtgtgtataagtatctgaataattcaccattgacatggatgaaataggcatcccattacggtaagtaataaagaagccatgaggatcgacattaaagaagcgtgaaatatcactctcgaccatattccactgttcagtattcgcccaatgaaagatagtggagcgccattcgctcgccgttaccctcttaaatacacacttgttgttgctcttctcactcatatccaatatatccttccaacaatattgcggtataaatgcggagacgaacatcttttatctacccgtgcatccgtatattcattaaccaagtgctcattatttgaatgatgacccattgattattaaagccccatcgatttactgatcatttcctgcaaaacttcactagttccaccataaatagtttgagcgcggctattgagccagtttttacccgcaacagaatcacgcatataacctgccccgccatgtaattgtaggcagcgatccgctactttcatctggagttccgttgtccaccatttgatgcgggcagcatccaccaaactgaaaagacccttgctaaattgctcaacggcgttatcaagatagacgcgggcaatttttacttcggtatccaactgtgcaaggataaaacggttgtattgaaaggagccaatcggctggtcaaacgcttttctttctttcacgtaagccagcgtactctgtaaaatatgttctgcgctggcaaccgccaccgctgagatactgagccgttcccgtggcattgccgacatgaagtaatagttaccgaggttttcacggccaatcagattggtaacaggaactttgcaatcatggaaaaacagttcagccgtgtcgctgccattccagccaattttcttcattggctctcctctggagaacccggccatatcccgctctatcaccaacaggctgatcccctgaccttgctgaccctgctctgtttttaccgccacaacgatcagatcagcattgatgccattggtgatataggttttgccgccattgaccagatagtgatctccctgccgcttggccacggttttgatatctgccgtattagaaccaccgctgggttcagtcatggcaatggctgcgactcgcttcccaaggcataattccggcagccacttttgtttctgctctccactgccaagggcaaaaatgtaactggcaataatatcgttatgggcgacgatccccggtacggtaacgccagctctgataagttcttccgtcagaatcacggcaaaacggtaatcatgttttcccaagccaccgtattcggggctgacacttatgcccaacaagccagactgacccaacttctcccaaaaagaacgttccatcaaaccattatcttcccaagcctgatgttcaggaacgatctcacgttcaagaaattcacgacaagatttccggtaatcgtcgaaattatcaatctcaatacgcatattcactccaaattcgttgtcagctttattgttgcgttccactgtcactcagcagtatttgcttaatgacatcccagtgccggtagacggcaaagtgatccccttcaatacggatgagtgaggtcttgtgagaagtgtgatttttccaagcctgcatatctgccaaaccgacatgtatgtcctggctggctgaaaccagcaccagtggataatccacctgaatgttgccaagctgaggaaattggctacgtatgagataatcattgcgtaattgcctgatgatgggttttatcagcgccggttcgttcaaaatcgcctcaggcgttccctgatcttctctggttttctgaatcaattgttcatctgtccattcatgccgctcatcatacggttgaagttgaggtggcacagagcaggacaccacaccaaactgaggggtaagcccgtaacgctcgtgcagtacctgacctaccgcaacactgagtacaccaccaaaactgtgaccgaatgtgatccactccgtgatcccctgcacctgcttctgctgaaaatccgcccaaatatctgaggccagccgatcaatcaacggccccaactcatggacttcaggctctttggctaaatacccccgaccggggatcgccacgggctgcaagatcgcggctttcgtggccgccagatcattcagccagggacgataaatggccgttgtcgccccggcatgtggaaaagcgtaaatgacccgtctgcaattaatgttcattttccctccgcgctatcagaaagctgacaatccgctcagccgtcatgatggtcgtcagattggtcggcatcgaaggaatagtgggaaacagcgatgcatcggctacggtcacgccagtgatgccatgcacttgtccatcctcttgagtagcgcagtcaggatcagagccggctcccattctgagggttcctgaagcatgccagcccggattgaccaggttcttaatcgcgctgttcatgatttcatcgttgtaaatcatggagtgagaccaaaactggatgccatccagaaacgcatcgacttccgggtgccgcagggcttcccatattttacgaactccgccgacaagacgggcgatatccgcaggattgcgggtcagtggcaggtcaatctggggcagcacagtaggatcggcggtgctgataaaaacacgccccagagcctgtggacgcatcagcatcacggaagccccaaccagcatgggataagcgacacgatctttgaatcccggtaccgtctcactggcaacattgttcaatagcccgatttgcacatcaacttttgtgtcatagccactgctgatgcgggcagcaatttgccgccacggcaagcccgttgtacacacgccagttttcggtaatgaccagagcacgactgatgcgtggtcagtcaaatttcggccaacggcgggcaattccgcaatcaccggaatgcccaaagcacgcaaatgttcgggatcgccgacacctgaacgctgtaacagggttgccgaaccaattgcgcctgcacagagaacgatgtgttctgtgtgataaacttgttcttccccggcctgaatcacttttacgccggacgccgccgttccgttaaaaatgatctgggccaccagcacatccgtcataacgtgcaggttctttctatgaagaacaggttcaaggtatgagcgataaacatccactctttctgccccattgatgacattggcaggtacaggccccacagcgggggcctctccggcattaagatcatccacatagggaacaccagactgctcacaagcacgggcaaaagccatgtcaaggggatggatttcctcatgttgcggtctgcgcaaacacattggccccagtgaaccgtggttatcatcacccgtgcgatcgacatcattctccagatgtttaaaccacggcagaacttgttcccaagaccagcgagggcagcccattttcacccattgttcaaaatcgctgggaaatcctctaaaggcaatggcgccattaacggcagaagaaccacccagcacctttcccacacgataattgaacggttttcttccccggtgtttgcgctcttgttttttttcttcttgcaggtaatgagaaggcgaaatgagatcggcgaaccgatcttcactgcgtacattcgcttcgtaatcccagttatacccctccagcaccagccttgacgcatcccggagcgggctggccgggtcattaacatcagatgcgtgacctgcttcaagcaacagcaccgatttcgtaccgttctcagacaggcgcgatgcagccacacaccccgccgaaccgccacccaccacgatgtaatcgtatgtcttggtcataggtcactcaccgcttgagattgcataatcgtcccgataatccgagaaaatgcctgaatgttggaattcatgaacaacccttcgataatgtcctgctctccggcgggagtaatattaaattcctgtcgcagagcactgagcagaccaacggcatgcagtgagtcgccaccaatatcgaagaagccatcggtaacatcgaagtcatcatgctggagctgtgcctgccagagttgtaaaattttcgtttctatctcattggccggatcgacggcgattgctgtgtgttcttcgctatcagcccaaggaagtggtagcgccttacggtcaattttgccgttgctggttaatggcatatgagccagcaacacgtaatagctcggcaccatataggacggcagtgtattgcgggcaatttccctcaactgttcctgaaaatgggtaggctcttctgacgtatccgcagcagagggaaccacgtaggccacgatatgccgctgaccggttttggcatggacgggggcatccataaccacgtgaccggcgttttcgtgggtcaagagacaggcttcaatttcacctaattcaatgcgatatccattaattttcacctgattatcttcacgacccagaatttctatcaggccgttagccatatagcgtcccagatctcccgtcttgtataaccgctcgctagtaacaggatgggtaatgaatcgctgcgccgttttttcgagatcgcccagataacccaaagtaacgccctctcccccaatatagagttcgccggtcacccagttgggacaaggtgaaagccaattgttcaggacatggaatttctggtttgccaatggcttgccataaggaatacttttccaatttttatcaatatcttcaattggatagcatatcgaccaaatagaaccttcggttgcgccaccaagactgatgatcgccgtattgggcagattttcccggaatccgctcaggcagatcgatagggatccagtcaccgctcatcagtatcagtcttacttgtgtctgagccagatcggcaccatttcggtctaccaaaaccttgacaggagcaggcacgctgttccagatagtaatctgatgtttaaccagcgtttcaaaccagattttcggatcattagccgtttcagaggttgaaaagacaacctttcctcctgcccccagtacgccgaaataatcatatacggacaggtcaaatccggcaggtgcaacggataaaaccgtgtccttttctgtcacatgaaatttgcgattgatatccagtaccgtgttcgctgcattgcgatgggaagccatgacccctttcggttcccctgttgaacccgaggtaaagatgacatatgccaaatcatccaacgcttgcacggaagagaaatgagcagagaccttctgttctgtatccattgcctcagacatcaggcactcatccagattgatccggaataaatcagccaattcaccctcgttaaaaaggctgctctcagtgacgatacctttggtggagcagcgcctgagcaagttcatccgacgctctgcgggaagctgaggatcaatggcgacataggccgctcccgacatgagaatccccaataccccaagcaccaatgcagggccttgtggcagggaaaccgccacaatatcatttggatgaatctggactgaggcacgaagagattttgcaacttcactggcgcccttgaccatttcggcataagtaaagtgtttttcgccctgcacaagggcaatggaatgggggaatttctctgcggcctgcaaaatcatttcatgcagaagttggggagcaagatcaatatccgttgcattagccttggcacgttctgccatatcggacgcaggaagttttaccaatgatccggttttgccccacacagaatcatcttctgcacaggcgatgaggagcgccatataactatccagcatggcttcaaccataccatcggggaacagctcattaaccgtattccagttaatctggacgatgccatcaaggcgaacgatttggttttccagccatacctgaggggtttgattactgctataaacctgcaccgtgccagcccagtccatatccgtaacaacatcgtctaaattggctgtcagagtattgctgaataccaccggtgcagaaactgcgcggctgccatgactgcgacgagtcagctccctcaagacctgaacgccattgtaggaagaatgccaacgattcatcagcaaatcagtctgaagctgtactaaccgatcattgaaactatcgtcttctgtcccctgtattgccagtaatgtaggttgcaggaagttcccgacaatattttcaacctctgcaaaatagggacgacgaccaagttgtgtgatggtcaatgtaaaagtctgacgttttgaccactgacggagaacttctgcataggctcccaacaacaacgtttcaagcgtcagtttttgctgctctgcttttttcttaagagcggataaggtttctgtcgctattttccgactgtaacgcttgaacatcggtggagaaatcaattcaggggcgtttttcaatggcaattcaggggatggcggtaagttatcgaactgttgttcccaataagctttatcatattgcccttgtggttgtccctgtagataacgttcagccttgatataattttgaaaattcgcttcgtcatctaattcaggcaattcgcagccttgataaacccgcccccagtcccgcaataccaatctgacgctatgaagatccatgaacatcaaatcaaaatagaggtgcaaacggataatttcatcactgagtatcgttgcgcgtatatcaaatgacgggattttatccacgggtaataactgtgtttccattttctgacgaatatctgccagctgtttatctttttctgatgccggccacgctctgccatcctgaatagaaatagtataggtcaatgattcagacaaaacccgctgctgaccatctgaagatagcgcagtccgcagcatgggatgatattcaaccaccttgttgagtgcgtcattcagtgccttgatatctaaggatttgacatcccattcggtatacaggcaactcgtccgcccgcccagttccaacccaggattacggccgatcaggtaagcatattgaatatccgtcagtggaaaatcgtctgttgtcgactcttttgtaaataacgttttgggaatagtcatattcagtggcaatacactgcaaagcatttcgtgaatctgctgtgtgagatgagatattcccgcttctgtatttttattttctagttcagctaattcagaagaagaaagagaaacttgtaatccagactcttgcaatgccctgagaaaatgttgcatacattatcctctatcgtgtagcagagaaatcgagttttctctatgtgatattgtttttagttacttgtagtaaattttttaaaaccaaaatcaaataattccgataaatattctgaaacataattaaactggtttaatattgaatattaaaaaataatttcgagattaaaaaccaatcccctatttatattatttcccctcaaaaattaataattaaatatccagctttaatgtgatgatattgatcgcccaacaatattgcaacatttttataaccataaattatatctaataacgatatcaaattaacaattaatgttatatgagagttatcataataaatagtcgcaactaattaaatataatagtaattttaacatatcattttttatgatacgtcattttatatgttgatgtaagtatttgacaaatattaataataaaaaaagacataatgaaataattattaataatacattaacgggataggtaaataggtgataaagagtagtgattagtatataccgtcgataaacataaagttatttatcgacggttattaagattgacgttaagaaaataatgtcaggaagagtgcagctaaataaagaccaacaccataagacgtgtgcgccatcaggcttcttaatctggcgatattaggcgtgggggttttggatgctgcaattcccattcccataccgggctgcataataaaataaggcgcgacgacagtaacgacaccaacaatcaatgcagggatcaaagtgggatttttcgcccaatccagcccccaaatcaataataaaagtcccgcgaaaataatcccaatcaggtaatgggcgaaccagccaatcccagtttcacctttcacgggctcagcctgtacaatgcttttatggacaaatatcccttttggaatatgcccaatccagcgacctaccatggaataattcagtgatggcactccaaagctgcgttttatgaaaaccgcccaaagatccatcacaaccgttgcaccagccccgatcaataccgaacgaacaatcaactccagtccttcattcatttgttgctatcctcctaatttggccattcatcgcagttgaatcacttatctgacactcgcagcgtccaaaaaactttgatattattgcattcaatgaatttattgaatgtaataatattggaagccaaatgtcaatgtttgataaacaactctcgttgagatcgcggaaattgccaaagtactggggaatacccaccgcctgacactgcttgaatgtttggccgataccgagcaatccgtcgaacgtctgtcggatttatccggcctgtctgttgccaacacttcccagcatctacagcacctcaagcgcgtgggactgcttcagtcccgcaaagaaggcaagcatgttctttatcggcagggagaaggcccgataacagatattatctccgcactcctgcaatatgctgaatttaaccgcacagaaatgcgcaggctgatcgatgatacaaataaccaggaatccatttcatgggaagaactgctggatcggatcaaagaaaaaagcatgacattgcttgatgtcaggccaaaagaggaatttgaacaaggccatttgccgaacgccatcaatattccggtcgatgaattgggaaacagactggacgaactttctgccagtcaggaacttatcgcctattgtcgaggcccttattgcgttctctctgccaatgccctcgaattgctgcgtgctaaaggcgttcgcgcccgccgctttaaaaaagggttctcaggctggaaagatgcgggaatgcgtatcgaagtatgatcttaaatttagcgttttcaggccagtcattggcctgaatataataatgaattggttttacttataaagttaactatttaaacaggaactataaatactattcattcacatgaataacaaataacaaataacaaataacaaataacaaataacaaataacaaataacaaataacaaataacaaaatagctagattagactaataaatacaattttttcagaaaggtgctcaatcgctattgtaagcatctttctcgccaaaggaataagtgaccttcatactcattaggtgaaatgaccgttgtattgattggcacatggttggataccaatgtcattgcggatacgtctttccctttacggaaatatttggttgattacctaattttgagtatattgatacgacaaactacccagatttcaaacacaaaccactacacttatctgaatcctcatattaaactctagcttacccattgactatacaacaaatcatattattaaatgacatataagggaccactttatgaaaaatgaaagaagacattttctgaaacaggcaggggttactggtgcagtattttcattattacctctgcttccagcaggagctctcgcctcttcacctagtcaactaaagaaagaggatggtattggtatcggcatttgcgagatgaccccagaggaaatgtcaggtccatattttataaataacaaactgctgagaaggaatatcacagaggatgaacaaggaatacctcttttattgacaatgaaagtcactgattctgtaacctgtaaacctttagatgatatccttattgatatatggcattgtaatgcaatgggaaagtattcaggttggaaatacataaacccagacctcgaagctccatctgataatataggaacgatttcacgaacggatgaaagcacatttcttcgtggggcacaaaggacagacaaagaaggcatagtcagattcaccacgattttccctggattttatgccggaagagctatacatatccatttatcagcaaggagtgcgaatgtacaaaaaagacaggaagataaattctattttgtaggccaactctatttccctgaggatatatctaaagaagtcatgattaatgatatgtattctccaagggagattaataggcttaaaaatgaagatgattctatcttttctggagttaaaaatagagctgcaattttgacagtaaaaaaaataggtgataatccattggatggattacatggaaagatagttttatctattaataaagaccatgtgtccaagaaaataacccctaaagacttggctaaatacactgtgtaggtgaatctaatttagaaaaaaccctccataaccggaattttagatccaacaggataaaaatagactataggcggtatcgaaaaaagactttgtgctctaaaaatagtaaaaattcgatatttagaaccgcttttgaggccgaaaaacagagtctcatatatattagctcagacttgatctgacagttgccgattatttatacaggcatctgtcagattacaagctctgtcgcattaagccctgtttggataatatgatattttttattggttggactgatgatgtccctgactcgagaagcgctcaaacgcctgcattatcctgttgatatcatcgctcagtgtgtttgttggtatctggcctacgcgctgagcctgcgtaatctggaagaaattctggctgagcgtgggattgccgttgatcattccacgctctcttgttggtcatgtattcaatatgtgtattgtaagttttattgtgttgagcaaattgctgcttataacactaaaatcaccttatgatcttgatcgtagataatgctggaatcgccaagttcaacatattaaatacacaaccaaaaaatgaaattttaaaaatgacctgtcagtctaagtcagaaatctcacacgtaatgttttatattaagatataaaatggtgtgtatttccagtcttcagcctctattatttcaccactttgcggttttataagtttaaccttgagatcatggtcgataaatatattaacagcatggacgctttcttcaaaacccccaaataccacctcaattgcatacccaaatttttcattatttgaataggcttatttagaagcctgtgctttgtatacaaaactaaaatcatcacaatcaaaggaattttttctatatttaaaatttttcagccctgattctttgtatattttctttactttttcgtctgaaactaatttgtagaatggatccagaatcctaaacgttgataaccttaatttgatattcggccaggtttttttaactaagggctgtataagtttttccttaataaaatcagcatgcagagtaaataagctgtattttttatgattttcggttagcaaggaccgcgactcatcatgggaatgactgtacaaaaacatttctgttccctgattattccaaacgagcctatattgctttaaccccttttctgttttgacatactctttgttgaatgatatttgcctatcatctatgctgggattacgagtatgccagtataatttagttgaagtgaggtctatagaattgtcataggcatacatgacgtacttcttatcgttgtattcacctatcatctttattgagttttccggaatttttttatcccgcagttgtaacatgataaagttagcagaataatcttccgatcccataaaggcaggtttttcatcaacctcaaaataaagaaccttcttgtctctatcatcaatacagagtgtacgtccatgtgtgtctttaatgaaataggaagcgtgaggggatgtatcgttttcgagagattctgcgtcatcgatcaagataacatcagactcatttggggaaagggaaatggggttctcaccatgatgaatattttcttcttctgaaagtgttgatttatctgaatcgaatacgctgtgtgttttaatggctttatctttcttttccataatatagctaccttattgttaaattgagtatttatgtatggcttttaagtagttacatatagttttcactggaagttaaaacataatcagtcaataactgaggttatgatgttatatatttataattatagatgaaaactataaaatttctggattaaatgtttatgtatagaaaatattgaatattgaatattgaataagccatccattagaatagcttattttaaaattggaaatagggaggtaaaattcaatattcaaaaaatggattttgagtttgaaaactgtcagtgaatgacggtgttaattgtttttcctcagtaaattcaatcataaaacgactcatagcaagatgccaattttggattagcattatccattttttaacggcggcctgaatcgccagccaaatccggactgaagcgataaaattatcattcagcccatattaagaaagtgtgaggttgagcacaggtaagaatagcgttttgttgccagtggttaaattatcaacgccgtaaacgctccaaatacagctacaggatattaacgacgggcgctttttggtcggaaagcggcgactaccttttcatcagtttccacataagggccatccaacagttggatgcagtaagggacactagcaaaaacccctgacaccagcactttgccactggcatctttcaggccttccaacgtttccgcaatggctttcggttgaccgggcaggttgaggatcaacgcttgatgacgaataacgcctacttgacgggataaaatcgcggttggcacaaattgaaggctgatctggcgcatttgttcaccaaagccgggcatttcacgatctgcaattgccagtgttgcatctggagtcacatcgcggcgcgctggcccggttccccccgttgtcagtaccaaatggcagccccgctcatcgactaattcacacagggtttgttcaatcaggatttgctcatcagggatcagacgcgtttcgacgctaaaaggcgtggtaatcgctttttccaaccatgtttccaatgcagggaggcccttgtcctgatagacaccgtttgaagcacgatcagaaacagacacgaggccaatgcgcagtacattcatacgaacctcaattaacagaaaaaatagagagaaaatatcgctcatggtgaagtgaaaaaataaaaggcgacctcattatgtcgcctttgtagaagaaaaaatagcgtatcgcttaagattacagcagatcagcgatcatgctctcaagcttgccctggtctacggcaaatttacgaataccttccgccagtttttcggtcgccatcgcatcttgatggtgttcccagtagaactcagcttctgtcaatcgagctggacgcactttgatttcgccttcataacccagtttgcactcaacttcacctgctgtttcagacaattctttcagcagcgcaggagagatagtcaaacggtcacagccagccagttccaggatttcgccggaattacggaaacttgcgcccataaccaccgtgttataaccatgttctttgtagtactggtaaatttcagcaacagagatcacacccggatcttcatgtggtgcgaattctttcttatcgccattcgctttgtaccagtcaaggatccggccaacaaacggagaaatcaggtagacacccgcttccgcacaagcgcgcgcctgagcaaaagagaacagcagggtcaggttacagttgataccttctttttccagttgctccgccgcacggataccctgccatgtagaagccagtttgatcagaatgcgatcattgctgatacccgcttcgttatacagtttgatcaaacgttttgctttcgctacgctggcttcggtgtcataagaaagacgggcatcaacttcggtggaaatgcggccagggatcagtttcagaatttccagaccaatattgactgccaatttgtcgccggcatcaataatctgctgctcacgagaatcgctctgaccacgcgcccattcaatggcttcattaatcagttggcggtattcagggatttgagctgcgttcaaaatcaaggaagggttggtagttgcatcttgcggctgatacagtttcatcgccgcgatatccccagtatctgctacgactgttgtcagtttacgcagggaagtcagtttatcggtcatgtttaatatctcatcgttatacgtaaaatattggcactgttgcctcgccatccggtgataataacatggtcaagcgctgctgtaaggtaggaaaatcttatcgctgttattcgcccttttcagtttgtttttgctaaagttgagaaagcctgcattatggggaaaacgattcgaaacaaaatcatatcggaacaaaatcatgcttattactatttcacctgcaaaaacactcgattatgaaagtccactcgcaacagagaaatatagtcagcctgcattgctggaggaatccaagcaattgatcgatgtctgccgaaccttaacgccagcgcaaatcggcagtttgatgggtatcagtgataagctggccggcctgaatgcggctcgttttggtgaatggcaaccgaatttcaccccggaaaatgcccgtcaggcgatcctcgcctttaaaggtgatgtctataccggtatgcaggcagaaaccttctcagacgccgattttggctttgcccaaacgcacttgcggatgttatccggcctgtatggcgtattacgccctctcgatctcatgcggccgtatcggctggaaatgggtatcaggctggagaacccgcgtggcaaggatttgtataagttctggggagatctcatcactgaaaatctgaatgctgcgctggaacagcaaggtgatgatgtgttggtcaatctggcttcagatgaatatttcaagtcggtgaatactaaaaagctagcggctcaaattatcaaaccaatttttctggatgaaaaaaatggcaagtataaagtgatcagcttctatgccaagaaagcgcgtgggctgatgagccgctttatcattcagaatcaactgactgatcctgcccggctggtggaattcaatctggaagggtacgccttcgatgaatcgctctccaaaggcagtgagcgggtatttaaacgccctgaacagcattgattgatgtcactccacccgccattcaggtggagtgacagatacggcgttatttcggcgctctttccattaagaattcgcgcaaactcgcaaagtcagcaggcagaaagtgggataacagggctaaatccgtacgctctgccaattcctgtggcaatggcagcggctggccgaggatcacttcaacactttctttgaatttggccgggtgagccgttcccaagaacaggccatattctcctgcctgtaattgatcacgcagtacacgataggcaacagcggcatggggttcggaaatatagcctttggcagccagttcttgcattgtggcctgagtggtgctgtcatccaccacaccattggctaattcactgagtgaccagcctttgcgctggaacaattcttcaatgcgcggccagttatttggctggctgacatccattgcattcgaaagagtcgcaacggtctgatgtggctgccatgcgccttcagacagataacggggaacggtgtcattgacattcgtcgcagcaataaaacgttttactggcagtcccagcgatttcgccagcaaccccgctgtcaagttaccgaagttgccacttggcacggaaatcaccaactgttcacgtttttctgctgggatctgggcaacagcttcaaagtagtagcagatttgcgccaataagcgactgatattaattgagttggcagagttgagatacagtgcacgtttcagttcttcatcatcaaaagcctgctttaccaacgcctgacaagcatcaaaatcgcccttgatagcgacagtgtggatattcccccccagtgtgcagaacagtttttcctgcaatgggctgattttcccttctggatagaggatcaccacctgtacgttgtccaagccatagaaggcatgagcaaccgccgccccggtatcaccggaagtcgcagtcaaaatagtaaccggctgttctcccgcgatttgtgcgaggatttgtgccatgaaacgaccaccaaaatctttgaaagccagtgtcggtccatgatacagctccagcgaagcgatatcgtcttcgacgcctgtcaccggggcaggaaaggcaaaggcatttttgacacgagccaccaattgttctgcgggaatttcatcaccaataaaggcagagagaattcgctggctacggctgacaaaatccagtttcaataattcgtcgatttcgtcacgactgaattcaggtaagtcctgcggaaaaaacagcccctgctgtctgcccaatccctgtttgaccgcctgtgaaaagctgacctgttcgctactgtcttttaaattatatagtttcatcgttaccctacctgtcgtgcgcctgcgagatccagacggcaaatatgcacaaaaccttcatcattctgtacgtaatgttgttgcagccactgtgcgacttctttcgctacagccatgtcatcgcagatcgcaaataatgtcggcccagaacccgaaatactgcacaccagagcacccagtttctttactccattacgcgcgttggcaaatccgggtaaaagttgtgtgcgataaggttcagcaacaacatctttcatcaatttagccgctagttcggattgctgggtatggcaggcgtgaataaatcccgcaaaataacggccgtgattaatcatatccccacgggagtagtttgccggcagaatggcacgggcttctgatgtcgaaactttgatgccggggtaagccatcacccacaaccaatcatcaaaaataggaacagactgacaaacggcattttcctgcgcaaggagcagttgcaatccccctaagtagcacggcgcgacattatcatagtgcacaccgccggaaacacgcccctctaactcgcccatcatgtccagcaattggttgctgtcaaatggacagccagcatactcattcaatgccaccagagcagcaactaccgaacaagcactggaacccagccctgaaccaatcggcatgtttttttccagtgtcatggcaacaggcagcttttttcccagacgctggcaaaaaagctgccagcattggtaaacaatgttgtgtttgggatcagcaggcaatttgccagcaaaccgcccttcattacttaaactgaaacgttcagcttcacagacagagacgcaatctccaagcaacgagccatcaacaggagaaaccgctgcgccgagcacatcaaacccaacgccaacgttcccgatagaggcgggtgcataaatcctgaccaccattaaacccccaatttccatgacagagtacgtaatatatcagcaaaaaccccggcggctgtgacatcattcccagcaccgtagccacgtagcaccagcggaatgggttgataataacgggtatagaaagccagtgcgttttcgccatttttgaccttataaagcggatcgttgccatcaactgcggcaattttcaccctacaacggccttgttcaatgatgccaacataacgcagaactttcccctgttctgcggcatcagcaacacgatgagtgaattcttgatccagttgtggcaaacgttgcaggaagctaccaacatcaccgctggcatcaaacgcggccggcaagactggctctacgtgaatattttccaattccagttcatagccagattcacgagccaagatcaatagtttgcgagcaacatccataccggagagatcatcccgtggatcaggttcggtaaagcccttttcttttgccagcagagtcgcttgtgaaagcgtcatgccttcatccaacatgccgaagatataagataacgaaccggacagaatgccgttgaactgcaccagttcatcccccgcattgagcagattctgcaagttttcgataaccggtaatcctgcgcctacgttggtgtcatacaggaatttccgcttcgatttttcggctgcctgacgaatttgacgatagtaggccattgacagcgtattggcctttttattcggtgtcacgatattaaaaccatcgcctaaaaagctggcatactgctccgcaatcgactgattcgaagtacagtccacaatgaccggattcaggagatgatattctttttcaagacggataaggcgactcaaactgaaaggctcggtcgcttctgacagcgactgttgccaattatccagaccgatgccctgcatatccgtcaacatcgcccgcgaattggcaatgccacacactcgcagatcaatgtgtttttgtttgagccatgactgctgacggcggatctgttcaatcaatgcactacccacccctcccacacccaccacgaaaacttcaaccacttgagcggtgttgaacaacatttggtggcagagcctaaccgctgtggtagcggtatcattgtcaatcacagccgaaatggaacgttcagatgatccctgtgcaatggcgatgatgttaatattcgcgcgggtcagtgcggagaagaaccgggcagagatacctcgctgagtccgcattccatccccaaccacagagatgatggaaaggttatcgatcacatcaatgggatcaagtacaccatctttcagctccagataaaattcttcggtcagcgccttctgtgcttttgtcagctctttttgcggcacacagaaactaatgctgtactccgatgaagactgcgtgatcaacacaacagaaatgcctttgcgagacatgacggaaaacacccgtgccgccatcccgaccatacctttcatgccagggcctgagacgttgatcatcgccatattgttcaggttggtgatgcccttgacaggcaaattttcgtctttatgcccttctccgataaaggtgcccggcgcatcgggattcgccgtgtttttaatcaggcaagggatctgaaattgggcaataggcgcgattgtccgcggatgaaggactttggcaccgaaataagaaagctccatcgcttcctgatatgacaagctttttagcagacgcgcatcgggtacagcccttggatcgcaagtataaacgccatctacgtcagtccagatttcgcagcagtccgctcgtagacacgcagccagcactgccgctgagtagtcagaaccattgcgccccagcaccaccaattcaccgttatcgttacccgcagtaaaacccgccatcagaatgatatgctcagccgggatgttcagcgccgcaatgcgtttggacgattcgtgaatatcaacggtagattcaagataatgcccgtgagaaagtaggtttttgaccggatcaatgactgtcactttatgaccgcgcgcttgtaaaaccgctcccataatggcaatggacagtttttcaccgcaacaaatcagagcagcattaatgctgtctggacactgcttcaatagcgaaattccatgcaaggtctgtttcaggtaggcaagttcacgttccacaatgcctttcaggtattcataatcgaaattcggctgatgttcttttaagcccgacagcaaatcagcaaagatttgggacacatcgctcatgttggaaacaatatcctgccctgccaccgttttgtctatcatcgccaccaagtggttcgtgatttttgcgggtgcagaaagaaccagagccacttgcccaagggatagttcactttcggcgatatcagcaacactcagtatacgctggtaatttgcaactgaggtgcccccaaatttcagtactcgcattagcatttctctcctgatttatgtccaaaaaaaagcccgtatcttgtgggatacgggctttttattattttatgtgtacgcgtcagcccgccccgtaactcatagttccggtggtaatcgtcgtagtggtttctgtagtaaccttatttttcgggctgatatggcgcatgatttcctgtctgtcttttaattcgtttgaccccctattggttaaagcaaactgtagccgaagtcaaatatttttgtcatgaaagcataaaaaaatgccattttccgtattgtaatcattcagaatatagcgaaactattacgtcattatctggccgataatatcgttttatagaatttaatgtcatgaaaaacatattttgtaattattttgtctttatgataaaaacacgctcatcttgacattagggcgttactgttaatctatctaaacgttctggcaacaccacagagttaacaatattctctcaatttaataacatatgaccgagtttaaaattaacaattacaacgaatgttaacgtgctacaattgattttgatatgtatcaacaaaagttagcttttttagagggcaagtgcattactagctgttatattgctgttaatagactaatatagtcccctgtttaaacccgctttttcgggcatgtatcctcaaaaaagcgatgctggcttctggcataaaatatatcaacaacgtctattttggacatgagctgcgttttctgtaattcagaacaagatcagcatattttcttttaataataacagcttgcgtcatacagattctgttttttttagcgattttaggtagcaaccatgcaaaccccgcacattttgattgttgaagacgaaattgtcacacgcaataccctgaaaagcatttttgaagctgaagggtatgtcgtttatgaagccactgatggctcagaaatgcacaacattctgtcagataacgatatcaacttagtgattatggatatcaatctgccaggtaaaaatgggttacttcttgcccgtgaattacgtgagcaggcaaatgtcgccctgatgtttttaacagggcgtgacaatgaggtggataagatccttgggcttgaaattggcgctgatgattacatcaccaagccatttaacccacgagaattaaccatccgtgcacggaatctgctttcccggactatgaacctgagtcattcaggtgaagagcgccgtcaggttgaaagctataagttcaatgaatgggaattagatatcaacagccgctctctggtaagcccaatgggagatcagtacaaactgccacgcagcgaattccgtgcgatgctccacttctgtgagaatccggggaaaatccaaactcgtgcagaactgctgaaaaaaatgacagggcgcgaactgaaacctcatgatcgcaccgttgatgtcactatccgtcgtattcgtaaacacttcgaatccacaccagatactccagaaatcatcgccaccattcatggtgaaggctatcgtttctgtggcgatttagaagactaatcgataccacctaaactaccgcatttgtaaaaaagccctgaatgtccttcgacatcagggcttttgtttaatgagtaactcactctttccacggcataatcggcacagcactgatcgcatttttaggcgacccgtcgatgactttatcagaataggttaaataaatcagagaactacgttcagggtcgtagaaacgaaccacttgaagttttttaaacaccaaagatgtacgtttttggaagacaacctgcccttttttggggggtgtcttgattttgtcgctcaattcaatcggcccgacctgctggcaggatatagcggcatcagaagtatcttctgccaaccccaatccacctttgatcccacctgtcttagccctgctcagatagcaggtgacatttttgacatcaggatcatcaaaagcttctatcactattttgttatcagggccgaatagtttgaacacggtatcgacagaaccgatctcctcagcatgcaagatcacaggagaaaagatcaaggcagccgctatcactattttcttgattgttaccatatttagtccacttgaattaaataaatgcagtgaaaatattcactattcacatataatgtgaatcaatatctttcatgaaatcattttcactactaatgtatttatgacgaaaaatcgtgacattatagctgaataggcattctaaacgagtaaaaaatggtcttcaaatccatttctactggttaacccactttttgaattgcacttaaaagtacgcctattttgagaaagtttttatcagcctgttttatgttcaacatccaccgacctatgtatgttggcgggtggaaatggttgtgaaaatgaacatagtgatacctattgttaatgaatttaacaagataactcttgacaaattatcgattaagctattaatttattccaagaaaattcttgtttaatttaatgggaaggtttttccgtaaaaatggatatcacatgctcaggcttacacaaaacaaaattaatcattcatagcatctagaattaacaatttttacccgtgagaataggaataatttctgctctccgaccatcaaaaggcatcacaagctatgtttttttaccttttgggaatggtaggtgttaattctcgaccaaactgcataacagttgcattcagaaaaacgttttggtttttcaaaatagtaagttgttgtacatttgtatgattttctttttgtcttaatgacttagggagatgtatggatcaaaccaacatcattcgagatttgctgcattggatggataataacctagatcgtccactatccctcgataacgttgcagcaaaagcaggttactccaagtggcacttacagcgcatgttcaaggatgtcacaggtcaggctattggttcttatatccgagcaagacggttatccaaggccgcagttgcattgcgtttaaccagtcgccctattctggacattgcattgcaatatcgttttgattctcaacaaacgtttactcgggccttcaaaaaacagttcaaccgaacgcctgcttcctaccgccgaagtgacgagtggtgtgctacggggatttgcccacccattatgttggataacaaaccgttgccagcacacaaatatgtcacgctggaagatcagctgcttatcggtactgagcatacttgttcttatactctggagcagtggtcaagtgcctgcacagagatgcgtcacggtttctgggtgaactatctgcaacatgctaaaacacttccccccaggctgtatggattgcatcattccgatctcagtgcagagcatgaagatgagcagactgttttctataccacagcaatagagccagaatatgccacatttgatacgcaagacaacaggcctgttgttctacctggcggtgactatatttcattcagttattttgggggcaaagaacaattaaaagagttcctctttacagtttatggtatctgcttgcctaaattaaacatcactcgcaggaagggatacgatgtcgagcgatactaccttactaaccttgaatggaaaaaccttgaggatgagtctcaaagccacgttgtggaatttgagtacctcatcccaattgaacgttagccctgtaattcatccaatgcgggcatatccagatgtgtgatatcgcctgcagtttcaacaatccagcccgaagccagccacgggctatcttgataatccactcttgagatagagcaatttcttagccgcaggcggcgctccgagttggcaggaagccccaagatagagctgaccaaacagactaatgccataccgtgactcactaacaacgggcggctacctgctggcaggccaaggcaactttccagtgctgcccgcatacgagctgacaattcattcattgattcaccttctgggatcttcccatttggtgtaccatcgacaagacttttacgccaggattcttcttcaggagtcagggaattcagttcacgattttccagaacacccatgtttaactcccgcaaacggggttccagcagcacttcacacccacaggctttcgcgatgatttctgcggtttgacgtgttcgaccaaggtcactggtgataacatgtgtgatgttttgtgattttactctctgtgctaccaagcgtgcctgacgcaggccaatttcagtcaagggactgtcagtttgcccctgaatacggcgagccacgttccattcggtttcgccatggcgaacaagatagacctgtaacatattctttttccgttatactgcatctgaaatagttcaaaggataatttatttattatgtaccacgttattgctgcaacaactaaccctgcaaaaataaaagcgattagccttgcattcgatgatgtttttggccccggcacttaccgcatagaagatgtcaacgtagatagcagcgtcccccaacaacccattggcaatactgaaacccgtaccggcgcccgtcaccgtgtgatggctgcccgtcaggttcggccagaagccgatttttgggttggagtcgaagctggaattgaagatgacatgacgtttgcctggatggttatcgaatacaagcagattcggggtgagtcgcgctctgccagtctgatgctgcctgaaaaagtattggaaggcattcgtgaaggacgcgagcttggccatgaaatggcttatttgaccggcgtcgataatatcaagcaagaaggtggcgcaatcggcttttttaccaatggtattctgacccgcaccagcgtttatcatcaggcactgatattggctctcgttcctattcatcatgaaatttacaaagagttgaataaccaaccttaacggcctggccgtcaggggtcataacaaaatgaccccgctttggttattttaatcgttattatcttttaataattgtgcttctaaccatgctttgacaggggcaggcgctgcttttaagctgttagaaccacgagtaattgtcgctatacccacattgagctcatttttcaactcacgctggctcatctgtccacgcatcaattcctgaataatccgaatccgagttgacagagccgtgcgctcatcaggagtcaataatagctgcaaaataggatgttgcaaattttgttcaaatgctgactgtaacaatcccacaaaagtgagccagtcatcgctatcttccggggtgagtgccggatcaatcaagtgatttggtatcataataaacggccatactatttaactagtacggcagcataccatagttatatctaaaattaataacgcctttgccattctgcgttagtcaacgcatttgaatgtattcccataaaattatgatagtacatatcataagccagtacgtttttgacataatcgcgtgtttccccgaaaggaatgctctcaataaaagctatcgcgtcaatacgatcagcactattcgccaaccagcgatcaacatttctggggccagcattataggccgcactggcaagaacgcggttattgccaaaacgctggtaaaccaagtccagataagctgtacccactttgatgttcatagctggctccattaattgactgctgctggaataaccctgaatcttctgctccttcacggtatgctcggcggtttttggcatgatttgcatcaatccgctagctcccttcccagaacgagcctggggattccatgcactttcccgtcgggcaatcgccatcgcataactttgtgaaatatttttatcggcagtaaaattcgcaaattccttctgccatgccagaggaaaacgctcctcaagatgatcccacatattacctgtaatggtggcctgtacactgagtgccggccaatgctgttcaagagcgtaacgtgccaactgttgctgctttaacggactttgtgaagaaacaaagttattccactctgagttcgccagattatccatatgccagtatatcaactcatggatacgctttatttcccgcatttttgcaatcgaatcatctggtttttctgctctatcaatcatcaatggataagtgatatttaatttctgcgcagccaccattgaataaaagccccgcttttccttaaggttgtgcaatattgcttcaccctctgcttgcttaccttcattaagcaagacaatggcactccagtattgccactcctcttttttttgcagaatacttttgggaagcaatgacaaccactgtaccagccctttttcatcgccatcttgcagtgtcaaacggacgcgtcgctcaagcagattggtagattgcgaatctcgtatgacgtcatcccgccatttcgcctgctctggtgtgacattgctcatcaaattccatgccactgcatcttttaacaattgatgctcggagtcattcattttctgcacccgaacaatggccggaatactgtgtctagcaacttctgcgtctttacgggcaaaacgagaaaaagtcgtcatgataacggagcgggtaaaatccgttgatgtggacgtttgggcaaaatgctcaatgaaggcaggatcactttgcaatttcagtaaattttcactcaagctccgatagctcaaaggcaagcgcttaataagataattaaccaattgagtgttatttgatttaatcgccaattccatacgctgcaaaattaaatttgcagataagtacccagcctgttcccagacatcaaacagcttatcgcaactgccgggcaatgtgttgccactcaaccacagttcttgggcacctttccatgctacctgctgatttccagtagcccatttagcaaaataataattgcagcgcgtcatagcagcctttggtgcatttggagtgaatgccaaaataccagaccagtctccattgcttgccagcgaattgatatatttggatgtcagagaacgcgccgatggtaaagtcggataagtatcaataaagtgacggatttgctgaggcgtggcaatatccaaatcttgagttaactggcgatattcgagataaggatataggggataatctttcagcgttggcatcaatcgttcaacttccgccatatttttcgcctcccacgccagctttaccgtttgatatcgctcacgttgggcgtccaaagaatccgcatgtgctgccccagcaacaaaaaccagacccacagccatcgtaaaatgccgccatttattcattgctacatgctcctccaaaggactaaacggataaccaccaatacaaaaatgctattcaattataatcatattattgacatgattgattacaacagtgaattcataacgataagatttttataaaagtatcgtttagaagaacacacacaatctcgtttgtattcctccccacagtgaatacaatcgtcagacaggaacgaggcccgtactcataaaaacacgttccgcacaaatgatttttaccggttgcggtaattggatgcttgaactaatgctgatcaggtagcaacacgatacgtaaaatttagggtaaaatgccccatccaagccccataaacgcaaacgaatttcaaaattcccttattaataaaaaggtaaattacattggctcaatatgtttatagtatgcatcgggttggcaaaattgttccccctaaaaggcatattctgaaaaatatttctctgagttttttccctggagcaaaaattggtgttctcggtctcaatggtgcgggtaaatcaaccttactgcgcatcatggcgggtatcgataaagatattgaaggagaagctcgtccacaacccggcattaaaattggttatctgccgcaggaacccaagctcaaccttgaacataccgttcgcgaagctgtggaagaagcagtcggcgaagtcaaaaatgcgctgatgcgtcttgatgaagtctatgctgcttacgccgatcctgatgcagattttgacaagctggcaaaagagcaaggtcaactggaagcgattatccaatcccatgacgggcataatctggataaccaactggagcgagcggctgatgctctgcgcctgcctgcatgggatgccaagattgaacatctgtcagggggtgaacgtcgccgagtcgcgatttgccgcttgctgctggaaaaaccagacatgctgctgctcgacgagcccaccaaccaccttgatgccgaatctgtcgcatggctggagcgcttcctgcacgattatgaaggcaccgtcgttgcgattacccatgaccgttacttcctcgataacgttgctggctggattttggaacttgaccgtggcgaaggcattccatgggaaggcaactactcttcatggctggaacaaaaagacgcacgtctggcacaagaagcctcctcagaagctgcccgccgcaaatccattgaaaaagaacttgaatggatacgccaaaatccgaaaggacgtcaggcaaaaggtaaagcgcgtctggctcgctttgaagaactcaataacgttgattaccagaaacgtaatgaaaccagtgaattatttatcccaccaggcccacgtctgggtgataaagtgctggaagtgaccaacctgaccaaatcttatggcgatcgagttttaatcgacaacctgaacttctctctgccaaaaggggcgattgttgggataatcggcccgaacggtgcaggtaaatcaaccctgttccgtatgctgtccggtcaagagcaacctgattctggtacagtctctctgggtgaaaccgttacgctggcttccgttgaacagttccgcgatagcatggatgataagaaaactgtttgggaagaggtttccggtggtcaggacatcatgcggatcggcaactttgaaattccaagccgtgcctatgttggccgctttaacttcaagggcgtagatcaaggcaaacgtgtcggcgaattgtctggtggtgaacgtggccgtctgcatttagccaaactgctgcaagttggcggcaacatgctgctacttgacgaacccaccaatgatctggatatcgaaactctgcgagcgctggaaaacgccctgttggaattcccgggctgtgcgatggttatttcccatgaccgttggttccttgaccgtattgcgacacacattattgattatcaagatgaaggtaacgtcgctttctttgaaggaaacttcagcgaatacgaagattataaaaagcggacaatgggggctgctgcactggagccacaccgcattaaatataaaaaaatcagtaaataaacctgatagcgaaaacggcctgatatcaggccgtttttccgagttgacttatccccttcatctttcaagttgctgctttgttggctgcaacttgaagtttattgggatataacgactacaccatcactcttttttcttgaaaggattcataagtcttaacgaccttccccctttctaacgtaatcatgctatcagcgtattgaaccaggcggttatcttgagaagcaatcacaaccgtacctttttgttcgtgcgcaataaatttaaagatatcgacgaacatctgaaactccttatggcccaagttacgcgtcggatcatcggcaaatagatattcaggtcttctgactattgctcttgccatcgcagccagctgtttttcattttcagatagctcgccagggtaataacggctcttatgacccaatttgacaatatccaatgatttctgcgcgatttttgtcgcttgctcactagaaagtgttaatccataagaagttgataataacaagttatctaagagcgtcagtttattggataaattaaagtcatgaaaaataaacccactactttcataatgaaactttcccaattcgatatcattcattagtttcaacttgttattattaattaatacatctccttgatctggttgtaacatacccgatgcaatcgatagcaatgtgctattggtcgatgctttcggtcctgttatcaaagtaatttcacctggtataatagaaaatgtgatatctgaaatcatttcatgattaactgaattatcagtcaaaccatatgaaatattgataacctcaatcgatttaaattgatttaagttcatattctcaacacaattaggttaaaagattaaagctttttccttaacatatgctgcctagattcatttgtgatactactaatatctattagacattgtacaaataaaaatagtttatatgtgaaacatcctgataaggatatactcatattatgtcaattattatttacaatgagcatataataaataagatatttcctaatcttagaataaaaatttaacaatattaattatgcctaaggaaatacaatccaaataaaaatagcataaatttttctatttttattccatttagataataaggaaaaaatcatcatggttacttccgtagtttaatattttctttacattatctccatttttggtaaaacacctaatatatctgtgggtttgttaataactaataaattttatataaataagtcaataggtctgttcattaaatgatttatttctctacaattcaagtcaaaacgatagaattcaagcatcaaaaaatattattatcacaatttattttattactattgtaaaaataaccacaagaaacatttaattaaagttagttaagaataaaaaacaataatgctaagaatcactgtagaaaatagattatcatgaattaattatgataataatataaattaaaactatttttatatataaaagttagttacgccattaacatgtgttgaactaattcaatacagcgcagaaaacgttgatcatagtccgctgagttgacacaaacataatcgacgttatttttcttcaacaaactctcaagtaactgctgaaactctttacgttcccgttcactacctaaacttctcagcccatcagccacccacggggtgttgttttctaacagaatgaccagatcaaatcgatattcatcaatcatcgcctgtacaaagggatgctcttttccttcataacgcttgcaaaatgcctgtgtcgtcacgaaatcagtgtcaataaaagcaactttattggcatatttgactgaaaaatcaatatattgtgcatgtcccaatgcaattttatcgtaatctgagtattgcagagccatttcatcccctcccaagtgggagaacacgtactctcgcccatattcccatacgctggttgtgttaaacatattggctaacttgtttaccagtgtggatttaccactcgactcaccacccagaattgccacggtgcgcacaaaaaatggcttcacttctgttggaatatattcccaatagcgaaaaggtgcctgccgtatctggctgccgctgatattcatgaatgaacgttgtggatcaataaggatagtttcaatatcgaaatattctttataacatgctacatcctgcgcttcactggaatagatatattcaggattgatgctcttctctgccatgaatgccttcactccccggctccatacttcccagccattcggataaggctccatgccatgttcatcaaaaacgtggatgtggatatttttttgatatttgaatgtttgtaaaagccatctcaggcggtcactgactgtgggttgctgagacatagaactattgatgaacaattcacgatcccgcaattcgtcataacagaggacgacgtgcaattcatcgacctgactggatgcccgctggatcaaataaatatgcccagtatgcaacgggtaaaatttaccaaacaccacaccgacggttttcttttccatgggatacgctaatcctaaatattgatgaatagatgccagtttctgcgcactcggactctttattttgccgttaataagttggctcaaatagccttttgtcattccacaggcatcagccacttgctgcaatgtgtaactcgcctgtttaatagcttctttcaagtagtcaaattgccccataaaaccccctatgtttagtatactaaacaaaataacacgcttgttgtgaaaggtaaaaacaaaattggttgtttattagtattttgggataaaatcttgttatcctaaccattaaaagtatttaaaattaaataatttaagatattcataaaataaaacaaatattaaattattagtttaagcgaaaagttaattaaagaactcattattgaatgcaataagtgaaattttgctgaaccacaatgaaatttatgccgttattttctgaattaaatcccactgtaatttcacagggtatttattatagataaataacttaattcggtaaaagtaggaaaatttgagcagtataacgtcccactagctgattttttatttagattaaatgaataaaaatatcactcaaaatttcgcatatttatttgagtcggatgtaaaaactgaatttcctaaaaaccaagatattagaaaaaaatgggacagttattgaaaaagtgtctgatgacctgccacagtcaacgtgacgatagcaggcaatcagacagatccttaatcagtcatccaactcatccaacacagatagtgcatctgccaattttttgacaccaaacactctcatctctggcaatgcttttttcggcatgttagcgtgaggcacaatagcgcgtttaaagccatgtttggctgcttctgaaatgcgttcctgaccactgggaacggggcgtatttcccctgccagaccaacttcaccaaataccaccagatcacgaggcaaagggcgatcacggaaactggaaaccaaagaaagcaataacgcaaggtcagcactggtttctgtcactttcacccccccaacgacgttaacaaagacgtcttggtcagccatttgcaaaccaccatgccgatgtaaaacagccagtagaatcgccagtcgattttgctcaagccctacagcgacgcgacgcgggttggacagcatggagtgatcaaccagcgcctgaacctccactagcaaaggacgggtaccttcccatacgaccatcacggaacttcccgacgtaacctcatctcctcggctcaaaaaaatcgctgaagggttactcacttcccgcaatccctgttcggtcatggcaaacacacccagctcatttaccgcaccaaaacggtttttatgactgcgcagagtccgaaaacgggaatccgcctcaccatccagcattaccgaacaatctatgcagtgctccagcacttttggccccgccagagagccatcttttgtcacatgcccaaccatgataatggccacaccacgcgttttcgcaaaccgagtcaaataagctgcagtttctctgacctgtgcgacactgcccggtgaagattgaatatccgccatgtgcatgacttgaatagagtcgatcaccatcagtttaggctgttcctgttcggcaatcagacaaatttgttcaatgctcgtttctgacagcatattcaatttatccgtcggtaatcccaaccgatgtgccctcatcgccacctgctgcaacgattcttcccctgtcacatacagcgttttcatctgttcagataactgacacatggtctgtaatagcagagtacttttccccgcaccaggattaccgccaatcaaaatcgcgctgccgggtacaacgccaccacccagcacacggtcaaattctttaaacccggtcgaaaatcgcggcaactcttccagactgatttcagcgagtttctgcactttgctgatactgacctctcccgcgtagccactgaaacgctcactgcgggaagatgaagcggcagccaaacgcacttccgtaatggtattccatgcgtggcatgcggtacattgcccctgccagcggggataatccgcgccacattcgttacagacaaatgccctttttactgcttttgccactctgtactcccttatatggctgcctttggcggccagaaaactcacattaacgctcttcgtgttttaaaccaccgctcaaaacacacagaacccccatcaaatcagcatggcgaatacctactttggcctgcgtatacactttaggttttgcatgataggcaatccccagccccgctttgcggatcattttcaaatcgttagccccatccccaattgccacggtttgactcagtgggatacccagttcttttgccagccgtaccaacgtggttgccttgtattttgcatcaacaatcggccctttgaccttgcccgttaatttgtcatctttgacctcaagctgattagcaaccgcagcaaacagacgtagctgctgacgaagattatccgcaaagaaggtaaaacctcccgatgcaatcgcaacatgccaatccagcgactgtaacttgcggacaagactcgtcagccctggcatgaggggaagggtttccatcacctgctgcaatattgatgcatctgcacctgccagttgagcaacccgttcatgcaggctttctgagaagtccagctctccctgcatcgcgcgctccgtgatggcagccaccttatcaccgacgcccgccagacgggcaatttcatcaatgcactcaatctgaatggcggtcgaatccatatccatcactaacagacctggtgaacgcaggcgtgggatctgccccagaggaacgacatcaaggctgcactcatctgccaaccgtttaatacgtggggaagggctgccggcaatgcggacaacttgataattatcaatacgccatgatgagaccacgacaatggcaattcccagacggtgctgaaaatcgctaatacgctgtttatccaaaccgcggccgtacagtaaccagccactatcccctgcgcgatagtccagcggcatcacttcgtcgccactgagggataacggtaatcccggccatttatggatctcatcgggtaggtaacggtaggccagattattagacatgaacatcgactcctgtaattccgtgtcattttggcaggcaaaaaatgcttttcaaactatcctatcaatacagcatctggcaacatgatgtgttccaaagcatggatggaataacgatgatcaaagcaaaactaaaatttcggctgcacaagacggcgattattttaatatgtatagcactgctggtattactgctgcagggtgtctcctatttcagtcgttctcagcaacaggctcaggtaaatcagtttgaagatctggcgaagactctggcaaaacaggtagcatacagcttgtctgattatatggagaatggcagcaaagatcttaataataagaagattgtagccagtctgaactatctgaccagcaaaagtcgcattttggatgccagtgtttatctggaaaatggcacccagatcgcgcggagcggtgagccaatttctgttcgtgaccggttatcgttagatggcaaaaaatcaggcagctatttcaatcagcagctcgttgtccccatacccggcaaaaatgaaccaaaaggttttctccgcctgacactggatagtcacaggctagaaacagaagccaagcaggtggataatacgacgaatttactcaggatcatgatcctgctggcattggcgattgggtttgttctggcacataacttactacaactcactcccagtcgctggcagcaatcaccttatctcttgaccgccaataccaaatcctctgatgaggatcgagaaaataaaagcgacacctctcgacgctaaccttcttccccaattcatcatttcatctgaattcagcataaccactgaattcagatggtcttctttcctgttttttctgcataaccccctattttcacagataaatgactatgtatttttatcatcacatcatttattactaaaccctgatgttgcagtctgtgaataatcagcaagaatcatattaggcatctttgataatcgtaaggagtcaaatactgtgtcaaacatcatgcaaaaaagtaattacttaacccactcggagattgaaatactactcaaagagttgggaaaacaccctcatgctgaacgaaatatatgcatgatatttatgggctttattcatggttccgggtttctgaattgcttggactaaagctttctgatgcggggggtcaactgatacgccagtggcttgcccaacgtcagaagtacaaaaacagtgagcagaatgactggttattcttgtcgcgcacaggggtacggatgtcccgccagcagttttataaaatcatccgacaaacgagtttacaggccaatttagcggtttgcgcgaatccgcacatgctacgacattcctgcggttacgcgctggcggacaatggcgtggatacccgcttgattcaggactatttagggcatcggaatattcgccatacggtacgttatactgcgagtaatgcgggtcgtttcgggactatctggcaggaaagaggaaaacgaaaattgtctacaattagtaccaaactgttaactgaagatgattggtcctaattttgctatttttaaagttgattattccaacataattaatggttttaatttatattactttcgatataaaacaatctaaatgagtattcaccgaagtagaaaaacaggaaaattctgatgatggagtaaggggatatgacacataaaaagaaggggttattttctacattgtaatcaatctattactttgattctttcggatgaaatgagaataaacggattgcaaaaagtaggataattgacgggttaacagtttggtactaattgttaaccaaataccgtatttaggccacgtattatctgatgggtatttctggcaaaaaaaagccattccgaacaggaatggctttgacttctcgatttattcattctttttctatctgatatcaatataagtccaaaattgtttccgccacaaaagcatattgactcttaacatggacttgggttttattgaagcaatcttccaaaaaccaatcagcaggcgttttcaaagcaatggaaacatcaaccaaatgttccagactgattttattggttcctcgttcataacgcgacaattgctgttggctaacgctgattctgtccgccagctctgctactgtcatcccagcttctttccttttcatttggattcgttttcctaccagcatactgactcgcataatatctttactctcaattaattataacttaataaaactactgcgattccttcatatttaccggcttttggtggtgtgctcgtacgcaatatggatgtcagtgtgaagttttccggttgatttcttcctttcgctttcaaattcatcccttccattgcttcccgcccattaatctgcagtgtggtatacatctgtctgttcgaatccaagtaaatttttgcttctctattcgttgagaaaccttctaatcggaagcttccctcaagagcacatttcacctgccccgtgatcgaacgcgtcgcattattgacatctgatgcttttaatgcgccataagcaatttcagaaggcacagaaatagagcaattctgatttggggggggtaacttaccacaagtggaattaggaaatttttccgctgaaccataacctggagatgttccataggagtaaaacaaccctacacaatcagcttccttactcatgatggtaaatcttgttctaaaaggaatacccagtttccttttataagcccgcattacatctgcagttgtaaggtatcgatttgcatcatccaaacacgcacctgctccaaggcaggaaccatacatacctggtttattgccattattataaaaaacatcaggcccgacatagcattgactgctgccataacaagggtttggtattccttcttcctctgtccaggcaataatttccatggtcgtgacagcctgattacctaatggttgagtatcaaccgccataacataagcgcccccataggcatatgaggcacttaagaaaaacaacaatgctacgaacttcatcagtgatttcttaatatggcgcataatttattcccctaaatagcatcaaactctggctaaaaattgtgagcgaaaaataagtcagcataattactcataactgacttcaaaggtcgcaattgcattgaatgcaccagcaccaatcctattttgttggatagcgcggggttcagcttgtacatacgctcgaaacgggatcacattactgctactggtacgagagagcggaaatttactgactttgttaaaaggaagtggcttgccatcgatgctctccataccaatagcggcaccggaagcacggctgtcagcaccgaatgccagcaatccgggcagtgctcgactctctggccccataaacctgatcttgaggctttgcgcgacacggggatcacactcctccagatgcagttcgaaatgctggcctgaagtgcgatggttctgataaaggtcacggttaagaatacggcccaaatacacctccatcgctttatcttctgtcttaatcacacagggagcagcgagtacagtcagcgtaattttgacattctggcgcagactatcttgtgcataggcacttttctgaccaccaatgccgaaaataaacagggctggcagtacatatttggatagcttcatatttaacggactcattactctttaccccaacatttacccaaagaaagccatcacgatccggttaatgagactttaaatttcccatcagcatgacgactgatgggacgttatccacaaggttcaatcagttttcttcaactgtggttttcgcaaccgtgcagatatcgccattacagctgaatgttagctgtggacgcccgccataatcattgacataggtcagtactggcgcattgcccagcgcactgaggtctcccccgagtttttcactacttctgggtgctagcatcaaaggttgaaaaccatcgatattcttaccattaaccttattagaggcttccgaaatggtgatgtaataagatgtcgggttactcaccagatattgatttgcctgacgggtcaaagtgagtttttcctgccatgggttatcaaggtcgatacggcgagcaatgacggcttccgggcgatagaacaacttaacccgggtttgtaacgcaatttgcagcacattaggtttattgctgcgtggcggaatttcacgcaaattgaaatagaacaggctttctctgtcttgaggcaattcggctattgtcggtaatgtctgaattttgacctgactcttcgctcctgcttcaacacgctgtacaggaggaactaccacgagcgggccattaatcttatttcccttgtcatcttcaatccacgcctgtgccagataaggcaaatcgacatgctggttttcaatattcaagctaacggacttgacatccccattgaaaattacccgggtacgatccaatgccatcgcagccattgcctgataagctggcatcaggcttgtcaccgttatagcggttaccattagaatttttttcattttcattattacttgcccattctcaaagagattcgtttttagattgctctgctaacaacaatactttccatgttaaatcagcaacataatacgccacttcaattcaactttctggcttgccttattgcaatttactgatgttcaccttttaaaaactgacaaggtagtaaaaatgaagtcaaagatgcttcggatatttcttgcggtacagtgatttcacactgagccccgccattccaatgtacctgcaatttctcacctgcattcattccactcagataggcatacccatcatcactgacaatcccaatttcccgttgagcggtgttcatgacagaagcaccgaaaggtgggaatgaaccatcaggcaaacggataatggtcatcgctttaaatcctgacatcacctggaacttccgataaccaatcgcgccttccgtcagggttgcctgttgcacagaacgcagggcttctacgttatccggcaaattgtctaaatcgatgtttgcagaattgcggtaatagtgattaacatccactagcactgccttaccaaagtgatttgtatgaacaacagagccaaatcccctgacgggcacatcactaaccccttccgtatccaccatcaggcgagttgcgccaggaagattgatacgatgcaatgctgcgccatttgctgtcacggtcactccaccttgaagaccaagtgctgcggaggtatacccgccatcctgataactggcactggcagacagcaacgttttatcaccataatgggtgtaataaccatctgcggcagccttaccaccgatgctgctacccgcagagatacgatagttatttcgttcatcaatgcggttgaaataaccagccatatgcgaattaccctgacgattggccaaaccgttatagctaagtgttccgctctctccccacggaatagacagattcagatacacgccatcatcttttttattgtcaaaattgttgcgataggcggataagttcacattgatattcttataacgcccaatatccaaatatttggacagcgagatgttatagcgatcatttgttggtctgttccagtaggtctgatggctatagttaagatgggcattaagaccaagatccttaaattgtttactgaaaatcagggtataaagttcttttccactatcagagttaacatcgcggtaacggcggtcgatatattgcgccatactcataaaattacgctcggagaaacgataccccgcaaaggtcacctgactattgtattgctcgaaacgtttcgaataactgagacgatatgaaccacccgtaaaggttttattctctttcggtagtcttgcccttgattccgttatgtcaaaagacagcgcaccaaacatcatcaagtcacgaccgatccccagagacaaggcgttgtaatcccctgctcccagcaacccgccatacaatgaccagccgttattaatcccccaggagaattcgcccaacccaaacgcgggcccttcccgacgatgtttgtcattggtcgattgcccaccgactaatttatactgcacgcgtccggggcgagtcagataaggaactgtagccgtattaacctgaaattcctgtatgccaccatcctgttcttctactctgacatccagatttcccgttactgcatcactgagatcctgaatgcggaacgggccgggagcgacctgagtttcatacagcacccgtccctgctggcgcacagtaaccttggcattggttctcgcgactccggaaacttcgggggcgtatccacgcaagtttggcggcagcatattgtcatccgtcaccaaactaacccctgtataacggaaactatcgaagatattagaattcagataatcttccccaaaagtcaattgagcttgaaggcgaggtatggcgcgatacaggtagtaacggctccaatcccagtcacgctctctttctccagaagctccctgcttattatcctttttttttgtccggttataattagcctgccaatcagcccgaaaacgccatgcgcccgcattcatacctgctgttccgttggcactcacctgctggttgctactgccatgggtgggtttagatgtctgcgcattgacgttatagtcaaacaatactccaggtacaccgttatcccagcgggaaggcggatcccaatccggtaagtcatattccagatagatctgcggaacaattaaatacagagtataagttgccagatcccctctggctgacatgcctggcaaactgccgagatcaagacactttccatcattctgccagcctaatttttctgcccactcctgtttcagagctatttgcttcaccagttcaggggatatacaggcttcgctgcttttagggtcatcgggttgtggggtaaaatcaatcgaatacatgtccggaaattcatttttattcatccggacacccataatatagttaccaggcatgatatagcctgcgcgggagaatttatccaaatcgatattggcacgttcaccgacatccagcgcgtcgatattgaattcaattgatggattagaatatgctgtttgcatacccgccagtgcaaacaataccaatgccgaaagaggtttaattctattttttaagcggactgcttttattctattaacgactttcgctttattatcgattatttttttattagcgacgttctctttattaatgttgttttttatattaatagctgaaaaatgatgattcatggaatttgaaaacaaagccatagcaccctctgaacgatgaatcgttaataatccaatttgaatttagccgctgcctgatgctgccaaacgagtgagaatatagggcttctcacctgatacatggcattattaaatttcatcgatctaaattgaagatctcgaccgatactggtgtcacagaggttgccatatgtcctgcttatccgtaatatctcacgctttctcttctttgtgctttactgattttaccgtacagcgggaagtagaggaaaaatgtcactacaggtatgccattaaaattacattaaaatggctaaaagcctgattttccgagtacagccaattagagagaatgccgttggttaaataaataaaaaagggtatttcaatttacgtctatcatagataattccattaatggcacacattgatgacttaattttcaataatattaacttaaatcaacaaaacagatcctgctacatcatattgtagtaatgttctgctaacgtgttatatccgagaaataccctgaataagctatcaattatcaggaaacctataataacaataggcagttagtttcctgatattcaatgactaaaaattacccgttaactcataatattacaggtagtttaaagtaaagtttgcgatggcagtgaatgtacctggtttgatttcactgtgctgatttttaccatctactccttgtgctgtggtaaggcctttcaagtgtgcggcgaaattcagagcattgctaccttcatgcagagaaaatttatctgattctgtacccagaggaatgattttaccgcccgcattggtaatggcaattgcagcaccagatccagggccttcaatgcctaataaacctttctcatcagcttctgcaccagtaaaggttgttttcacaccgttttgagttttagcagtacagttttgtaattcaattttgaacgctttcgattctgaacggccaccacctttcaggatattgctagaaaccgcgcccagattaacatcaatattagtgtttttgattgaacaaggtgcatcaataatagaaccgctgaatttaactgttccgctaccttggttaactgcgcttgccgcaccagccgtcaaagcgacaccaaaacccagaaccatcgccaatttattaagtttcataatttaacttttacctttaatttaaaaatatagatactcatagccaacaggaagccgaagcacagaaattaatttctgacacttaggcgaatgattatttagttttttgacgtaatgaataacatgtcaaaataaaccaaactggcaatatcattctacagaataagtcttaagtcaaatttcaggtaataaaactaaagatctgcgttaacttcatataaaatatgagtttttataaaaaagtacgtggaatgagtagtatattttactaataattttttaaatttggattattagcctgagttatatcaagcaacgatcagtaatttaggatcttagtttgcgttgctttatcattcaattttgccgacctgacagaaaaaaatattttattatatcgacctaagcctaagttaaggtttttattatggattttatgactttagttaaaataaaaccaaaatatttacctaattaagataattatcaagctaattaccaatttaaaatatcactaaggttaaatagttttaattttgttaaatttaattttttcattcattttttaagcaaattattccgaaaagaagtgcctattaaatgaaaaggtaaaacttatctttaacaaaaccgaacacatcaacacaaaacttaataaataaaaaagccctttccaattatggaaagggctttttttattaataaaataataaaattatttattattttttaattatcacctaataaaattgattcaagcgcaatttcaatcatgtcattgaacgttgtctgacgctcttctgccgaggtttgttcacccgtacggatatggtcagaaacggtgcaaattgctaatgccttagcaccaaattctgccgctacaccataaattcccgccgcttccatttcaacgcccagaacgccatatttttccatcacatcgaacatttgtggatctggtgtatagaacagatcgactgaaaaaatattaccaacacgagcgttgatattcttcgccttagctgcatcgactgcattgcgaaccaaatcaaagtcagcaatcgccgcgaaatcatgatctttaaaacgcatgcggtttactttggaatcagtacaggctcccataccaatcacaacatcacggattttgacatcgtggctgactgcaccacaagaaccaatacgaataatctttttaacaccaaattcggtgatcaactctttagcatagatagagcaggatgggatacccataccgtgacccatgacagagatcttgcggcctttgtaagtaccggtgaaacccagcatgccgcgaacatcgttaacctggcgagcatcttctaaaaaagtttccgctatgtattttgcacgcaatggatcgcctggcatcagaacaacatcagcaaaatcgcccatctcagcattaatatgtggggtagccataaatctattccttatttttattacatatcaaaacaggtgaatactaagacagccaatcggctgtcctgaaaaatcagaacatcactttaccgtaatccattggcgtcaggtcgaaatatttcgccacggtctgaccaatgtcagcaaatgtttcgcgatgtcccaatgagccaggtttaaccttcagcccataaaccagtacaggaatgtgctcacgagtgtgttccgtacccggccaggttgggtcacagccatggtcggccgtcaggatcagaatgtcatcttctttaaccattttcagcatttctggcaagcgacggtcaaacaactccaacgccgctgcatagcctgctacgtcacgacggtggccataagaggagtcaaaatcaacaaagttggtaaatacgatggtgttatccccagcctgttccatttcaaccagtgaagcgtcaaacagtgcatcaattcccgttgccttgacctttttggtgataccgacgttagcataaatatctgcaattttgccaatagaaacaacttcaccctgtttttcgtcaaccagttttttcagtacggttggcgctgggggttcaaccgccaaatcatgacgattgccggtacgctggaaatcgccagccttgtcacccacaaatggacgggcgatgacacggccgatgttataatcacctaggttcaactcttcacgagcaatttcacagagttcatacagccgatccaagccgaatgtttcttcatggcaggcaatctggaacacggaatccgcagaggtgtagaaaatcggcttaccggttttcatgtgctcttcgcccaagttatctagaatgaccgtaccggaagagtgacagttacccagatagcctggcagattagcgcgttcaaccagtttatccagcaattcttgtgggaaactgttgtctaattcctggaaatagccccaatcgaacagaaccggaacacctgcaatttcccagtggcctgatggtgtgtctttaccagaagaaagttcactcgcataaccgtaggccccaataatttcagcatcctgatccaaacctatcgggaagatcccgctggattcctcggttgctttacccaaccccaaacggctcaggtttggcagctgcaatggccctttgcggccgatatcagcctcaccacaagcacactgctctgcaatatgccccaaagtgttagatcccttatcaccaaatttctctgcatctgcactcgcaccgatgccaaaggaatccaataccatgatgaacgtacgtttcataattttctcctgcgtcagtcaattcacgctatcaatgcggaaactgtcggctgttaaaatctattttcattattcatgatgatttagccatcaatgtggcggtaaaccatcggtgtggcggcttttgtttcggtactcacatcaattcccaaaacgatggacttacgcacgacctccgccgcttcctgccaatcattttcgttattggcataaatcattgccagaggagtatctgcgttcacttctgcaccaagtgcaacaatatcactcagccccacactgtaattaatgggatcagtggccttgtggcgaccccctcccaatgcaaccacggacattcccaatgcccgcgtatccatttcagtaattatgccattttgcccagcaaacaccggtttgctaaaagaggcagccggtagataacgagcataattttcgacaaaatcgatcgggcctttttgtgctgccaccatacgctcgaaggtttcagccgccttgccattgtctagcaccgcctgcaatttacggcgtgcttcggcacgatctgccgccagattacccgataccagcatctccgcagacaatgccatagtgacttcaaataaccgaggattacggtattctccagtcagaaactggacggcttcacgcacttctagcgcattgccggcgctggaggccaaaacttgattcatatccgtcaacaacgcggttgtcttgcaacccgcaccattagcaacgctaacgatggattctgccagttgttctgactgttcataagtcggcatgaatgctccagagcccactttcacatccataaccagcgcatccaatccctcagccagttttttgcctaaaatagaggccgtaatcaaagggatggaatcaacggtggcagtaatatcacgagtcgcataaaaacgtttgtccgcaggtgccaacgaattggtctgcccgataattgcaacacccacatctcggataatgtcacggaagcgctgttcatcaggaaagatgtcaaaaccggggatggattccaatttatccagcgttcccccggtatgccccaaaccacgtcctgatatcatcggtatgtagcccccacaggcggctaccatcggcccaagcatcagggaggtcacatcaccgacaccgcccgtcgagtgtttatctacgatcgggccatgtaaattcaattttttccaatccagaaccgtaccggaatcgcacattgccaaagtcagtgccacacgctcttccatcgtcatatcatggaaataaatggtcatcgccagtgctgcgatctgcccttcagaaacggtattatcacgaactccgttaataaagaaacggatctcttcttcactcaaccggtgaccgtcacgttttttgcggataatttcctgtgccagaaacaaagcgacctcccaatcatcattatctgaaaagaatggcagtaatgcactctatcttaatatgcattcaatatgtggttattgatctcaataaccactactttgcttttggccttggtgtccaagcactgtcaacaaattgcccaacagactggaagcaccaaaacggaaatgacgggggtcggcccatttgtctcccatgatacgcgcagacagtgccagatattgtgcggcttcttcggctgtacgtacgcctccggcaggtttaaagccaacagtttcacctacccccatgtcgcggatcacactgagcataatttctgcgctttccagtgtcgcattgacagggactttacctgttgaggttttgataaaatccgcacctgcgttgattgaaatttcagaggctttacggatcagattctcttctttcaactcacccgtttcaataatcactttcagccagacgccagatgcaacgcaggcatctttgcaggctttaactagatcgaagccaatctgttcattacctgccatcagagcgcgataggggaaaaccacgtcaacttcatctgcgccataagcaatggctgcacgagtttcagccagtgcaatatcgatatcatcgttgccgtgtgggaagttggtcactgtagcaatgcgaatgtccggagtaccctgttcacgcaatactttacgtgcggcaggaataaagcgtggatagatacagatagcggcagtatgacccaccgggctttttgcctgatgacaaagtatcgccactttctcatccgtatcatcatcattgagtgtcgttaaatccatcaaactcagcgcatgctgagcagctgcggttaaatcggtcataaaactctccaacggtattattatcgtgactgaacccgttcacacattgttttgaacgattgttttgaacgattagtgagttcgtttgttggcgagcggacttggttccttgaagatgttgccatagttatgcacaacagcaacagtagagttccttctctccgcactatactttcttcagcttttactgccccggcgggcaccaacttaatccatgaagccttggcacatcattatttgaacatgtaaataccgaataatgcgtaccataaatcacactaatcgaatgaaaattgcaatgataaacatttttttgtgattcatatcacatcgaaacagtttcagaaaaaacaaaagcaggtgagattatctcacctgcattcaatttgatacgcgattcctgcttttataacgcgaggaagaacccagcaatggttgcactcatcaagttagagagtgaaccggccagtacggctttcagaccaaaacgtgcaatgtctccacgacgatttggcgccataccgcctaaaccacccaacaaaatagcgacagaagacaagttggcgaagccgcacagcgcaaaggaaataatcgctttggtatgatcggaaagcacttgcagacctgcggcctgaactacctcgttcggtttcagatattcgccaaagttcatgaacgccacgaactcattgacgaccactttctggccgatgaaagaacctgcaatagtcgcttcattccacggtacaccaatcaggtaggcgattggtgagaacatccagcccaaaatcagttccatggacaattgaggatagctgaaccagccaccgataccacccagcataccattcagcaaggcaatcaaggcggtgaatgccagcagcattgctcccacgttcagagccagttgcatacccgatgccgcacctgatgccgcagcatcaatgatattggcagggcgatcttcagccgcaatcagcgacatgacatcatcggtgtcgcgtgttttttccgtttccggcactaacagtttcgcaaatagcaagccacccggtgcagccatgaatgaagcggcaatcaagtattccaatggaacgcccatcgatgcgtagccagccaatactgaacctgccacagaagccagaccaccacacatgacagcaaacaattcagattgagtcatggacgaaatataaggacggacaaccaacggcgcttcagtgtggccgacgaaaatatttgcggtcgcagacagagattcagttcgtgatgttcccagcagcttttgcaggccaccaccgattattttgatcacaatctgcataacgccgatgtaatacaggacggcaataagtgaggagaagaaaacgataacaggcaggacgcgcagagcaaagataaaaccactgccgccgaacagttcaaacattttgtcggaaaccagcccgccaaagataaaatccgttcctttctgaccgtacccaatgacgttggaaacgccttttgacattccaatcagaacgtctttacccgctggtacgtaaagtacaaatgccccaatagcaacctgaatcaaaaaggcgcccaagactgtgcggatcttaatagctcggtaattactggagaaaagtactgcgataaaaatcagcactaccatccctatcaggctcataatgagttgcatcggaagaatccctgttcactgaatgaatgaataatgaaaaaatatgccagttatattgtgagttcctaccggcattgtgcgaggccgattatacctagtagtaaaaaagaacaagcaactaacatcacaaattaataccgcaaaaagtaatataaaaacacaaaatgagacatagatcacataaaaccatctagtttctaagggattagatgattttgcggtgaaaaaggtaaaacaagggataaatgagtaaagaagaccaattaaggattattaatatttatttaatacgaatgctcacttcctgttaccctaaaaaaacatattatttctgtggttataagtcagcttaacgcaaatagtgccatgctgttgtgataaatctggtcggccatttcatcaggagattctcgacgcaattcacacaacacagaaaaaacctgtgcgactctttctggtcggttcggctgcccttggtatccagagagtggcatatcaggcgcatccgtttccaacacaagggacgacagaggcagttgggaaattgtactgcgtgttttttgtgctctcgcgtaagtcatcgttcccccgacaccaatgtaaaatcccaaacgaataaaaacctgtgcctgaggcaggctaccagcaaagccatgaataactcctgtgcgtggtaagtcatgtcttcgcagtatggtggccagttgatcatggctttttcgggagtggagtatcaccggcaaatcgtgccttttagccaacgctaactgcgcttccagcacccttttttgtttctcaaactgtggctccggcatataaaggtcaagccctatttctcctacagccacacatttgggatttttttccttcagcttctgcgccaactcatccaaatgagaagcttgatgctcattgatatacagtggatgcagaccaaacgcagcatagatggaaggatagtcatatgccagcgtagcaacccgctgaaaattcatttgactaacggtggggacgataatggtgtccacccccgcttgcctggcttgtttcagactcgtttgttcattccctgcaaaggggggaaaatcaaaatggcaatgtgtatcaataaacatctacttatccacgtcatccaacataatggcgcctgtcagcggtgtcataccctcttcctgcacttcgattaccggacgatttatgctgtccagcaagctatatcgcctgaagccatcgtgattaacctcatcattatttaaaccactgcgacagacaccataacttttacgcttttccagcccaaatttcccaccaacgaaggtatgcccaatggtagccaaaaagtatcgcccacaacgccgccccaaatggtaatcctgatttaatgcactgattcggcttcccaatgccatcgtagccaatggcgcagggggataaatttcgaatacctgcacatcatccggcgggttttcgataaattgctgcgtccggctgtaactcttagcatggagattgatcattttgaccatcttttgcaggctactggcttccaaccagcgctccatccgcttgaaccactgcggggtataataaagctgtgaaggcactgtcctgatcacgacaatcgtatctgcgccacggcgataagcttcttgtaccggaatcgcgtcacaaatgccaccatcctgataaactgtgtcaccaagggtaacgccattgcgataaaaccccggaatggcgctggaggctttcaagatctccatccaattatgttcattagggtgaaaataatcaggttcaaagttatctgcgcggcaggcacacatgtagaattcacggccagcatcaaactgatgcatcgcaacagaggtattcagcggtaattgttcagatatagtatcaatataccaatccagatcgatcaaatgcccgccacggacaaaacgcagcggattaaaaaaagtgggtgcggttgtgtaacgattgatcactctgcgggcatagccccgctgaccacaaatatagggagagatattctgggcacccgcggaagttccaaggaacaattcaaacggattaaagccaagccggaggaattcatccaaaacacctgcggtaaaaatcccccgctgcccaccaccttcacaaacaagtgcaatttttcctggcttgatctgtgatttataagctaaaggttctatgttacccaacgttattggaatatgtttccccacacttcctcctaaaaaatcaatgacagtgtcatagagtaatctgaataatgactatctatcagtatattgttgttcaaacaatacgtttgtaaaattttcgttaaatagtgaaaaatagagcgtaccacaaatactgaagctatattatgaaaaaaggaaagtaaaatccccctgaggaatcgttttcccacaggagttttagaggatactgattacttacaatctggtgaaatgtaaagtaccgaagtgtagctatacacgaacgggactttacatacctaaaagtattttacccgttataaaagtgcttaaccaagtagcagtagcatgacttccctgggaagtcattttataatgacaagaaaaagaaaaaaagaaggcattttccgaaaataatttttaagacaatgaactctaaaaatattagcgttacatcaataaatttatatcttcggtgagaaaaaaacatctggtattactattgataaatataatactatatcgcccttcaagattatttaattaaatatgatataaaatgcataataaatcaaattacaaacaataataaatcattaaaaatatacaataaaaactccatttaatatattattagattaattatttattaaagattacgaattttaattcttaatttaataccaaaaattcgacctatatttatattatttattgataagtggagatttaattctgaagcagaaaatataaataaattcctaatggatataaaacagtaacaataaaaagagtggcctattagcagccacccagtcaattattaagattattttttaacctttaatgtgtttttcactgacttgacaccatgcactttatgaacaattttggctacttgtttagcctgatatgtgtttttgacaaaacctgaaagatgaacaatacctttttccgtcttcactgaaatatcattgctatctaatcctttagttttcagtaaatccgcttttacttgcgcagtaatactgctatcgcttacataagcgtctgcgtgtttcaaagagttgtcaactttgctgcttacactttccaatgtgctagctggagatgttaatgcagccagtgcgttactacttatcagaactgaacctaaaacaatagccagtagtgaatgtgtaaactttatgtgtttcatcctatcaccttccgtcatattatgtgggtaagaacagcaccagaataatatatcaccctatgacataaatgaagtaggatttacaataaatcacgaattttttcactaaaacagattattgttctttatatagaaaaaatacagaaagaggttacaaactgacaagggtcaactatttgttgaccctatgatataaaaagaattagtgttcgcgtgttttacggaaagaaatttcgggataacgttcgctggttagatttaaattgaccattgttggtgcaatataagttaagttatcaccaccatcgagtgccaagttcaattcattcttacgcttgaactcttccagtttcttcgcatcgttgcactctacccagcgagcggtggaaacattgacggattcatacaatgcttcaacgttgtattcgctcttcaaacgggcaacaacgacgtcaaactgaagcacacccaccgccccaacgatcagatcgttattagccagaggacgaaatacctgtactgccccctcttccgataactgaaccagacctttcagcaattgtttttgtttcagagggtcacgcagtcggatacgacggaataattctggcgcaaagttaggaataccggtaaatttcagttcttcgccctgggtaaaggtatcaccaatctggatcgtgccatgattatgcaagccgataatatcccccgcataggcgtgatcgatatgagagcgatctcctgccatgaaggtcagtgcatctgaaatgacaacgtctttcttgaggcggacttgacgcagtttcatacccttttcatatttaccggaaacaacacgcaggaatgccacgcggtcacggtgtttcggatccatgttggcctgaattttgaaaacaaaacctgtgaatttttcttcctctgctgtcacttcacgcgcatcagtcagacgaggcattggcattggcgcccatttgacaaggccatccagcatatggtcaacgccgaagttacccagcgctgtgccgaaaaatacaggtgttagctcaccctgtaaaaaggcttcctgatcaaactcatgtgatgccccttttaccagttccagctcttcacgtaattgattcgccaactcttccccaacaaccgcatccagctcagggttattcaatcctttaatggcacggacttcctgaatggtatgcccttgaccggattgatacaggtaaatttcatcaaggtaaagatgataaacccccttgaaggatttaccacagccgattggccatgtaatcgggctacaggcaatcttcaactcattttccacttcatccatcacttccatcggatcacggatatcgcggtcgagtttattcatgaatgtcaggattggagtgtcacgcagacgggtgacttccatcagcttacgggtacgatcctcaacacctttcgcggcatcaatgaccatcaggcaacagtcaaccgccgtcagagtacgataagtatcttcggagaagtcttcgtgccctggagtatccagtaagttaaccagacaatcatcataaggaaactgcatcacagaggtggtaatggagataccacgctgtttttccatctccatccagtctgatttagcgtgctggttagagccgcgaccttttaccgtccccgctttctggatcgcctgtccgaacagtaatactttttcagtaatggtggttttacccgcatcggggtgagaaattattgcaaaggttcgtcgtttcgcgacttcctgctggaatggaaaatttgacatcaattaggatcttctagtctatacgcggattgatattattagggaagcgccccgaacgacccttcgcctgcaaatccgtcatgttaatcgtgattggggcttattttcgctgaacttggatttataaacaatcaatgattatctggctgagtgctatcatctttttcactcatggcgcggcgaactcgttcaacgacttcaggagtgacagacccctcggccagacaggaaaagtcgcatattttctgacaacacaaagcaaacgatgaacaaaataagttcataaatcaaccagcaaacagaggtaaagccataataatggcatcttcctttcccgtcgccgttgggtaataattcttacggatagaaacttcgttgaaacccagatcttcatacaaaccaatcgctgatgtatttgaacttcgtacttcaagccatagcgtattaatctgcttttctggcagcacattgatcaggtgagtcaacaacgctcttccattcccctgcgattgatgctcagagtggatgacgatattaaatagcgtggcctcatccacaacacactgtatgattgcaaagccgataatctggtcattcagcgtgattttataattcagataacgctctccctggttggagtaaaaggttttttcactccacgggaatgcatgactgaactgttctatttgaaatgctgcgggaagatcagcgggagttaatagagaaatattcttcataatggtaaatttgttgccaaagagagcgttttgcattcccgtcaagggataagtcatttaatgctgggcttctcaaagaaatcccttgtattgataaggtaatatcaacccccaacagccagcatggacaatggattgattctgaaagcagctcaacatcttttgtcgtgatgcaataaaccgatgaggcatcaatccccatggctgtaaaaatatcagcaaacaatgaatgacttaaatcaatatgatcatgggtaatgatcaacagacgagttgagtcagggatgaggacagacaattcaccttgcaaggccctcgggctgcgcacaacccactgggtgatccccaattgggcgagtaatctgtcacgcttcgtcatcgtgttttattccatctgccataaaaaataacaggtaatatactatcagagggcttatctctacgccaatcagcatagcatcacaattttgccctccgatgtttatacttggataaagatttataaggagctatacatagatgtcagtattaaccccggccagcgaagttatcctgcgccaccatgagcaattcatcaaccatcacctgctgcttgccggtgatcttcaggacaatctggcaacggaaatcgaagccggaagtgtgcgagtacatactaaccaatatcaccactggcaatccctgatccgtcaactgggtgacaatgcctcttttggcctcgttgcggacagcgcatttgtcaaagggtgtgatacattgatttattactggccaaaaagtaaacatgaagcgcgcttccagttacgcagcctgttttccattctgccgcccggaaccggtgtttttgtggtcggcgagaatcgcactggtgtacgcagtgttgataaattaatggaaggtattgtgactttccagaaagtggatactgcccgccgttgcagtctcttctatggtcaactggaaaatcaggttcaatttgatcaaaataattggtggaacagctatcaggtaggtgatgtcaccgtcaacacgctgcctggcgtattcagccaagatgatctggatgtcggcagtcgtttgttgctttctacttttgatggccctgtttctggtagtctgctggatatcgcttgtggctcaggcgtattggcagcggttctgggtaagaaaaaccctgatttgacactgacactgagtgatgtcaatgccgcagccataacatccagcaaggccacactgaaagccaataaactggaaggcaatgttgtcaccagcaatgtgtattccgctattgaggaaaaattcgactggatcatttccaatccaccattccacgatggtttaaaaaccaatttagccgcggctgacgacctgatccgcatggcgccaaactatctgaagtctggcggtaaattgcggatcgtagcgaacgct

SEQ ID NO: 16856 - DNA, 1043 bp, Xenorhabdus bovienii
  unsure (1)..(1043): unsure at all n locations
cggcgacgtgcacggaagcgaccgacgccgcacacacgccgcgagcgattgtcacgaacggaacgaccgcgggaagaacctactcccatggtgggagacggccagcgggaatcgacccagaagatcgcgcgagtgtggcatatacgaaaagtccataacggacgagggagcggagcgcaacaccatntctcatcttgacgacgcgccgagctaacatagcacaacaccaggacgggaggaccgcacgtgagcggtcatagtctcgggtaggatctcaacatgcaggagactacgcgagcctgtctcatcatccggtcgcctcactctgcccctcactcccgacgctccgcgcgtggccttgcccgcggccgccacaccggccgtgggactatcccgcagagggagagggggggagcattaccatagacctcggtgggcgacccccaaaacctgctcacccggggaaccgggcgcagtcctcggcgattgtcaccgcgagaccaccatacatacaacggaggaagcagcggcgcaccattccaagaccgcaacgagtacaacgcctatccccaatgcagcgacctgcccgatcacaccccagacacgcataactccgaaaagtagcacctatatatatcccccccccctcttatgcgacataaaccgtgcgcgcttatctcccgccgggacaaaggcgtatgggaagaactgcttgaagaactcatctttgaacccgatttcgaatggctgatgattgacgccagtcatattaaggttcatccccacgccgccggcgccgcaggaggcaatcaggatatggggcgcacaaaagggggctcaatacaaagatacatctggccgtggatgcgcatggtatccgatcagagcgcttattcaagcggtccacagcggatgctccaagctgaggccttatgacggaacgatcagacatttattaggaatcggggctatacagtaataggtctagggatcccggatgcnggctaattcgtaggttcggccaacacctgccngccggccct

SEQ ID NO: 16857 - DNA, 998 bp, Xenorhabdus bovienii
  unsure (1)..(998): unsure at all n locations
aggggcatgcccccccccccccgccggggagaaaaattatctcccccccccccccctgcgtttttgggggggggggagaaaaaaaaaaacccccccccctgccgtgttctggattttacggaggggcggaccctggcgagagtttaccgcccgattatggcgactggaaaaatacgaatcgccgtttttgtcggtggcgggacaaaggcgtatgggaagaactgcttgaagaactcatctttgaacccgatttcgaatggctgatgattgacgccagtcatattaaggttcatccccacggggggggggcggcaggaggcaatcaggatatggggcgcacaaaagggggctcaatacaaagatacatctggccgtgttcccgcctggcatgcccgctttagcgctagtgcccccccaccccccccttcgccccccccttcctgctctccccctcccccgggggtgcgccccgtttctcttcccccctttgtgcccctccccccatccccccccccgtccacccgacccccccggcatccccccccaaacccccgcccccaaacctcggccccctcgcccagatcccctcgggccccctcccgccccacgccccccacccgaaacatttcctgtctcatctccaacccccccggggtatagcgacccgtcatgccaaaaatagtgcctcatttcttgctactgttcagatccgctgtcttgctcttgcgttaaatgtcttatcacgacaccatctagggacctatccaaaattttatacacagatcnnnatnnnntccnnaaaattcaactgaggctannnnnnnnnnnnnnnnnnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16858 - DNA, 1014 bp, Xenorhabdus bovienii
  unsure (1)..(1014): unsure at all n locations
gtggtcttagacatttanccaaaaagccaagccaggggttttaaccgatgccaaaaatgaggcccctatttgaggcaaaacgcggcgctatacctcgcaagcgaacaaggggagtatagcattcccggctaaccgggtaagtccactaagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctagcgattcatgtgtatgtaaagataggctgagttgaatacaggacctgcaggcatgctcagttgatacattgtaaagaaagtttaattcactagtagcatgtttatattgctggaataacctagggtaagcccgaaaaattggaagcatagcctcatccttaaaacaagccaggaat

SEQ ID NO: 16859 - DNA, 909 bp, Xenorhabdus bovienii
  unsure (1)..(909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatttctctgttaattactccagtaaatcaattcacggattcagaaggcgattagggttacgcaccgggcgaacgggacaatatccaaaagggcatatttctcataatgcgggaactaaagggttaatgaagcgtaactcaggctcattcaaatcaggaagttcaccccataatatgtgcccaataggaactgagagaattagcaaggatggctatgtttatataaaagtggacagacctaatatatggagattgaaacaccgtatgatatgggaagagcatcacggtaaattaccagcaggcgctattgttattttcaaagatggtaatcagaaaaattatcagattgataatctacttatggttacccgccgggaaaatgtaattttaaataaattttaccccaacacacctgctgagtataaacaaaccactacgtatttagcgcgtataatgatagcaattaataataaagagagagtgatatgaaagtcacaatcgaagtaccgaacaagaaagaccttgatatggcatttggattagtcacagatttcttgaagcaaaaagataggaaagtaaatgaatctgcgttctttactattaacaatgaacgctcgggacgaatcagggaatcacataaaggcaatatcacgtgtcgcatccatgactaacgaattcgagaacgggaagagtgtcggttgactgcttatcgtcaaccgttttacaaattaaagcgaattttcaaccgagcannnnnnnnnnnnnnnnnnnnnnnnnnnnnnn

SEQ ID NO: 16860 - DNA, 135663 bp, Xenorhabdus bovienii
attcctgtccagcttcaacaatatctttgttattcaacatatcatacccatcttttgttacctcaatagtggcttgatgtgttggccttggagttgtcgttctatcataattggctccgtcaatgctaacccatttggctcttctatcaggttttccatttgtctcacccggaactaatcctcccgcattttttgttttttctgcttctgttgcattcatatttcgagtaacagtgtaggttttatctttagctaaaccccaaggatctatccaactcattgggtttggtgcataaacgtataggttcaatccaccacttaatcctactggatctggtgttataaaccttccaatctccggtgcataataccgataagtattaaagtgtaaccctgtctctttgtcaaaatactgccctgaatagcgaaagttttggtcaaaactctttgatgaacgttccgtatcggtaaaatacgccattgtagtgctattgaccgccccaaatgcatcatactttcctgaccacgcaatctttctttcttcatccgtgacttccagtggtgctccattgatatccgcgtgataccagaaatactcacggatgcttccactagcaacaatgcaggctaacggcgtataactttcatgagactcgtaacaatatgtgtgggttttaccgatattaacattgtgttcctgcaataatttctgtccgtgccaaacaaattctgtttgctcttgctgtggtatgcctgtgggccatgtagtgaccaccttacgaatacgccgaccaagggcatcataatggtagatagctttcatgccaccaccttccgaaagagtcagacggttatccccatcataacgatacgtctgcctgttccctctacttgttccacgcatgatgacattaccatgctcatcatgtttgtagctccactggttccactgtatcagcctgtcaccttgtggtgtcagatgcttgctctctttcgattcatgctcaatcatggattgtggacgttccaacaaattgtctgcacggtcgtaccacagcatttcttcaaagctgtccacgctggtgacttttttcaggcgactttctgagtcatacagatattccacccagccacgataatgatcttccatcagagacagttcgtcctgcccatcatagtgccatgctcgccacggtttgccctgtccaatagacgctgatttatccctgacactgtattggctaatgcggcgccccaatggatcatattcacggaactgaaataacttgcactgtgttcgactgatttcacggtgcaaattgtcacgttcaaattcagtgataatttgctggttatagcgcactgcactgagatggccggagccataatagagccagcgcagggtatcaccttgcggcaaagttagctctgtcagattatccatttcatcgtgattaaactggagtacatttttgtcattttgttcccgaataacccgtcccagctcatcatattcaaaactaatcgtattcggcagcagccctagttgttttccagcagtattagggtcacgactggctttcaacaaccgccccattttatcccattggtactggtagctatcagtactggtttctcgtttgataaggttgcccgcagcatcgtaatgaaaataaatcgaatgaacaggttgtcggaatacacggtcgcccatgcgtttttcaacacttaacaaaccagccatattgtattcatactggattaaggtatcgtcaggacgaatttcttcaatcagacgtccttccgcatcacggttcagcaaataacgcccaccattggcattctcaatctgtactaaatgtccttcggagttatattgatagcggttctggcgttgcatacggtcagttatacaaacggcttgtcccaatgcattgtattcccaagaatagggcgaattctcattacgctggtgatgggtacacacgtttggaatgaatgggaacccaaccagggagcagatgagaaaattagaatcataccagccaattatggcaaggcaattgatgggattaccaacagaatgggacgcctccgcgcctacggaaatgccatcgtcgcaccggttgcggaagaatttataaaagcttatatgcagggggtttaaataacagtcgaatatgcagtagcaatccataattccactataaattgctacttattgacaagtatcaagtatgtccacccacttggcgaacattaactatttcaccctctattgtaaataaaactctgtgatccttactaagtctgatggtgtattgttctataccactcgatgtaccgcccaacattttaaaattacagccacctacatcctctgcagcgtcacgtgggtgtctattacttgctgttatagttctcacccattcttcatatttacgttcggccgcaggtggtatttgtttccatgtagcacgactgtcgtcaacttcccatgccatatatcacctctatttttagatggtagtttgtaaatactaattcgaatgcgttttttttaaactatcaaattttgtatgcataccgtactagagtaataaacaggagagccaaaatgagcaataatttgattgagaaaataaatacaacattggaatcagccgaggaatttaaatcggaaggtgccagtataataacattagatttggatgtctatattacaatattaaaacgtctggccgaatatgaaaatatggagccaattgccatatataatttagctgatggtgagatttataaaagcattaatgatataggcgatggaaaaagcgtattcgcagtaaatctataccctcaccccaacaaatagagaaccctcatggatattatcgacacagctaacgatgccgttgagttgacggtagataaagaatatctattcgatattggcaatgaaaaattgaggaaaatagcatgaagaataaattggaagatttgaataaccatttgttcgttcaattagagcgactatctgacgaaaatattctgaatgaacaattggaaaaagaatttcgccgtgcaaaatctatttcagacattgccatccagatagttaacaatgggaaactggcacttgatgttaaaaaagccatcggtaatcaagacgtagattctctacctaaatttctaggtgggtaaaaatggctcagtttaaatacactgataaaatgaaaaattggatgaggatttattacggtttaccagtgcaagaactgactgctaaattcaatgagcatttctctgttaattactccagtaaatcaattcacggattcagaaggcgattagggttacgcaccgggcgaacgggacaatatccaaaagggcatatttctcataatgcgggaactaaagggttaatgaagcgtaactcaggctcattcaaatcaggaagttcaccccataatatgtgcccaataggaactgagagaattagcaaggatggctatgtttatataaaagtggacagacctaatatatggagattgaaacaccgtatgatatgggaagagcatcacggtaaattaccagcaggcgctattgttattttcaaagatggtaatcagaaaaattatcagattgataatctacttatggttacccgccgggaaaatgtaattttaaataaattttaccccaacacacctgctgagtataaacaaaccactacgtatttagcgcgtataatgatagcaattaataataaagagagagtgatatgaaagtcacaatcgaagtaccgaacaagaaagaccttgatatggcatttggattagtcacagatttcttgaagcaaaaagataggaaagtaaatgaatctgcgttctttactattaacaatgaacgctcgggacgaatcagggaatcacataaaggcaatatcacgtgtcgcatccatgactaacgaattcgagaacggaagacggcaggtggcaagggagtgccgaagcgaattattcaaaatcaagaaacgcaccgaccagcaaaccgcaacaatactcactcagtacctaccccgatttgaaaccgctatgtcgccacatcaaaagagcaaattcttgcctgtgatgtggctgcgatactacgtagatatgattgataaggagatgaagcaatgaggctcatcactgataataatgagatagaaagcataactttatccagaaagaaagcggcagcgctcatagggattgatgtggacacattatccctatggtgtcagataggtaaaatagcctacaccaagaagaaccccaccaagccaaactcaccttatttatttacacgcgccgcatgtattgcagcaatcaacaatccgatccaaactgtgcttgtgagcgcggtagatgcgacagagaaaggagataaacaatgtcaatcttccgtagaggaaatacgtggtatgggaactacacgacgccaagcggcaaaagaattaaggaatctcttgggacaacggacaaaaagcaagctcaggagttgcacgaccgaagaaaggccgagttatggcgcatagaaaggttgggtgatttccctgatgtgacctttgatgaggcgtgcttgcgatggatcgaggaaaaagctgataagaaatcactggatgatgataaaggccgcatggcgttctggttggaatatttcgaaggagtaagactaaaggatatcaccgaagccagaatttatacggcaatcagcaagatgaggaaccgcaagaccaaacagcgctgggaaagtcgagttaaagccgcccagaaaaaaggaaaagaagtccctgcatatacagaagtttccgtctcggtagcgaccaaagcaaagcacttagcattgatgaagtctctgctaagggcagctgaacgggattggaaatggttagagaaagcacccgtgatcaaggttccagccgtcagagataaacgtgtcagatggttagagtctcatgaagcccaaagattagttgatgaatgccccgaacctttacagtcaatcgtcaaatttgcactggcaacaggattaaggcgctcaaacattatcaatcttgaatggtctcaaattgatatgcagaggcaagtagcatggatacacccagaccaaagtaaatcggatagggctataggggtatccctaaacgaaactgcttgcagggtgttacgtgcccagataggaaatcataataagtgggtgttcgtccataccaaaccatcaactaatcccgatggaatggtaatgcctaatatcagaaagatgcgtgttgatgataacacagcatggaattcagcattaaggcgagctggaatagaagatttccgattccatgatctgagacatacttgggctagctggctgattcaatccggtgttccattatccgcactgcaagaaatggggggctgggagtcaattgaaatggtcaggcgatatgctcatttagcgcctaatcacttaagcgagcacgcacgtaaaattgatgagctttttggaaatctagtcccaaatccgtcccattcgggaaaaattgtagttgcaaaataggggtaagtgcttgattttaaatggtacgccctacaggattcgataaaattagttaatttattgtttttaaatatatttattttgttcaattaactgctgcaccccctattatacccccgtattatttttcctctgtttgcctgattgttttctgctctcatcattgcaagcaggctttgcattgcaaaaatatcatcaatgaaataaaaattgctaaaaatgcaatgataacttcaagatagcctatccgttcttttatcatgtgtagagttgagttaactttaatctggtcgatggcatctcattgtagagaaaaatgacaaaattaaagccatcgagataacggtgaatactcagccaaatatttatctaatcaatatgttaattcaaatagtttacatgaaattgataaataaatgacgttgcaagaaaggtatatccaagcataaatttccagtttcgtttaaatacatacaaagaactccaaacacttctgaatcttcttacattatctaattttttaaacaaaatatctctttcacaatcagataggtatgagtttattattttttcctttatgttcttttctatttttgtgaaattagattcttggattcgcctaataagtgcaatttctaagaaaggcggtcagttgctatagtaggcatctttctcgccaaaggaaaatgcgctatgacctataaacaactgaccgaaacagaaagatatcagattttcagcttgaaagaagccggtttttcacaacgggagatttcaacgtcactcaatcgaaacccatcaacgattagccgggaattgagacgaaatcgggaggcaaagaaatatgcgcctgaacaggctcagcttaaggccgtagtgcgccgacattgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgggggtgatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggcgatactatcgttggtaaagatcataaaagtgcattattaacattagttgaacgaaaatcgttatttactatcataattaaacttgaagataaaacagcagaaggggtcgcaaaagcggccacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtatcagagctggagattaaccttgtggcaaaccgattaaataatcgccctcgtaaaacacgagattaccaaacaccgaatgagttatttaaaggaatacccactcatttacttcgttcattacggtgttgcgcttaatatgtgaatccaagatttataactaatggaaaaaagcttatcaaagaagaacatcaagctaagtaggaaagtaatcatttgagcgtttttatttgggatcccccaacaccctataccaattattaatgaccattccgcaattgaataatgctgcaaattcccccaccacttattcatatctttagcatatttttttatctctttttttatttctgagaatgctggtgatctttgacaacgtttcaaaatgcattcctttatattgataaaatagcctaataaaaatatatagccatgagtataaaattaataactacgaatattattttgtctcatggcttatttcattgacataaaactattcagtagaaactttgcgaaccttgcgctcaatgagctgtccgtacatatcaaaatagcggctaggccagatttctgaagggtggattccaagataatccgcgattatccattcacctttaggccacggcctactgaatgcatttgccagtgtagatgaactcagtccggcctcgcgagaaacagccgctaaggttgtaccacgtttacgtaatgcggcaattatatcggcctgatgccaatcatttttaacattattcattactgctaccccttccattaattaatattgatggtggcgattcagacagggttcgcggaccggagatcaaccattccggcaaggcaatgccttccctacctgaaccaccattgaaagggcgataacaggcacactggtagaaatttcctaccagtgggttgatcattcaaggccgcgacgccttgaccattggattttgccaatggcgggattactttaactgattgttttagcttactcaataactgaacgactaagtttaacggctataaactcgctcaacgtaacgcccacgaccatcaccatgacctaaatccattgaaaccagcgcccttgcttcctgacggctaaaaccattctgttggtaaaaattcagtgcatcctgcgcccacgcatagcgcaggctatgaggagagtgacaacctactaaaccaatccttgtggtgtgtgtccgccaatagttcatggcctgcttaagatcgggtttttcaatcaacctgccgcctcgttgctctgcaatagcaatggcctgatcgacagcttcttttacagcagcaacattcaatacgcgggtttgtcttggtctgccgccttttgtaccgaaaacaacatgcagtttcggctctggttgttctaactgtttccgccagcttttcaatgaagcactgcattgcaccgcttcctgagaacgtaaccccatcaaacgggcaagtttcagtgtgacagcaaatccggcatcacgtttaagcgccttctgataaacgacctgaaatgtggcatcagggatcgcctgtttcgttccggcgcggctggctccgcttaatcccaatgcctgattgctcaaacgcggagaagtttccagtttctccctgcctgccatgcggaaaatattgcgtagcgcggacatttcattctgcaccgttcgtttagcaacaccctgagataaacgggtatcaacgtaatgttctacatgcttggctttcaaatggctgagacttttaacctgaatattcaggctcaataacaacgcccccaaacgtcccgcaatccgaatacggtcatggcaggttttatgactgccaccaccctgacaggcaaaaaattttaattctttaatcaatcggctcattggcttccccttgcttatacctgacaacatgcgatctctggcgcgcgacagaacggacaaaacaggcaatgcctgcttcgtccttgacggatatctgtgcgccagagtgaacgcaggttgaggtattgcggggtatcggttgagtacacggtactgccgcctgtgttaacaggtcatccccaccggctaaaagccagcctcgatatcgtcaagttctcctttttcaatctatagaatgcagtgtcagattcactgtgcggttaatcagacgtgagcctgttagggttgtactgtcctttggttgcggcgtcactttcagcggtaaaccggcaaaaagtgacgccttaagtcccgtaaatagtcagcaaacgttgtgcacgttgaaataccatcagttacagcaaaacgccgcaagattcagtgtcaaacggtagcaatgagttaattatttcgatgtagaaaatttatctgttgattaattcaagcagagatagtgagaagtatgaatcggatgtacgaacgccatcctgttattcattgaagataaaggaaaatatgcttatgttgatatgaaagataagtgcatgatctaatgttcactacacttgattggcaatataaaaacaccttttgggtgtatttttttagtttaagaaaccttcatcatcagacaaggggtttatgtctggcaatacctacttccaaaggtgcgcaggtgtaccgcaatgcttgctctccctttcaggctacgggagttttgtttcgccaccctaaggcgagcctgacaggcgatggatcatgagtattaacagttaaatactttatcggttggatcgagcagggtcaattttttggtgagaaagtgatggtgaacatcccctaatccagagtcctacaagttaaaaaagcaagttcattgcttgtcgctgcgttgtaaggacctttgcttgagcaattaagctggcagttggtatactgaaatgacacagttcctcggtaattagtctgtcaatcttgcttagtaatcacactaataatagacctaaaattaaaccgttaagtaacaagaaaattacacaaggaacctattatggctgatgttcattcacctacagttcgtagtaacaatatgaaagctatccgtaatcaaggtacaaccattgaagtaaaactagcagccattcttgacaatttaggcttagagtttagcaagcaggtaaaagagctggctggcaaacctgattttgtgattgataaatatcgtaaaataatatttacaaatgggtgtttttggcatcaacatcaatgttacttgttcaaggttcccgcaacgaggaccgaattctggatagaaaagactaggcagaatgcattacgggataaaaatgtacataaaaaactcaaaaatgatggctggaacattatggttgtctgggagtgtgctatgagaggtaaatttaaattatctattcaagaattatcagaacgaattgaagaatgggtttgtgcaggggattattttgccgaaattgataccagagggatacatagtgaaaatgcttgagtaggctccctgagtcattttcaattagctattatgatatattttatcctaattaatacaataaaaattgtattaattaaacaattagttacgtcaatttttcatccaaattacggattaattactacttcgacaggtattgtcaatgattcctatgggacttcataactaaccttttcatcaaggctcaaatcaatatgctacacttgtaaaatagtttgccagcatcttctatttagctcaattttaattaaatatcacaaaaaatcactcttaatcagtaaaattattaaaagtattacacaatggaaatgtgtaaaattactagttcagttacaacatcaactaattagattttcctgctactaaaaaatcatttattttgctcaatatgatagaagataacttatggattttttatccctttccaaactaaccactcgtataatagatgtcataccacatgctgcatcactaatagaaggacatagagatttcggctataacctcgaaactgctctggcagatattatagataattcaatatcttccggtgctacatgtataaacctttatatagatgtaacaactgaaaaaccgtggatagctctatctgatgatggatgtggaatgactgagccggaacttatagaagctatgcgtctcggtacaaaaaaccctaccgatgaaagagcagctaaggaacttggtcgatttgggcttgggctcaagagtgcaagtttttctcagtgtcgctgcctaactgtgctgactcggcgtcacaatataatttcttgtgctcgttgggatcttgatcgtattgcaaatctgaatagctggacactagaactacccggtgatgtggaaaaaatcagtggttacgaactgctaccaggaacaggaacagtagttatctggcaaaaacttgatcgcctaagtgacggctatatggatgacatagcaaaacgtattactcatatgaatgctgaattctcaagagctgagcgccacttgagacttgtattccatcgctttattgagggttctaagccgaaattaaggcttttactaaacggtcgccagcttagaccactagatccaatggtatcatttcatccttcaactcaacgagcccccgaagatataatctcacttccaaaaggtaatgttcgtattcgatgctatacgcttccccatcataggaaaatggcaaaagatgagtgggaagaaataggcggtccagaaggtcatctcaaatctcagggactatacgtatatagggaaaatcgcctaatcattgcaggtagttggttgggactaactaagcaaacagagcttacaaagctatgccgtattgcaattgatattcctaactcaatggattctgaatggaaaatagatgtcaaaaagtcatctactcagctaccgtcaatagttcgagagcgcttaaagagggttattgagagatttattggaacatctaagcgtacttatcgcagtagaggtcaaaagttggtcgataccacgttgtatccaatttggaatcgaatccaaaagaatgatcaaattatcttccggccaaatcttgaacatccattatttctctcgtacctagagaaacttccagaaggactacacgaaggcttcaagagttgtttgcgtctcgttggttctggtttacctatcgaaacccttcatgcagagcttgttggaaatccagagtcagttatctcagactcggcaatggaatccgatttgaagcaggcggtgaacgatttagcaaaagtattaatagctaatggtgtagcaatagataagctttcagactcaatgcaaagctaccatttgttcagaactaattggaatctggtgaagaaacttattaatgactttgtaaaggagcaagttacatgattaacatagaacgtgttaagaattgtgttatgaatatggtcgaaacagcactatttaatattccgtccaaaaaaacagaagaggaactccgcacatttatccgcaatgttgcctccattactcctcttgaagcaggcgaaaggaagttagccgaacaagagatagaacagatagcgcgtgaaattgagactaagcagggcattaaagctggtttaggagccttcatagataaggaagacttcgaaccatggctagataatgcgaaatcacatattgaaccgttttactggaacagatatcgccagcttttgttacaaactggactcccaaaagacgtcgtaattgcaaccgacacagtaacagacaagatccttagccgccttggagacccgaacaaacaaactccttgggatagacgaggtatggtcgtgggccacgtccagagcggtaagactgcaaactatataggcctaatttgtaaggctgcagatgctgggtatagattaattatcgttattgcaggcatacatagtaacttacggaaccaaactcaagctcggattgatgaaggattcattggtcgtgatactggcaaatcacagaaaaagaaaagaggagaagctaaaaatagtattggagtagggctctttgactctaataaaacccccgtaagccttactaacactttaagagatttcaataaaggaacagcatcaacaaacaccagtgagatagattcttacaacgttcctgtagttttggttataaagaaaaatcatcgaactctaactaatcttttggagtggcttaaagacaacagtgcccgaggagatcgggagatgatagatcaacccatgcttctgatagatgatgaagctgacaacgcatcgatcaacacaaagtacaacaaaaaattagtcacaacaataaatcgtcaaatcagggagttactgaacacgttccaccgaagctgctatataggatatacagcaactccatttgcaaatattttcattgatccggatcaagaagatgaaatgtacaatgaagatttattcccccgagattttatcattggattggacgcccccagtaattatttcggtccctcgaagatcttcgtcagagatttacagggtgaaggtgaatcaacttggcttagaaatataactgataatgaagatatcctgccaattattcacgagaactatcgtgaaatccatacattacctaattcgttgatcaatgcattgcgtacctttcttattgccagagcgatcagaaaccttcgaggacagataaaatctcattgttctatgctcgtaaatgcgagtcgttttaccgctgtacagggaaagattagaaaccgtttgtatgaggttttggaacacatacaaaatgcagtaaggataaatgcaagcaggaaagctgaagcgctgaaagatccggagattgctgctttgtactcagtttgggagcaagaatattccgatgcagaacctgattggttcaaaattcaggctatacttcttgatacaatcgcctcagccaaagttgttgaagtaaatagtcgcatcaatgacctagattacacaagttccgacgaacgtgggcaaacagtgatcgccgtaggtggcttctcactatcacgaggacttacccttgaggggttaactgtaacttggtttctccgtaatactaagatgtatgatacgcttatgcagatgggacgctggtttggttatcgtaacaactatgaagacctatgtcgtatttggatgcctccagagggtattagctggtattcatttatagcagcagcagcggaggaattgcacgatgaattacgtacattggaacaggcaaaagcaacaccaaaaatgtttgggttggccgtacgaaaacatccagcaacgcttcttgtcactgcacgaaataaaatgggttcaggtaggcctgtaacaatgcaagtgggtttatccagaaaatttatcgaaacatctagggtaagcgccaatctaaaagaccttaatatgaataaggagttagctaaacgtcttatccaaaatctgagtatcggtaatttcgaagaaacaaaaccatctgcaggtacatgtgtaatgcatgtcccatttgaaatggttgagcaatttctttctggttgggggaatgctgaacaaagcataacaactgacccagatcttgttttaaagtatatccgggcaaaaaaaaatgatcatgatgaactagaatactgggacatattgatttccggcagacaatccggtgaagtaaaccatgaacttggtagagaaattatcccaattagaaggtcggttgaaccatcagaccttttaaacaatttcatatcattcaatgggcaacgaatgagaattgctgatgctagctttgaaaaagcaggattaagtgaggatgagatttctatagcagaagcaggttacagtattaatggtaagcagaaaaattatccaggccatatctatcggtcagtcagaaaacgcccattgctgataattatgctggtagaaacattcccgatgaaaggggaagaacagaaactaggtgccgaattaatacctcttgaacctattatagcgtggggaatcagctttcctgaatctaagcgcccaaatgaaagcgtcgaatatatcgtaaacactgtacgataccaagaaattttcggcacagaagacgaagacgacgatcaagaggaagaactttgtgagcagtaatccatggaataagctaggtatagataatgctcgtcgtatcaatagcgaaggacattttgatttcttctgggttgttcttgaggcaggtataccagggctcatgctcaagcttccggtagtttctcagcctattttccggcttcctaaactgaaaaacctcattgcatcgtttaggcctgtggctaatggctgggcatttgttcttggattaaaagaacgaagccagatcgaactctttgaaatactctgtcgcgatgtagtagctgcaggtgaggcggcagagagctgtgaagactctcttgcaagaactatccaacgcacacaacgttggcatcatctcttgcggggaggccgctctggaggactgtcagtagaagagcaacaggggcttgtaggagaacttgcctttcttcgagaacttgtgtctgcattcggagaaaaaacagcaatcgagtcttggactggccctatgggagcagccaaagatttcgaatttattggatgttatattgaagtcaagacccgccggatagcagctaaaccgtttatagcaatatcttcggacgaacaactagccgctattgataacagccgcttgttcctccgggtaattaatatagcatctgccgtgcttccgaaaggtatgagcctccatgaacatgtccgtattactgcagaattgtttgaaaaaagtggtgatgtttttgatgtttgggaagatgcactttattcgactgggtacgatcctgagaacggttatgacggaaagtgctggcaactcagttcaataacagactacgaagtaattgaaggctttcctagaatctcacctcctcttccagttggagtccagaatgttcgctactcaatatcccttgatgcttgctcaccgttcgagcttgaaactgacttaattgatagtatccgggagaaccttgacgtatgaatgagctatttgaatttcatcaacatttgattgccgatgttcaaggggatgctgatgctcttggactggtgaccgtagaagcatttttcgaaaaggttggtgagctccttactgaggcaggagaaatcgatggggcaagtcgggcttatttggaaggcaactattcacgggctactcttcagctagatggatatgggggagatcccagagacagtgacggaatccttagcctcattttatgtgatttcgattcgaacaagggtcttcgtgaacttcataaaaagcatattcaaaaactgtcccaacgactatacaattttttgagctctagcttaaaatccgacttccgggatcaactagaagaaactagtcctggattcggagtagcagacctaatttgttccacttggaatgctattgataaaattaaattaattattgtcacgaatgccattttccggacaaggacagattcggttaatgtcgaagagttgtatggaaagtctgttacagtcagcgtctgggacttggaacggcttaagcgatttatggagcaaggccaatcaagagcaaacccggttatcgatttcgagcaagattttggtggggcgattccctgtttgcctgcttctcgaggagataaagccctcgaaagctaccttgtggtaattcctggtaaacaattggctgcgatctatgacaagtgggggccaaggcttctggaagcaaatgtgagaagctttcttcagattcgaggtaaagttaataaaggcatccgagataccattcgcgatgaaccacatatgttcttttcatacaacaatggactgagtgcaactgcagattcgatagaaataaatcaaaccagtacaggtctctacttaactcgcgctgataatctacaaattgtgaacggtgggcaaacaacagcatcgttacatgccgcaagaaaaatttttgcggaacagcttacccaagtttatgttcaattgaaactcactattgccccgcgagagcaatcagaaatagtggtacctcgcatatctgaatgtgctaatagccagaataaagtgaacacagcggacttcttcgcaaatcatccttttcatatccgtacggaagagctatcacgccgtattcttacccctgccggaaatgataattatcgcgaaaccaaatggttttacgaacgagctagaggacaatatgctgatgagagaaaccgtcgtacccaagcagaaagaaagaaattcgatgcagagtttcctcgatcacagttcttcactaaaacagaccttgctaagtacgaaaatacatgggcatgtttgccacatattgttagccttggtgctcaaaaaaacttcgcagaatttgctaaaactataggaagacgatggggttccgatggtgtttcattcgatgatctctggttcaagcgcatgattgctaaagttttaatattcagagctacggagaaattagtctctaatgcagattggtatgaaggaggctacagagcaaacatagtcacttatgcaattgccaaactagtgagtgatgcaggtgcttacgaaatgctaatagatctcgatagtgtttggcgctatcaaaaggtttccgatgagctgaaaacagctcttcttatggctggtcatgaagcacaaaatgttatcactaatcctcctaatggaattcgcaatttcagtgaatgggcaaaaaagcaaacatgttggcagtcgctttcggagagaaaattgccctacacaaaaacgttcacccagatgctcatttctccagaattagcagaagaaaaagtacgagaaacacaagctaataaggcattacagaacagtgtggaagccgagttaaaagttttccagctgggagcttcgttttggtcagacgctcggaattgggccagagaaagaggactgctctcacctaaagagatcagcataattgaagcctgtgctgcaatacctcacaaaatgccctcaagtaagcagtgttccattgcaatttctgcacttaagaaactccaaagtgaaggattttcagcaacagagattttcaaagattccaattaaaaacggttaggatgttaaattcagctcatattaatatgtatgagctaatacaaaccatactaaccaatatggtaaactttatattcagatttattgttacattaaaaaaacttgggcttgcatatattttgcaacaagcccaattcatatttagagaataaatgaggcgataattatcaccagtaaattaaaagttactcagctaactgccttaaatttaacatattgtatgtgaacaaaacttattagcactttacaactattcagtatctactgtcataccatataaaccgctcgtagagaaagagtatccagaatacaagtcagtcatagttcgaaaatagtaattgttcaaaataatgccaaatcattctaataaatttagaacaatctcaccaatctgccttgcaaggtagggaggcactgcatttccgacctgtacatattgctgtgttctgtttccttcaaaaacataattatcaggaaatgtctgtagccgagcagcttcacgtactgtcaagcttctacattgtcttggatcatagtgaataaagtaatgaccatctttcgaaatatggctggttaccgtcgttgcacatttattagcagcctgagttctgaatctgtcagtatgtgtacccgtattccaattttcatgagctggagctaagttctttgggaaatctcgagatttcggagagactccattatttaagtatgtgtaggcagaactgaatgcgtaacgcaccaaatctccttccatgtgtccgcgtgtttcatgattcaatacaatccgaggcacatttttcaaataccactcttgtaaatattctggtatattagagcttagattagtcgttttctccttttctgaccgcttcaatcccttaaatggttttatttccaatgtgctaacagcattccagccaaatacgtcttctaaatattcttgtaccttctgagcattggcctcaactatatttctccactctctctcatcatcttttcgtttggaaaaaccactacgcagtggaggaagatcagacaatacctgttctactgtcaccattttttctaccggagtaagaatttgtgggacttgcttaatatcatctctaactcccagcaaaattacacggtgtctagcctgcggaataccatattgttctgatttaattataaaatcgtcaaaatccgtatagttaggattgatcaagtctcgatcttctttaaccaatgaataaatcttataccccttcacccctaaacgattagtaatttttcctggctctcttaagtcgtcgagaattttaggaaagatcaattcaccgttaacttttgctgacaaaattcctcttacgttttccatcacaaaaacatcaggttgagcaattgacaaaacttcaagatattccttgtacaggaaattacggtgatcattttccgctctataatctttaattcctgcatttcgcgttctgcctgcaagtgagtaagcttggcacggaggacctccgataacaacctttggacctttatgtttttctgttaactccctaattcgctcatgaatcagtatattgtcttctcccagagcacgaggtttatcaagtgtttcattgtgagctttacttgcttcagtaggatagcgttggaacaactcccggcgactaagctctccttcaagatataaaaaatagtctttaagtgaagagggattatctttaattttccgatagaaagctcttgtcgtgagcgtcttatgtgccgatgattctttctctaccgatacaccaattttaaatggatagttaccatttttatgacgacaaaaagaaatgccttcgcccaagcctcccggccctgcaaataaatcaataacaagaatttcgcctgttttcatatttcaacacttaccattagccaatataggcataataccaggctactttttctagacaatgattttaatataaaacatatagttcgtgttcggacacataggaaccacaaatagttccattttcgttgcatcactatttccccgcccccctgctgattgtctgactggttccacgccctgattcatcatgcctgccacgtcgctcaacagtacaccaacccaaaccaatgcaccttgctaaaccaccgacaggacaataaacagtgggctcatcaataacctccataattaacctgagcttcgcttaagggaagtgaactaaagtgcctgaggcacgatcaacgtttttgctaaagaaaacaaaatagtggagaccctcaggcatgtataatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatatcttacagccgattttcccggattagtcagctatactcgtatcctcaccctgaagaaaagggcgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccgcaggaaaccaggatgatcgtcagccagtcagagcgctgacaaaaggactaacaggatgtttgtatggtgataaggggtatttatcccaggctttatgcgatgagttagaagcggaaggcgtcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgagatcgctatctttaaacgaagctgaggttaattaaatcatccgaagtgttatgaatgccttccagatagaactcgctgcccggctagaaagaatttctcacttaatcaatagataattactttgacttatggcactgacgcgctgcgcttgtcttctccgatttaccgggctaatacattaacccggtaaatcggagagctgaaaaaacacctaccagaaaaggtttttatctatccactctccccctatacaagaattagtaataaaactgttcacctattcacttttaaatattttcatttaaattcatattgttaaatgataatgagttgaaattaaactcatcatcactcttcaccaaccgttcacctcaaaccagaaaaaggtgaacaatggtgaatacttgtgaacagtttaaaaataaccattcaccctataatatattgatatatctgatttaaactatagagtgaacagtggtgaacacttttttatatttcttcgaaaaatgtctccaataagaataatttattcttctggctggtcattccttgtcagttttggcatccactcaatagcagtatcaatattcaggttcagattgctacgaatgccgtatttgcttttcttgcgcaggtaatgctggctgtactcagccagtgcgcccggcatatccataccaaatcgtgttacggaaacaggtttattcaggttgttgcctttcatataagcaaggtaggcgtggtagaggtacttatggggattaaacggcataatctccgcattaccgattaacaggccgtcagtttcattagacgcaatcaggtagccgcagaaatcaactaatggatctgtgccacgcttgatatccagcgcctccgcagatttttgctgttctgccagtaaactcctcgcagcctgtggatcagcgaaccgatacagcagatgccggataatcacaggcaattctgccgcgattttatcccgcaggagtggatcacgttcattttccggcacaacttcggaaaagttgaaaatcactcgacgccgcgatacaccaccactgcgatcactgaaactcatggcattattgtttaccgccaacaccacagcaggaatacgggtggaatagggttgcttatgcttcggatcgatagcaactccatccccgcctgtaatggctttgatgccggaaccatcacccacatagcgagtctggtctggcaggataatcaacgaatatcccacaatcagcgcccgttcccgtggattttccagtgcggccatactggcggaaacggtattgcctttacctgccagcattgagcagatttcggcaaagatgctttttccgctgcccccggcaccagtgatttccagaaaaagctgccagtcgtaacggttcgccagcaccataaacaaggctgccagtacccgatcaaatttgttctcacagttggctgttgctcggttaagccattgccagaactgcggtgcatgatctttcagagtttcccccgaaataggggaattgaattcaacgtcattggcaagcagcagccagtcatttttacgatgaggccggaactggcacgttttcaggtcaaacactccgttgctgaatccgattaagtgacgttctggcggctgcatcatgggaagctgtaatttgagagcatccacggcagagctgatgccatgcggtgagtaaggcagtttttcttccataaaggctgccaccatttcccgctttaaatcgcggtcactgaccggacgccagacaataccatcatagtgatgaacggtttccgaagcgccatccaatgctaaatcaccgtcataacgcgccagtaatacttccccacgctggctggctcccatctgacataatgtcagttttgaaagttcattattattgggctgaatggctgattttttcttggttgataccggttgataaagtccctgagaaaaggccagctttgccatttccacaccatgttgttggcggtaatcgtcccagtcggttttgtactctgtaggtggtaacgtaacccaaccattaaccgcaagagctgctttttctgctaagaccctgccgatattcactttcggcttgccgtgcttatccagttcgtcgggatgatgccagtcattatctgctgcgaaaataatttttgtgtctgaccaacgttcccgaacggcttttgcaacagaatacaaattgcctgcatctaatgccgccaaaacagtgcctttatagagcaagttaactgtgagcgctgtggcgtaaccttcggtaatgaccaccgggtcggattgatcttccagctctgagacgggaataaacgcaccttttttctggctaccggacagtaattttttcgtcccatccggcttgatgatttgtgcacctgttacttttttatccagtgttgccatgggcaacaaagtcgaattattgaacaataaccgctgattagggaaatccagcccttttgcagccagataaggagattgcccggcaacagcttgtgccattagtgatgccactttttcggcaattgactgcgtagtttgaatggtttctctggctggcttgggttctggcaacggtaacgccagcgcatctgcaatgacttttgccgcctcagtggtggaaatacctttggttcttgccactaaatccagcccgtcaccatagtttggagcatcacactggcgacagtgccaattgccatggtggtgatcgtcgataaagtgaaaacgatcagtgccgccgcagacaggacaagcaccatgtttgccctttgctggaatatcgatgctacaagcaggcagcagattttcccaatgatacatggccgattttttcacggtctggatcaggtcaagtggattttggctgcctgtattatctgaatgtgtaaatttagggtgagtttggttagactgtgtatcagccatatcgtaagtctcctttacgttgtggtcagacgcctcaaacgtgttcgcgcacactggggcgttgtttttttatgttacgtttcttatgtcatgcttttttctatgttatgccgctcgtgattccgcgatcctttgggcaatccagttatcaatttctgattcaataaaagcaatggagcgggagccgagtttgacttgtttcggaaattctccggcactaatcaatttgtagatccacgctttgctataacccgttctgcgttgaacttccggcaaacgaataaggttttccttcggtgctgtcattgtcatatttttctcctgttaccgagtccttgagcgctcatcgtggacgttgtttgatgacaggcggattatttaaaaagcaagactaaatgaacagcgttaattgtttttccgatttgttgaatttatttttttggaacttataccttttcatcggcattctgtataaaaatcatactttgttggcagtgccaacaaagtatgaaaaatcaccacttctttacgcccttttgccaaattttccgatcagcacattttcgcctcgttccagcatctccatatgatccgcataccattgcagcatttccaagcgcccatccagatactgagcgtggttgtaagtcccacggatgctattcttgtcaacatgagcaagctgggtttcaatccaagccgtgttatagccttgttcatgcaggattgtactcatggtatggcggaagccgtggcctgttgcccgtccatcataaccaatacgcttaataacctgattgatggctgcctcactcattggcttacccgcatcgttacgaccggggaaaacgtatttcccgcgccctgtaatctcgtgcagtttaataagaatagctttaacctgatttgacagtgggacgatatgaaggcggcgcattttcattcgctcggcggggatttgccagagatcgttatcaaaatcgaattcagcccattccgattctctcagctcaatggtacgtactccggtcagcatcagcatacgtgttgctgattgcgtcacttggctgccactataaccactcaaggcgataagaaaatcatgtagttgatcggctaaaaggtgtgggaagtgtttttgcttgggggctttcagtgcgctggcaaggtcagtaacgggattgaactctgcccgccctgtaataacggcataggtgaaaatttgccgacaggcctgcctggttttcttcaatttatccaaaacaccgcgttgctccatttttcggagcacagccagcatttcagcgggtttaatctcggtaacggcacgtttaccaatatatgggaagatatcttttttcagatattccagaatgtcttcggcatacccttgtgaccagtttgggcgtttatactcgtgccactcaatagctatagattcaaaactattgctgaccgcaaatactttggctgccttctccgctttcttttcctctatcggatcattaccactcgataatgtccgccgagcatcatttctcttggctcttgcttctgcaagggagatttcagggtatacccctaatgcgagcaatttttctttgcctacgatccgatactttaaccgccaatagcgagagccattagggttaaccaatagatataatccgccaccatctgcaagtttatagggtttttctttcggctttgcagtgtccacctgtcgggctgttagcttcatatgggggtatctcacttcattgaacctgaacgtacccctaaatatacccctataagatcgtagatttcaacataccttactagactacaggagaacgaaaaaaggctaatagtacgtatttactggagttttgtagacttaggaagacgttaagatatgaaaggatggtacgccctacaggattcgaacctgtgacctacggcttagaagggcaaaaacctttgatttcactctatttcttacaatttcacttggtttcattattttgatttaaaacggattttatagcttgaacagtttcatgtagttgcatatcatttcatcataacttgacccgctacttgacctgttatgagggatatatcaatggctagtactttattgactgacagtaaaatccgaggcttgaaacccaaaaactcagcctattatacatggcaagcagcagcaacacgaggaactggaaggttaggagttaaaacatatccatcgggaagaaaggtctttgtctatcgttactttaagaatggaaaagaaaagttcataaacctaggtgatttccctgctctttctttggcagaggcattatccaaatcacgagatgccgccgccaatgtttcagctccagaaaaagccatcataaatcacgccacaattgaacagctattcagtgactatattgccgaccagaaacgccgtggcaagagatcttatgataaaacccaatacaggctaaatcaggtattagatagccagcacattgagagaaatactccagcaaaagatattaccccagaacatattaaaagggtattagctgaatttatctcacgcggtgctgttgctggctcaaataaggttcgtgcaaatcttcatgcagtatttaacttcggtctattcgcggacaatgatcctgccaaactgaacgagaaagttatttatggtcttgaccgaaaccccgtgaccatcgttccacgccaagagggagcagataaggcgttggatagatttttatcttgggatgaaatgaaagagattctaaaactatttcgtatttcgtcgacagtattcccaatccatcctgattatggccggttaatattgctttgcatcttcacaggtggacaacgcccctgggaaataatgaccaatacaaaagataactgggataaaaagaataacactctgacagtcccacctcatatttcaaaaaacggtgattaccacgtaattccattgtgtgaatctgcaactgaaatattagaatgccaagccaaacaatatccaggctcagaattcctgtttcccggagagactaaagaaggtcatttactcactgctgaatatgccaagcagatccgcaaattttgtgctcgctatgattttgaaaaatttacaccaagggatattagacgaacctttaagacgctggcaggagagatggggatcagttctgagatgagagataggttgcagaatcataaaaaacccggtgtctcaaccaaacactatgatcgctacgactatctgaaagaaaaacgggaaattatagcgcaatgggaaagtaagttactatcactatagggcagaaaactgccctttgagattcaggcagttttctaacaaagctgagttgtttggattgacttaatcctcatattgctaaatatgccaaatagtaatttgtctgttttcatttaggatttatctcatcgcaatatttactttcatttgaattaatagtttacgtttatatattcaatgcaaatatatcatttgttattattatttttcattaaataaaaaagtcagaaaataaaaaacctcattgctaaaaatagtcttttttgtgatcgaacgcataaaataaacatgatcatgattttgccaaagccgttacctatttttttatttttatctcatgaagttacgaaaaaaacaccttttatggataaacattaagtggttcgatatactaatcacatacgctatctaagaatattatttttcaacagcaattattttaactttttacgctgctattgtcggatgtcattttttatttcactttatttaatttggcctttactccttcgttatttattattgccttcattttatttatcacggatcagccgatatattcggacaacaaagtctcttcaaattatcgcaaaacaacctattgcgtcctgaattaaccaatttgtcggagacaatgtgagttagatttaaatcttgtacccgaatgttatggcctgcgttgttatcaggtgggatgcctattacataacgttccatcatctcagggagacacatcatgtcaataaagaagaacatcaataaattgaagaaaggacaagcccttgttcagcaggggcaagaggctgttcagaaagcgaaacaggttgcaggcaaattaggcggcggcattacaggaacggcaggcttacttccgggtggtggttttactggagggataggcggcaattcaggcagcagcatgtcaggcacagcgggcttaatcccgggtggcggttttaccggtggaaaggggctggcagaacgcgcagccggtgggcagaatgcggccaccaaagcgctggaaaaagccgctcagatgctgatgggcgggcgtgacccgagtggcctgcaatttaccctgaccgcaggcggcttaccgccgcagacgtttgtagtgaccaatttcacgctgaacgaaagtttttcccagccgttcagcctgagtgtgggactggcgagcgccgacccggctatcgattttccggcagtactggatcgcaccgccacgctgaccattctgcaaaacggtatcgaacaacgcagcatcacggggatcgtttcccgctttgagcagggtaataccgggttgcaccagactacctaccaaatgactatccgccctgacctgtggcgtacgaccctgagacagaactcgcgcattttccagcagcaggatatcgccaccatcctcaccactctcctgaaagaacacaacatccgcgatgtgatcttcagcctgcgccatcctcacccggcgcgcgaattctgcgtgcagtatcaggaaagtgactttgccttcctgcaacggttaacggcggaagagggcattttctacttcttcgaatgcagtaacgggcgcaacacgctggtctttgccgacgactgcggttcagtcccgccgggcatagtgatcccttatcagcccggtgaagtcagcaccgggggtgaacctgccatcagcagcttgacatgcagcgcacaggtgcggccggcgcaggtccagcttaaggattacaccttcaagaatccagcgtggccggcggaatttcaccaacagatgcgggacgaaaatctgcaacaactgtactacgagcactacgactaccccggtcgcttcaaggacgaagcacatggcaaggattttacccgctaccggctggaagcgctgcgtagcgatgcaatgatgggacagggcagcggcaatgcgataaccctgcagccgggcaagctgtttatccttgataaccatccccgggcagacctgaatcagtcatggcagaccgtctccaccagccacagcggcagccagccgggtgcccttgaaacgaaaaccggcgacagcggcaccacgctgcacagccacttctatttcatccgtcagaatcagaactggcgcccggctccgctgcccaaaccggtggttgatggcccacaaatcgctaaggtggtcggcccagccggtgaagaaatcttctgtgaccagtacgggcgcgtgcgcctgcaattcccgtgggacaggtacggacgcagcgacgaccaaagctcctgctggatacgggtcagccagccgtgggccggtcagggctgggggatgctcgccattccgcgtattggacaagaagtggtagtggatttcctgcacagcgaccccgaccagccgatagtgaccgggcggacttaccatgccagcaacatcccgccgggtaccttgccgggcagcaaaacccagatggcgttccgctccaaaactcacaagggacagggctacaacgaactgctgtttgaggatgccaagggcagcgaactgctgtcactgcacgcgcaaaaggatatgtacaccaaggtgctcaacaaccgcgatacccatgtgctcgccaaccacagcgaaaccgtggagaaaaaccagaccatcaaggtcaatgagaacaaagaggaaactgtcacgctcaacagcacggaaacggtgaaggaggtgcgcaaactgatcactggcaaggactacattatcgaggtcggtgcgcataaggccgagaccatcaccaatacccttgccatcaacgtcggggatgtgattgagctgcgctgcggtctgagtgtgttgcgcatggacagtgccggacgtatcacccttcagggcagtgagttcaagtttgaggccagcggggcggtgcaaatcaccggtaaagacattgacctgaactaagaaggacagactgagatggaatttcgtaacctgaccccctttgcggtgatgaattactcgatgcttgatgtcgacgataccgaacatcacgtggcggtgatgaaaatcggctaccagctcttgcccaccgggccgggagaatacagtgccgaactgctgcctgcaccgcccttgtgtttgcaggatgaatatcgcagggcaatgaatgcctcgccgatattgcaggaaagtgatctggcgccgtttaaaccgcgctgtgatgtgattgtcaacggcacggcgtatgcgccggaaggtaagccctgtaccgaattcccggtgcgattgcaggtgcagagtaagcaggggcagaccttgatcgataaaaccctgaccgtgatcggcgaacgggagtttattcgcgatgcgggtggcaactggcaactgaccgagccgaaaccttttgcaacattgccgctggattaccgctatgcctttggcggtcagtgcaaaatctatgctgacgaagaagccagtcagcacctccaagaacgtgaccggctcactcccgaacaacgccagcagcacccggacggagaaaacgcaccggttgctcacgccacctgtgaaaccaatccgctgggaacggggtttatcactccgtggtacgccaacgcgaagcagctcacccgttaccctgcgccgcgtattatccggccagatgctgagttcactgcccaacattttgcagctcaactagggggaacactgtctgccgataccccagcctgccaaccacagggcatgggatttatcgggcgtccgtggctgccccgccgtcagcttgctggtacttacgatgccgactggcttgcccaccgtcacccttatctgcccaaagacttcgacttcagatactggaacggtgcccccaccgatcagcaaattgactggcctgacactgatacctcgctgagcctgcagggtatgacacccagcggcaacctgcacgtcaccctgccggggcatcggccgtttattctgctgcggatgcacgaaggagggttgctccccgtgccgatgcgcctcgatacgctgatcctcgacagcgatgccctgaccctgcatatcacctgtcggctgaattttaaaaccagcctgccggttcgggtggcggaggcgcggtttgaaatcgatccggatgctccgttactcaaactcgccccccctgaacctgaaaaggagaccgcccatggcggataactacattgcccgcactgcgggcgaatggctgatagtcggcatcttgccggacgtatgcaaaaccccgatgggcgcgtcaaccccgcccattccgtacccggtcatcgccaaactggcgggcagcgatgtgccggttaaatcggtgcgggccaatggacagccagtggtggtcttcgcccagagttttgtgccgcaaaccctcggcgaccagcccggggtggccaacggcgtgaaaagcggcaccgtgggcgcaaaatgccacccgaaagcgcatacccaaaccgtccgggccggtaacaaactggtgctgcgccatggggatgaattctggatgaatggagcataaggaagaatcgcaatgggagaaacgattagcattaccggtggccgtgatgaaaaagtattttgtgaagcttacaatatccgaaccttggctgaggcggaagcgatccaaaaacacatacccgccctcatccaacaagagactatggataatagtttgctcaccgccggggatattgaatatattacagaagctgagggccggcttgccgtcaaggtcattgataaattcaaaagcggggaatttccgttagaagaatggaagcatactccccctgaacccaatgagcctctgcccgccaaatcccgcgatgacagtccgagcggtacgggcaacacgataggtaaaattgtcggtcaggccccacaggccgcgcagccgccgcaggaggcgaatacggccgtcacaccggaaaccgagcaagaaaaagggtttttggaccaggccggagaattgtggaataagaccaaagaaggcgtcacaaaatggggggaagaagccggagagaaactgagtgcggcgtgggataatccgggaaaggccgccatcggtgccgcaaaaggggtgtggaatacggtacctgatgtgggtgaattcgtctttcgaacgacagcaggtatgcctgctgccatgatgtcctcttctggtacggtattgaaatacgcgggcgctgacgcgttaggcgatacagctcttgccgccgccgatgcatggaataagcaggttgtcgataaggccgttgagttgagccatgtggatgccatccggttcgacatcacggataaggcggaacaagggggggcgctgatttttgatggcgtcagcctggctacgggcgtgggcgggctgatcagaggtgcggccagacaaggcacgaaagcgacggctaaagccactaaacctgcacccggcgccaaagtcaaagaaaaaccccaggacgcgccggacgcgaaaccccagaaagtgccgcccaaagatgacgccacaccgtccaacaaaaaagacggcaatgacaatgggctatcgaccaaagagggcgacccggtcgacatggccaccggcgacttcctgcaagtctggccggtgctggccataccagggttattgccgataagcctcaaccggacctaccgctccaccgcggatttacacgggctgttcggtcccaaatgggcggatgactggtcacgacaattggttatcggtcacggggaagtgcactatacccatgcagatggtgtggtctacgactttgccaccccggacaaccgggtcttgtcccgtaaccgccatcttcctcactgcctgctgacgggcgacctgatgggcgcgctgtgcctgaccgaccgccgcgcccagttgacgtaccatttcagcccgagttcaggcagcgcgcagaaattgtccgccatcactgaccgccgccagaaccggattgatttcagctacgataaacacgcccggctgattgaagtcacccgcaatgacggcctgcggttaagcctgcattatcgggacaggcagctccacacgctcaatatgcatgaaacccgcgatgaccagtccatcaaacaacgcctgctgacctgccattatgacccacaggggtatttgaatgagtgtgacgccttccagcataaccacctgtggcatgagtacgacattcaagggcggatgatccgctggcatgacaccgaccagaccgacctgatgattagctacgacgaccgcggccgggtactcagtaccacctcacctagcggctactggcatgaccgcttccgctacgatgacaactcccgcatcaccacctatctggacggtgaaggaggcgaaacccgttaccattacgactcgaacgggctggtgatacgggaagttgacccactggggcgcgtcacccgccgccagtggcgacacagcctgctgatgtgggaaagcgatccatcagggcagatgaccacctttgattacaatgcggacggagaattgaccgaggtggtattgccgacgggagagacctttgtctatgcttatgacgaacacggacaactgaccgaaagccacctccctactggcgaacgctggcagtggcattatgacgaacagggcaacctgaccgcgctgactaacccgctcggccatcgggaagaataccagtatggtctccacggtgaattgcgccagcgcttgctgccggacggccagacgtggcactatgcctatgacgaacaccagcgccttgccgccgtgatgatgccgaacggcgaaaccacgggactggagctggattcactgggccgcctgcgccgtttcaccgatgcactgaaacaggaaacccgctaccggtaccgccccgaccatgccagcctcattcatggcagcctgagtgaaatcacccttgccgatggcatcacccaaaaactggactatgacagcgagcggcgcgtggtggcggtcaccgacggcgaaggccgtaccactcgctacacttacggcgcgtttgacctgctcaatcaggttacccgacctgatggcactatcttgctctttggctatgaccgtctgacccgtctgaactcggtcaccacctccacgggtgaaacttatcgctataagcgtgatgccgctggccagatcatccgggaaaccgattttaccgggcggacgctggcgtatcagtacgataaactggggcgccgcatacagactagctatcccgatggtcagcaacttcgctggtgctattccactgcgggcttgctggtcaaacaggaaagctggcaaccggaagaaaaccaactggtgttgaaagacatcacgacttacgaatacaacaaacggtatcaattggtgaaagccactaatgccgatgctatcgttgagtacgagtatgacaaaaccactgggctgcccacctgcgagcgtatcaacggtcgggaaatcacccgcgaatgggataacctgaccggacgtccagtcagtgaaagtgtggatggcaataccctgcacttcggttataacctgccgggaagtttaaatcactttcagctcaaccagcatgcaccactgacattccagcatgatgcactgggacgggaaatgatgcgggaaagtgccaatggctttattctcgccagccgctacaccgcgaccggattgctgacgcatcagtcagcgggacaggccacccaatttttcagggaaacgctggcacagaatgacccacactttcctccgcaagcctctgcggtcaaccggagctggcaatatgaccgagctcataatgtgcgagtgattgacgacagccgctgggggcaaacccgttaccgttacaatgccaacgaccaaatactgcatactctgttcgaaggtgcacgtccgcatgaagaacaattcagctatgatactaacggtaacctgagccaacatttaccgaccgatgcacggggagcggtggaacaaattattcagcgtcagaaagccgggcgtgtggtgcagcaggggaatatccgctacgcttacgatgacaatggccgtttggtagaaaaaactgaacagcgtgacggcttccgcccccaaatctggcgctaccgctgggatacgcaaaaccagctcacccacttcgagaccccggatggctcacgctggcattatcgctacgatgcttttgggcgacggatccgtaaactgaaagttcatgatggtaaactggcagcggctaatttacagttgtggctaagtggtaagccggatttagcacccagagccgatgccatcatggggcaggattacctgtggagcggcgaccagcttatcgaagaaacacctgtttatgccgatggtacaccggcggaaggtcaacgtgtccgttggttatatgaacccggttcattaacgccgtcggcacgccttgaaaaaggcaagttacactatattgtcagtgaccatcagggtacgccacgcgaaatgttgtccgaggaaggggtactggtctgggcacagcggctgacgacatggggcaaatcggaacgttttcaggtcatcgcttccaataatccggattatcatgttggctgtaacctgcggtttatggggcaatttgaagacgaagagtcgggtttattctataataggtttcggtattattcgccggagacggggcagtatatatcaccagacccgattggattgcagggcgggtttaatccttattcttatgtacataatccgacaaagtgggtagatccttacggtctggcaggcggggttgggaataaaggagaacctatccaaaaatcgccatcagactttgctagaagctggcaaggacaaggcgattatcccggcgttgatcgtttccgagatatcacagtcaagaaaggcacaatattgatggcaggtgcaccaggccaaggaagtttctacacaaccgttagagcggttgagaggagcggatattctaaagaaggtgtgtttaaaggattacaggtaatacctcataaagatttcggatataggccaggtatgacagcctatagagttctggaagacacacctgctgcctttggtatagtgagagctaacccccatgctggtcccggtggactaccccaaatagttattgaaaaatacgatgggattttagaacctttatattcggtgaagttaaaatgatatacgctaatggtaatgtgaacttaaatggaataataattaatccattaattaaaaaagatattttcctagaaaaaacatcagagcttaatccagaaaaaatttatatttttgaaaatagaatccgttattctatagataatgtattgtttttaaatttaaaatatattgtcagcgctgtttttcaggatgaatttctcatttatattgaattgcttcctttcgataaggagatagaaaataaaatcaatgtatttaccaatgaaaaccaaatgagaaataaattaatcaatgatgatttattaaaatcactatttggttcatcagagaaactttattttccatggggaagtattgagtctatagcagatactagatcaggtatgtcatacatatctatttcttataaaaacagtaatcactgagttagatatgaatagccgggaagatcctcgtgatcctccggctttttatgataaccccctatcagttcccgtatcctcagcttgacctcagtgagctggtcttgtcgggggtcagcacagacagccatccataattttgacggtgagtgtagcgccttaatccattgacctttcaggtgtatcgtggatggagcactggccttatcattttgttgcagcacgttgcatattccgacccaacgtgaacagccattttggcagatagtaaggcagccagagaatcctctaattttaaagacttcatgtggtataaagaatggccaccaaatcgagggttctacgaaggtaaatttgaaaaacttaccttgcaaccggatacaagacttgatcgatatagtacggattatggcacatttgtttctccagaaggtattccatatagcgcaagggcgctgaagccgggaagtgatggcagaccttatactgtttttgtagttaaaaaaccaataactgccgatgctggtgaaattgctccttggtttggctatccaggacgtggcacacagtacgacttgcccgcgaaggtaaaagaattaattgacaatggttcattggaaaaagtgtcaaaaacattaaaagggaaacccataccgttagattaataggtatatcaatgaataaagaagaactgagaaaacgtttaaaagagaataagatctcatcatcatactattcattagaaggaggtgctcccgatgataggatctgccttagttatgaggatggatattggttagtctatcatgcagaaagaggtgcgcgtagttgggttgaatcgtttgaaaaagaaggagatgcatgccaacgtttctgggagtatgtttctgatataaaaagatgtatggataaaacataagaccggaagagatctccgtaatcttccggtttttttctttttaagagcggctcactccctgcccttagaggcttttataaattccgtgacgtatggagagggaagatgatgaattatcaaaaaaaaaccagtgttaatgcatgatggggataaatatgatttcatttacaaaaaaaatcatatcaattgcccaatttgtagaagtgatatttttttagtgtatacaactccgatgattttgataagttagctcacccattgcaagacaacttggctaaaaacgtagcgtgtttagttaaaaatgagaatgaatgtggacatagatacacatacaaaagacttgctctacgtatcaactatactaaatgtgaacttggagggcatgattttgcagtgatatttacttttggtgaaatacaaaataccagatatgggtctcacttattaggtgtttttcaagtaactaaagaaaaattagatcaataatcacgtattttcatcgaggctgtacataacttcattttattaaaccggaaagatccctgtgatcttccggctttgttctttttaagagcggctcaatacctacccttagccgcttttataagtaccaatcagttcccgctattccatggtttggccagcccagtatgggtacgcaatatgaaccttctggtagaattgaacagttagtaacagatagtgttcttaagaggttaccatgaacttcaaaatgaataatctgaagaaaaaagaaatgatttatgatggtcttgaagacggattttatgaactaaatcatacgattcaatgcccatattgtgatgaaaaaataactgtcagcgtttcaagtctaaaaaacttaagtgagttagatgaacatttgcgagtagcaataaaagatagaattacaggtatcaaagagtttccgttatcaacaatcatgattcacaactatgatgatttatcagccatgtatggcatatatgattgcaagatacaaaacgtaaaattattagccatttttgctgttggcgaacgacaaccagcaagatatcaggtaattttattaggaatttttaaatatcctgaaatgaattaaaagtaataccataaagctggaaagatcccgatgattttccaagttgttcaagcccatgtaccagaccgcatagcgaatgctgcctatgcgcgtgcaaatctggataatataggtaatgcccaatatattaaaacgactgacctaaataaagcacaatttaaacctaaatgaagtaagttaatatctatctcatcatgtaaaaattagagaatacttttatggaaagattaatcgttaacgtcaaagttaattgggtttctgaagatcaagatgggaaatctaatttaccactcaatatattatattatgtcattacggagccaatgaaaggcaagattggtgaaccaacatattggagcttagtattagacataaaaagtaactcttatgatgcaggagaagaggagagagtaggtttaggaaaagcttattttctagttgatgatgctcctgattttttacttactcaaggatttactttaaatgtatatgaaggtcctaagtttgttgccgtagttgaagttctttgaacttgttaataaatagtaattggttaattttttatttaaactcaaacaggaagaactatgcgagcttccagtttggtctttccctaatatctatcttgccccgtaattaccaattaatcctcgcatcctgagcttgacctcactagacaagccttattggcactgatactgtttttgatagctggagcaagaataccacctctatctaatagaggtgaacttaatgagattttaacttattctggtatgcttgggaaataaatctgaaaacagattagatacaacaccagttagtgtcaatggaaatatgggtaactataatagtttataccaatttaactccaagatgcaggcttgttatgattatttattctataaaatcagtattatatgaatttttaatcatgcatcttcaagtttgttgagtatagatccgaaaaggtatggaaaatgatggacgtcaatgaaagaaaaatcaaaataataataaatggtaaaatggaagaagctgaattgcatttgattacatctcctgataggcattgttgcttaaaaatatttcataataacaatcagttggcagaatcaaatgacactgattatttttcatgctttatagatttaagaaaccaattaaaagatatagtttttctttgcaaaggggcaaaaataaatgtgtttccatctgcaatgcagagggatatgggtttaggtataggagcttatgaaactaaattaggtcagtatggcttacccgaaaatcaggttcatatatttgattttgaggataaagatgttgatgtttccccagaagaacaacgaaaatttcattatcaatggtttgaatcattacggaaaaataactgatttattagcgtagattaagccggaaagctccccccgtgatcttccggcttattgctatacactgggcacagagccataaaggtgatattcgatcgtggactcaatttattaattttactacactatcagcaattgaaaagtcttacacggcgcaggcgggtctcaggtcagattctgtcatcaacataattttgccatagccgaaaacaacttgaacggggttatccagcaaaccggtttccgttaaccaatcgccagccagatacagctcaccattgtcacgtacccaatcgatgccctgtttcggatcatcttccactgcgtggaacagggtagccggatcatcgtcaggcttcgccaacgtcaacatcagcccgttgttatattgctggataagaaacagggtattgggcgtaaatcccatctgctgcatatcgtcaccacttaacacacattccggttttgcagcgtcttcagtagaaaatttaagttccataggttccttctttgttgattaataaaataaaatgcgagctacttcgcaaaagaaaaattttgccatttcagtgcaaagcgcaactaacgcaggagcgttcaatattgtgttttaattgataaaacatggcattgtgagtttatcctggtagctttttacttaattttccgggaaattgctgcagccagcgtgccacggcgatatcatcccattcgccttcattcaagctttttaagcaatgccacagttcatgaaaattttgggccgtgatgatcaaacaaccaggcatcactctgatttttaacggatcactaatagagaacccggcttccagcagccattttccgcttaaattgatggcagggatcgtgcggttaacccccttggggcggtaaaccactttctgataacgttccggttgggaaattttgtaaatgcgggtgcctgcagtagaatgcgtgtcagccataataactacgtccttagttgttgtggttagcggttttatcgtgttcctagcacgttaaagccgcgtcgaaattttcaccgccactctatccgccgcccaaataacatgccactgacaaaaatgacctttgcaaagcggctcgcaaaataacgacagcgaatgtattccatttctattgactatcggctcgggatagctgcctcatgccgggcatcaaagagaggtaaacccaacagccgtattacccgccgccatttgggtaaatggaaaagcgaacaaactttgcactattattcatattgtagtaatgtacctatatagagaattaaagtaggaggtgctgccatgaccatcacgaccctctccagccgagagctgaatcaggacgttacccgcgcgaaaaaagcgaccaagaacggccccgtattcatcaccgatcgcggcaaaccggctcatgtgctgttgagcatcgaggaataccggctgctgacaaagcaacatcgtaacattgccgattctctggctatgccgggcgttgcggacattgagtttgagccgcagcgaatgactatcggaacccgcccggctgatttctcatgatgtacatactcgataccaacgtggtgtccgagctacgaaaaattcgggcagggaaggccgatccgaacgttgcgaaatggactgaaaacatcaatgccgccgacctctttgtgtccgccattaccatcatggagttagaacttggcgttttgctgattgagcgtaaggacgccacacagggggccatgctacgggcgtggctggagcaacatgttttgccggagttctccgaacgaacattgcccgtcgatacagccgtagcacaacgctgtgcccggttgcacgtaccagacaggtgcagcgagcgtgatgcgctgattgcggcgacggcgcttgtgcatggtatgacggtagtcacgcgtaacgtagccgattttcagtctacaggggtgacaatcctcaacccgtgggagtcaaacccatcatgaggatcggaaaactgtcgttatcgggttactgtatgcgccgcttgagatccttcagcatgtcattcaatctctcaatggcctgtgtgttttccgcaatagactgcttgtgacgcgcgtcggctttagcctgctcattgagttgctcctgtaagcaccgcccggttcctgcgtccagaaaatgatcctgactggcctccactatccagccggtatcattggacgcggtaccgctgaccagtgatgtccacgccgaggcgttacccgatttgtccaccagccttgctcggaagtagagcttctccccaaccgccagcccttgtaaagtatgagtgcgttgcgggtaggcaatatcggcgaactgcagcgtatcgtcatcctctccgtttttgttgtagccaatttccgttttcagcaggacatccgtcggattggcaaagtcccagtccagccggataccaaaaagtagcgatgtggttcggagggactgcggtgccgacggagcctcttttcggcttcccagcagggtatcctgcgtgttcatccagatactggatattgccgctgcattcgtggccctgacccgcgcctgatagcgtccgtcatcgacgttcggcacctcaagactccgggcggtagtccggggagcggttatccagttaccgttgtctttgcgccattcgacttcataggccacggcactgtcggcggcatcccatgtgatccgcaacgtggtggagattataccctgattaagcgaataataactgtcgataagaacattcttcggtgccggctgaacgctgggcggaatgacggtaacggggcgttcgtcaatacgggtgtccttgtcgataagagcatacttgtcggggttgtgctcaaccgctgtgatgtcaaacgacacgccgtcctcccccgcttttatacccataacccggaagggttgctccgctacatagctagattcaatggcccagactgcgcctacctcaggtggatctgaataggcatagccacggttactcacggagatctcctgtccgttaatcgctgtaatgagatccctttctgccttacctgaaggcaggttgatgacaagccagtcccctacttttgccgatggcacccgatccaagataatgtatcgcagccgcatggcctgaatacgcccgctcatccccgaccctgacagcaggttatccgacacgccaataaggtaacccggcaggggaatgtgtccctccagcccgacggtgaaagtgactgtccggtcgtgttcgttggtgtgcagcacccatttaccacgccggatggcttcactctggcgggtacaaccgatggcagtgaagtcggcctgccggataccatagcggcgtatcaggcgatgttcaaacactggctcaatagcatcctgataaccattctgcggatcggaccagctcaccatggccgtggagtaatgggttttctcgctggcactggaataggtgaatttgccgtcacgcacattggcacccgtaaagagataatccatgtcacggggcatatccgccagcacgttcatgttgttattggcccagaacgtcatcccccggaagatccctgcaatatcacgcaacacggcccaagcgtcttcctgtgactgaatatagacattgcaagtgaaacgtggttcttcgccgccttcgccatccgacacagtctgatcacaatattgagcgatgctatacagatcccattttgccagattcaggttttccgttttcacccgggtgccgatgctgaaccggtcatttatcatcaagtcatacagcacccatgccggattgtcactccatgcccatttgaaggtgccatcccaactgccataatagcggcggctatccgggttataattggctggcacacggatgatgcgcatcttcggctcacaggtgatctgcgggatattgcgaaactgtttggcatcaaactgaacaaataacagggcagtttccgggtagcttaatttggcatcgatcacctcggtaatagcctccaccaccatggcatcagcgatccggttgctgttttcttttggcgtcaaccgccgaaggcgcacctgccagcccgaataggcagtgggtaaatccacccgatgggaacgttcatatttggtggtagttttaccatctacggcagttttcaggatctccttgaaagcaccgccatctgtcgcgagatcaatggcatattcaatgcgataacctactgtatctccgttatctttttgcctctgcaactggggccacgataaccgcaggcgaaccgctgacagttgagtattggtgaccgtcgtgacccacgagctgaccagttccgcgctgacggttcgggcattttcgaccgcaggcataccggggatatacgcctgatggggtgtgccgggacggaattcccatttgaccccttcaaaattgggcgtgccgtcggcaccgataagcggtgtgttatccagaaaaatacgtctgccatccagctctcccgcaaattccccttcaccgagggcaaggaggatcttggtataggaggtggactgcaaagagtcaggtgcttccaccgggatgcgcggatgctggctgccacctttgttgccctgaataggctgcttttccatacttcaccctcagagcgttattgttgatcttcagcgtagatacccgctgaaatgatggcaccgccaatacggcgtctaccgtagccaatgggcacaggatttccctgcgcaacggtgttcaccggaccaccgaaagcataggatggcttgttgtcgggatcttcgcgccgtgccaacccgcccggcatcggagaaagcatctgcactacgccgcccagcatcatgccaaccccagacatgaccatcggcgcaccaaacggggtcgcccacaaaaacgcgccagcaaccaccagcaccgcgcccagaatggtctggaaaacaccggcgtttttgctgccgataatcatcggggcaatgcggatatcgtcctgcccggaaaacaccagctcttcccggctgatattgcgttttccgttaaacacggcaaaggtcagcccctgttctttagcggtcagcaggaagcgttcaaatcctttaatcagcacggataatgcacggatcgcttcctgtggggtagagacagccagcttatgcactctcccgaactgagcccccagcacaccgtaaagccgtacggttcgtaatgtgttcatgatgtgactcccctaaacaaaaaatccgccgaagcggatgagtgacgtaaggttgtgatggtgcgttcctgccagtagccataatagggttcgcgcttactgagctgcccgtacagatggtgcaacatcaggccgttacccagataaacactggcatggttgggttcattggcctgtacctgcataataatcacatcccctgcctgtaattcaccgcgacacacgacaaatccggcagcggcataatgtttcatatacagattttcgccccgattccaccagccatcggtacgttcaaaaccagggagttcaatagcctgttccagtttgtaccaatcacgtacgatggcataacaatcccaaataccgtgcacgaacgggcgaccaattaatggcttaatacctgctatgggcatcaaggtacggatatcccctcccggccacgaaacaatcacccatggaatttgtgacaagtcacattgggcgatatccaactggctcggttgtgtcgtcgcatcggggtggctgtggacaatggcaacaatcgcaccttggtcttcggcagcagcataatcctccgggtgaatacggaactgttcagtgggtaacgatgcggtattgcgacagggaagatagtgctgtcggtgacgctgttgaatgatcagcccgcagcactcatctgggtaagcggcttgggcatgagccatgatggcacaggtggtcgattttctcagtatcttcatggttatcgcctcagcaatgccgagccgggaaacccgccaaagggcaattgctctgtgtcaccaaagcgttttttacaatcgctcattaatcccccgcaagcatcagaggccggatcatcggtcggcttgcctctttcattaaaataacgggtgccgatatagccacacggtgattggcggtactgcccgcgaatacaccatgtacataggctgtgaatttgccgggtcgggattttaatcccctgtaaatcggctggggaagagagagaaaactggatgctttcgttatcttcctgagttttgctgtcgatgtagaaaacatcgattttttcctgcgtcggatcagcttgcgggttgccgtcgaggaaattacgggcatccagatagtgagcaaaggtcatgcggatcgtgacacgcgcttgcaccatgttttggtaagccaaacacaatgcactgagcgtgccgtccagattggccacattgagagtgggtgtcactgcccgtccatcgccggtgacttccagcccttcgatgctgacgggccaaggtttgtattcgacgccctgccaccagagggatttcaccggtaaatttccggtattttccagttcggctccggtataagggatcggatgattatgaaagtacaatacaggcccgccaaataccgagccatcaacaacaaataatacgattttacttcccggctcaagccgctgaagtgtagcattgatggtcataatgaaatctcttatggatgatagatgagggtgaaggtcacggaaagagtgaaataagcgccattagcttgaatattgaatttccccgcctgatacaatcccagttcaaataacgggttacgccatttgaatgggcgccagccctgatgctcacgcagaaaagctatgataggctgtatgtcagacagtgccccgacaaaagacaaaggccaactttcgcgctgcgtgttgatcccatcgccggacgtttgtttataaccatcaccgaactggacggaacgcacaataggttcaaactccccgaccgcgcccacccttgcaggaaaatcaaaggtttttatcatcatctgcctcctctaatcgcagcactgagttcaccaccttgacttaaacttttatgcagcaaaaatttgaatcgctgatcgacaaatttcgcgatatcctgtcctgccgactctgcaccacgggatgttttcgtgtcgtggttaccgtcggaatagatcacaatatggacggtgttgaaggtctggttgccagtactgcctgtggtctgaacacccagcttaccgtcagcaccgcgttttaagggtaagatcgcttccggtcctgcttcccccatcacaccgccgcctttggcaaaagcaaacagagtcggttgactgacaatctgcccgctatactgatttaaatccgcagattgatagacgccacctttcgcattcatgatgggactcttccagacatccggggtcattgctgtgccagaacccatcgaagacaggccgcctcccgccgaagacaatgagctggcacccatgcttcccatcgcgcccccaaagaaaccggagagcgctttggttatcagcgcctgcaccgcaatacggaccagatcctgaataatggattgcgccagtgatgccgacagttcccgcatggattccgaaaaggattttgtgcccgtcaacatgccggttaacgcgttacccgtacgttgctcgaccacatccagcagacccatttgcattttctggaaatcgccttgtgatgcgtataaattcttagcggcagcaaattgcgcatctttggaacgataagcagcggctatcattaactgttcatgacgttccttgctgataagtccgttccgatagtaggtgtcgtaaagtgcagcttgttctgtgagctgattttgcagttgcacaaaaggatcgacctcacccgccatatccagatgcggggtggaaatttgcttcgcctgttcagctaatttatcttttaccgaggtctgatataacgtcctgctggcagataaatactcctgttcacttagcaaccgttcgctgtacagggctttcagttcttcgctggcttctttttcctgtcggatcaatgcagctgccggagaatatttatctgccagttccagtcgctgcttttggtgattttcggcattgaggatttttaaacgttgaagctcactttccgaagccatacccgatttgccgacttcatagattttacccagcatttctttctctctgaatcggatgcgatccaagctggtggcatgggtctgctcaatttccttacgtaactgctgataaaggttaagtgattgtttgccttgtttctcttctttgatgggatcttggcctgtccacggattacccgtgccgttcccctcgggttttgacagctccggcggtggttggtcaaagatacccgctaccgatgttgcctgtaggtttttctttcttgctgttttattttctatccctttgaggatatcttctcgtcgactgagtaatacccgaccttgcttttcaacttctttcggctcttcataaagaaaattcaagaaccctttttgacgattttgtaatcgcttgattcgagtttgagaataccgttccagttggctatcaatctgcttgagttcttctttcaggtggttgatatcatcgtcagttttatcaagctcgatttccaccttaattctggaaagacgttgcagctcagccaccgtatcaacggtttcatcctttaagtgccgcaacccctctctggcttgaacgctatggttatataatccatacaaggctgaacccgccaacatcgctgcaccaaatggcccaccaatcatggcaagtgcgccacgggtaactcccccggcggcagataatgcccgataggaataagaaagccggcggttagccgcttcaagttgcccggttgcctgtgtttgcaatttgagagcttcagtttcctgtcggatcagggttcttttttcttttgcataattgacggaaagaccgtgcaaacggtttgttctttccagatattgaatgtgcctgccctgtgcttccgttgaacgcagcgtggcattggcctgttcaattgtctgttttgcggtttctgcctgctgtttagcaacatcacgagctgctttttcggtggcgcgccatgccgtaatattttcacgtaatcccgcagtcagcttagtcgccatcacaggaattaacgtatgcaatgccacactggcaaccagattaaagttttcggacaacgcattaatcgcattggttgccccctgcaccccggtacgtaatgagccgtcagcactctgtccgattttcaaagccatgccttcaaaggcactcatcagcacatccagatcagccccaaggttattagcacgcgcactgacctgttcataagcgacctgcgttccggtcagggcttgggtcagttcttccagtttttcccgcccggtgactaaattagacgccgcactgacattcgcccgcccgaataatttcaccgcctgtgcggtcgagaggtttttgcccgtcagggatcccaatgccgacgacagaccaacaaccgaaggtttcagatttttgtctgtcgagcgttccagcgccagtatcacgttacgaatggcagtgcctgcctcgccgcctttaatgccgcgttccgccagtatctggataactgcgcctaactcttcaaagctgatccctgcctgtgccgctgcggtgccaccatttttaatggcctgcgccgtttcgttaatttcggaagaaccgtatttcgccccagccgccagtacgttaataaagcggtcagcctgttctgcactggcaccgaactgattaagcgataacgccaatgcacgagtcgcatccggtaaatcaataccggacgcctgcgccagtatcaccgctttctcggttgccagcgtcagtgcctcggtacttttcagcagttctggctttgctgaggccatcaatttaaacgcctcagcaatgcgggttgcgccgaattccgtggtacgcccgatccgttgggcatttccatccagtttctttaactgctcgcctgttgcaccagtaatggcggacaggtcagataacgcctgcccgtatttacgggtatgggagataaccgtattcagtgaaaagccggtgcctgccagtaacgccagttgcccggaaacggatttaatatgtgatgccagtgaactgtaggtctttttcagtttcttggcatccgatcccgccttatccgtaaaacgttctgattcccgcccggcataacgataggcatccatgatccgggatttaaacgaggtggcattaaccagcaagccgaccgtcaatgtcgataaattagccataacttaacccaataatttcatgacagcatcacactgtgcccggaccgtatcacacggagcagatacggatgcagcaggcggactgtctggctgttggcggtttttcagtcggtaataggcttgccactcgttgagcgtggacgcaggcaaggacaagatacgataagggtcgatttcaccgagctgttcagctaacgtgaaggcaaaatgcagccacggcgagtagattagtttttttcggcctcctccagtgtgccgatggaatgacgcttcacggtctggatggcttcaatcagggtggcgttatcatggacgatcatcaattcttctgcggtgggcagataatcggcgggaatagatttacccttatcatccaccagacaatccaataccatctgaacattcaggcgggaggccccacgcccgtctccctcttcactcagcttttcagctttttcttccagctccagcagttccagtgccgtcatccggcgcaggttgatttgagtaccgaacagttccaccgctttaatctgcggatgcggagtgagtaaggccgctttcagtgctttcattggataactcctgtttttatgtcagcgatcccccaaacgaggttgttttgcttgcctttaacggtgagctgaatcacttcactcgccggggcgttaatatcgttcatttcccatccggaaagcgctagcaccatcgtggcggtacgtttattcggcagagcaatgtaaaactgcacagtttcgcgcttttcagccgcgttcaggaaagagacgaaatcttcgttcgccggatcatcgataaaaccgagggatttttccgggccttccggcatatcggaaataaactgcttattggtatcaatcagggtggtacagtcgacaaaactgccggtcagccctgttgcgcccaaggccttacagttgatgagtggtttcatctgctccacgctatcgccgggcttgccgaatttcaccaaagtacctaccggcaatacagcgtattcaggggacgttgccatgattatgactccagtcaggttatttactataagccgataaggcggctctgatttcctgcgccagcacttttaaaacgacttgtttgttgtaatccagcgccggacggataaaaggttttgccacttgtttgatggtacccgtttcctgcgccagtgcttttattcggtgtgttttcaccgggccaaccgtgatcatcacgccaccctgatatttcgtggattttgcggtgcggatagggatattatcccgcagatgcacggcgttgcttttcttgtcgtaaccggcatggacctgcatatcttcctgcacaatctgcatcgccgctttaccggcttttcgcataatgtccgtctgaagtgcgacatccagctcctgcaatttgctccccagctccgcccatcccgtagtttgtacggtgatcataccgggttctccgtgtaagtgatgataaagtcccgtgtgatacggtaacgcttgcggttttcagtcagctcttccgcctcctgatgcaaaatcccgcgtgaaacggtttgtaccggataacctcctagcaggccatgctgcacagattcccatgcggaacggattttcgcttccagccgcagggctttggtgtaatcgttcagcaccataatgctgatttggaaacgagcttcgattaacagcgaagccgccagcccggtattgaatcggggatcgctgatgcgctgataggttaccccctctaataccgtagagggcaatatcagcggataaacaggcaggcttgttaaccgttctaaatcagctttgagttcgggttcaatcatgacgcacatccgcctccgtggtgataatcgtgcaatcaacaaggttacggtcaacggcgcgtaccgtgaaccgccgttgctgatgtccaatcagccagcccggttcgatatcacgccgggatctgacggtaaattgctgtacctctatcacctgttgttggtcagcagtacggatctttcggtttgacatggcttcggctttcgcccagacggtggcaacataatgatgactgatcatttctgaacccagctcatcacgactgataaccggacgaagtaaccggatgcgataacgcagttcccctgctttcatggggttctcctataacggaataaaacgatagggttccagcaatgcctgaaagcccatcggtaatgactgggcctcccggttgtcgtaccagaaccctacaattaacataatcgccagtgccacatcgtcggtaacgagcaggccatcaggatcatccttcggcacctcgttctcatacaggcgacggttcaggtagctttctgcccgtttgatggcggcacgggaataggtgtttaataagtcatcttcggcggaattatcactgtcgatacggcattgttgccgaagcagatcaagagtgggaaaaggcatgtactctcctgataataaggtggttaggccttaccttctgctactttcagcagtttcactgcgttgctgtccaccagcagagaacccacccgtttagtggtgtagaagtgaataaacggtttgtgcgtgtacggatcacgtaacatacgcaccccgaggcgatccaaaatggtgtagcagcgtttgaagttaccgaacgctatcggcacggcacctgtgctcaaatcagtaaactgctcgttttccgcgataccgtaacccagcagagaagacggttgccccagttgtagacccggctgccacagatagttgccctgactgtctttcagagtgcgtacctgaaacagcattttgttgttcatcatgaacttcgctccggtgcggtacggtttacgcagggtgtagatcagttgcatgacttcatccgcggtcacctcggttggttttttcagcagcagatgctgtaacttaccccatttacggtctttgtcttcctgcacatcactgccgtaggccagcaaacctttcggtttgtttttgccgtcaccgtgggtaaaagcactctcctcctgctcagcaaactcttgtgtcagttcagatgagataaaggcttccacatcgaaaaaggcatcatccagcatggtctgggtcgcggcgggattgccgtaaatctcgccccatgtcggctcgatgggcatcagcttcggtgttttagtttctggacgttcatccgtttcgcccacccagccactgttaaccccgccctgattcaccaatcgcttgaagttcggactgcctacggaaaccacgtgacactcagcacgcatcactacttcctctttcaacgcgctgataatattgcgatccaactcctctgggacggcatagcctccttcaggatcggcagtggtctgcatcgctttttgctccaactctgccagcctgtcttctttgcccttgcggataaactgggcaaacgcggctttgtgctcgctcaccgctggcgtattgctgccgcctgccggacgtttcagccccaccagctcctcttccagcgcggatttcaagctgtccagctcagacagtttgccattcagggtatccacctgctcggacaacttacctttctgagcttcgattgcctcaatacgctgatcgttcttctgtctgaactcgtcgaaacgctgctgaatttcctgcgcaacctgttgtacatctttgacttcaatcgccatcgaaaactccggttagttaaaatgtaatgattccagtgcagttaatgccgagacggtctcagcatcacgcaaagacaaggctccgtagccctcctccataaaggccctggcctgagaacgggagagtccaacatcacgcaggacccgttcaatacgactgggattggggatatcacctcgggcaaaggccgatttcacgttgctcacccgggcatcctcgttggcgggaaaggtcactaggctcacttcccataaatcgagatctttcagtaaaaaagcctcttttgtccggtcatattcccagtctttcaggatgtagccgatagacagaccggagagtgatccggctttcatatgggcatgagcacgttttgccagcagatcgtcatcaatcagcagtcgccctttgagatacagccctgtctcgtcttctttcatttcggtatagataccgatgggttcatccattcggtgctgccagagcagcgcaggcaggccacctttttcaccccattgcttcagcgtattggcaaacgcaccgggtaaaacgatgtcatcagcgctgtctttgagtccgaacactgagccgtaaccctcaaactcaccggaatcgctgaccgatttgattctcaggggcatatcaagccgttgcttggttatcatcggcatggggttcttcctcttttgtcggggcttgttcgggtttcgtggtcatgttcatcggcgtgagataaatatcaccgccctcgcggggattgagttcttccagctcccggcattcgttcggtgcataaatgccccagttaatgccggtggcataggcttcaaagcgggatttcatgtccccgcgtaacaaagccccggtgttgaacttggcataaaaccgcccctgtttagcagttttaaccagcccggcattgatgcgctgttcaatgcgggtgaggtaaggtaccagcgagtaattaataaacccgatccccagattttcgatgttgttaaaggtggcgcggtcggtgttctgcaccatatgcaacggcactcggaagatgcggcagatttcctcaagctgaaatttacgagtttccagaaactgcgcgtcttcggcggacaggctgatttggtgccatttcagccccatttccaggatcatcggcttatgagcgttgaccagcccctgatgacgggcttcaaaatccgttttcagccggtgatacgcctcgtctttcagtgcctgatccgtttgcagtacgccactggtgactgccccgttaccgaataaccgtgaaccgtgctcttcagtcgccagtcctaaccctatcgcctgccgcgcataggcaatcggacttaacccggtctggccatccagggtgaagatgcgcacatgccaaaggtcatcctgtgtcagtgtccggctttctccgttcgggaaggtcacctgatattccggctgccagtcacgggttaatttgctgctgacactgcccggatcgaggggcaataattccaccacttcgccgagcgccttcactttgtagacatagaagttaccgcgcaggcacaggcaagcaattaatagctcccagaactcctgcggcgtcatatagttattgggctttaccgatagcagtttatgcagtcgttcacgggttgtccgtttattgccgcgatccagttgctcatacagcgaacagggcagcatgccgaccgattccgccagcacccgaacacaactgaacacagcggtgagctgcatcgctaactgtggactgactcgccgcccgctgtaggtatcataagacaggccgatcagttcacttaagtcacgggaggtcatggagtcggcggatttgcgaaataatccggggaaaaacatcaggtctccttatcgggtttctggctcaacatacgtgagaccagatacgaccagccgaggcacaggctgccggcaaccataaatcctgcggccgatagcagcagccatgcaccataagacagcaaagtgccgcctgccagcccaaccaacagggcagcaatcattaatcttttcatgaaaaaacctcagagtgagcgaacaccgtgggagatcaaatgatctgagagactgggttcttcgtgcaaaatagcccgccccatcgccataatcagcgctaccgcgccatcaattttgctgtctttatgctctttgatggggcgcacaatgtcatcatttccacccatcgttttcccgacgacattgccgatacaccaggacataatcggattaccgtcatgatggaaacgaccggactggatggcggcctccagctctttcatcggatcgctcatgtgagtgaaattctgggtaatgatgatggggttaataccctcatccgccagtgagtgagataagccagttgccccaaagggatcaatcggggcttcattgactgggttcaggtgacaggcgagtttggcttcttcaaggatgtagcggtaatccacttcagcaccttccgtcacggtcagcagatccatttccacccatttctgaaaacgctcagcactgcgccgattttcgttctgttccacactgtagaccgtgtcatacggcacccagaaacgtggggcgatactgtagaaatggcgtttgccgtcaatctcacggacaaaaagccgtgccatgctgttcatatccagcttgcgggcgagatcaaaggctagaaaacaaggctggccctcgaactgttccagcgtcagtgaagtatcttcgcactgtttccagttcaccatattgaagtaagcctcccgcgcagaaacccaaatattcaggtgtttggtcttaaatacgctggctaaacgcgggttattcagggcgcgttgttgctgactcagcaggaaatcggcatacaccgagacgcccatattgggattggctttgcgtaatacctccggtgaggtccagtcatcgccttcatccacggtatagatcacaccaaacaattcctcgttaggcacattgccggacagcatttcaatcacttcgcgccgcttgtcataacacgggccttcaatgttgtaacctgccgtggtgatcgcccacatcagcggctgtcgccgtgctcccattcccgtgagcatggtggtgtagagatcatcggtatcgtgttcatgatactcatccacaatcgcacaactgggtgactggccatctccgggattgccgatcagcggctcaaaccgggcaccgtctgccgggcggttcatattggaagcattcacttcaatgccgaatgcctcaagtagcagcggagtccgcttgcacatcagacgggcaggccggaacacttcccacgcctgtttctccgtagtcgcgccggaatagacttctgcgccgaattcgtcatcacaagtaaagcaatagagtgccacccccgctgaaattgcggatttgccatttttacggggaatttcagtatacacttcccgaaagcggcgtaaccggctgcctttatgcacccagccaaacacggaacaaacaataaataactgccacggctccagcgtgatgggcatgcgtttaaacgcccattcccccttggtgtggggcaacaattgaataaatttggcagcctgttcagcccgatctttatcgaaccggtacttaaacgcggtcgccttttcctgactcagattatccagatgccgccggcaggcgtctttgacatggcggcctgcgtcaatcttgccgcgcacgacatcacgggcgtactggctggccgcattgacattgaggtaagatttacggctcatgatgagatcatcctcatgaaagggttgtcagttttggccttgcccgcggcgcccatcagacgctggcggctgctgggatctagccccagcagggagccggtcgtatccatttcggattgctgttcttttttggcggtcagttccgggtttttaatgggccccccggtcgcgccggttaccgtgttaccctgttgggcaatattgataacggccttgcgccagaactgatacgccacacaccagcgctccagtaccgtcaggtcagtcacacacaacagcccctgtgcgcacagctctttgctggtcagctcccacatcaccaccgccaacggcatttcatgctcaacaaaccaatcgggcggcgaaacgcccgtcaacggggtaaaggccggctcatcccggttcagttttcgcttacccggattgcctgccagttcttttcgtgccgtcggcttggggcgacgacctgatctgcccgccgttccagccatactcagaacctcccgtattcaaaaaaacagggccagagggataaaaagcctcccgatttaaatttcatttttcgcgggtatgaaaaaagacccaaggcggcagtccttgggagcgagagaggtagcgatttgccccgcccctccctctataacgatggcatgtgcaatgattgcaattagaaattaatattcactcaacctttatcgtaatcgctctgtcgcggtcttctgtcgatggcaggcttcacacaacaattgcaggttgctcaacacatcggtgccaccgtgggctttgggttggatatggtcaacggttgtccctgtaaccactcgcccttgccgtaagcaatgctgacacagatggttatcccgttgtttgactcgggtactcagcttatcccattgactgccatagcctctgacatgtcggctcttgccttgttggtgatattgccagcctgtgtgcagatggtcagcgcagtagccgctgcgatcggaggtggtcttggagcagccttgcttgcgacaggcgcggggaatgcggggtggcatgtctgacctccatatagcaaaaaaccacccgaaagtggttgatatatgatatctatactatgaaaaagggtaatcattcagtaactatttgattctatctgtacgctcgatgaaaaggagacatgtcatagctaataccgatagacaatgataacttattgcaaatgaaaataagcgtgattatctgatatagcgaagggcttgaaattaagctctccgactgcgtaaaatccagatacaaaaccaccagctaataactgatggctattaaaaacattataatgtcgttgtcactaattttgattaatactatatttttagcttaacacccaaaaaggtataatcgtcaataatatctttctctattcgacgccttaaacttgcagaaaatgccgacggtaacgccattgttctttctgaaaatttaggtcttgactcccagtgcttatatgcaccatccgacattaatgccagaatgacatcattcccactactaatatctttgatgtctttaactatgatatcaaaatgtaattcaatgtcattagataaggcagatgtaagaatagtggaaagtctctctttgtgattcttcaagttacgcatactatgctcaccagaatctaagagttcttggaattttgtatgatctttggttaattgaactaacttattcccatttttaaagtaaagccgacaatctcctacatgccctatataaaccttagtatccactacatgtacgattgttagtgtggttgcaacgctaaaatcaaagttatcgatagccttcttagcctgtgaaaacgctttctctatgctaaagttcggctctgttaatgctttttgaattgcctgtattgcatattttgatgccaaatccgcttgttcagtcgaaccaactccatcagctactgcaaatacaatatttgaatcattatcacaagtaggaggcaagaaataatcttcatttacagctttgccttttgctgcagcgctaaagcaggacatgtcaattattctattcacggtgttacccccatagctttataaaaatcaattaataattcattagcatctgcatatctatcttcaggccaatgcgctctacatgttgatatgactttttttaacttatggggaaggtcttttgagtacacatcactaatgacctgacctatagcaaaaatatcagactgattggaaaacaacccactctctgttatttctggagctctatagccgtcacttcccatcccatttggttgaaattttgtttttacttcagctctgacaagatttaaatctttcactaatccaaagtcactgattttgtatcttccatcactgtatttcagaatattagctggcttcaaatcacggtgaacataactattgtcgtgtattgttttaacacccttaattatttgtcgcactgccataattttttcttccgcagacataccactcttaatggattctaataagttatcttcagccttctccataataaagtaaggtttgtctcctgcggtactaaaaagcactataggtgctatagagtcataatcaattaggttcaatgtacattgagttttaatttcaaccagaaacctctctcttaagtcagcaatttcctttatggctgttttattattctcaggagaaggcgagaaatattttctagcataccttcgcgagtgagtctttgttagattgtatacattaacttcatacacttcaccgaaaccaccacgtccgagtcttttcaagtcctcaataaaataattaccacatcgatccacactaagtcctcagataagaagctacggaattatgagagctatttccattcagagctataaacaatcagaaaaaataatatttatgaactgtagttttatactactaggcttagtgagtgtaaagaataattaatttaatagtatgctgaattttgattatctttagaattgatacctcctcctttcctctgatgaaactctagatatgtcatctttaccgcaaacactccgttctaatatattcctgcaaatatcttaattttgcccgatcgttgatgacaccttctcggatatcgagaatagttgatccagcttctccagtgagttcgacggtggttgcatcgaccacgctgccggaggcagtggtttcagacacaggacaggtggcttggatgcgcagcttgcgatgaccagcggcaacatcagcccgaagaatgtcgatttcagtcttagcattggcaatttcctgagtgtgtttggtatccagctcatacagtatttcaatatgcgtgttctggtaggtgatggtgtcagtcagttgctggatttcggttatttggtcgctattgataccgagctgcctcttgtaaccagagcggtataagaaggctgcggctgatgaaataatcaatgcaataacaacgccggaggtgaaattgagtttcatgataaaaacatctggcgttcagatgcccggcgattatccagcccacgcataaccttgcctgctgctttattccatcgggaaaactctcccgctacacccgtataatcactttgattgagtttcttcaataaagtggaccccgaaaagttaccgctgccacaattgaagataaacgagcacaaggcatcgaactggccttgattcaaagagactttaatcaattgccttaatgtagtgtaaataggttggagatcatcatgcaggaatgcttcggcctgctgttctgtaatcacatctccttttttaaccccttttgtatgtccataaccaattgtccacggaataccaccagttgcgggatctgggtaggcttttagtttcaggccttcatactgcttgatgcactcaaggcctttatcgctgatttccatcagaagatgttcccgctcttttctttgctgccttactcagcaattgaccgataaagtccgtacccaagtacccaatcaccacactgccgatgtaggccaaatcaggattcagaccaaacagatttaatacatcacgaatgaaccaggcgaacatggcacatataaaggcatcgatagagacttttaaccaaccgctgccgttatagcggcctcggagaaatgccattgttccggcgagtacagccccaataccttgttcttttattgaaacaagccagtcaccgagatgtacccaaatatcaggattttctttcatcttcatattccacccgattagagcaatgggtatccgtggaggagtgaaataggttcccccctgtgagttaggtaatagaaaaagttgaataatcaatctagattgattattcattcaaaaaataaatcaataggcaaaaagtatggctgactacctctgcataaataaggagaaatatgactatatttagtaaatgtcctgtatgtgatacccctttggatccattaccgaagaaaggcggggccgaagaatattcttgcacgaatcatggaagcatcaaaatttctgacacagttatcgatatctataatagaagcgatgaaaaaatccgtgatgaatatagaaaaaaaatagcatcaaagattgagaacggagaaggaggcaatataacgtcttacgacttataaaacaaagagcctcatcattacttgaggctctatcgttaatcgtgcattttcaaacaccatacaaagcttgaaaattttgattaaacacatctgacttttactatccaccaaaacactattcggtggttaccattatttcttgttcagtctgtttaaaccgttcctcttccagttccacacccaacacacgacgattcaattttaacgccgctttcaatgtcgcccctgagcccataaaaaaatctgccaccaaatccccttcccggctgctggattggataatatgcgccattaaatcagccggcttttcgcaaggatgttttcccggataatactgcactggtgcaaaatgccagacatcggtataaggcacgtctgccgtcaccgtgaacgagcggcgcattaaaccgtattcctgccgcaattcatcatactgacgcgacagggttaaatgagacgccaccagctcaggatacggggtgttcagttcaccacgctggtgcttttctttggcgatacggtcaaacagtccttgcaacttttggtagtcagtttcactgggtaactgccactgactatcgctgaaccaatgactagccatctgctttccggtggctttgtgtatgtcttttgccgtgatgcctaacgctttacgagcatcacgaaaataatcgaccagcggtttaaacaccgactgtttcagctcccggcattgtttgaaataaccatcgcctttcgggtgataggggccttggtaatgttcggcaaaaataatgcgttcggtggccggaaaatacatccgcaggctttctttattctgcctgcgccacggacctgacggtttcgcccagataatatggttcagcacgttaaaccgttcccgcaccagcagctcagtatcagaggccagacgtgaaccacaaaacatatacaggctgccgttgggtttcagtacccgccagaactcagcaagcagttcatccagccatgcaagataggccgtgacatcttgccactggttatcccagctacaatctttcacgcgaaaatacggcgggtcagtggcgattaagtcgatgcagttatccggcagggttttgataaatttcagggagtcgtctttgactaaggtgacagagcgtaaatccatccgcttttttcctctcgacgctggctgttctcaggaaagtcacaacacgaaaggccggcattaaccgacctgttctttcacgtcctgagaaatagccccatcagggagaacgtttgaaaaacgtgtcatcatctcggctttccattaaacccgccagacgaaattgcgttaacagtaattggcaacggggttcaggcagccccattaatttagaaacttcagaaacagaaaaccacgtatacaaaggaacggcgtctaaaacacaggcggctgttattgtcatatcttcatgttttagcatgataaatttaattctccggtcagtttttgtgcataaacacacatgtaactctgacccatcacaacagcaagtcttatgtttatttcaggcgtaaaaaaaccttgcacggggcaaggtttaaaatgtctggtattaataagccttgtgactttacaatcacgtttatcacaatagcaccgcttttacgatcgtaaagatttatttttacaagcagccacataatgggtgttgctctaacgggatgtctttatccatttccagtgagatatccagcatcattaacatcccttcaataactccttcggccttttgtaatcgcttcccgatatgcgtatcagaacaatgatgatcacgagataattgcataaatgttttaccaaagacgtaataatcaaagagcaggtcatgggcatcactatgcttctggttcagttttgccatgcaactggcgataatcatggcgtcgtcatcacaacattgtacgcgggatttcactctgttcgggattaatcctttgaagcccaccgcaatggatgaccagtaaaccccgtcgcgattatcagccgcccatgcaccccagcgttccatgactaattgaatatcacgcattcgcacactctcctgttaaagtgccctgtcggcataacggcgttctttttgtttggtttgtcgttgcatccggcaaacttcagcagccgatatctgatcagtcggcaaataatgtccgtgcctgaatgcctgataaatcgtaccggtttgcccgtggcggttcttctccagaataatttccgcgtactggctggcggagctgagtgggttatacaccgcatcccggtaagtaaagagaatgcgatccgcatcctgctccagtgagccggaatcacgtaagtcagcagctatcgggcgacgctgatgcaaggggcgcttatccacttcccttgatagctggctcaaggccgtgaccggcgtatgcagccgtttcgccaatcctttcagtgccttcgatatttctgcaacagccagatcgtgacggtcagcccggggttttctaatcaacccaagatagtctacgaaaatgccctttaagttcgggtggcggcgcttatgcgtttcactgatggcgcagatttgttcgacgctcaggtcgctggcatccagcacatgaatatcccgatcgatgagtgaacccagtgcatttccaatgcgtccccaatcatcgtcatacagttcacagtttctgagtttagaaacgggcattgcagccgaacctgccaccatacgttcggcaatttgttgcgccgccatttccatggaaaacaataaagcaccgccaccgtcacgggtcatgccgtcaatcatgcacagggccagttctgtttttcccatgcccgggcgtccgcccagcaaaatcaggtcagtcgggttaaatcccccggtcaattcgtccagcggctcaatgcctgtcaggatcatgcctgtcttgccctgattgcgcgcttccagtgtttcaacgtatctatccagcaatgtaccgatgaccacgggctgtaagctactatcgctctgggataattcattaaactgggacgcaaaaacctcgatcagtgcttcagcttgcgtgtgattgccgcaggcctgaatctccttctgataacggttaatcaggtcagtgacctgacgtacacgccaataactcatgactttttccgcatagccttttaggtttgcctgccagaccggggttttggccagttccagcaagttagccagaataccccgttcttcacccattgaatccgcaatgaaaaagggatcgataatggcactgctcagggcctgctttttgatttccccgtacacccggcgcagatgaacggagctgaacgcgtcatctggcagaatcgctaatacgtcgtaagcgtccggtgtcgccccgcctgataacaagccactgatgacggccatttccaaatcatatacgttcatgcgatttcccttctgtagctttcccagtcaaaggccaataccgtgccgccctgaagcaatctatctagcgttcggtcacccaaaaactgagccagctcagtcacaggcaaattactgatcaggatggtgggcagcaggtcttcatagcgattattcagcacctcaaacagaatattgcgttcagactccgtgccgtactgcacgccgatttcgtcaatcaccagtaaatccagctcactgtaaaatttcagtgtgtcaaattcgctcatctccccttcgctattccacgaacgacgaaaagcccggatgatgcgtgacgcggtggtgataaaaaccgcttcatcaccccctgtggcaatctcgcggcagagggcgacggcaaggtgggttttgcccgtgccctgacgcccgcacaggatcatgccttcccctgcccgcttgcgttcctcccacgtctggacgtagccctgacaggttttcaggttggtttctgccatcaggctctgcggtaggtaagtagcaaagctggcctgcgcaaagcggggaacaattttcaatatgcccagatcgattgtttccatcgcgtctgctgctccttaaagattttttgtccaattcgcgccatgtgattcataacgcttgtgcttaaatccagtatgggtgttggtttgtggtggacgcccggatctcggtttgtcaggaaataacccttgccagctgttggcaatggaggtgcaaatcacctcatcaggattggtacatcctgccaattgcttggcctgctggcggcaactggtttccgtcaggggtttcctgatttcctgcctgaacttcacccaatccgcccacgtttcggcactgacgttttccggtttggcagtcaggggatcgaattgcccggcccctttgggttttataggttctttgactggttccttgacgggttcaaaagagtgactggttctggtgccatctgatggcataggggggatgtcatcaggcggcataggggtgccagcagatgacacagagctgccagcaggtggcatagggggtatgcttttgggtgacacagggtcagcggataaattcagataatagacattcgaggcattccctttcccgttgtgattaccgagccggttttccttgataagcaagcccatcttaattagggcatcaatgtggcttcgcactgcgcttttgctgcattcacagtgatctgcaatatgctgatatgagggccagcactcccctttgtcgtttgcattgtcggctaatttgataagcaccagttttctcaggggattacctacccggatactcattgcctttaccatcagactcatactcatgctgtttctccctgttaccgtacattaaaccccatccccatgttcatcccggacgcacctcaaacacccggcatcatccgccaccagtggtaattggaaatttatttaggggttttgttcaggtggcgggaaaacagtaggcagatcaggacgcaattcatgagcctgaaccgccccgtttgaaaaaaccacaatatcggggacccgtgataccgaaacccgtttttttctgtacaaccatgcactgatgagcgattgcgcacaccccagaacctgagccaatttggcctgactgcctgcgatatctatcactttttttatcacactgtttttcattagtccctttctccaacaccaaggcaataaaaatatcactaacagtcaatataaatcactattggagtatttgtaaaggtatcactttagagatagaataagaaaaaatgttccaagacagcggttcttgggcttatcacctgtatttcacgtaaatacgggaaccactcatgaggcacttatgacgcttgctgatagattaaaagaagccatggcagataaggggctgacccaatctgctctggcaaaaaaaaccggcatggcacaatccatgatatggaaattactttccgggaacgccgtcaaaacaggccgactcgttgatttggccaaggcgcttgacgtgcgcccggaatggcttagtgatggcagtggtcataaatcgcagtccggtgatactgattttgctgtcaggtatgacaaccgttatgcaccggtaaaaatttatgaagcagaacaagaaaccccagagttcttcatggtgccggccttttctgaacagcaaacctcgtttgaatcctgccgggcttatcgcatcacccaaaataccggctgctctgaagcgccggaagggacggtgattgtagtggatacacaggaagagatcgccaatgatgatttagtctatacacgcatcggagaacattattcagtttatcgttataaacaagggggggctgccaattttttatctgttgatgactcgcgtatccccttgataaccctctctcctgccatggaaatcgtcggtgtgattgtttatttatttcgtaatatgaagcgaaaacgataacattcctcttcctactctaaacacccccaaaccctgcctctatttgcaacaagatactgtttttaatgcagtatcttcaatttcattgaaattattatcaccctaaaaatctaaaaccattcaaataatatcaaattaaaattatttgatatcaataagataattaaaaaatttgatatatatcactttaggtatggatttgatgaaatttaagtgataatgttagcggcatcaaagtgataggaataatcactactataatcagcgagaggatttatgcgtaccttcatttctgccatcatcaagaaaccggcaacaaaacaaaaaaatgctatcaccattaatggcattgttgccaatattgcacaaacaaacagcctgcatacaggaacaacacatatcacttttttggcagatcaatatcatcagggcaaaacccagaatcacggcatggatatacaaaataaagatgaatttaaacatcatatcttaacaacgtatcgagtcagcccaaaacatacagagcctgttccttgctataatttagaactgattgtcgattacggttatgcactctataagcggagaggacgatatatgcatttaattgatatcattcctctgattaaagcagacaagaaaacacagccaataataaaaatagccacacaataaacgactataaatacaatctataaatttcaatcaatattaaaactgaatgacagcgcctgcgctggggaatgtttcactctaaattcagaatagttacatacaagaagagaacacgaaagaagtctgttatatggaaactgcaaataaaatggctcaaatggagccagaaaaatatcatcttacatctttatattgggcacaaacaaaacactgagcaatgcatatcagtaatcaaaacaacaagagatacgccctgctggtactacagatagcccgagcacaagcaagggagttttgagaaatggctatcagagagggaggcaagtcatggcgataagatacattaagcgtgaagagatgcaacgactcacaggaaaaagcaaaacaaccctttggagaatgtacgcaaaaagaaatgagtttcctaaaccagataagactgctggtggaacatttctaggatggcctgaagaggtctatgaggcttgggtgagagagaagaagtagcgataacttgacccgttacctgacccgttgttatagcgggtttttcatttcttatcgtaactgattgattttatggtacgccctacaggattcgaacctgtgacctacggcttagaaggccgttgctctatccaactgagctaagggcgcatacgagatgaaaacacgttaatgcgttgatgtagacgggattatacgtgcatactggattgagtcaatgggcttttcgttcatatgcttattttatgattaccaataaaactgacagacgattcatgttctgacaaaatagcgcctattcctatactcgatgatggaatcttaaatacatgtcagcaaaaattattgatgggaaaacgattgcgcagacaatcagaagcgaagttgcagaaaaagtcaggcaacgagtcgccgctggaagacgtgctccaggtcttgccgttgttttagtcggagaaaatccggcctcccaaatttatgtcgcaagcaaacgccgtgcctgtgaggaagtcggttttacttcccgctcttacgacctgccagacatcaccagcgaagccgaattactctccctaattgataacctgaacgaagatccggaaatcgacggcattttagttcaacttcccctgcctgccggcattgataatgtcaaagtactagaacgcatccatcctgataaagatgtggatggtttccacccttacaatattggccgcctgtgccagcgtgctccaaagctgcgcccctgcactcctcgcgggatcgtgacgctgcttgagcgctgcaatatcaacacctacgggctgcatgctgttatcattggggcgtccaatatcgttgggcgtccaatgagccttgaactgctgttggcgggctgtaccacgacggtgacgcatcgttttaccaaaaacttacgccagcatgttgaacaagctgatttactggtcgtagcggtcggtaaaccaaatttcattcccggcgaatggattaaaccaagtgctattgtgattgatgtcggcatcaatcgtttggaaaatggtaaagtcattggcgatgtggatttcgatagtgcatccgaacgcgccagttggatttctcctgttccgggaggagtgggcccgatgaccgtcgcaacattgattcaaaataccttgcaggcttgcgaggaatatcatgatgtagataaaaccaaaggatactgatggaaattttttgtttagatggacacccttatgtagagctgtgcgatctactgaaacttcaagggtggtgtgaaagtggtgctgcggcaaaagcgatgattgcggaaggtttggttaaagttgatgaccaggttgaaacccgcaagcgctgcaaaattatcgctggtaaagcagtggcctttaacggccaatcggtgcgcgttgaagcgtaatttcgtgatattgcatcaccgttaatgctcttctgaaaaactgtaccctcaatgttttatacatccacggtacagttttttatttaaaaatataattaataaaagtaaaaatcataggaaatatcaacatcatattgattttaattcatattattagattaagatccagaataaataaaataaaaaccccagaaaatacaaaatcaagaataaataccacagcaatatgagacggggaaatagtagattcatccggttttattctcaggaaatgtgatacaagcgatatcctgataaataatcaacctcacaatgtattgcttttctaacaagttgctatactgataaactcacgtacaactgaaaaggcgttgattatgttaagtaatagagctgcaagacggttgttgggtatgcctcataaattgagtaattccaagcgtaaggtaataatttctcttcttaatctcaccaccagtgatagtaaacaccaaatcccagaacacctgagacattcttcttttgtctgtatgaaaaaagatgcttattcaggaataataacctatcacccaggaaatacattttattctgaacatttgaatacccgtcgatagaattgcctgtttttattctacagaattcattatcactaaaatgattatcgtgataaaaaagcgctaaaagacgaaccgcccactgatggggcggtttctagttattttatgaatcagtaatcaatcaaaaattgattatttgcgacgccatgtcgttccctgtgggccatcttccaactcaattctcatcgcgtttaactgatcacgcgcagcatctgccagcgcccactctttgtttgtacgggcatcgttacgctgcttgattaatgcttcgatttgggcaacatcatcatccacatgagcccccccttgcaggaactgttcaggttcctgttccagcagccccagaattcccgccagtttacgcagttcagcagccagaccgtttgccgctgccagattttcagttttcaggcagttgatctcacgagctatgtcaaatagtatggaataggcttccggtgtgttgaaatcatcgttcattgcttcagtaaaacgggcttcaaatgcttcgccacccgcaggctgggccgatttatctgtgccgcgtaatgcagtgtacaggcgctcaagagcagtacgtgcctgtttcagattctcttccgtgtagttcaactggctgcgatagtggccggacagtaggaagtagcgcacggtttcagcatcgtaatattccagtacatcacggatggtaaagaagttgctcaatgacttggacattttttctttatcgaccattaccatgccagaatgcatccagtaattcacgtaagggccatcgtgagcacaggtagattgcgcaatttcattttcatgatgtgggaacatcagatctgaaccaccaccgtgaatatcaaaatgatgtcccagttgtttgccgttcatagcagagcactcaatatgccagcccggacgaccagcaccccacggcgattcccagctaggctcacccggcttggacattttccacaacacaaaatccattggattacgttttacatcagcaatttcgacgcgcgctcccgcctgtaactgctccagatcctgacgcgacagcaggccataatcagaattggtatcaatcgagaacagcacatcgccgttcgcagccacataagcatgcccgcgtttgatcagttcttcagtaatctgaataatttcaggcatatgttgagtggcacgcggctccaagtctggacgctggatattcagcgcatcaaaatcgctatgcatctcagacaacatacgtgtggtaagtgcatcacaactttcattattttctgtggcacgtttgatgattttgtcatccacgtcagtgacattacggacataggtcaaatcatagcccagatagcgcaggtaacgggcaatgacatcaaatgcaacaaaagttctaccgtggccgatatgacacaaatcataaatcgtgatgccacacacgtacatgcccactttcccttcatggatcggcttaaattcttctttttggcgactgagagtattgaaaatttttagcatcggtgggttttccgtaaaaagtgacgtacgtgtaataaaagcgaacgaatccgctgattataggcttctttatcagcgatataaataaactagaatatgaaaagccagatgagatatttcaccttgatatgcaacgctttgcaagcgccgcgagcgaccttgttcaccgacgcttgcagagtactgactcgagatcacagatatgatataacagcggatgttccgaacaccctagaaaatagggtcaatcaaaactattattaggatttctattatggtgacttttcataccaactttggcgatgttgtgattaacactttcgctgataaagcgcctgtaactgttgaaaacttcttgaattactgccgtgaaggtttctatgacaatacgatttttcaccgtgtcatcaatggcttcatgattcagggtggtggttttgaacccggtatgaagcagaaaacggtcaaagcacctatccaaaacgaagccaataatggcctgaaaaacacccgtggcactctcgcaatggcacgtaccaatgatccacactctgcaactgcccagttcttcatcaacgttgttgataacgattttctgaatttccgttcagaacgtccagacggatggggttactgcgtattcgccgaagtggtagaaggcatggatgtggttgaaaaaatcaagggcgtttccactggccgcagcggtatgcaccaagatgtaccaaacgaagatgtgatcgttgaacgtgtcactgtcagcgagtaatcaatcgttacatgtgtacgctgtttattgcagatcttcatctcagtgagcaagaaccggcaattactgccggttttctgcgttttttacgtgaagaggctatttatgctgagagtttatatatcctcggtgatttttttgattactggattggcgatgatgaccccaattccctgcacaatgaaattgcccaagcactcaacgagctgaaacaaaaaggtatttcctgctatttcattcatgggaatcgtgattttctgcttggctcccgatttgccagagagagcggtctgatcctgctgccacaggaaaaggtgctagaattatacggtaagcgtattctgatcctgcatggcgacacgctatgcacagatgatacaggttaccagcagtatcgtaagcgggtacacacgccgtggatacaacggctgtttttacttcttcctttgtttatccgactgaaaatcgcagccaaaatgcgtgcaggaagccaatacgccaatagccagaaatccgaatcgatcatggacgtcaatcaacaggcggtgattgagcattttgaaaaatatcaggttgattggatgatccacggccatactcaccgtcctgcaatacatgatattcaaatcgcggataaaaccgtacatcgcggtgttttgggcgcatggcatcatcaaggttcaatgttcaaagtgacggaaacgtcgattgaactgatgtttttccccttctgatccctgctgcgtattcctgtaaaaatcgacaaatcaaataacgcaaacgttttccttatgctattcgcatgatatgatccgcctcctcaatatatatttgttctggtggacacccaatacaggagcatctgagttatgacgacccgccctgatcccgcaaccgctatttctgcaacttcaatgcaacaccacgccaaaatcgccattgtcatgggttcaaaaagtgactgggcgacaatgcaacatgccgccgatattttgacgtcactcgatattccctttcacgttgaaatcgtttcggcacaccgaacgccggataaactttttcattttgccgaacaagccaaagaaaacggttatgacgtgattatcgcaggcgcaggcggggcggcacatctaccgggtatgctggcagccaaaacattggttccggtctttggtgttcctgtgcaaagtgccgcactcagcggagttgatagtctctactccatcgtacaaatgccaacaggcatccccgttggtacgctggccatcggaaaagctggggcagcaaatgcggcattactggcagcgcaagtgctggcattacatgatgatgtactgtttcagcgtttgtcagactggcgttcagcacaaacacaagatgttttgaataatccagatccacgggaggatgcatgaagccagtctgcgtattgggcaatggtcagttgggtcggatgctccgtcaggcaggcgaaccattggggatcgctgtctatccggttgggctggatgccgagcctgaatcagtgccataccaaagcagcgtcatcaccgcagaaattgaacgctggcccgaaacagcattaacccgcgaactcgcccatcataaggctttcatcaaccgtgatattttcccccagctggctgatcgcctgccacaaaaacagctcatggatagtttgggtttggcaacagcaccgtggcgattactgtccgatcccagccagtggccgcaactgtttgcggagttaggtgattttattatcgtcaagcgccgtactggcggctacgatggacgtggtcaatggcgcattcgaccgggtgatgaagcggaattacctgccgaaatttacggtgagtgtattgtggaacaaggcattccgttttcaggagaagtttcactggttggcgcccgcaatgcgcaaggtcaatccgtattttatacactgacgcataatctgcaccaggaaggtattttgcgcaccagcgttgccttaccaaacgcagataatcagttacagcaacaggcagaaaaaatgctgtctgccatcatggatcacctgaattatatcggtgtcatggcgatggaatgttttattgttgacgataacttgttgatcaacgagctggcgccccgagtgcacaatagtggccactggacacaaaatggcgcttctatcagccagtttgaactgcatctgcgtgcgatccttgatctgccgatgcctcagccagaaataatggcgccatctgtgatgatcaatctgatcggtacggagctcaacccagaatggttcggtttgcctctggtgcatttgcattggtatgaaaaggaagtgcgtccagtgcgcaaagttgggcacttaaatctgtctcatgctgacaaaggcgcattgcaaacaacgttacaggcattgatctctctactgcctgcggagtaccaaagcggtttggaatgggcgaaaattaaattaagttgatgagtgatattcgacgttttgaattcaaggaagtggtaattttgaagataatttaccacttcctattctagttccagcaattatttttatttcttcaataacgttctggctagtgtatctacaatggttcttgtcatttggtcgatttcataattgaggaaatctcccgctttgatcttgttgaaattggtcattcttaatgtttctggaatcaggttcaaggctacggttttattctcttcatcaatgccattgatggttaaactacaaccatgaagaccaatgaaacctttcaggaagaaatacttaatgttgtcttgaggaattcggataaccaaccgataagtttcacctgttggcgtaaattcaatgacttcggccatcccttcaacatgcccatataggctatgcccaccattttcttgattcatctgatgtgatctttcaacgttaacctcatccccaacggtgagcaattttaacgttgtgctctcagcggtaaaatcggagatatcaaaagaaacccggtcatcggtgaactcggtgacggtcagacaagtaccatcgatggcaacactggtgcccacagaaacaccggcaaaaaaacgatgataattacttacggtcagtgtgctgaaaccattatttttattgagtgacaatacactctctttaccttgtacaattcctgtatacataatatttctcgtctccaaattaatataattacagattagctttattacagcttacactttattttttaaatttagaataataaaataaaaaacgcatatcaaaaccctctctgctaatttatttatattattatttccgttcgaaaattgataccgaaaaataataaaatttatatataaatataataatcataaaatatgaaaatatttaaatttaattatattattaatatcaattctaattaaatatatattcttatgaataccatgaattaaatataaaatatagaatcctacgttgctaaataaccttaataaaagcattgataaagcactggtgttttatccagcaattcttataataataacacacataatagaatgaaatattgcctatttaatttctctaccataatataaacaataatcatttgacattatcgtataattaaataaatgttactattttgcacaaaattgccaatgagataacaaggagacaataagtgccatttttaaggaaacgggaagcaaacaacattctaaagccgatgacagcaacaacggtcggtttatctgcaatctctttattcttcctttttaccgttcccgctcaagcaagcgatttcgtcaattttcaatccattgacaccagcctttacctgcaattcgaaaataaagtcgccccccagaaaacgatttctcccatcgtagaagcatttggtgattacaagattggcgatatgtatgtttacagcatttggcaaaattcgctgcaacatgactatcaaggcgataaaaacacctattactataaattcgtccccagactcagcgccagcaaaataacgaggtatgatctttcctatggcccattaaaagatgtgctgtttgcccagtggattgccaaaaccaaaaacgtaaaatacgattatttccccggtatcagccttgactggcaagtccctgggtttagctggctgcgtaccctgttttattttgaaaataatgcaaaaggaaattggaacgatcaacgaattcatattgactatgccattcctttcaataatcaattgggggattttcggatcgtagggacgttagattatacgcttgggttacacgataatcctgaaatgctggagttcaagccagaattgcattatgacttggggaaaaaactgggctatcaatcagggcatttatggacaggccttgttctgaatacaaccaagaataagtacaaaataaaagatacaccgtactatcgcacgaaccaattcagctatggcgtgtttattcgatacagctttttctgataaacacataaaatagtgctgtttttagtggtttatagcctttatggggtcacaatgtccattcaacacgacaaattcgggcgtacttatcagtggtttttgctggtacttttaggtatggtatattttttatccacagcaacaacctttacgtcattgggcgttgttctgcccagcatgatcaatgagctgggctggaactggacaagtgcgggtttgggattctctctgcttggcctgacctgtggactttccagttttctgccaacattgttcatccgcaagattggtgtccgcttcaccctattcattggtctgctgatttttcttgccggtttctaccatctgtataacacccatgtcatttcatcttattttatcggaacagccttattgggtgtcggttttacctttttagccacagttcccggcacttatgtcatttcacggttatatgaaaaacagtcccttgcctttggtttctatttcaccatcggtgggctggggggcgtcattggcccgtggatctattttctggccacccgtgtctggggaacgtggcgtatgcactggatgatttccgccattgttctgaccgtattcgtacttctgactatttttatcctacaagaaggcaaacgggaagttgcccatgccaaggccgttaatcaaaagcacaatagccagaaccccctgaaaatttatcgcactaaacagcgctggacagcacggagagcgctgcgtacatggcaattctatgccattgccgccacttacaccgcgtttttgtggtgtggcattacagttaacagttttgccgttgcccacattatcgagaatggcttcagtgaagctatcgccgcagggctgctgagttcaatggcctttatcaatgctttttcaagattggccgggggcgcggtaggcgagtggcttgatccgaaaaaattgctgattggcagcctgacggtcatcattattggcttgatcgcgctgagtatcgcgtcttcatggcctttcttgattggattcacactatttgtcggtatgggctatgggatgactttcctcgcctccagtgtcctgctggccaactattttggacgtaagccttatctggagttgttttcggtcatgaacctgatttctactctggcttgtctggcgcctttttttgccggggcgatcaaagattattcaggcagttttacttcggctttcctcattattgccatccccgtatgtgttgttcttgtcgtaacattgatgatgaaaccgcctgctcaaaaaatgaaaaagcgtttagtcgacaattccccattcaccgaatagggtaatagacgaactgaaacagtgcacaaacaaggaaatagtgatgtcaaagaaagagttcggtgtattcctgcccatcgctaaaggtgggtggatcatctccaaaaacacgccgccactggatgcgtcttatcaacaaaaccgggaggctgccattctggccgatcagattggccttgatttcattatgtccatgggtaaatggcgcgggtttggcggggaaacagaccattggggtagctcgctcgagtctgtcacgatgatggccggtattgctgaggtcactcaccgcgccaagttgatcgccacggttcatgcggggctgcacaatcccgcagtgacggccaaaatgatcgccacgctggatcatatcagtcagggacgtgcagggctgaatattgtttccggctctttcaaagatgagtttgaacagatgggcgaatgggatggcagcctggatcatgaccagcgctacgccatgacggaagagtggacacaattgatcaaaaggctctggcgtgaaaaacacgttgatcatgaaggaacctattttcacctgaaacagtgtgtttcggaacctaaacctctttcactgccccgtccttatctggtttgtgccggccaatccgaacgtggcctccatttcagtgtgcgtcatactgatgtctgttttatcgggggcaaggatgaggcagaaacccgcaaaattagcttaaccgccaagcgcattgcatcagagtgcaacacaaccaccaaaactttctgcatgtgtacggtcatttgtgccgaaaccgatgcctatgctgaaactctcgctcagttttatcgccaaggtttggatgtagaagcggtcagaaatatgatgcacagttttggtgtcgatgtagatggcaaaaacaatgccatggttgaacgatcacaaaatgctttcatgacccataccgccattggtacgccagacacctgctacaagcaactgtcagatttactacgcacctgtgaactggatggcgtgatgttaatcttccctgattatattaagggattgaaaatattcggcgatcagatcctgcccaaattaagggctgagtttggctgattggcctatccccttcacctaccagccaaccataccttctttgacaaatgggaaacctcatatgaacggtttcccatttattattaatagctcgatttattccggcaaacgtcggtgcagccctttaccccgcagcaaccgaatccctaaccaactaccgcacaatgaaagcagcaggctactgatgataggaagcaggaaccacatctgccattgcggttgccacgggaactcaaacacttttgtctgcaacaaccagagtgccacttccgcaccaaatgccgcagccaaacccgccatgaaacccagcaaggcaaattcgctccacaatgtgcgccgcagcagtttcttgctcgcccccaaggtacgataaaccaccagctcaagctgccgttggctcatgcctacctgaatctgtgccagcagaagcagcgcaccacaaatcattaccaaaacaaccataatttccagcgcctgactgatttgctgcaagatcccctgtatctgtttaagcatagtcccaatgtccagcatactaatggtcgggaaatgacgatttatttccgtcagaagctgtccatctccttcataatgaaaactagtcaaccatgtctgaggctgattatccagcgtctctttggaaaagataaagaagaaattcggatgcaggctttcccaatctaccttacgaatactgctcacactgacctgaaatatctgtgtattacccgtaaatgtcagtttatctcccacattaatgtgcagctgttctgctacgccctgctcaatggaaacttccttcggtttcggtggccacgttccttccacgagagtattaaaggggggtaattcggccttccatgtcagattgagttcgcgacgcactgttgtgctcttgggatgcctttcgtcagcccattcaatcgccgactgcccattcacttccgtcaaacgcgccagaaccacaggatagaactcagtcggcttcacttgatatttcgccagcaagtcattcactggtggaatttgcgcctgagtcatgttgatcaggaaataattcgggctatccggtggcaattgctgctgccatcggcttaataaatcgccccgtgccatcacgagtaatgccagtaacatgaatgacagcgaaaatgcagccagttgcgtcatggtctggaacggacggcacagcagccgattaaccgccaaacgtaaactaagctggcgaaatgtcatgcgacgcagcagccataagccgccccagcccaaaattgccagtagcaaagcaaccatcggcactcccgccagcaatgaccataagagcggcttagtgcccgccagtagtaccaaccctcccgtcataatcagcgccacggtgggcaggtagtaacgtaacggccagatcgccgcagtgacatcactgcgcaatacccgtgatggctgcgtcgccattagctgacgataagggcgaattcccaccagcagggcaatacccaacagcgaacctatcgcccacatccacggccacatacccgcttccggtaacattttgggcaacatcgccgccagaatccgaatcaaagcggactcaaaaaccaaacctaaaatggagccgacaacaatggcagcgagcaatatcaccagccactgcccaacgatccactgacgcaacgcccaacgccctgcccccagtgttttcaagatcgcaatcaggttatgacgactacggcaatagtgcgtcatcgaaacagctaccgccgccgccgcaagcaacaacgttaacagtgccgacaacagcaaaaattgctgtgcgcgatcgatggactgagccagtgcgccgctgtcctgtttcaatgtgagccaacgttgatccgcttttaattgtgggtcgatcaattgctggaatgcttgtatggactctgatgagccggaaaacatatagcggtaagtcaggcggcttcccggttggatcgcgcctgtcgctttggcatcttcaatattgattaaaatacgcggagaaagctggaatggattgaagccgctatcaggttcctgaagcagctcaccacggatcttcaataccgcatcgcccacgtcaaggctatcccctactttaatccccattaacaccagtaaacggggtgcgaccagcaccgaacctttttccggtttcaatccctgtggactggtctccaattcaccatacagcgggtaatgttcatcagccgctttcacctgaaccagttgcggaacgtctcccgcataggtcatggtcgaaaatgagatctggcggctcaatgtcagccctcgttcctctgcctgtttcagccaagattcatcaacgggataagaagcctgcaataccaggtcacccgccagaaaatcacggctctggtaatgaacgctctggtcaatccgatcgctgatgctccctaatgccaacacacaggccacggccaacgtcagggacagccagataattaatagcgatggtgtacgccattcacgccaaaaccagcgccagatcatacttcctcctgcaatattccatccaccagacgtaaacgacgctggcaacgggcagcaagctggctgtcatgggttaccaaaatcaacgtggtggcgtaatcgtgattgagggaaaataagagatccgcgatgcgatcacccgtttggcgatcaagattgccggtcggctcatcggcaaacaggatttttggacgagtactgaatgcccgtgccaaggcaactcgctgctgctctcctcccgaaagttgggctggcatgtgtttcaggcgttgccccaaccctaactgtttaagtagttcaatggcattctgacgactttgattttctgattcaccgcgaagcagtgcgggtagctgaacgttttccagcgcgtttaaagttgggatcaacataaatgactggaaaacaaaacccacattttccgctcgcagctgcgccctttgttcttcgttcatacggctaatattttgccccaataagtggacttcaccgccgctgccatcatccagccccgcaataatacccagaagggtcgatttccctgaccccgattcaccaatcaaagcaattgtctgcgcaggctcgacaaccagctcaacaccttgcaatatattaattacctgttccccctgaccaacatgtttagtgagatgatgaactttaagaatactttctacagccatgtatgtttccttttattgttagtgctatgcagcgccagagcaaccgcagcggataccctgcttatcttgggtgatagccttagcgccggttatcgcctgcccgttgagcaatcatggccgactctcatggcaaaagaatggcagcaatccggcaataaaacggctatcgtgaatggcagtatcagcggcaataccactgcacagagtcttgaacgcttgcctgaattgttgaaacagcacaaccccaagtgggttctggttgaactcggtggtaacgatggattgcggggtttttccgttcaacaaatagaacaagatctgcaaaagataattactttgattaaacaggcaaacgctcagcctttattaatgcagattcgtatttcgccaaattatggaaaacgctacacccaatctttcgctaagatttatccttcattatcggagcgtaatcagattccgctgctaccctttttcatggaacacgttgctatcaagcctgaatggatacaagatgatggcctgcatcccaaccaactcgcacaaccttttattacccattggatgtctgaccaactatcggcatacatcccctttaagtaagaatatttattaatagtaaatcatttatttccataaattgatgtaaacaagcaggtaaagttatgcaaaaagcggttcttattaccggatgctccagcggaatcgggctggtcgccgccaaaatccttcatcaacgtggctaccgagtatttgccgcttgtcgcaaacccgctgatttagcacatatgcgcgagttgggattagaacccatagaattggatctggatgataaagaaagtgttgaacgcgccgccgaacaagtcattcaattaacccatggacgtttgttcgggttgtttaataatgggggatttggcgtttatggcccattagagagcgtttcccgcgaactgatggaaaaacagttttcaactaatttatttggtactcatcaattgacctccctattattgcccgccatacgcgcttatggtaaagggagaattgttcagaccagttccgtattgggattaatctctacgccaggccgtggggcatacgcagccagtaaattcgcccttgaagcatggtcagatgcattgagaatagaactggcagacacgggaattaaagtcagcctaatagagcccggctcaatcacgacgcgttttacagaaaatgtgaaccaaacacagcgcgatcaccctgtcgaaaatccaagtctggcaaaccgtttcagactcacacctgaggatgtggtcactaagttgattcatgctctggaagcccccaaccccaaactacgttatccggtaacattattgtcccatgccatgacaattctgcggcgcatattacccgcgatattaattgataaaatcgtgaagtggcaaagctgattaagattgcaaatcccactgattaaccttatttattcatgtcatcgccttataacgaacttaagagaaacatcccatggaatcgataacgaacactaataaccatactgcccatatcattcatatcaatgaatctaatattgccccaatgattcagcattcactcactcagcttgtcgtgttctatttttggtctccacagaacctgcattgccatgaattggaagagacccttgataagctggcgcatgagtatgccgggcaatttgctctggccaaagtcgattgtgaccaattacctaatatcgctgcgcaatttggtgtacgtactgcgccaaccgtgattttcgtacaagaagcccgccctgttcacggttttgaaggaattcagacagacgaaactatcagaaaaatgttttctcaatttctgactcaacaaaaaaaatcactgttagagcaagcaaatgaacgacttgcggaagggaaaaatcaggaagctttgtctttactgaaagaagcgcatcagaccgagccaaaagagattgagattacattactattagctcaggtatatatttcgctcaatcaccttgaagacgcccagaacatcttggatacccttccattagaagaacaagatcaacgctacaatgatttgctggcaatccttgagtcacagaagcaggcggcaaattctcctgagattcaacaacttcagcaagcgttagaaattcagccagaaaatgctgaacttgctgttcaacttgccacgaaactgcacgaagttggccgcaatgaagaagcactggaactgctattcagttttctgaaaaaagatctttctactgctgatggtgcagtgaaaaaaatgctgatggatattatttccactctcgaaaccggagatacgctagcatctaaataccgtcgtcatgtatactctttactctattgattaagtaacacttatatattccataattagctaataaaggaatcgttatggatttactctctttgggtactgtacccattcttatcattattgcagttgtcatcgtctttacttgtgtaaagaccgtttcacagggctatcagtggacggtagaacgcttcgggcgctatacccgcacactgacgccagggctgcatatcatcatgccatttgttgatcgtatcggccgtaaaatcaatgtgatggaacaggttctggatatcccgtcacaggaagtgatttcccgtgacaacgccaacgttaccattgatgctgtctgctttattcaggttgtcgatcccgtgcgggcggcctatgaagtcagcaatctggaactggccatcattaatctgaccatgaccaacttccgtaccgtgctgggggcaatggaactggacgaaatgctgtctcagcgcgatttaatcaacagccgcctgctgactatcgtcgatgaagccactaacccatggggcgtgaagatcacccgtattgagatccgcgatgtgcgtccaccgaaagagttggtctctgcaatgaacgctcagatgaaagccgagcgtaccaagcgtgcagatatccttgaagcggaaggtattcgtcaggccgccattctgaaagcggaaggggaaaaacagtcacagatcctgaaagcggaaggtgagcgtcaatctgcgttcctgcaagctgaagcccgtgaacgtgccgcagaagcagaagcgcgtgcaacaaaaatggtatctgacgccatctctgacggtaatattcaggcaattaactacttcgtcgcccagaaatataccgatgccctcacccgtattggtgccgccgataacagtaaagtcatcatgatgccgctggaggccagcaacttgatgggcgctatcggtggtattgcggaattgattggcgaaagcaagaagagcaaacaggataaatagccatgattgaacagattgccactcaacccgtctggttctggctctgttttggtggcctgctgctgattgcagaattgctgggaacggggggatatctcctgtggacgggaacagcggccgtcgttgtcgccttgatcacatggattttcccagagatgagctggaaactgcaaggcattctgtttgcggttctgacattgctgtctgccattgcgtggcgtagctggctacgctatcgtccacgcaaaaatagcgatgagatgctcaatcaaaaaaaccagcagttaattgggtttcatgcccgcttaaccagcgctaccgaaaacggctatggccgggtcaaactagccgatggcagttggcgtgttcattgtgacagggaacttccagccaatatggaagtggaagtgatcgccgtcgacgggatcacgttgaaagtgaaacccgtcgcaaatcaaccgtgatgcgtacaacagccggataattgctcaatgatggggcaatctgccccatcatctcccggacattccgccgccaatgccagcagtttgccccttattttctgcaatttcaccatagtgttttctatttcagccactttttgcagggtcgctgttttcacatctgcactatggcgacgaggattgtgaaacaaccgcaatagctcacggcattcttcaagcgtaaaccccacttctttcgcctgacgcaacagagtcagttcatcaatatgcttgtgctggtaataacgatagccattatctccgcgcttcggcgcggagatcagatctttttcttcataaaaccggatagctttgctggttaaaccggtcttctgagcaatttcgctgatattcataatttccccttgaccctccccttgcaggaaggtttagccttaatgatatcgccgctatttttcttgagttatcaatatcactatctttttatcacggtaaatagataaagataagtatatcactctgtatcaggaaggagattttgttatgtccacaactaccattcttgcacttcaggggttaacctgtatgcactgtgttggcagtgtcaaaaaagcattggaaaatgtatccggtgttgaacagactgatgttacccttgattatgccaaagttatcggaaatgtatcccccacagtcttaattaccgcgattaccgatgcaggttatgaagccgtcgtcgccactcagcccgatattgagttacaactttcaggcttaagttgcatgaaatgcgccggtaaaacccaaaaagcgctggaggcggtagaaggggttattacggccaaagtcgatactcagatcgcaaaaatttacggcaaagtagagagtaatactttagttaaggccgtcgaacaagccggatatcacgctgagttagcggcaggtataaccttcccaaaaactgagccgctgacaatatcttccttacaagtaccagagtttttagcagcggcaggaaacgcaactccggtcagaaatcccgaaaatacagttcttcatgatactcccaataatgacaatgacagtattcagcttctgctggatggcatgacctgtgcaagttgtgtcagcaaggtacagaaagcgctgcaatccgtcgatggggtagaaaatgccagagtgaaccttgcagaaagaagtgcattagtcacaggtatagcctcccccaacgccttggtggatgcggtcatcaaggcaggttatggcgcggaagtgattcaggatgaaaccgaacgtcgcgagcgtcagcagcaagttgcacaggccaatatgcgccgtttccgctggcaatcagcttttgccttagttgtaggggttccggtcatggtttggggtatgttgggtgacaatatggtactcactccctcaaatcacgctatttggctgaccattggtttggtgacactggctgtcatggtattggcaggcagccatttttatcgcaatgcgtggcaaagcctgaaaaatggcagtgcaaccatggatacgctggtcgctctgggtacaggcgtagcctggctctattctatcagcgtcaatttatggccggagatttttccacctcaagcccgtcacctttattatgaagccagcgctatgatcatcggtttgatcaacctcggccatgctctggaacaacgcgcccgccaacgctcttccaaggcgcttgaacggttgctggacttaacgcctccgactgcacgggtgatcaccgaaaaaggtgaaaaaacgctgccattggcggatgtgaaacccaacatgatcctgcgtctgaccaccggagatcgcgttcctgtcgatggtgaaattattcagggaacagtctggctggatgaagctatgctgacaggcgaaccgatccctcaacaaaaatcaacgggcgagggcattcatgcaggcacagttgttcaggatgggacggtgttgttcagagctgccgcggttggcagccagacgacactggctcggatcatcaaactggtgcgtcaggcacaaagcagtaagcctgaaatcggccaattagcagacaaaatatcatcaatatttgttcccgtcgtcgttgccatcgcgctaattgctggtgctatctggtatttcatcggccctgctccacaagtcatgtactcgctggtcatcatcactaccgtcctgattatcgcctgcccctgcgcccttggattggcgacaccgatgtccattatctctggcgtgggacgcgcggcagagttaggagtgctggtgcgtgatgccgatgccctgcaacaagccagtcaactggacacccttgttttcgacaaaaccggtacgttgacagaaggtatgccacaagtcactgaaatccatacttttaacggtttcaccgaagaacaggtattgttatgggctggcgcgttggagagtggctcaaatcatcctctggcaaaagccattgcgctgaaagtggaagggcagaaattgccagaagtacagcaattccgcacattggccggattgggaatacgtggagaggtgggagacacaacactgctgttagggaatcagagcttgcttgagcaaaatcaggttgaaacggcggaattaaaaaccttgatgtcggcacaggcagaaaaaggcataacacccgtcattctggcggccgatgggaaaatcgctgccctgttttccattcgtgatcctctgcgtcaagataccttttctgccctgcaacgcttgcatcatcaaggttatcgtttagtcatgctgacgggggataatccggtaacggccaatgctatcgctaaagaagcagggattgatcaggtcattgccggtgttttacctgatggtaaagcggcagccattcaaacactgcaatctgaaggccggaaagtcgccatgatcggtgatggtatcaacgacgcacctgcactggcgcaggcagatgtaggcatcgcaatggggggtggcagtgatatcgccattgaaactgcggcaattaccctgatgcgccatagccttcacggtgttgctgatgctgttgcgctttccagaggaacattgcgcaatatgaagcagaacctgtttggcgcatttgtctacaatacattaggcatcccgattgcggcgggtatcctgtatcccttcacagagacgttgctaaatcctgtggttgccggggcagcaatggcgttgtcttcgattacagtcgtcagtaacgctaatcggttattgcgcttcaaacccaagcattgaatttcagaataaagtctacaaaagcttattattcagcccacgacaagctaaacagaacggagtttagcttttcgtctataacaatcttcccactttcttgttaacctttaacacgttagcatatcgatgagtgccaactattggagtctgtaacatggggaaattgatgacatatctcaacaatgtattaggactgaattcccaacggcattatccctatcctgcttttgacatcaccctgccacaaaataggcatttgcacatcgtgggtagcattcacatgggcacagaaaacatgtttccactttctgagatactactggaacaactggaacagtgtgatgccctcatcgttgaagcggacatcacgcaacccggatctcccttcaaagaaaaatttccagaacaagttgcgctgtcactgcgtttatcacctgaacattttgaccgtttaacgcattactgccatgaaatccagcatcctctaaaggcactggattcattaccctcatggcaaattgctttgatattacaagcagctcaagcccaatatttgggattacgccctcaatatggtattgactgccaattgctggatagcgcaaaagccatcgataagaccattatcgagctggaaggaacggatacccaggttaacttacttaccagcctgccaaatgggggactttcactgttggaagatacactcatccattggcataccaatgcgcgtgctttacagacgatgattagctggtggatgaattacaaacctgcacagccaaaccaaacgctgccgcagaccttctgtgaagagattcatcagacattgatggccggacgcaaccaccaatggagtgagcaattacatgctttgccggcaggcaagtatctggttgccgtaggggctctgcatcttcatggtgaaaacaatctgctacagatgatggaaaggccacaaggataaaaactcgctcactcatctcatttttacaggaaaaacttacaggaaaatagtatgactcccgccgttattttactggaaaaacaccagattaacttcaggcttcatccttatgaacatgatacgaatgaacatagcttcggtgatgaagtcgttaaaaaactcggtttggatgctaaacaggtttttaagacactcttggtttcattgaatggtgatcccaaaaatctcgctgtcgcagtcacacctgttgcaggacagttggatttgaaaaaagtcgccaaagtattcaaggctaagaaagcagagatggcagatccccaactggcacaaaaggtgactggctatctggtaggcggcattagcccactagggcaaaaaaaacgtttgcccaccattatcgatagtcaggctcaaaccttaccaaccctatttatttctggaggcaagcgagggttagatattgaattggtaccaaccgatttatgtcaactacttaattgttcctttgccgatattgctaaagtctgaaaacaaactgcaattaccattgaatttttcgagctggctctgttttcttgaaagcagagcttagtcctatattgttctattctagaatgccgatatactgtcctcaaaccagaagtcatgttatttactatttcgtataacttatttatgtaatttaataaatttaaataaaaggagataaaaatggccacttcatcatttttcagacaaattgtcatcaccgatccaaaagcaataaaaatgctgagaaaggctaataaacgaaaacctaaagaaaatttcaaaaaaatagatattgaagcagaacaaatcgaggcaatagaaatattaaaacgaaaattctcactctaggaaatgtattatcggttcttggcagagaaagaacaaaagaatacttactgtccttctcctgcccatcaaaccacgatgtagaatcatttttacatttaaaatcaattaggtttgaattggcagatgtcaccagaacttacccaattctgaatgaaaaaggagttattcttgcctatttttctttaacttacaaggaactatcaacacaaaatttttccatttcaaagacaaaaattaaaaaacttgacggtataagtaaaagcgcaaatacaataaaagtttacttgattggtcaagtagctaaaaatttctcattagttataaattcaataaatttcagagaaatttttctttatataaagaatattatcactacagtaaaaacactaataggaggaagaatcattgctttagagtgtaaaaacaatctaaaactcatagaattatatatgaaacatgggcttaaaaaattaccaacaaaaggagaaatcaatccattaatcactatgatttttaataattagattattatttagtttcaaccgttcctattttagataacttaaaaccactcagtataataagtaaagaccacctatcttacaggtggtctttttatacagataattaacgactatctatcaattactgccattaattacttatgaacgatttcacctttcggctcataatcggcaactttcaatggagaatgcgtctcgatatagcctttcaacacttcagcatcaacaaaaccggtatccacatacccaggtaagttatcgacacgtggatagccatcacctccgatagcgttaaagttcagggtagccatacgataagttttattaggatctaacggcttgccgccaattttcacatcactgatttttttgccatcaaccacaaaactgacattataaaactgcccgtaagcacctgaatccgtttccatatttgccacggccgtcaaatatggcaagacttctctacctttgaaatccacataaaccagttggttagcaaatggatgaactttcaggacatctttgtaagtaatatcccctgcttcgatagaatcacgaataccacccccactcatcacggcaaaatcagcatttgtccgttccatctgagccgccagtacaagatgcgccatattggtctggacgaaacgcactttactgcgatcaccttccaattttccatctactgcgcccacttggacatttaatttccggctgcctttatcctgatatggtgtcaacagtttcagcatttcaggatgctgagtaatttgatgagtgtaataagcactccctgtgctgccatcttcgttttttacttttttctgtaagttgatggggatcaattgatagtgaactaatttgaattcaccattacgaaattggaaatcagcacggccgacatatttgccccattcatgtgcctgcacaatccatgttccattttggcgatcgggtgagcaaggtgttcctggtacataatccacttgtttgtagtttttgttttctgttgacatgcagaccggatcttgtgaatgcccccctacaatcatatttaaataacccgcaggcaaactgcgtgccatttcaacatcccccggcgcattgctgccatgatgcccatcgttataatgccccatatgggttgcggcaatgatcacatccggtttttcgttctttttcagctcatcaataacttttttcgcttcttcggccggtactcggaattcgacatcagggaagttggctggattgcctacttttgccgtatcatcggtggtcaaaccaatcaccgcaattttcacgccttgctcatcaaacatcacatacggcttaaataaacgcttgccagtactggtttgataaatgttagcagacagaaatgggaaattggcccatttttcctgctgatgcaacacgtttaaaggtttatcaaactcatgattccccaacgccattgcgtcataacccactaaattcattcccttaaaatctggctcagcatcctgcatgtccgattcgggtacgccagtattgatgtcacctcccgataacaacaacacactgcctccttttttggcaacttcctgacggatagaatctaccagtgttttctgagctgccaggccatactcaccatgatcgttctgccagaagtggccatgatgatcgttagtatgcaggattgtaatatcgtaagttttattcttttcccaagcagttgcacttatcggtaataatgataaagaaacgacaagggcacatgctggtgttttgaacgaaaatttcatgggtatctccatgttccttaaattttatctgtgatgtaacaattattagttttatgaaaattataaacctatcccattgagccatgctacttttcgacagcaatgtttatacaacagtgcctctgccggaacaggctcgaatccaacaccagaatagaatgatggcacctaggtgctaggatatattttccaatcaagattacagaattgtgtcattaattagggttttatttcatttttattagggttttatttcatttttatgggataagtatcaaattatatcaaggtaagtaaaaattttattagcggtctaatatgtattaaagtgtaacaattaaacaacaattcaacgccatacaacacaggctggattgatgagacaaccaatatgagtgaacaaagcaacacagaacaattgcctgattcatcaagaaaaacacatcagactgttttttcaattctcggtgcaatcagcttatcccatctgcttaatgatatgattcaatcgctgattttggctatttatccattattgcaatctgaatttaccctaagtttcattcaagttgggatgattacactagtttatcaggtaaccgcatccctgctacaacccctcattggtctgtatacggataaatatccacagccctactcactgcccatcgggatgggattcaccctgtctggactgcttctactggcttatgccgaaagtttccctatcatcttactggccgctgcactggtcggtacaggatcatccgtctttcatcctgagtcatcgcgggttgcgagaatggcctccggagggcgtcatggactggcacaatccctgtttcaggtaggcggcaatctgggaagctcactggggcctctgctggctgcaattttcatcgctccttatggcaagggaaatctcgggtggttttctctggcagcactgctggcaatcgtcattctgttgcaagtcagccaatggtataagatgcagcaccgagcttctaaatccctatcatccactcatatttctcagccgaatttccccagaaaaatgattgtgcgttcttttgccattctgctgattctgattttctcaaaatatttctatctcaccagtatcagcagctactacactttttatctgatccagaagttcgacctttcagtacaaaatgcccagatccatctgttcatttttttgtttgctgtagccgcaggcaccatgattggggggcctatcggggataaaataggccggaaatatgtcatatggggatcaattcttggcgttgcgcctttcactctgcttttaccttatacatcactattctggacggggccccttaccgtagtcattggcctgatattagcatctgcattttctgctatcctggtctacgctcaagaactcattcctggcaaaacgggaatgattgcaggtttgttctttgggctggcgttcggcatgggaggtatcggtgcagccgtgctcggttatgtagcggataaaaccagtatagaattagtttacaaaatctgtgcttttctaccacttcttggcatttttactctattcctgccaaatatagaaagaaaaccacacgaaaaaccatgaaaaacaacataataatgtcatcatctaaatgacattttcctttgtaaacaagcgtaaataatgacaagatctacataaaataccattaaaatagcatttatgtagatcatctacatttttacctataaatatattttttatcagctttgttttaaatgatttatacaatacattattacctcacctaaccctacaatcgatattattgcctaacccagaaggagccttgatggagcattcgacacctcttatcacgaccattgttggcggttttgtactcgcctatctgcttggcatgcttgcccaacgcctgaaaatctcacctctggtaggataccttgcggcaggtgtacttgctgggccttttaccccagggtttgttgccgatacttcgctggcacccgaactttcagaaattggcgtgatcttactgatgtttggtgtcggtctgcatttttcccttaaagatttgttagccgtcaaatcaatagccattccaggcgccatcgctcaaattgcagtcgcaaccttattgggtgtgggattatcaacgctgcttggctgggggctgtttactgggatcgtctttggactctgtctatctactgcaagcacagtcgttctgctcagagcgctggaagagcggcagcttattgatagccagcgggggcaaattgctattggctggttaattgttgaagatctggctatggtactggcgctggtattactgcccgcagccgcaggtatactggatagccagaatgccaacatcggtcaattgctgttagaacttgctatgaccattggcaaagttgtggccttcattttattgatggtttttgtcggtcggcgtctgatcccctggattttggcaaaaacagccagcacaggttcccgcgagttatttactctggcggtactcgccattgccttaggtgtcgcttacggagccgtgaagctgtttgatgcctcatttgctctgggtgcatttttcgctggtatggtactgaatgagtcagaactaagccatcgggcagcacaggataccttaccgttaagagatgctttcgcagttctgttctttgtctctgtcggaatgttgtttgacccaatggtattgttccagcagccacttgctattctgggaacccttgtcattattattattggcaaatcattggcagctatgcttctggtcaaaatgtttggtcattcacgacgtacagccctgacgatttccgtcagtctcgctcaaatcggggaatttgcctttattctggcagggcttggcgtcactttaggattgctggatggagaagcacgtaaccttgtgctggctggtgccattgtctcaatcatgttgaatccgattctattcagtttgctggatcgttatctggaaaaaacagaaactattgaagaacaattattagaagaaacgctggaagaagaaactcagatcccggttgatatctgcggccatgccattatcgtgggctatggccgagtcggccgtcttctctgccagcggttgcaagaaagaaatttcccgttggttgtccttgaagatacacgtgcccgatttgaggaattaggggaaatgggcatcagtgctgtgatgggcaatgctgccagcaaagatatcatggctctggcacggctcgattgcgcctgcacgttatttctgactatccccaatggctacgaagcaggtgaaatagttgcgaatgccagagagatccggccagatatcaatattatcgcgcgtgctcactatgatgatgaagtgacctatattatggaacgtggtactaaccacatcattattggtgaacatgaaatagcaagagcgatggctgatgcactctctatgtatgagccaacttgcccgatagagccaccaccgtcattttcgacagcaagttagttatcgatatggtgtatcccgctgatttcagggggatactccagaacaaaccataccaacgttgttgcatcgttaacgtagtatcagcgttcccagtaagattcttccaaactatcttctttctctggcaacccacgcatcaggcgaggtgagtgctggctcaatacctgataactcactctattcgcgtatttacatacctgagccaatgacgagtacgtcaaataagagcgcatatgcttactggagttaggcacattcattcggtgataactattggctgtaatatcatgtagcaatgcagacaatgcaccatcgccagccccattagtattcatgattttttcaggcccccccatataaggctcaatatgggagtagactcgcattgggttctggcaatcggctttgcatagcacccgactaaattcatagagattaaattcagcaatagcacccggcaataatggatgtgaagtctgacgtttatgttcttcttcggtataacctgccatatacagtcccgccggccctgcggtacataacactaaatccacccaatttaaggccatgtctgctgccagcagaggatcactaaagcccgtcagctcttgggcttcatcttcattcatggcgaccacagaaacattttctgccaagaaatcgcgccaccactgcggatcatcagcgatgacgtattttgttcccaatgtcagtacaacaggcacattatgctttttcgcatattcgatggctttcatcgttgcttccggcatcggatcacccgatttgcaacgcaccagataggcggtaatcaccagtgctgatgcttccgcaataatatgttcagggatattttccggacggagttggttcattaatcccggactgatagcgaatgtcctttcaccgttttcagtcactagggtaaaacaacggccaattgggccatcaaccccctgaagatgattcaaatccatgcggctggatgtattgcaaagataacaatatgcataactccctatctggatgttattacacatagtgccaagcaatacggacttatcgtcagccaaaacagaataattatgcagagtattaccgatggttccacccgcaaattcgtgactaatcaaattattgtctgtcagttctttgtagagtgcctcggcgacatcatcttcaatgacgagtgaatgcccctggctcaagttataacgctggataaaactctcatcaaccttagcttcaatgtctaccagtgtttgatcaataccaacgatataggctcggttattttcagtatctatcatttctttgatgggctggagcagaggatctctcaggctgacaggaaaatagtgtttagatttacgtttaccagggaatttcataattgattgatgctatagagccaaaatatgcggcatgttagcacaatacggtgtagcgcaataccgtagcaaaacaaaaaacgtagcgccataacgtttgacagccaatgctattagagcattggctgtcaaacgttaacgagtaaagcactgacgataaaaaatttaagcttcttgtttctgacggctgcgtgccatatggcgaaccagaacaaatataacagataagataaagccgataaaaccagcaccaatcagaatcagcagacgtttaggtgaatctttcgctgtaggttcataaggttgctgcatatacctgaatggctcgaaatcaatcttatcaatatttactaattttaaattttctatatataacagtctattacgaagatctgcatctatctgagttggatcggtaatctcttcggtaatctgtaatttacgttgcagtgcatccgcacccagcgcaatcgaataatccgggtcatccttgatcatagcgccaccattggaaacaggttttttaacacccgcagagttagcaatggagatcgcatacttcaagcgttcgatatcaacaccacgcatattgcgaatacgagccagatcaatttcatacgacttttgtgaaaagaccagtttctgatgcaccatatcattcaattcatctttcacctgatcacgaacaacggaagagacaaaattgatatacccagtcaacaagttgtaagaatcttccgccgtacccgcactgaaagaaagtacactttcatcatctccttcattatcttttttaggtaaagaaatggagatatttttatttacaacctgctcaatcagctttcgttttccctgtatcgcgccatcatccatcttagcaagcaacgccttgaagtagtcagtgctgaccaaatagtcttcacgcaatacacgcgagttatagttttcgacaaaacgctgatataacgatgcttctgtcactttcggatcaagactcaaaacttgcaaatccgttagtgcatttttcaatggctgaaattgttccaatgtcggcttcactacggctgctgtacttgtccatttctgtggtaaaaatgacgcaataccgaagccaatcaccgcaaaaacaaaggatattgcgataattaaatattttgatcggaaaattacggagaataattcaaataaatcaatctcatcttcctgcttaggatgataatagtttgaattctcttcataaaaatcggggtgtttaatcggtttattactcattatctctatgcccaatccaaataattttgcttttcattaagactcaagttgtttttcttactcatagtactcattgatttaaaagcaatatccttaaaaatcacacgatcaccaaaacatatgctgataaatataccaccaaaatacccgtagctaccaatactcgccagtcaaaatgtaaaataacatctcataacaggcaataatccattatttcatggcgttatttaccaattgttcaagcaatgagatgtgtgcctcattatcattaagtgcagaaatatattcaaactttttaccccccgcatgcaggaaaatcgcttgattttgctgttggatttcttccagtgtttccaaacagtctgatgaaaatcccggacacaatacctgaacatgttccacaccttgttctggcaataatgccattgtcttatctgtatagggcgttaaccatggcaaacgaccaaaacgagattgaaaagtcatcataattttatctgcgggataatccaatgcctgtatcaaaagctccgtagttgccctgcaatcctgcggataaatatcccctatcgttgccaaccgttctggaataccgtggtaggaaaggagcaaacgatcaggcaaaccatgtttttcaaaactctgctcgattgttgcttttaaggcagcaatataagcaggatgtgtagcataactacggatgaaatgcagatggggtatggtgcgatatcccttcaatattttgctgatgctatcaaataccgcggccgatgtcgtactggaatactgaggataaagaggaagcacaatcaggtggtcaataccttgttgcagcagattacctacagcttgaggcaaggaagggaaaccgtaactcattcccaaaacgacagggatatccgtcagtctttcatttagcaatgtctgctggcgctgactataaaccagcaaaggtgatccctcttctgtccaaattccttggtacagtttagcaacacgagaagaacggaaaggaagaataatgccgtacaacagcggcttccagataaacggagggatatccacaactcttcggtcactcagaaatttcgccaggtaacgccttattgctacaggtgttggctcatccggcgtcccaagattcaccagtaagacaccatacttattgctactcatccctcagtactccactaaaataactaataacctagtataaacatgagttatagtcacatctaacatttcatggagtgacactcaaaaaagtcaggcggttattaacaccgcctgctctagctgttcaagatttaataattcaagaacataccaaatcattagcccagaatgccgaccaattcttcgctgacttcagcgacctgacgtgtaccatcaagtttgaagtactttgtgttccctgcctgagcttcgttctgatagtaagaaaccaaaggtgcagtctgtgcgtggtattcaaccagacgtttacgcactgtatcttcctgatcatctttacgaatactcagttcttcgccagtcacatcatcccggttttctactttgggctgattaaatttgatgtgataaacacgacccgatggcgtatgtacacgacggccaataatgcgttcaacaatgattgcatcagaaacagcgaattccagaacataatcaaccttgatacccgcttctttcatcgcatcagcctgaggaatggtgcgtgggaacccatccaacaagaatccactacggcagtcatcttgtttgatacgctctttgaccaaagcaatgaccagttcatcagtcaccagcttaccgttgtccatcagttcttttgctttcaaacccaactcgctacctgcttttactgcggcacgtaacatatcacctgtcgaaatctgagggatcccatatttctccatgataaattgcgcctgagtccccttaccggcgcctggcgcgcccagcaaaataatacgcatcgcgtaaatccccttgctatttgcttttcgtattttaataaaacaggccaccataccatttgaatggggtatggctcaagaaaacaggtaaacgttttcgtattgacctaaaaataaaccacgcccaattttccgttgaagcgtggtctattatcatgatttcaatgatcttaagctttttcagccaataataattgattcatccggcgaatgaattggtttggatcatctaatgtgccgcgttcagcaaacaatgcctgatccagtaacagttctatccaatccgcaaactgggcttcatcatgaatatcagccgcttttttcactagattgtgctctgggttcagttcaaagttatagctcacttctggtgcagactggcctgctgccgcaaatagtttcgccatttgggtgctcatttcattggcattcgttgtcactatcgcgggtgtatcagtcagtcggtgggtcagcttaacttctttcacgcggtcaccaagcagcgttttcacacgctcaataaacggctccagttttttatcttcttcttcctgctcggccttgttttcatcagccagtttgtcaagagattcatccgtcttgctgacagactggaatgacttgccatcaaactcagtcaggtagctcatcatccattcatcgatacggtcagacagcaacagaacctcaatgcctttcttgcggaacagctccagatgtgggctatttttcgctgcggcatagctgtcggcagtgatgtagtaaatcttctcctgaccttcagtcatgcggctgaggtaatcttccagagaaacagtttgtgccgagccgtcattatgagtggttgcgaatcgcagtaatttagcgatagcttctttgtttgaaccgtcttcagcaggcccttctttcaataccaagccaaactgctgccagaaggtctggtatttttccgcatcgtcttttgccagtttatccagcatctgcaatacacgtttggtcaacgcattacgtaaatttcgggtgatagtactgtcttgcagaatttcacgggaaacgttcagcggcaagtcattggaatcgatcagaccacgcataaaacgcagataatttggcatgaactgttcggcatcatccatgatgaatacgcgttgtacatacaatttcagcccatgtttatgttcacggttccacatatcccacggtgcctgagcaggaatatacaacaagctggtgtattcctgtttaccttcaacgcgattgtggctccagcttagaggatcagcgaaatcatgggaaatgtgtttataaaactcttggtactcttcatcactgatttcggctttaccacgtgtccacagcgcttgagctttattgattttttcccatgtgacggtatcgtcttcttcgtttttggtttcaatttcaactggcaacgcaatgtgatcagaatatttgccgatgatagaacgcagacgccagtcgttaaggaattcatcctccccttcacgcagatgcaaagtgatttctgtaccacgctcagttttttcaagatcagcaatggtgtaatcaccttcacctgttgattcccagaaaacaccttgatcggccgcggtacctgccgcacgggtacgcacagtcactttatccgccacgataaaggcagagtaaaaaccaacgccgaattgcccaatcaactggctgtcttttacctgatcagaaccaactgattctaggaatgatttagtaccggattttgcaatcgttcctagattatcaataacttcatcacgggacataccgataccattatcactaatagtgatggttttatgctcgttatcaaaagcaagacgaacacgtaactcaccatcattttcatacaattcaggttttgacaatgcacggaagcgtaatttatccgcagcatctgatgcgtttgaaatcaactcacggagaaaaatttctttattggaatagagagaatggatcatcaactgcaataattgtttgacttcagactgaaatccacgggtttcctgacctttcatactcatttattacctcaatctaaatccagttcagatatgtaaaatcggacgatggtaatcaaatggggataactcccaacaatttcaagttagggcaatcagaagaatataaaattggtttgatgaatgtacagatcagctgtggatggtggcgttatccgcagcaccatccattggaatttcccatttgaaattgggtaatcgatcacaaatcagtgattctttggcgacccgcaagtgaatgggacagcgttgtgccatccaccatttcaagttcactccccacgggaacaccatgagcaatacgactggctatcacaccatactgcgaacacatttccgcgatatagtttgccgttgcctctccttcaacagttgggttggttgccagaatgatttctgacagggtttcggaagatagccgttcttccaaacgatccaaaccaatatccattggcccgataccatccagcggcgataagcgccccatcaggacaaaataacgaccggcaaactggccggtctgttcaatggcgtgaatatccgcaggcgtttccaccacacagatctgaccattctgctgacgacggggattgccgcaaatcgtgcattgttcctgttcggtaaatgtccggcagtcctgacagtgaccaatttcagacatggcacgagtcaatgcctgagcaagcctcatgccaccactgcgatcccgttgtaacagatgaaatgccattcgctgggctgatttggggcctacgccgggtaaacagcgtaatgactccatcagggattcaagaagagggctggtttgcatcagaatggcatcttaaagccaggcggtaattgcatgccgttggaaacgccggacattttttctttctgggtttcttcaatgcgacgggctgcatcattgaacgcagcggcaatcaggtcttccagcatatctttgtcatcgtccatcaagcttggatcgatttcaacacgacgacagttgtgtgcaccattaatagtcactttcaccagacccgcaccagattcacctgtcacttccagatttgcaatttcttcctgcactttctgcattttttcttgcatctgctgggcctgtttcatcaaattgcccaaaccacctttaccaaacataattatctctcttcgctatagccacagtttaaatatatattgtagcggttaaacaggccggatactttcttcatccaattctgcatcaaacagctgctgaagtgtttgaatcgttctatccgaaataatggattggcgtgcttgtgccaatttttcttcataaatggcttgccgccactccaacggagtttttaccgcaggattatcatcttcaataatacggagatcaatcggttttccatgcaattcacttaaggcttcggacaacatttgctgtgccgatgctgaattaaggtgacgttgttttgaacgcagatgaagacaaagccgactttcatcaatctgttctttaaacgcattcaatgcaacctgctgaaccagttttggaatattcagtttatcaatttccgctgaccatgaatctctctgtttcgattcaaccgccaatttttccgccagttccggtgtcttctcgtgctcaagtgccgcttttatcgcttttggcgtcgtgacacaaacttgcttttcctcaacactcgtgttcgttgtccgccagcggtaagcttcttgctttatgggctttggctcccgggctttgggaatataagattgtggccgctgttcggccacggctgctaatcgttccagcgccgagcttgccgacttcgccttcacaggctctgccggctcagacttttttgggggcgtattcccttgtcgagtaagcgaatgcctcgcttgcagcaattttgccgttggactgctgactacaggctctgtactcattgattgcggagaactgtgttcagaacctttctcagagcgttcaccagccgcatggttttgtacaggtgaaaccggatggcgctgtgcaggtgcagatacctgcggtgctaccgggatttctccaccggacgctggcgtttcttcaatgatagttttggggtggaacgccaaagcgcgtaataatgccatttcaacgcccattcggcgctctggggcataagggagatctttgcgtccgaccagcaatgcctgataaaaaagttgtagatcggcaggagaaattgatcttgccagcaaccgcaaacgcccttccgttgaagagggatcgttatcaggttgctgaggcaataactggagcatggcaatgcgatgcagcaatgacaagatttcgaccaacagatgttcccaatccacgccacgggatgcgatttgctcaaccagtgccataagctgctgcccatctgcccgaaccagccattcaatcatttccaaaggctgatcattatccagcgtgcccaacatctggctaacgatatcggcggtcagtttacctccaccgagggcaatcgcctgatcggtcaggctcagagcatcacgcatactgccatccgcagcacgggccagaagatggcgcgcacgggagtcgctctctatttgctctgcattaaggacatgttccaactgaccactgatttgatcgacgttcaatgccttcagatggaattgtaaacaacgtgaaaggatcgtcacgggtagtttttgtggatctgtcgtcgccagcaagaatttcacatgttctggcggttcttccaatgtcttgagtaacgcattgaaactatggcgcgaaagcatgtgaacttcgtcaatgagataaactttgaaacggccacgggcaggtgcatactgcacgttgtccagtaattcacgggtatcttctacttttgttcgagaggcggcatcgatttcgatcagatcgacaaaacgcccctgctcaatttcaagacagttcgcacattgaccacatggggtcttcgtgattcccgtttcacagttcagcccctttgccaacagacgcgcgatggtggtttttcccacaccacgggtgccagaaaaaagataggcatgatggaggcgctggtgctcaagaccattcgccagtgcagtcagcacatgttgctgaccaatcacatcagaaaatatttgtgggcgccacttacgggcgagtacttgatagctcattaataccgaggaaattgaacatgactgtgtatcatgctagcacagcctcaccatgaacggcgaggctgatgtatcaattatgcaaaaatgggagtaatcagtgaccagggaactctatgagcgtgtagctctcaataccctgttttttcaaacgctcggtaccgcctaaatcaggcagaccaatgatgaatgccgcttcagaaacctctccacccagacgtcgaatcaaacttacggtcgcctcaatggtaccacctgttgcgagaagatcatcaaccaccagaaccttatccccttctttgatactgtttttatggatttccaaggtatcagtaccatattccagatcgtaagtttcacttaacgtcgcgcgaggtaatttgcctttcttgcgaacgggaatgaaaccaactcccaaacgtagtgcaacaggggcgccaaacaagaaaccacgagcttctgtaccaacgattttggtgatgcctttttcttggtaatgttctaccagtagatcaatcgtagcttggtaggcaacgggattatccagcagcgtggtgatgtcacgaaaaagtaccccgacttttgggtaatcagggatcgtttcgatactatctttaataaattgcagtttttgcgcattagcggtcataatcgatgccagccagttataaaaaacgaaaacgctaaaatctattcaaactatcggaaaaaagcaactgcaaagcaaattgcagcctgtttttgttgattttggtcaagcttggcacctatcacatcaaacattattgttacaaaatagttaagcatgatgaagtaggttttaacgaagagattattaacgataacgggatgctgatgagcatacaaaatttattaggcgcacttgaaaaacagatcagtatgctggaaacagagcttgagtcactccccaagacacctttttcagtcgcccgttttgatcaagcattattccaccaacacagcaataaactgggtggatatcttaatgaaattaaaaaaaatatgtcacaattaaagacctgtgtgaaagataatcgtaccgagcaggtcagatttctttctgaacgtttagtgacgcaaattgaagcactgaaacgcgaaatatcaacacagccactgagaaagcaagaagagaaatttgaacatcagtcacaagaacgggatttttaccatcgtctagccgaacatcaggattatgagcgccgtttaatggcaatgattaatgatcgggaattacagttaaataaacaagttatactgacaaaccaatataaactacaaaaagaaatcgcagcgctggcaggaaggctcgctcgttgtcgccaagcattgatgcgtatcgaaagagcgatagagaagcaagaaaattcagattagtcactaagggaataaccgattatggatctcgaacaagcaccacctgaagtgcaactcgcggtagaccttatttatctactcgaatgcaatgaaatttctcccgatatcgcactggctgcgttagagatcgtcaaagatgattttcaaggaaagctgaaaaaacaggctcagcagcctaaggaataagcagagttaatacctatcccatcagacatgtcttttaaggtaaaagtggctgatcgccaggagatacctgcccatctgaatggtggctcccaccgttcaatgccttctgtacctcttgcagactattgccttgcccattgtgcaaatacacttccaactgattgaatgcgatattgatattattttcccgacatagcttatcaatattgcggttaacttcatccacagtatggctacgatctcccaactctttcacatatagcctcaattcatgatccaatgtactggcgccaaaactcataaaataaacctgtggtatcggttcattcataacacgagggttatctttggccgctttaagcagaacttcttttaccttatccagatcagagccatacgcaacgccaactttaatgataatacgtgtgatagtgtcagaaagtgtccagttaatcagacgctccgtgacaaaagcacgattggggataatcacttctttacggtcaaaatctgtaattgtcgtcgccctgatgcggatcttactgactgagccagagtaagtgcctatcgtcacagtatccccaatacgaacaggacgttcgaacaaaatgatcagacctgatacgaaattggcaaagatttcctgtaaaccaaaacctaaaccgactgaaagagccgccgccagccactgtaacttattccacgaaagccccaaggttcccaatgcactgatcccaccgacgccaatgatcaagtaagtcagagtcgtcttaatcgcataagaagaaccctgctgtagctgtaaacgagacaataccaacacttctaataagcccggcaagtttctcatcattacccatgaaatcaccagcattgccatagaaatccccaaatctttcaaggtaacctgttgcaggacattccccagctctgttgtcgtgctgtactgccacagattaatcccatcaaggtaggaaaatactgtcaccaaatcagaccaaacccagtaaaacgcgcccaaaaaaatcaaaaacagcaccatcgtggtcaaacgcaatgattgctggttaatgcgctccagctccattggcggctcttccactacgtctccttctgccccttctttcgcctgagcctgacgccgggcaattgcccggcgataggcaatgcggcgggcggcaattcccaatccccgtaaacaagcctgataacaaatatgccagaggaacagcaggtaaaggctgtagagccaacgttcagccaaacgcagggttgtatagaaataaccggataccataagcaccatcagaacaagaggtgcaaaagtcaatgccgtcaccaccatggttcggatcatatgtgaacttttcacacgccatacctgacgacagaatggaaaaataaaaatgaaaacgaagagcaggcaaattaacaccgtgcactgaccaatcacatcatcagacaaacgtaacgggtgtttgacccccaaagttatccaaaacagtatcggcagcaatacaatcgacaaccgcacaagatttttgcggaacagagtgtaatccgctctgttcaatgaaaaatggtgctctcctattccatctttggcgaggatttggtaactacatcgatacataatccagaaaagcgccaattgtcgcgaaaagctccatattaaatcacctaaatcatcccctgatttcgaataccagtagcctatcgccaaaattaaaagagcaagtggtaatgtttttaccaatgtcagaattaatgctaatggggtgtgcaactggctgtcccgacgcagttgccccacctcatcagaaattttctttaactgctcgttaatgccttttgtctgccagcgtaaaaacaggccgaccagcaaaaggggaatgacaaagtgaatggaattctttaatcctgtggcaaggccactgagagtcaaatgaatattcagatggctcagctcttcctgaattaaatcaggcaaagatttcaaccaggccaggttcattggtttattgctgttgacccaaaagatctgttggacaagcgtctgttccagcgattgggtgacatccagcaattgttgctgatccatctgtaaattgatggcgtgtgtaatttgatttcccaactggttattgagttgattcaaaagctcacggcgaatttccagaatttgttcgatagcattacgaatttcacctactgcttccttagattcatgttttatctcatctgaatgtaggttcaataactgattggcataatcattaagctggtaaagcttatcgcgttgctggttaatttcaaattgctccaaacgcagatcagcaatttttatcggcaaatcctttgtcagaacattttgcggtaccttgagctgttcctgaaacaggatacgcgacagcaataaactgccacgtaatactttaacctgctctttaagattacgttcagattggatggctctatccaagaagttcttaacgcgaatatttttttgtaccagttggttactctcccgcgtttcagcaatcagccgctcactgagttcgcgattggtctggatttcttccttaaccaacgggttagactgaatatgagaattagtatcatctgaattctgcgcttcttttgctgtttcttcagaaacaatcaaacgctttccgctcaccacattttgaataaattgaacataacgttctaattgatcaatttggaaagaagtgtaatcacgttgctgctgcaaaagcgtctgtagttgtgtatttgcctgtagagatgccctttgtaattcattttgctgcatcagaaaagattgttctacacgcaataaatcaagctggggataacgcgattctggcagctctgtcagctcattgttgagctgattacggatttgctgcaatctttgtacattgtggaacagtagattttgcgcccgctccggctgggtttgtagcccaattaactggctattgtagctagcaagattttcctgagctcgttgcaagctattcagtgtactgttcagtttggattcaagttgcttcagcgacaacgtttccagcgtttgtttataatcattctcatcctgctgggcgttatttttcagattttccaatccggccgtgatttgacgtgatttctgcggagagtcctgtaagttttttttaagtaaatcggaatccagcttaacttgatctattttgtcaaagaaatagagcgccttttccaaatcagctatcgatgttttctcctcaactgtgtgttccttacgctctgtcaggatcttaagctgattttgaatatcattgcgggttggtgtttcactgctaaatgctgccattgcaggagaaaagaaaaataacagaaggaaaaacaggctcgccgtgaaaacaaaacgaaaatataatgtatcgggccttttatcgcataagacccgcttattgagaaaaatacccaagtatcggttaaatggaaccatgaattcatctactcatcatttgcagataatggaatgatagcactgaatatcaggaggttatgaccgattttatggttcagaccttcctgatagcgtcaattttaaaatgataacactaagaatagattccatcgacatttgctcctgtgatttaaaacttattttcctcgttacatcgcaagtggtggctatatttgagtgtatcaataagaccatccaccagatacgtcgattgttcctgaatattaaaactgtccggtgcgaatgaccagttttccagtactcctgtcatcaacgctttcagcatgatggcagaacgcctgagatcaagatcatgaggcaattctcccgactgaatgcaagcccccaaaatattttcaatttttttataatcggaaatacataatcctctaagcttctcagccaataaaatcatttctccaacaaactcacatttgtggaaaaaaatttccatcagtagtcgattcctagaatcatcaatcatcatttttaacagaaaaatcaacagagatctcaatgcaaggagtggattattcggatattttgcttgatactctttctctaactcgtcgattttattttcgtgcattttacaaacagcagaaagcagatcgattttgtttttgaaatgccaataaattgcgccacgcgtcacaccggctgcaatcgcgatatctgacaatgaagttgcagaaactccacgttcagaaaatacctttatcgcggcttctataatctgttggcgggtttcttttgcttgttgtttagtttttcgtgccattttcgtgccataaactttgtttttgacttgaggctgatttacatacattcatgtatgtttgtactatagcactctcaatcaataaagtaataatttcactcgttagcactagctagatttaaagcgtctacattgaaaaattgaggtttacttatgcgaaaaaacagaggggttttgcctctggccacactactggtactttcaggcagcttcattctctcaggatgtaatgacaacaaaaattctcagcaaggggctgctggcgagcatgcttctgaagtgggtattgtaacgctgaaagcagaacctctgactgtgatcacagaattacctgggcggacttctgcttatcgtgttgcggaagttcgtccccaagtcagtggcatcattctgaaacgtaactataaagaaggcagtgatattgccgcaggtgagtcgttataccagatagatccagcaacctatcaggcagactacaacaaagccttggcaaatttatccagggtacaagccaatgagaaagtgtctcgttcaaccgttgaccgttataaatcattactgggtacacaatatgtgagtaagcaggaatttgataaagcaaattctgagcatgctcaagcagccgcagaagtgctgtctaccaaagctgcgctggaaagtaccaaaatcaatctagcgtataccaaagtgacctcacctatttctgggcgtgcgggtaaatccactgtcactgaaggagctttggtttctggcgggcagccaaccgccctgacaacggttcaacaactggatcctatctatgttgatattacccagtcaagcgatgactatttacgtcttaaaaatgaaatagccaaaggaacagttcataaagaaggtggtaaaaccaaaactcgcctaatcactgatacaggtaaagagtacagtcaggaaggctaccttgagttttcagatatcacagttgatgaaacaacaggctctatcactatgcgtgctgttttcccaaaccccaatgaagagctgcttcctggcatgtttgtccgtaccaaactggaagaaggcgtgcgacaaaatgcgattttggttcctcagcaagcaattaccagaacacctcgtggccaggcaactacgctgattgtcgataaggataacaaagtagaattacgcaatatcaatgctgttcaggcaatcggtaataagtggctggtcacagaaggtttgaaagccggagatagagtaatagtcacaggattgcagaaaattgctccgggagtcaccgttaaaccaacggaaactgatctggatgctaagctcacagccaatcaaactgagcctgctaaaaagcctcaataaaggagttggtgattcatgcctaagttttttatagatcgaccaatctttgcgtgggtaattgcgattatcaccatgctttctggtctattggcgataatgaaattacccgtggagcaataccctgcaattgcaccaccttctatttccatttctgcggtttatccaggagctgacgcaacaacggtacagaatacggtaacccaggttattgaacagaatatgaacggcatcgataatctggtatatatggcttccaacagtgattctgctgggcgtatgagtattacgttaacttttgaagcgaacacagatccagatatcgcccaagtacaggtacagaataaactgcaattggcaatgcccctattgcctcgggaagttcaacaacaaggtattagtgttgataaaacaaccaactcattcttaatggtggcaggtttcatttctgaagatggttccatgactcaggatgatatcgccgattatgttggagccagtgtcaaagacccattgagccgcgtcagtggtgtgggtgaaacgatgttgtttggtaaccagtatgctatgcgtatttggctcgatcctgacaagctgctcaactataaaatgaccacacaggatgtcatcactgccattaaagctcaaaacaaccaagttgcagccgggcagttaggaggaaccccacctgttcctggacagcgtttaaatgcctcgattattgctcagacccgtctgaactctcctgaagaattcagcaatattctgctgcgcatgaagcgcgatggttcacacattcgcctgaaagatgtcgctgtcgttgaacttggagctgaaagctacagcatcattggtcggttcaatggtaactcagcggcagggatcggtatcaaactggctaccggcgccaacgcgttagatacctcaaaagccgtcaaaaaagcactggctgagatggcaccattcttcccacatgggttgactgtcgtgtatccgtacgacactacgccattcgttaaaatttctattttcgaagtggtgaaaacgttagcagaagccatcctgctggtgtttgtcgtcatgtacctgttcctgcaaaacttccgcgccactttaatcccaactatcgcggttccggttgtattgctgggtacatttgccatccttgccgcatttggttactccatcaatacattaaccatgtttgccatggtacttgccatcggtctgctggtggatgatgccattgttgtcgtggagaacgtcgaacgcgtcatgcaggaggaagggttaccaccaaaagaagccaccagaaaatcaatgggacagattcagagcgctctggtcggtatcgcgttggtactttctgcggtttttgtgccaatggcattcttcggtggagcaacaggcgcaatttatcgtcagttctcgatcaccattgtctcagcgatggtactgtctgtactggtggcgttaatcttgactcccgcactgtgtgccacaatgctcaaacccgttgctaaaggtagccatggtattcaaacgggtttctttggctggtttaaccgcctgtttgaaaagagcacccaccattataccgatagtgtaggccgcatgctgcgtggtactggacgctacttgttgatctatattgtattgatcgcaggtatggcctttatgtttacccgtatgccatcttccttcctgccagaagaagatcagggtgtattgcttgcgatggttcagctaccacctggttcaactcaggatcaaacacaaaaagtattggatgaaatcaatgattacttccataccaaagaaacggaaattgttaaatctgtattcaccattaacggttttagtttcagtggccaggggcagaattcaggtttagtctttgtcagcttaaaagactgggatgagcgcaaagactacaaaaacaaggtgccagccattgttggccgtgcgaatgcacatttctcacaaatcaaggaaggtatcgtatttgcgtttaatattccttcgattgtagagttagggtctgccagtggttttgacttccagttgattgataaagggaaccttgggcatgaagcattaacccaagcacgtaaccagttgcttggcatggttcaaagccaccctgatatgctcacgagtgtccgccctaatggtcagaatgatacgcctcaataccgtatccatatcgataaagaaaaagcggaagcactgggcgtttccaccgaaaacatcaactcaacactaagtacgatgtttggtggagcttatgtcaatgactttattgaccgtggccgcgtcaaaaaagtctatattcagtctgatgcacttcaccgtatgttgccaggcgatatcagtaagttatatgtccgtaaccaccatggtgaaatggttccattctctgcattcatagacatatccaaagatccgtgggtttatggttcaccgcgtttggaacgctataacggtttgccatcaatggaaatcgtgggtgaagctgctaaagggaaaagtaccggtgatgcaatggctttcatggagcaacttgcgtcacaactaccaagcggcattggctatgactggactggcatgtcttatcaagagcgtctatccggcaatcaggctccagccctatatacgctgtcattgattgtcgtgttcctctgtctggcagctctgtatgaaagctggtccattccattctctgtcatgttagttgtcccgctgggaattgttggtgcattgctggcaacgtcaattcgtggattggacaatgacgtctactttaaagttggtctgttgacaacaataggtctgtcagcgaaaaacgccatacttatcgtagaattcgccaaggatctgatagagaaagaaggcaaagggctgatagaagcaactctagatgctgtcaaaatgcgtttacgcccaattctgatgacttctttagcctttatgcttggagttatgcctctagtattgagcaatggtgctggctctggtgcacaaaacgccgtagggacaggcgtattgggcggtatgattgcagctacatcgttagcaatctattttgtcccagtattcttcgttgtcatcaaacgccgtttcagtaaaaaaagtgaggatgtcgaacatatttcgacccatcactaaattcaaaaatttaaccaaaggccactgatgtggccttttaaatgggcctaaatctcttcagacaacaaataatcaatctctcaatatctacaacgacaaccttataatctaattaaaataaatacttatgaaagataccctgcgtttaaaagtaatatctttctgttttttataataaatagaagataaattagtaacttgccatatttttcttctgattacacctttaatggtaaaaagtgttccatcttgatggtgacatatgtaataatagcattatattgattttgaaagtcgcaatacaatcacctataatgatcccagtgctattgctacaacgtctactatattagtataatccaatatgtttaatgacatatgtgaatatcgctatcctttttagtagagtgctagccttttgccagaactaagtgtaagttagtcatcgttaaaaactcacttggcagatgctagaaataggtctttaatattaataaataataatcatgttttgataggccatattctaaaagaatggctataataattgttatgtataatccttaatccaaataagccgtgcgttgttacaggggtgattatggatgaatattcaccaagaagacatgatattgttgaattaaaatacttatgtgaaaatttaattcacgaggcattttcagtgctaaatcgcgctgataatcattggattaacgatctgacttccgaaaaaagcttaaaactaaacgaattgatcgagcacattgcagcgttcgtctggagttttaaaattaaatacgcagataactacaatctcagtaccttaattgatgaatatctggatgaaacatataatttgttcgggagtgataagataagcttttttgaacttacaaaatggcaaaaaacaaacgaacacttaactaacattctgttgcatgatttgaatgcctgtttaagcaaaacctgataaatatatttctaactattttttataccaaataagataaggcgaccatgactaaaactgactatctgatgcgtttgagaaaatgcacttctattgaaacactggaacgtgtaattgaaaaaaataaatatgagctttcggatgatgaacttgaattgttctactccgctgctgaccaccgcttagctgaactcactatgaataagctttatgataagatcccatcatctgtttggaaatttgtccgctaagttgtcgtgatcagataggaagtaattaaagccggtaaccattatcggctcactatataaacagattatgaattcaaaacgggtgagggctctgccagcgacaccccggcacacacatcccctgctatggctgcttctttccagatctgaccaagttaacaagttagcgttgcgggagaaccaacagagcccccattgaaattagcttcaaacttcaaagcggtgggcattatctttcatatatcgcgaaatagcaaggccgcgccattcagatgctgatttattgcccatatagatgtaaaaaacatcaaaaatgtcactgactaactagaattgacacaaactcaaagccttttattttcccacaatcaaatatcttttctaagtaaaatgttgtttttctgcttatcagtgttatattcgatttcttcaacctcgttaagaacccacgacaatcctgctactatggcaaatcagacacatagcatacgaaccatcaataggcaaaaatataaataaatatactaaataatcaaaagaaataattcttcaatcatatataaatttttattaaatctaaaaaaccaacacatataaatcataaagtcgtccttccatgaaccaaaaaaacaaaaaataagcataaaaatcaatgacaaaaaacaataacaatatcattcgcattatttgataagcattgaaaaaattaatagtgataattcgatttcacaataaaaacataaagataaattttatttacaattcaatctatttatttactaataaatgaaaatttattatttattattgttccttaatgtactgttgttgttttatacgtttttaaccgctattaccaaagcaaaggcacattatgagtcaggcattacaaaatttaattaacctgatacatctagaaaaaatggtcatgctcccaatagttagattattgtagtaaactttccattttttattactggtgagatatggctaaagttgatgtggtttgtcgttattgtcacaaagcagaggaggtcaaagggcatggaaaaggaagcagtgggcacccgcgttatcactgttatgcctgccgtaaaaccttccaactgaattacacctatcaagcctgcaaacccggagtgaaagaacaaatcactgatatggcgataaataacggcgggatcagagacactgcacgtgttttgaacgtcgggatcaataccgtgcttcgcacgttaaaaaacatgaacccagacaagtaacaacacggcctctggcaggaagtgagattcacattatctgtgaaattgatgagcaggggtcatttgtcggcaacaagaagaatcaacgcgggctctggtatgcgtgggaaccaaaccagaagcaaatcatcgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaactattgggagcatgaccctattttctgcgtccaggggatagccataaaccgattatttatgatgttgaaatattacgtgatgggagaagtttcagcgctcgccgagtcagtgcaatacagaatggtaagcctattttctacatgacagcctcttttcaaactcctgaagaaagttttgaacaccagtgttccatgcctgaagtacctcctcctgaagagttagcatctcagcaagaaattgctaaaaatatctttcatctactccccagtaagctaaaagatgctttttcagttctacctcctctggaagtgaaacctattaaattctatagtcctttcaataagtcaccagaagagcccgttcgttatgtctggttccgcagtaatggaaaaatgccggaggatccgttcattcatcattgcctactgggctatgcttcagaccttaatttcctgcctacgtcattacagcctcatggtattgggttcatggaaaaagatattcagatcgccacaattgaccactctatgtggtatcaccgtccattcaaaatggatgactggctactctattccatagaaagcccatcagcatcaggagcgcgtggttttgttcgtgggcatatctatacccgtgaaggagtactcatcgcgtctgccgttcaggaaggggtgatccgcaaacgaaaataatattgtgtgccgtactatatctacggcacacgacagtttcaaaaatggaagatatgatcagttataagcactttcgccatgagaagtaatatccaagccttccctttcagattcaacgctaatacgcaacccaaccaccagatcagcaatcttgaatgacagataagcagccacagctgaccagacaatacaaaccaatatactaatgatctgcacgccgatctgtcttagcattgtcatatcttctggaaatccagtgccccctaaagcggatgcagtgaaaatactcgttaataaacacccaacaatgccacatacgccatgtactccaaaaacatcacagacatcatcaacacgtaaccagcgttttaataccaccacgccccataaaccggcaacccccgcaatcagtccaatgataagcgcaccaccgataccaactgttgccgctgcgggtgtaattgccaccaaacccgcaatacaaccagaacatgctcccaaaagagaaggcttatcacggaatagccattcagaaaaaacccatgacaataccgcgcctgctgttgccgccatcgtatttataagggctagtgctgcgatggcatttacagcaccagcagaaccaacattaaaaccaaaccagccaatgtaaaggatcgcagtgccaataaaagtcattggtaagttatgaggtttaaaagcttccttaccaaatcctgagcgccttccaagtaaataagcaccgaccaatcctgcaaccgctgcgttaatatgaacgacagttcctccagcaaaatccaatgcaccatcctgagcaagccagcctcctccccacaccatatgcgccataggaatataggaagctgtcagccataacacactaaaaattaacagtgcagaaaaacgaactctttcgcataaagccccgacaaccaaagctacggtgatacaggcaaatgccccctgaaaaacgacatgaatcagttgataaaaactgccattcaaatcagttatcgatatatttttcagcatgacctgctcaaacccaccccaaaaacgattacccgttccaaaagtcatgctataaccgtaaactacccaaagcacacagactaaggaaaagctaacaatcacctgtgacattaatgacaaaacattcttacgacgcagcaatcccccataaaacagggctatgccaggtatagtcataaagagcacaagtaccgtatttaccagcatgaatacagtatcagctttatcgaaagtacttcccgcagcaaacgcaaaagaaggtgcactagcgataatccccgcaatgatgctggttatggataaaagttgttttttcattttccatctccctatttacaatgctgcatcattcgtttcacccgtcctgatgcggacagcatgctgcaactcaaagataaaaatcttgccatcccccattttgccagtgaatgcagattgctgtatgacatggataacttcttctactcgctcatcatgggtagcaatatcaattttaactttgggtaaaaaattaacgctgtattcggctccccgataaagttctgagtgccccttttggcgtccaaatccctttacttctgtaaccgtcaccccttgtataccaatatcggaaagcgcttcacgtacttcttctaacttaaatggctttatgatggtagtaatcagtttcatacttcccccgctttttgctgtgtttgcaaggaacattcgtgcgagaagtgttgcaaggggtatgccaagagttaaaaagtatctgtaatcaatttgttatcagagaaaatagctgggaaaggaaagtaaaaaaggagtgactagagtagtcactcctcttatgcacactaagcgtgcatagattcattcaaagtctcaccgacctgttggagttgatacatctgataatagcgcccacgcttagccagtagctgttgatgctgcccttgctccactattgcaccgcgatgtagcactaatatggaatccgcttcaacaatagttgaaagacgatgggcgatgaccaccaaagtcgtctgtttacggatcatccgcaatgcctgctgtactgattgctccgttcccgaatcaatattcgccgttgcttcatccaagatgagaatctgcggcgtttgtaccagaacccgagccattgccaaaagctgtttttgccctgcggaaagggtattcccctgctctcccagtactgaattcagaccatctggtaagcggcggacagattcagccaattgaaccatctccaacacctgccaaattttatcttcactgatatcccgccccaatgtgatattgtcgaaaaatgaggctgcaagcactacaggatcttgctgtactattgctacgccattacgcagaaccgcatgagaaagggaagatacgggacgaccatcaagataaatttcaccgtcttgccacggataatatcccataatcaaattagtcagagtacttttaccacttcccgtatgaccaactaaagccacaaacccatgtgtaggaacatgcagattgatgtcactcagcacaactttgtcattacgataggcaaaagttaagttttcaatatcaattctaccactcgtcagcgcctgctgatcagtgccatattgctgctgtgggctatccattaactcaaaaacccgctcccctgaaactaccgcctgttgcagtaaagattgttgagctgtcagttcaatcagaggttcattcaggcgcccaagataattgacgaatgcgtataaaacacccacgccaatcacttccgttcctttgaagccaaataacaatagcaggccacacagtatggcagcagaaaacaaactcagtaacggcctcagcaaaatgccatccaaccgcaacgcttgcatgcgagactgataatgttcacgattagtcgccagcattttctcaccaaaacgagcttgctggcgaaattgctgaatcactgtcataccattaatggtttcattaaagccgtcattgatatcagccagataactacgaacccgtctaataattggagtactgaaatgctgataaattatcattaccagcaaaactgctggaaatattgtcaaagcaacacatgccatacgccaatccaaaataaacatagctatcagcattgccccgatcaacgaaatgcagcgaaacactgtagggatcacattcacaaacagatctttaatggcttcagtatcattcgtcacgcgggatattagctgcccaacaggctgactatcgaaggtgctcaacggctggcgcaatgccgaattcatgacatcagtacgaagcttctgaactatccccacagatgcctgattgaataataggaactgaaagtagtgcaaggcagcagcaacaaactgcaataccaaaaaagtaaccgcaagcccactaacaacatcaagcggaagattgcccgttgctaccatattgtcaataaaatagctcacaagcagtggcccactgacttctgctaacgcagcaacccatgacatcagtacagccagcaaaattggcttgcgataattcttactgtaagacaacaagcgctttaatgatggccatagcttgcgcacactgggcttatgcatatcatgattagtcatgttcaccatccaattcggcttcaagttgctgataatggtacatatcagaataccaaccggattgtgtaataagttgtttgtgcgggccttgctgcgcaaccgtgccatgctgaataaccaaaatgttatcagcttccgttaaagcagacagccgatgggcgctgataataacggtacgctgctgccgccactggctgagattcttcataatttgatgttctgtctgaccatctacggcagaaagtgcatcgtccaaaatcaaaatttccgtatccaataacagagcacgtgcaatggagatacgttgcttctgcccgccagaaagcattacgccacgttctcccacttccgtttggtagccctgcggtaaccgcaaaatatcatcatgcatattcgccagacgagcaacttcttcaatttgttcttgagttgcatcaggccggcctagcgcgatattgccagcgactgtatccgaaaacaggaaaggagtctgattaacaatagccaatcgtgatcgccattcttccaatctaagtgtagaaacgtgtcgtgactgaaaaagaatttcaccgtcggtgacatcaaattgccgctgtaacaaggcaagcaaagtgctttttcctgcaccagttggaccacaaacccccaataactgacctggtgataattgaaaacggacatcatgtaaaacagatctatcatttgcgggataaatgaaggtattgatatttgcctgtaatgtaccgcgctcaactaataaggactgagaaccatcatcaatcaccagtggctcctgtaacaagctgcggatccgtgtatatgccgcactgccacgctcaacaatgttaaacatccatgccaatgccaacattggccagatcagcaatcccagatacataacaaagctagtcaattcacccagtgtcatagagccatgcacgaccatccaactccctccaccaatcgctaataggtttgcaacgccaatagcaatgaaaatggtggggtcaaaacgtgcatctacgcgcgcaacgtgcatatttttacgtccagcatcagtagcgacttcttcaaattgactggattgcagatcttccagaccaaatgctttgatcatacggatgctggtaagactttcctgagcatggttattaagagcagagaatgctccttgtgcagacttgaaacgatggtgaagctgttcgccatatcgtttaatcaccaacgccataatgggcatgggtaacagtgataacaacgttaattgccaactaatttccacactcatcacgataaggacagcacaccccatcactaaggaatcgactaaagttagcaccccctcacccgcagcaaaaacaaccctatcaacatcattggttgcacgagccattaagtcaccggttctatggcgcaaataaaattcagggttctggctgctcaatttctggtagaaatcactacgtagtttaacagccagccgataagatgccccaaatagccatacgcgccaaacataccgcagaccgtatatcgccagcgcaatgagcagcatgatgcctagccacatcaataattgactggatgacatcgtttttgcactgatgccatcaacgataattccgaccaaacggggaggaattaattgcagcatcgcaatcataacaaggaagataatggcaccaaaataacggcgccattcgctgagaaaataccaacttaattgagaaaataatctcacaaacctattcccgaagtaaaaaatgaaagaattagcattaactccatcagaaagatttttgcattatctaatccggtattggtaacgctgttgtatattttattttttccattgcaaagttagaggtgacatcaatcaaaccagaaactccattaaccatgcgtttgtagaaccgatcataacttttcatatcaacaacttctacatgcatcaagtaatcatattccccagccattcgataaaatgttaaaacctctggcatctcttttataaaagccacaaactgttcataccattcactactgtgctgttgagttttgatcatcacaatcacggtcagactaagcccaagtttagtgccatttagcaatgcaacttttccgacaatgtacccatcatcttcaagccgttttagccgtttccaacaaggtgtagaggtcaaattaacggcttcggccagtgcattcaaggatcggctacagtcctgttggagcagatccagtagcttgcggtctattttatctagcatatccaaatcctgtagaaaattttcccaaaagcaaataataaatgtagaaaaataacaatctatttcccccaatataaaagtaatctatatatcattaaagtattgttattcaggatcaatttatgtcgtcttcatgggctacaaatgccattaaagccatccaagctgattatcaacgaagtgctgatacacacctgattcgcctcaatctccccgtgttttcagggattcacctttatctcaaagatgaaagcactcatccgacaggtagcctgaaacatcggcttgctcgttccttgttcctttatgcactcagtaatggctggatcaaggaaggaaccccaatcattgaagcctcatccggcagtaccgccgtttctgaagcctattttgcccgcttgcttggcttaccttttatcgccgtgatgccctcctgtacagctaaacgcaaggttcaggaaatcgaattctacggtggtaaatgccactttgtggaacactcagcccttatttatgacgagtcagaacgtctggcaaaaaagctgaatggccattatatggatcaatttacttacgctgaacgagctactgactggcgtggaaacaataacatcgcagaaagcattttccgtcaaatgcaactggagccatttcctgaaccaaattacattgtcatgagcgcaggaactggcggaacatcagcaacgctcggtcgctatatccgttatcagggatataacaccaaactgattgttgttgatcctgaaaactctgttttctacgattgttatcaccaaaatcgccgtgatatccgcggaatcaccagcagtaaaatcgaaggaattggccgcccacgtgcagagccatcctttatcccaactgttatcaatgacatgctgcaagtccctgattgtgccactatcgccaccatttattggcttgaaaaattaattggcagaaaaactggcgcatcaacaggaaccaacgtttggggagctttacagctagccaaacagatgcatgagaacaaccagcagggtgcaatcgtgacattgctgtgtgatagcggcgaacgctatcttgatacctattacaatccagaatgggttcgcaataatatcggtgacatcacactgtatctcacgcaactacccaagctagacggttatgagtaacatatctccttcaatttaaataggtaggtattatgaaacgagccgttgttgtattcagtggtggtcaagattccaccacttgtttaattcaggcactccgtcaatacgatgaagttcactgtgtcacttttgattatggtcaacgtcaccgcgctgaaattgacgtggcttgtcgtattagcaaagaactgggtgccgctgcccacaaagtacttgatgttactttattgagtgagcttgcaatcagcagcctgacccgagacaacattcccgtgccggatttcagtgaaagtgaaaaaagtggcctcccaaatacatttgttcctggccgcaacattttgtttttaactctagcggcaatttatgcctaccaagttgaggctgaagccgttatcaccggtgtttgtgaaaccgatttttctggctacccagactgtcgcgatgaatttgtcaaagccctgaataaagcagtttgccttggcatcgcccgtgatatccgttttgagactcccttgatgtggttgaacaaagcggaaacttgggcattggctgattattatcaaaaattgaacttcgtccgtacccagactctcacatgttataacggtatccaaggcgatggctgtagtgagtgtgcagcctgccaccttcgggctaatggattaaacctttatttaaataatactcaatccactatggaagatatgaaatccaaaacgcatctgagctaaccaattaattttacgcaataatcgctatcattgagaggctgccaagcctctcactattttaaactttaaatgcttctaatctttcctgtatatccccctctaaagttaatgccttctgagtcttcaaatcaatacaggcaaatgtggtcaaagcatcggtgagtactttattatcacttctgcgtataatctcctgaaaaaatacaccacttttattacgtaattccttgaggctagacctcacttccaactcatctccgaacactgccggcaggcggtaattgatgttaatattaactacggcaaaaccaacattattagtttttaaccacgtcagtgtgtcactttctgtcagtaaatcccagcgagcttcttccatgaattccaaataacgagcattattcacatgctggaaaagatcaatatgatagcccctgaccttaataattgtacgcattgctattttcccctttcaactcatccgaccagataattaacaatagcaaaacattttaattacaatagtatttaatgaattattcttgatcaatatcacagccctcttgactcttgatgcgattagcatggtattcaccaagagggcttgatgatcaataggttaatttatcccgatttttttctattaaagcagggccaatgccctgaacttcctgcaactgctcaattgccgtaaattggccatatttttcacggtattcaataatcgcctgagcctttttggcgccaacgccattgagttccttcactaattgttcagcattcgccgtattgatattgatgcttccttttccctgtatttccttttctgagactaattctttcccctccttcacgtcacttgtttcaataacagctttgtgttgattggtagattgtttcacagctttatcaggtgattcatccgctgcaattgcatgagataacggaatactgatacaaaaaaccataacaagtgaattaaatagtgtccttaaatatttcatataaattcctccgtgttttgttgacggaggaaagcttgccataacagaatttctggacaagaggaaaggttcaaatatgcgaaaggccacgaaagtggcctttttcaattgttgttttgcaaaaatagttgcgagaagcttcgcaattttattcaatctgccccatcttaatctcggcatcatcacgcaaattaatcatcaatgattccagcatgaaagtaccgatttgatactgatactccgctatgtattgtttaacctgttcttctgaaacagaaccagggacaactttatccaattggataagcacagcgttgccaagcccatcttgggctaaaccatactcagacttgccatctttaggatgaggcagagtaaatgctacattagtagcctgattagtttgtgataaatgtttgatcacagtggagacaccaaactgaatcccagctgctttcaatgcctgctcacctttaccttctttcaaaacagccagcagtttttcactttcaagctgcaactgcttttcagctttctggcgttttactaattcggcaatctgagttttggcctgctcgtaaggctggatagtttctggcttgatatcatcaacacgaacaataaaggctctgtcaccatccacagaaataacatcggagttagttcctgatgcccctttatcatcgattagatttccagagaaaatagtctgaaccaccgaatcgaaatttatttcagtaggaatatggtcacgatcaaaccagtcagtcgtcacggccttataaccagctgccttttctgccgcagccaaagattcgttatcattggtagcggcatcacttacttttctctgcaatgcatagaatgcatcaaccgctttttcctgtttaacgattttttctatttccgaacgcacatcgaccagtgattttattatctgaggtttaatatcatctaaacggaaaatagcatatccaccagatagcttgatgacgccagaaagctgccctttttctatcaaattagctgacttaatctcatcaggtagggagctttcttccatccaaccgagatctcctcccttttgagcagaaaatttatctgtcgatttttctgccgccaatttgctgaaatcagcacctttctttaattcatccaaaactgatttagcttcagcatcagacaccaattgaaccaggctgtattttttttgctcgatctgtgtatactgtggcagattgtttttataatatttttcaatatcagcatcagatacggtgacacttttcaattcatccgcagcatccatcttgatgtagctgactttcaccttttctggcacggtgaaactcttgctattaacgtcataatagtttttcagctctttatctgtcactttttgctgtgcttcaatggatttcagctcaagtgtagcgaaacgaaccgttctttcttggaaggcaagcgctgtttcctgtttgatctctgtcggcaaagcaatttctgaacccgtcaatatcgacatcaattgacggttaatgagatcttgacgaacctgttcagcaaagctatctgggcttctgtttgcaccggtaagcaaggtcagatatttattgttatcaaatttaccgtctgtctggaaaaaaggtaggttacggatctcttccttaacctgttcatcgcttgctgacaagcccagcttacgcgcatattgatctgatagaacaacagtgatgaggcgatccagtgaattgcgtcgaatttgttgtactttctgctcatcacttaacagagttgagaattgatctcccagcctatcctgcaacgcaattttgtcttgctgaaatgcttgctctaattgagcacgactaatggtttgaccattcactttggcagcataattaccaccttcacttgacaggtagcctgttacaccagtcaaaacaaaggtcaggataattagagccaatacaattttaagcacaggaccgtttgccgccgtgcgtaggttgtccatcataaagacgtaaaactccgctttagtgaaaaagaaactaccatattacgctaattcaaacgctaagagaaaaaaagcgcatcaaccaattggttgatgcgcttatattctaacctatcaaccccgccccgtcagtttaagtttaactgtaatggccaaagcgagggaggatgtttcatattcattactcattaacagcatctttcagtccctttcctgcgcggaaagcgggtacttttgctgctgcgattttgatttctttgcctgtctgggggttacgccctgtacgagcagcacgctcacgtacagtaaaagtaccgaaccctaccaaaacgacatcatcaccgtctttcaatgcatcagataccgaagaaatgaatgcatctactacacgcccggcagctgctttggaaatatttacatcagcagcaattttgtcgatcagttgtgacttgttcactcttatcatccccatttagtttcactatcgtaacaaataccgatctctaacggataacgcgacagccatgccgttatatcaatcccttccagtattagcaaaaaatcatggaacagcaaaatatttaatcggatatttggattaaactaacttaatgagacaaaaaaagctggcaagtcttaatatactcgccaacctaaattttatacaaacttcttgagttagctcactattttcgtactactttagtgatactgcttctgctccaaacgcaggagactgtaaagcaatagacaaaacatcttctatgcgcttaacaggatggatctccaaatcttgaataatattctgagggatctcttccagatctcgtttattttcatctggaatcaagacggttttgatccctccacgatgagctgccagcagtttttctttcaaaccaccaataggcagtactaaaccacgcagagtgatttcgcctgtcatagcaacatcggcacgaaccggattacctgtcaggcaggaaaccaacgcagtacacattgcaatacccgcgcttgggccatcttttggtgttgcaccttcaggtacgtggacgtgaatatcacgtttttcatggaaatcagagctaatgcccagtttatcagcacgagcccgaaccacagtcaaggctgcctgaatggattcttgcatcacttcacccaacgaacccgtataggtcagttttcctttacctggcacgctggctgtttcaatcgttaacatg

SEQ ID NO: 16861 - DNA, 831 bp, Xenorhabdus bovienii
  unsure (1)..(831): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttgagctttatctttacctgtccaaatatcgttggcctgatacatattggaacacgcggttgtaaataggagaggaaagattaccaatacattttttattatatttatgacgggttttatcattgtgatttacgccatgnatgtatatttctgtaaatcatagcttgttgataaataagatacaaaaaatcccctctagcgatagcgagaagggattgatgaaccgataattatttatgtattttacagtatgcggctaattaatcggtcgactcggatgcggcgtaaacggcgtatcagtttgcgaaccttgaccggatagagctgtatactttccagctcctgataatcattgataatttttgtatgagtacgaatgcagtccagctctaacgtgcgttgttcttgcatttcctgataagggtcgtgaatgagaatagcattctctagatctagtccccatgctcgtggattgagattattgccggtaattaattgccatttgttatcaacccagatcccttttaagtgataagtattatctgcatctttccatagccgaatggttaattgctggctatcgataaagtattgcagccggctagtaaaacgacgtagattaatttcatacagataaggtaatgccccgnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16862 - DNA, 5234 bp, Xenorhabdus bovienii
  unsure (1)..(5234): unsure at all n locations
nnnnnnnnnnnnnnnnnnnnnnnnnnnnnnnnnnnnnnnnnnnnnnnnnnnnnnnnnnnnnnnnnnnnnnnnnnnnnncactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacggagtttcagatgaaagacagcagcttgttcgggattgaaaacagaatttgtctggcggccatagcgcggtggtcccacctgatcccatgccgaactcagcagtgaaacgccgtagcgccgatggtagtgtggggtctccccatgtgagagtagggcactgccagacacctatttataagtgttgtccacatggcaacattttttatttcagcattcggaatcacatcaatagtgaccgaaaatagctcatgctgatatggctcagttggtagagcacacccttggtaagggtgaggtccccagttcgaatctgggtatcagcaccataaataatatgttcggcaagtaaaacagaatttgcttggcagcaatagcgcggcggtcccacctgaccccatgccgaactcagcagtgaaacgccgtagcgccgatggtagtgtggggtctccccatgtgagagtagggaactgccaagctttaatacccagtcaaaaggccactcaaatgagtggccttttacgtttcttagtttcttattatcatagccggtaactactgatttatctttcaaatgtagagtctgatagactacagataaattacttatcgagcttgaagtaaatgtctgcctgtcaatttatccaattaaaagcgttcaacacgtttggtatttcagtctgtgctgatcatatttctaccgtaacttcagttgaatcactgttgtctgcatggcaagaagcggaggaaaaagagcatcccattttattacttggtggggggagtaacgttctttttaccgaaaattttaaaggtactgtgatattgaaccgtattcttggtgttgatatacaagaatcggatacagcatggcatatccatgttggcgctggtgaaaactggcatcagctgattgttcatcttcttcatcaacagatctatggcttagaaaatttagcgttgattccaggaaatgtggggtcagcaccaattcaaaatattggtgcatatggaattgaatttaaacatgtctgtgaatatgtcgatctaatagagttgaaaactggcaaactgattcatcttatggcaaatgaatgccaatttgcttatagagatagtatctttaaacatcaatataaagatggctatgctataacagcagttggcttgcagttaaataaggtttggaaaccaatattaacttatggcggcttaacacagttctcatgtgaagacgtaacaccagaacgcatattcaatgctgtttgtgaaatgcgtcagagtaagttacccgatcctgttattatcgggaatgctggcagtttttttaaaaatccaattgtacctattgaattggcgcaaaagatcaaatttgattatccagagtgtcctcaatatcaccataatgaacataatgtaaagatagcggcaggttggctgatagatcaatgtcacttgaaaggctattgtattggtgacgctgccatacatatgaaacaggcactggtgttaatcaataaaggtaatgcaacgggtcaggatattactgctttggcgacttatgtacgtaaaaaagtagcagaaaaatttaatattttcttagagcctgaagtacgtttcattggtagtgagggtgagatagatgcagtggaatgtatttcatgaaagatattagtatcccattaaaattaattaaagtgttatccgatggcgaagttcattccggtcagcagcttggtcaagaattaggaatgagtcgtgcgggaataaataagcatattcagaccattcgtgaatggggcgtagagattttaactatcccgggtaagggttatcgtttccctgcatcaatgaatctgctggataaagagcttattgcaggttacctgccaaatgatcgtctcgaagttatacctgttatcgattctaccaatcagtatttgctggagaaattgtcagaactcgattcaggtgacgcttgtgtcgccgaatatcagtatgctggaagggggcgccgtggcaggcagtggatttctgcttttggtagaaatttatatttgtccatgtattggcgtttggagcaagggccagccgcagcaataggattaagtctggttgttgggatagtcattgcggaagtgcttaaccgtcagggtgctgaaagagtaaaagtgaaatggccgaatgatctctatctggatgataaaaagctggcagggatattagttgaattgataggaaaaatgggtgatgcggctcagattgttatcggaataggcatgaatatttcaatgagtagtgaacagcagaaattgattaaccagcagtggactaatctacagcaagcgggaatagttgttgaacgcaataaattaatttctgaaattattcttgagcttaaaaaagcgttaattcaatttgaaaacgaagggttatctccatttcttttccggtggttaaaattagatcattttatgaatcgttcagtaaagctgattattggaaatcaggaagtttatggaacggctcgtggaattgatcagcaaggggcattgctgcttgatataaatggtgttattacgccgtatattggtggtgaaatttctctcagaggttgttgaatgcaaagccggaaatagttccggctattgttttattttctcaacctgacactttcaatagcgtggttcgctcctttagtcataattaggctagcgcgctctctagttggtaaaatgttttgttgtaagtttaatccattaatttccagccaaatatctgatgcaacttttatcgctgcttcggtagttaacttagaataattgtggaaataagagtctggatcagaaaaagcaccttgccggaacttaagaaaacggttgatataccattgttcgagcaactcttctgacgcatcgacataaatagaaaaatcgacaaaatcagacacaaacacatgatgtggttcatgtggataatccataccactttgcagcacgtttagtccttcaaggatcaaaatatctggacgctcaataattagttgttcattggggacaatatcgtagctgaggtgagagtatactggtgctgtaactttttcggcgcctgattttatatcagcgacgaatttcactaggttgcgcatatcgtaggattcagggaagcccttttttttcattaagccacgttcattcaatacattattagagtgtaaaaaaccgtctgtcgttactagtttaacgcggcgatgttcgggccagcggcttaacaatgcttgtaataaacgcgcggttgtgctctttccaacagcaacactgcctgctatgccaatgatgtaaggtattttttgcccaccagtccctaaaaattgttcaaggacggcctgccgccgcaaattggaactaatataaaaattgagtagacgtgacaatggaagatagatctgaaccacttcttctattgaaatctcttcattaatcccttttaaagcagcaatctcttctgctgtgagtgtcaaaggcactgagtcacgtaatgttgcccaatgttcacgatcaaattgtaaatatggagtcgtcaaaaaagattctttcttattcataagccaacatctgcctgtctatgcaggttggacaggttgttgtgaacacccgtatccgacaaaaaataaatctcatcatatcggttgcgctactacaggcgtagatttttttatgattttagtaa

SEQ ID NO: 16863 - DNA, 1027 bp, Xenorhabdus bovienii
  unsure (1)..(1027): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgtgtcagggaaaggtcaaacaccgttttattgatatcttagtgatcgcggtatgcgctgtcattgctggggctaacgcctggactgatattgaacagtacggtcaactcaaaaaggattggctgagttcatttcttccgctcaaagagggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactacnnnnnnnnnnnnnnnnnnnnnnnnnnnnnnnnnnnnnnnnn

SEQ ID NO: 16864 - DNA, 1044 bp, Xenorhabdus bovienii
agcaattgctgtgcatgcctgcaggcctgcatttcccgggtggtgagttctttcgctttttctggcaatgtgacatgaaaaaagtgatgcagcgtttcacggaatgtttttgcctccgagaaatagatattatttcgtacctgctcattcgcatacttccataatcgctcaatcgggttgaggttagggctgtaagggggcagataatgcaactcgatattcaggacctcggcaaaaaattgaactatttcagcgcggtggtaaccggctccatccagaatgagatgaattttttgtgaaagcggataggtttctcgaattgagccgaaaaacaggacaacatttttcgcgttaatcgtcggatattcacgaataatggtctcttcaatccgttgcaaattgagtgcgcccatgatgttaaggcgggtccggctgcctgtggtttcgaccactttgacatgctctcttccgcgcctcatccagccgtaacttaattttgtggactgggtaggatgcatcgcatcaataaacaaaataggcgcattttggccacattcagctttcaacgcgttgtaggtctcaataaagtgttgctgtttacccgcatcggatttatgaggcgttcccatcggcttcttgtagctgaacccttggcggtggagccattttgtcatcccagccacagtgaaagtcacctgccagcgcgcccagacacaagccacaatttgcgcggtagtgtgcatcaaatttgccgtcagatactccactaattctgtcgtttgttcggcagataaacggctttcagagccgccattttcaggggcgagtttttcctcagagacgtaatccttcagatggcgactcaccgtactttcatgaatacgcaaagcctgggcaatcatctgggcagtccagccttctgaggccaaaagcacggccttatgcggtcacgtacacgcacgacctgcaggcatgcaagcctcaattcgaggcctttttttttggcatctggcaaaataatggcatgggcccgaacttgattga

SEQ ID NO: 16865 - DNA, 197964 bp, Xenorhabdus bovienii
gcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacggagtttcagatgaaagacagcagcttgttcgggattgaaaacagaatttgtctggcggccatagcgcggtggtcccacctgatcccatgccgaactcagcagtgaaacgccgtagcgccgatggtagtgtggggtctccccatgtgagagtagggcactgccagacacctatttagtcagagaagccacccccaccgggtggcttttttgcgtttgatgaattttaaaaagacttttgaaaaataatctactactcagattggatgaacaaaattaatgtgccttcccctactcgataccaattccagtctgtgaacgaataaactgattgcgaaacattttcctttcctgctgaccttgttgtgatccatctgtgatggaaaataaccatgtaccgatgaatgctacaaacatagaaaacagtgctgggtattcatacggataaattggcttttcatgaccgaggatgctgacccaaatagtaggcccaaggatcattaatacaactgcagtaattaatcctaaccacccgccaatgagtgcccctcgcgttgtcagcttgttccagtacatcgacaataaaataatcgggaagttacagcttgcggcaattgagaatgccaatcccaccatgaaggcaatattttgtttttcgaacaaaatacccaatcctatggcgacaaaaccgaggataatgacagtaatcttggaaactctcagttcatcacgctcattggcttgaccttgcttaattacattggcatagagatcatgagaaaccgctgaagcacctgctaaagttaaccctgccacaacagctaaaatagtggcaaaggccacggcagagatgaaaccaaggaagaagttaccgccaacggcatctgctagatggacagcggacatatttgttccaccaattaatgctccagtcacatctttgaacgcgggactggggctgactaataatattgcaccaaacccaatgataaacgtcaggatataaaaatagccgataaaccctgtggcatagaaaacacttttacgggcttctttggcatcactaacggtaaagaatcgcatgacgatatgtggcaatccggcagtaccaaacatcaatgccagtcctaaagagagtgctgatataggatcagacactaatccgcctgggctcatgattgcctgaccacgggaatgcacagcgatggcttctttaaatagagtattgaaattgaaatttacggctttcatgaccatcagggccatgaatgttgctcctgccagtaacaggattgccttgataatctgaacccatgtcgttgccagcatcccaccaaacagcacatacagcaccatcaaaataccgactaaaataactgcgatgtgataattcaacccaaatagcagctcaatgagttttcctgccccaaccatttgagcgatcaaatatagcgcaacgacaactaaagagcctgttgctgacagagtacgaatggggcgctgttttaatcgataagaggcgacatcagcaaacgtgtaacgccctagatttctcagacgttcagcgatgaggaatagaataattggccagccaacgaggaagccgatcgaatagatcagtccatcataaccagaggtatagactaacgcggaaattcccagaaaagaggcggctgacatatagtcaccagcgatggccattccgttttggaaccctgtaatgcgtccaccagcggtgtaataatctgaacgtgattgcgttcgttttgaagcccaataagtaatgcaaagcgtgaacccaacgaataatagaaacatgacaatagcttgaatattcaagggttgttcttctacattgcctgaaatggcatccgcttgtgccaagttgtgaaagagtgtggaaaatagcagcatcgctgacaatacgatttttttcatttttttacctcattgaggatagtcgaagtcaaacgatcaaattcaccattcgccctgacaacatagatccctgttaatatgaaagaaataaatataatcccgacacccacaggaataccacgggtcatgctggagccttcatagaggggagtacctagccattcaggggaaaaagcgataagaaaaataaagctaacataaattactaacatgatggtggataacaaccaggcaaagcgtccacgtttcttaactaattccttaaagcggggattattttcaatttcttgataaatattaggattcatcagagcgtctccttttggattttgaacgatacaccttaatgcgttgtagacagccaaacgcagggtacaaaaatccgtgggaactcatgacgtatctgtcatgtccctgcacagttctctgcttttggtgatacgttattaagccgccttccggcggcgtacttttttaagacagattcatggattgcttttcttccagtagtttttcaacgacacccggatcggccagtgtggaggtatcacctaagttactggtatcgccggaagcaattttgcgcaagatacggcgcatgatctttcctgaacgtgttttgggtaacgaatccgtccagtgaagaatatcgggtgttgcaatcgggccgatttctttgcgaacccaatttctgacttcggtataaagatctggggaaggttcttcaccatgattcagtgtgacataggcataaatcgcctgtcccttgatatggtgtggaatgccaacaacggcagcttctgcaatttttggatgtgaaaccagcgcagattcaatttctgcggttcccaaccgatgacctgaaatattcaggacatcatcgacacggccagtgatccaataatagccgtcttcatcacgtcgagcgccatctccgctaaaatacatgcctttgaacgtcgaaaaataggtttgttcaaaacgctcatgatcaccatataaagttcgcgcttgtcctggccaggaatccgtgatgacaagattgccctcgcattcgccagttaatggctcacctgagttgcctaccaatgccggactgatgccgaaaaatggcaaagtagccgaacctggtttgagatcaactgctccgggtaatggcgtgatcatgaacccgcctgtttcggtttgccaccaagtatcgacgatagggcattgactattacctatcttccggtagtaccattcccatgcttcaggattgattggctcacctaccgagcccatgatacgtagtgacgtacgtttggttccttcaatcgccttatcgccttcagccattaatgcacgaatggcggttggtgcagtatagagaatattaacctgatgcttatcaacgacctgacagaggcgattgacatcggggtagtttggcaccccttcaaacatcaatgatgtggcaccgcaggagagaggcccatacagaaggtaactgtggccggttacccagccaacatcggctgtacaccagtagatttcacccggacggtaatcaaacgtgtatttgaaagtcaaagaagcatagaccagataaccgcctgtggtatgtagaacccctttaggtttgccggttgagccagaggtataaaggatgaaaagtggatcttcggcattcatttcttcggcagggcaatctgtgctgacattttcgatcaactcatgccaccacaaatcacggccttcctgccagtttttggtgttaccagtacgcttgaagactaccacattagcaacgtcggtcacggctggattgctcaatgcttcatcgacattttttttcaatggaataacgcggcctgcacgtatcccttcatctgcggtaataaccagcttggcattggaatcgataaccctgccagcaatggcatcaggagagaaaccaccaaaaatcacggaatggattgcaccaactcgggcacatgccagcatggcaacggcggcttcgggtaccattggcatataaatcgcaacgacatcgccttttttgacaccaagttttttcaatacattggcgaattggcagacatcatgatatagctcgcgataagtaacatgtctggattctgcgggattgtctccttcccagatgatagcggtttgctcaccacgttcttgcaaatggcggtcaaggcagttggcacttaaattcagagtgccatcttcaaaccagcggatactgacatgtcctgggtcgaaagaagtgtttttaacccgagtataaggttttatccaatctactatcttccctttctcaccccagaacgattcaggatcttgtagtgaccattggtaatcttgtagatattgttgtttgcttatcagggccgtttctgcaatgtcagcaggaataagatgcttgattatttgagtcatatttttatctccttgcgattgttaatactatgtcaaaacaacgttaactaaagtgtaaggagaaattttgtttcttttttgggcgtaagatcacgcattaaagagaatggatttcatggaatgatcaattaatgcggagtgtttgagagaaatttagttctgttgataatttaatgtttggggagaacgactaacttatggattttatttagttattctatccaatgaaaaaatgcaactgagaaatggaaaggaaaccatagttataatatggaattgataatcattttcattatcgtccaagtcattataataaccaccttgttcacaagctgtgagccttatacattctaaaccactggagatatgacatgagctattccctgcctgctctaccttactcttatgatgctctggagcctcatttcgataagcagacgatggaaattcattataccaaacatcatcaaacctacgtaactaacacgaatacagcgctggaagccttccctgaattagctaaacttcctattgatgagctgatccagcagcttgataaaatccctgcggataaacgcacttttattcgtaataatgcgggagggcactcaaaccacagcctgttctggaaaggattaaaattgggaacggtcttgggtggtactttgaaaacggccattgagcgggatttaggtagtattgagatcttcaaggaaaaatttgagcaagccgctgcaacccgctttggctctggctgggcatggctggttctaaaagcagatggcaaacttgcggttgtttcaactgccaatcaggacagcccgttaatgggagaggaaattgccggtgcttcaggttaccccattttgggtctggatgtgtgggaacacgcttattacctgaaatatcaaaaccgccgtccagactatattaaggcgttttggcatgtagtggactgggatgaggcagcaaagcgttacgaagaaaaaattaagtaactagtgagactgatttctctcagtaatgctggtcagtattatggccagcatttttactattcgataatattgttattacggatgagcaataaaccctaccgcttcgtaaactttatctaaagtcgcctgagcacgagcttgtgccttggcagctccttcagccatgatttgattaagtaatgcttcatcattgcggaaatggtgaaaacgttcctgcaagtcagtcagcattccagaaacggcttctgcaactgcacctttcagatgaccatacatctggccttcaaattcagcttccaattgaggaattgtcttacctgttacacctgccaaaatgtccagtaaattggagacgccgggtttattttccaaatcataacgtacacgtggtggttcttcggaatcagtgatggcacgtttgattttcttcgctgccgattttggatcttccagcagggcaataacgttattacggttatcatccgactttgacattttcttggctggatcttgcaaagacatcactttagcaccacccgttggaatgaatggttctggtacggtgaaaatatcaccgtaaatggcattaaagcgctgtgccagatcacggctcaattcaagatgctgtttctggtcaattcccacagggatttgattggcctgataaagcagaatatctgcggccatcagaaccggatagctaaataaccctgcgttgatgttttccgcatgactagctgatttatctttaaactgggtcatacggccgagttcaccgaaataggtgtaacagttaagtacccaacttaattgagaatgctgtggaacgtgtgactgaacgaagatcgtacttttcttggggtcaatgccacatgcgaggtaaagtgccagcgtatcaagcgtgcgttttttcaattcatttgggtcttggcgcacggtaatagcatgctggttaacgatgcaatagatgcaatcatactcatcctgcattttaacccactgacgtaatgcccccatgtagttaccgatggtcaattcaccggaaggctgtgcgccgctgaatacaataggtttttgggagtttggtttcattacagtgggttcattcattttgttacgcttcctgaagtttcaacgtggataatccgatagccggtagtaaatccgggaaatggtccaatatataatctgggtggcttaatgctatcgattctccgtagttatatccataggttaagccaacacaagggcagccggctgcctgtgccgccaaaatatcattacgggaatcaccgacaaaaagcaattcttctttatggatgccaaacatgcccattgttagatatagcggggcaggatggggttttttctctttaacatcatcaccacccagcaccagtgaaaagtattcactgatccccaatgattccagtaatggcgcaataaaaggtgtgggtttattggttacgatggccattggcagattatgctgtgccagtgttgccagagtctcttttacgtggggaaacagttggctgcctgttgtcacggttgtttcataaaacccatcgaatagcttacgggtttcacaatgcagttcaggggtggattctactcctgcccatttcagtgcacgctcaaccatgacatccgcgccgttacctatccagatagcaactcgttctttgcctgccgcaggtaaacctttggcaatcagagcctgatccagtgcttccgccagaccgctggcgctgtcaactaatgttccatccagatcaaatgcaatggcacgaagatttttcttaatacttgttaccattatgccacctttgataattcacggcgcatctcatcaatgaccgttttatagtcaggctggctgaaaatagcagaaccagcaacaaacatatctgcgcccgcctgagcggcttctctaatattattggccttgatgccaccatcaacttcaagacgaatatcgtatccgctgtcgtcaatgattttgcgtacctgccgtaacttgttcagggtttctggaatgaaggactggccactgaaacccgggttaacggacatcagcagaattacgtccagcttatccagcacataatcaaggtaactgagaggggttgctgggttgaaaactagacctgccttacagccatgttctttgatcagttgcagggtacggtcaacatgctcgctcgcttcgggatggaaagtgatgtaggttgcacctgccttggcaaaatcagggataatacgatctacaggttttaccatcagatgaacgtctatcggtgccgtaatgccataatcacgcagcgcctggcagaccattggcccaatggtcaggtttggcacatagtgattatccataacgtcaaagtggacaacatcagcgcctgctgccagaacctttgcggtatcttcacctaatcgggcaaaatctgcggatagaatggatggggcaatcagaaaatctttcttcattattatcttctccaattcattgttttatccccattattccaggggtaagaaacctcagtcacttccggcagtataacgccaaaagctcatcaactttactccgagcaagaatgtttctacttattgtccgacgggctttaacaatatgaagagaagcctgatggtaccattcccgcgtcattggcgtgtcatggttggatatgagcacaggaatgccctgctgagaggaaagatgataggccatcctcgctagattttcttgatcgaggaggttaaaactatttgtatgataggccgtaaaattagccgttgccgaaagtggggcatacggaggatcacaataaattactgatccttgtggtgcgttgtctagcgtgatttggtaatgctggcagacaaaagaggctttttgggctttttcagcgaaccagtaaagttcatcttcaggaaaataaggttttttataccgcccaaaagggacattaaattctccccgagagttatagcggcaaaggccgttatagcagtggcggttaaggtaaagaaacaatagactgcggtacagtggttcttggcttttgttgaactcttctctcaggcggtagaagtcttccgcagtgttgaactcctgagagaataatggacgggcatgattgataaattcttctggacgagattttaccgtgtcatacaggttgatcagatcactatttatgtctgacaagatgtaagaatcataatcggtattcaggaataccgagcctgcgccaacaaatggctcaattaagcgttctccctctggcagatgacgtctaatgtcatccaccaacgggtattttccaccggcccattttaagaaagcgcgtttttttttcatgccgtcaaattagctattcaataatttcagagccgcagattgtactctgtttaggacagcatatcagcgcctaatcaaaatagttttattttttcagatcttgctgaacctgttgtagttttctaacccaaggttttttggcctgaacttcagccgggagtgaggaaatggcacttttggcgtcagaaaccgaaccataactaccgtggatcaagataaaccatgccttaccttcacgtttcgcttcataaaccgtataatttgaaaggttattgttctttgcgaaggcaattaaggtatccgagcggctggcgctacttaactggagtgtgaatcggttggcggaggctttcagtaaatcaccgcgagtatcggtcacaccctttttactggcctgatgatgggatattgctggtttatcagttgatttggcatgattttctgattttgccactttttccgttttttctattttcggcggtgcaactttttcagtcttattctgttcaactggcggtatcaccgtctgttgcatagagttggactgtgatggcgtcaggtttttttgcaccgtatcattgatgttgccttgctgttgattcaaggcatcagaaatatcaccgggcaattctatgcgctggttgtggctacttgcctcaggtgttggagaaagatctttgcttggtgtattgctaatgggtggcatactgatttcttgtgagccatggcttgccggtgccgatggattttccggtgagctactctgattattggtagagagtgaagaagagccggatagatcgatgtttttctcagccgtattctgggattgctgtttctcatgatcagttggcgatttcaatgcagaactgatagcaataatcagcagtaaaagcaccagaattccaaccccaatcattaattgctggcgggatactgccagtttgggctggttggattggctgcgcgatcgcggagggcggcgatcagatgtatcaggtttaaattcgttttctgttttttgtttgttttctgattttaattcgtccatatgccctctcagcagagataatactgccaattgttattttagaggtttggcagcctgatctaactaaaaccgataatgttctatctgataatgtagctattttatagcataacagccagaaaatgattcattattcaagcttttattctcagaaggaattttgccatattcagataatcgtgtatttagctggtcgatggcagacataggcggacggcgtccaatatgacatcagacccgatatcagaacgaagttctgctttcccaattgccgtaggcagtaccagatgcaattttcccgcagagacttttttgtcgcgcatcatatgcggcaaatagatttctggagacatttccactgggccgttgactggaagctttgcccgctccagcaagctgataatgcgctgagtatcctgtcttgagaacgtgcccacaagctcagatgcccgtgctgccatcaccatacccgcagcaaccgcctgaccatgcagccagacgccataacccatttcagcttcaatagcatgcccaaaggtatggccgagatttaatagtgctcgcatcccattgcgttcttgttcatcagcagcgacaacccatgctttgagttcacagcagcgacgaatgcaataagacattgtctgattatcgagagccagtaatttctcgatattgctttcaagccagttaaaaaattcaccatccagaatgatgccgtatttgataacttcagccagacctgcatgcagttcttgagcaggtaatgttttcaggcaattgatatcgatgataacggacgctggctgataaaaggcccctatcatgtttttgccgaggggatggttgacgccggtttttccaccgacggaagagtcaacctgagaaagtaatgtggtgggtacttgaatgaagcgaatgccgcgttgatagcaagcggcggcaaaccctgtcatatcaccgattataccaccaccgagagcgataagcgttgtgtcacgaccatgattattttccagtaaagcggaaaaaatgtcattgaccacaaaaagtgatttgtactgttcaccatcaggtaagataacttcgtctacccgaagacccataccctgcaatgtggatttcacctgttcaagatacaggtgagccagcgtctcgttggtcactatcatgacctgctgaccagcttgcaggggcttgaatgcctcatcgctagaaaatagcccttgggctatggtaatcggatagcttctttcacctaacgtaacagttacttgttccatatcagctttcgccttatcgtttgctgctgtgcacaccagcgtgaatcagtttttttccagtaattcgataatttggttagcaacaactttggcgctttgctcatctgtacggatagtcagatcagcaatttcctcgtagagagggttgcgctcatcagctaaattttctaaaacttcgcgtgctggtgcatccacttgaagtaaagggcgttttttatcacgctgggtacgagctaactgtttttcgatggttgtttctaaatagacgaccacaccacgggcagacagacgattacgggtttctttcgatttaacagaacccccacccgttgccagtacgatgccttgtttttcagtcaattcgttaattattttttcttcacggtcgcggaagccttcttcgccttccacatcaaatacccagcccacgtcagctccggtacgtcgctcaatttcttgatcagagtcgtaaaactccatattgagttgctgagctaactgacgaccaatagtgcttttgccggcacccataggcccaaccagaaagatattgcgtttctctgccatgtttttggtattactaagactatttgttaatgataacccgccccgccaatcagattagccacgggacctaaactgaaacctcatgagtgagaatgtgagatcagatgggaaaattatctcagcacatcaacctgtattgcaactatatatatctggcacgaaccgttgtagtctggtttatgctttgttggctgactgtgagcctactttatgtttattggggtagactcttacttgtgatgttagacccgctcactcaattagataatccttgtatgctaaattactctcagcgtcaaatccataaacaggtcagaccaagaaaaatagtagaaaatctggtgaaaaagacataattacgcctattaattgtttgatatttatcatttatttttttattggttaaatatcggtcagttgaggtgtaataaaaattacgagttcccttcggctgtgctgctctcctttttggttaaataatgcacccaatagaggaagatcagacaagtaagggactttttgcaggctagcgccttttttctgctgaaaaatgccaccaagaatcagggtttccccgtttctgacggtaacctgcgtcacgatttcctgtttatctatcgccagattttcatttcctccctgactaatggggagtccaggggcgttctggctgatttttagcgctaaacggattttcccttttctcaagatgtgtggagtcacctccatacctaataccgcctccttaaattgaatcgtcgttttgtccttgtcctgaacgagataagggatatcagaaccctgcttaatgctggctggctgttggtgtgaggctgtcagccttgggctggcaatgatatccagttggttttcctgctccagtgcactgagctccatttctagcaagcttgcatggatgcgggcagtgttcagtaccagtcggtggctttgattacctgcggattgatgcaaattcaaacggttgaggcctattgagcgatttagtggatcagccgccatgccccagtgaattcccaactcatgcagagcctctctgctgctggtgacaatatgggccgtaatttgtacttgttgttgtggtgtatccacctctttcagccaacctttgatgcgggtaatggcatcaaacttatcttccaatatcaggctgttggttaagggatcgtgttcaactttgccccattttgttagtagcgccggaatatttttctgtaattgttcggcgatctgccctgcgtcagcgtattgcagagtaatagcctgatattcaatctcctgctcctgttcatcccgttctgctggggaaaattcgagttgttcatctaattcgtttttcggtggctggaacggatttcttaccgctatttcgctctctgtttctttccatgcgttaatttcttcggcagaactgagggttggcagtagcagaaacaggcaagccagtagaataaaaaaatgattgttcatgattatccctcatggagggcatctgacagcaccatgcggacagtcagatcgttatcgacagggatgatggtgaggtgtttaatcagcaaaacaggttgtacttgttgaatttcattgaggaaatggaggagttggtcatagcttagtaacagcatgatgtgccagaaaatttggttgccttccttatggcttttccactccatgagttgactgccagagctggttaagggctgatgaaggcgtttgagtacggtggcatttttttgcgggatattgttgggcaaaatattgctgccttggctgagttctgctgtcaattgctgaatctgttgtcggatatcgggtagattgggtaactcggcgatacgcttttcggataacgccgaattgtgtttctgctcggtgatattgagctggaggtcatggattgcgtattcattctcctgccagacccaaaaatagaaacttaatatgagtggaatgaccagcaattgctgcaacagaaacaactgccatgctggacgatgaaaccacacaagataattacttttcatcaggtgctcccattaaccagttggcatcgatagtaaatatcttgagatgttcttccgtggtgctcatttttttcagttggacattgttcagtgaggcattgtcggtcaggttatccagtaagtccgagacatcatcgtagttttgactgctggcggcaaaaaccaattggccggtgtcgtcactgaatgcagtaagccagcttttttccggcaataagtgcggaagttgacgaaataactgtaaatatctttgattctgttccatgaatgtctgttttttccttaattgcagtgtcaattgatgatggtgttgaacggcttgttcgttttctttgatattttgctgtaattgcactaattgatggctaatttctgttaattggttggtatattgcgcaagtttgtttttttgttgcacggaaataaacgtcagtatagatacgcagagcattaattgcaggcagagcaatagcccccattcccggcataggcgtttcaatcttgcctgacgccacggtaaaaaattaacctgatacatcatcgatcatccggcctcagtgccagccccgcagcgataatgaaggcattagttttttcgggtaatgggagctggtaatggcgaaatgcggtcagcatgttccagacatgaacgggttctgttggcatagcatgctgttcgtcactgtaataaatctcagggctagctatgtctggtgagacaggcaactggctgatgatttgtgccagatgcggatgtgcctgcattgatatcagaccataactaaaagggccactggcgggggcaacccatagccagtctgctatgcgtttgtggatcaaccagccgtcatcgggaacgcctgcaagtttggcaatatagcgtaatgcgcagggagaaatatcaatggcatcgggggataaatcgatgtctgcgagcagcttaagccagaggttgagatctttttgccgggtggcgctgatacaaatttgctgaccacgcacccgataatccaacgcaagatcactgacagggaactgtttttcggcattggcatgcacaaaccagccgagttctggttcttgcaatagagtatgggtaggtagggcgatctgcttctgtaaggtttgttgaacaggtaatgttaatcgtaagctaatctttttaggtaatttttgccgccattgcattaaaatgtggcctaatttttcaggatgttgtagccgtcctcctgaaataatgtcgcttgataaacgatattgccagcaatggcgaagttgccagccatcacgacgtttaatggctgcgagagcattaatgtaatgttcatggacatccagtccgatataccattttgataaatacatgtagcgatctccatatctgctattaatgaaaggtcatatccatagtgctgtatagcctttatactacgtactaatcgtttataaactgcccgattaacatggcgtgagaaatttcaggtgaagttcataaagtattttttgatccttgtcgttgtttgcattttattgggagccgcctcgatttttggtttgtacaaatatatcgagccgcagttgccagatgtcgcgactttaaaggatgtccgattgcagacacaaatgcaggtgtacagtgctgatggcgagttgatggcgcaatatggtgaaaaacgtcgtctgccgctaaccctttccgaaatgccacccttgatggtaaaagcctttattgccactgaagatagccgtttttatgaacaccatggtgttgatcctatcggcgttatccgtgcggtttcggtcatgatgacttctggccatgcttcccaaggggcgagtaccattactcaacagttggcgagaaactttttcctcagcagggagaagacgctgatacgtaaggcgaaagaggcgtttctggcgattaagatcgaacaactgttgacgaagaatgaaatcctggagctatacctcaacaaaatttaccttggcaatcgtgcctacggtgtaggggctgcggctaacgtctattttggtaagaatgccaatgagttgactttgagtgagatggcgatgattgccggattgccgaaggcgccttctacttttaacccgctctattcttatgagcgtgcagtcggccgtcgtaatgtggtattggggcgcatgctggaagaggggtacattacccagcagcagtacaatgaagccagaagtgagaaattggttgcccgttatcattcaccacagattgtcttctctgcgccttatctgactgaaatggtacggcaggaaatgattaaccgttatggtgaaaatgcctataccgatggatataagatctataccaccattactcgtaaagtccaattggctgccgttgatgccgtccgtgcaaatgtgattgattatgatgtgcgtcatggctatcgcggcgcacaggaagtgttatggactgtcagccagtcagcatggagccagggccaaattgtcgataagctgaaaaccctgcccaaatatggtccattgctgcctgcggtggtcacgaagtccagtgcgactcaggctgaagctatgctggtggatggcagtaaagttgaactgactatggcgggtgttcgttgggcgcgtcaatttaagtctgacagtctgcaaggggcggcaccacgcagtgtcaatgaagtgattcgagccggtgaacagatttgggtcagaaaagtcaatgatacctggtggctggcacaattacctcaagttaacgcggcgttggtatctctcaaccctatgaatggcgaggtagaagcgctggtcggtgggtttgatttcgagctaagcaagtttaaccgcgtgacccaatctctgcgtcaggtgggttccaacatcaagccattcctgtataccgctgcgatggacaaagggctgacgttggcatctatgtttaatgacgtgcctatcagccgttgggatgcgggagctggaacggattggcgtcctaaaaactcaccgccgacttatgatggcccgattcgtctgcgtcaaggattagggcaatccaagaacgtggtcatggttcgagccatgcgtgcgatgggggtggattatgccgctgactatctgcgccggtttggcttgccgggggaaaatgtcgtgcggacggaatcgatggcgctgggttctccttctttcacaccaatgcaaatggtgcgtggctatgcagtgatggcgaatggcggttatttggttgatccttacttcatcactaaaattgaaaatgatgaaggaaaggtattgtttgaagctaaaccgaaactagcctgtccacagtgtgaaaatattccggtgatttatggtgatacagcgcgttccattgagttgtccgaagattcgattgagaacgtgacccattccaatgtcacgcaaaattcgactcagccccagtcagagttagagcgtgctccggtcaatacgaacaacgatgatcagcagtacgcgcctcatgtcatcagtacgccgctagcgttcctgattcatgatgccttgaataccaatgtctttggtgaaccgggttggatggctacaggctggcgttcagcccgtgatttgaaacgccgggatatcgggggcaaaacaggaacgacaaacagctcgaaagatgcgtggttctctggttatggccctgatatggttgccacggtctggattggtttcgatgagcatagtagagctctggggcgtacacccgccctgaaaggtgaaggcggagcgaaaagtgctcaacccatttggaatgatttcatgaaagtggcgctggaaggtgtaccggtaaaagtgatggaaccaccagcaggcattgtttctgtcaccattgatcgcgcgacgggtaagctatccaatggtgggggcaatacccgtaaggaatatttcattgaaggtacacagccaacggaatatgctgttccagaagcaggaacgacagtcactgagaatggggagagtcaggaactgttctgattgacgacaggaatcaaggaaaaatgccctgtcgggaaactgacggggcttttcattattatcagcttatcaacatctgtgctctattgggttacttattacccactttatctttgacggctttggtaaactgtttacccccatccacggccgtataatgcacatgaatgttgatatcttttaaccgccatgaggccagtggtagcagaggatcacggaatattttattgatcacctgcttatctgggaatgccagcgtccatgttgaaatggctccggtgccttcaaatggcagataacggtcatcatcaaacatcagggtgtacagccagttctcttttgccacactgccatcatcttcactcagggaagagagggcgatctgctgctgggcgcgcagattggtaacaatattcttattgttgcctgcttttctgctgggatcataaagccagtttattccttcaatatctgcgctggtcagcgttgaactgcccgtctgggtcaggacggcactgatttctggtgacaggataggtgtgacgctcaaggtacttagcgaaattgacacggaaatccgtttgatctgacgcaggtaatgcccggggtaattggtatcaaatagcttgggattcagtgtaaagctgaccacctgttttttttcaatttgattctgtaattcatgcgctgtcagcaactcgctgagggagatggttttcttgatattcatgcggcgttcattgcgctgtagccacgcattttccatttgcagcagatccaactgcaaggattcacccgccagcaggccgcgataagaagcattccacgcggtggttttgataaagctcctgcgctgataatcccccacttcataacgccagcttgtctcagccatcagacacagcgaaagcacagcgtcataggcaggggcatacagggcagcgaggcgtcccatcagccactgataagtaggaacgaccaagaaccccgttgtcataaactcatacagttcacgggcggctgtctgttgagcatgagcttcccgcagagcggtattggcactcttgattagcacctcctgctcctgcaattggcggtcaataatattgatttcgctttgcgcctgtttgtactcaatttcccactcttggcgccgacgttcgtaatctgcgctgtcctgaagtctatctgcgataagagataacccttcagaaaccaattcagaaatgatggctgcgtttctgatgggtgcggagtatttgcctccaccgactgccaggccaaaaatattcggaacgacgtccagtgcagcacccgcagcatagaaaggggctgccgttgctttgacaacttctgatgatgttttgattgtgagggctgagatttccagagcggaaagattctcttcgtacagattgtgatagtgatcataccgctcttgtgccatctttttactttcttccagcgtggatttgcccagttgagcaatctggacagcttcctgttgcagctcaatggcgaatgcagataaccgaagagcctgtgattgttccagcacttcctgctcggcattgacttcactttctatggcactgaatagccgatgccccatttgaattaactgtttcaccgcatcattggcacgttttaacatggctgggaagcgataaggtggaacctgttgccggagattattccactgactaatagaacttcctgtgtggcgttgtattaggaggttatcatcgtcggcaccggcatacagtggcaacgtcaggactttgccatcgagcgtcaggccatggcggagattatacagacggctattcagcgttttttgatattcaattaattgattattgaatggcgatacaaaaggacggccatcaacgaccctaacatcgggttcaaagtctgccttgatctgttcaagggtgacatccaaaccttccggtaatgtaccgagcagttgtagtgcctgttgatagcataaacttgcttcgttcaggctgtctcgggttagttggcggtaaaggttatctccctcctgtatccagagtgtgatctgaaaatggaacagcgttttttggtaatacactggcaggctgtaagcaatggtatcagagtcgtcttctttcactgacgggggcaggttactgccattttcgatgatagggcgagaattccacatccgcattgacccatagggatcaaacagatagttgagtagccagcgtcgggcatcgtagaaacgctgttcttcgctaagccgataagttaccaagaaaggcaggtggaagaataactcccagaaatatattccgttggcaccgctaaagtctattggtgttgatgatgtactgtcatctaacgtcggttctagcagtgattgggtatcccatgacaaaacctgctcaatggattgcgttgcccgggcgactaattgtttgccaaacaaggtatttaatctgatggcggtggagcggaatccaaggctcgtaatgtccagatattgtgcctgttttgtattcctgcttaaggtgataacagggatcctatcgctttctcttacgatgatctggtatttatttgagactgtacctgtatagtctagaggttggttagcacctgaatactcggtttctaatgttgcggatagtgtgaaggaatattcgtcgatattagcacggatcgggatagtgatttcttccgtggtggcactaccattgagtattacttccttaattgttggggctgtgcctgaaggtgtatcaagcgtcagtgtcaattttgattttgtgtattcccaattataaaggacatcaaatgtcctcctacctcttgaacctttattctttgttgtgacaacaagtgctgacgtatctggtttccatgtttcacttcgctgagaaactataccattgagccaattcaactcagcgagtttagtcacggtattgtctttccattcattaggagacacagtaaaaagtatgatgctgccataagatacagtaaatgttgatgttggtgcttgatccccttgccaggtaagatggaatgttttcagactggtttgactggcaggaatatgtatcttgattgattccttgtcagaattatcaactttaatagtgccatcaaagtcttcggtaggaagttttgacaaaaattctatattattgaaaattttaaattttgtaccgtatcctttgggattccttttaatcaaagtatttgtccctgtcagaatcagtttggttttatctccgctgagtttagcgtctaacttcaatatgaggttcttattgtcttcacttgctttgtattcgataaatttctcagtacccacgtaatggtgctgcaatgtgtcagagtttttaaaaattttgtaccaagatgagataagtgtattttcatcttggttattgagtgcttttttatccaccagcagtaagtcgcgcagttcaaggaaatagtcttggtttttcttccagacactactgtctgtttttgtggtgtcatacagcaagacgcccatccacggatcgccttcgcgttgtatatccaccattgcgatcagccccggtttgtatttttcatctttcagatacgggttttcgttatcggggacacgtttaccatcttttgtcgggtattcgcctttggaatcggtaccatccagtcggaacagggtattcggtgcgctccactcaccgttgctttgcttataggtgaattttacgttgatggcgcgataatccgatggtttttgatctgcgctcatcagcgggctggcttcccgttcaacccaaatagtatattggcggccagaaatcacgattggacgcagagccagtaacgttcctgacagtgacagggtgattttctcccattcactccatgccaatgggctgatccgatcattgtcatcacgcatcttgatatcaagagtgcgccagtaatactccaccggtttagcgttgtttttaccgataaagtgataataatcattttccggatcagtgccatcaatatacccactgaccagttgcagattactgatccgctcaaactcggttaaataacgcaggatagccgtctggatcatattgttgttcaatctggactgccccaaatcattttccaaatccgcaaaagcacgggttttacgtagcctgcgggcagggtcgataaagttttcagggaagtttctttgcttctgccatgcctgccagtgaccatattggctcaggttacggttccagtgttcaatgcgctcatcactgatggtttgtacgccatagcccgtttccagacgggaaaacaggcggaacagatagcgttgtaaactggcgatagcgaaagccactctgctggtgctgacctctgtggcaacttgcaaatcggtcaagaagtaatttgataagtcttcaacggtggtgatatcggataaattatcatccgatggcgcccattgtcccagcagatactcaataagggcatcacgccacagttcattgagagaaccttccagtttggtttgttcttcctgtgtgcaggcggcaaacagtgcgctgctgacttgttgccagtgatcatagtcggattggttcgatagcttggcaacatccagcaggggctgggcagagatgtcacttttctcggccaatactttgacgcgcataatcgtgctgatgccgataacattttgtgccacgttatgctcgaagccatttgtgacctgttggatttctttgctcgtccaacctcggttgtccagatgttatccagcggtggcgtttggcctatttgattggcttggctcagataatagagtacgtcgtcttcagttttgtgattggctaataaatccagccaatcaccataacggctcagtcgatgcaagaaggtgagatcaagatcgcgtagcttatcgtcgggcagatgcaatccaaaccagtctggattcccgattagcgcctgtatcgtttttgctgtcaatttgaatgatttgacaatcgcggtgtagcggttgaggtcgtaccatgtggcgacggcttttgccttcaattggggatcgccggctggagttgccaatgagatggaatcgcgcaggaaagtcgcctgattgttgcctgtccacagtaataatggcaaagagagggtttcatcaagattaaacgcatggctgatggctttaatcaccagatcttgctgagcgataaaggcatcgcggatcagaactgtcaaaatttgagtccacgtatctccttgagctttccaggcttcttcttctgccagttcttgcaggatttttccaaccttttcagacaaggctttttccgcgctattgtctgctgaaactagatcaccctgaataattcccatgttttcatcaaccagttcggaaaacgatttcatccaattaaccgggatttgcttggcctgaaatcccatcatggccgccgcaattttatcttcactcagcaaggcatattgttgatcgggcagaatggagatcacttttttgagccagtcgatattctcaatatcttcgctagtcacaccattggcgtcgggttgataaggtgtcagtaatagattcagggataatgtagacagctcatggcgttttatccattgtgcagcattcatgacacggaccatcacatcaaggatatcaatatcttcggcatttttacttaatacgggcactccggccagttgttgcaggtagttcggattatcgttgttcaacaataacaacaatcccaaaccttctttgacgggcaacttcagcaggcgcggtaattcaaccagccggtacagcgccgataccacatccagtgagcgtttgggtttggtcagcgtttgtgcctgcatgattaagctgagtaaaatctgacaggtcgcatcatcgatcttcaggccagcacacaattgattgacggttaatgcgtccagcccttcgatcgtggagggatcgaattcctgattgtctaaaaccagtactgaagacgatgctgcctgctgtgacagaccggaagcattgaacaaacgatcaaaaaatgacagtttgttttcgagcgaatagggggtaatttggccgataaaggctgcaaattgctcggctgtggtgctgtattcctgttggaaatgcaggaaaacgcccaaagcacgtaacgttgcttcagtaatggcgaaatcctgttgtttttcagcttgtcgggcggttaccaacagcagatcaagctgttcagacgtcagtttcagtgctttctggatatgcaggaaacgctgaatgcgatcgaaattgtcattgctgatttctttgagcaaaacgacatcttttgctgttttcgggtctacggtttttgccagatagatggccggttcggtgccggcattgatgaatgaagctgcgtagttggcaccggaagggaactgtttacccgcattagtgggcttggcgacattgctggaataggtgacgatactgtgggtgattttattgtcagacagcccattgatggcgaaaagccgttccgcttcttgagaactcaggttggtttgctgggtaaagacggtgagacgagataaagataacgcggcctcggctgcatcccctttaacgccgtaatatttggcaaagaaatctttttggtcgctttgcgatttttcctgtagcagagtctgaagtttcggtgccagcgaactgctgaccatcatggctgtttgcagcgagtctgaactcagattgttatcgataaaattgggatattggcgatcggcctgttggatcagttcaaacaatgggagctctttttctgccaacactgcgatggtttgtttcagcggaaaatgaaacggcagtgcaagcggatagtgaatctctgccagtgaattggtcaaaggctggttcttgttgatatgcgccttgaccttttgggccaaggcttcaatgatcaatggtaatagactactggttttattgaggtttgtactatcaagcaacagtgtttcgatatcgggacgtctttggctgagaaatcggacactgtctttgtcagcctcgctctcaaacagtcgagtctgctgatacaaatcaaccagataggccagaggcccatcattggtttcgggtaaacccggcagacagtagagatcttgattatcattaaaaagcgtcttatagctggttcttgattccagaatattggccataaatcataccttttaaatagaaagtgtgatgaattagagaacttattctcattaccaatccataacgcaggtttatgttttttggcagattggtagggttgcactatggcctgtcaatgattgctatccagcctaaaatatattttggatctgatcgttttttaaaaaaacacttgatttcaattggctggattaagtgttttattaatcaatagaaagaagattttttattggggattaatgacgatcatatttattaatattaacgatataataaatatatttattaatattaacgatataataaatatatttattaattatttttaataaagggaaaagttttttacccatattatttacggtaattattttaattaatttagtttaagtgattgatgttttttgtcagattggcggcttaaaatggggacaggattaatattaagaggcgttattttttatcgcaaatagatttcaagttgtagcgcgatgacaagtgagtgaattcccaggcatatagataaccatgtgactggggagtaaacgcagccagcaaaagcagaaacttgaaggcacatacctgtcgattgggataggttttaacgcgttccattgcttgatgcttgcaggtatcgctgtgcaaaaaacagggcactgacgtttctggcttcgttgaaatcgggatgttccagcaaagacatcatatctgcgattggccagcgaacctgtactagtggttctggctcatctccttccaaacgttcgggataaagatcttgagcaatgacaatattcatcctgctggaaaaataggaaggagccattgtcagtttcgtcagcagttccagtttggctgccccgaatcccacttcttccttcagttcacgattggctgcttcaagggggctttctcctgcatcaatggcacctttaggaaaacccaattcgtattgttcaatgccaacggcatactcgcggataaggagtaactcatcgccgatcacgggaatgatcagtactgcttcacgattggagggtttcatgcgttcataaagtcgctttacgccattgctgaactcaagattaacagactgaatattgaataaacgggaatgggcaacgtcatttatattcaatattttaggtttcttctgatcaatcatgcttgcccctaatggttgccatacactggctaattgaaaaatgatgcatccaatcaccgaaagattattggtaaattcaatttttgtgatgaaattggatacgcatccaaactttgctttaatatggccgattatgccagtaaatgacagcgattatcgcttgtatgtatttttgttgctatcttgctgctgcataaaaggctttattttgcgaaatggtgtaataaaatttatttaacattttgttaataaaattaaaaatagaaggcaagaatagaaatagcctgaatctgcgtattttgctaggttgttattctgccagtctctttattgctgtcatgggcgtggagaagaaatgagttcactagtcattatattggctatttttatcactagcctgattataatggcttcctttctgactttcagatggaagcggcctgataacgcgcgttatctaccgtcaatcgccaaaacagcccatcgtaagctgaatactgatgaatatcaggcaattgactcttatttgcaaaatgtcctgcccctgatgcagccagataggagccacagatcaggccaaccagcactgcctgtcaaaaatgatacggtttataccatcaatcacaccatcaaccgcttttctgccgccactgatgaatcgcagcattggcgctattatgttgatgaaatagagatacatcttcctgcgttacttgagtcattcatcaagcagcagaatacgattgagattgttcagaccacatccatgcctcttgtgattgccgtgaatggccacttcctgaaagattatcagcaagatctgtccattgcgccaatcgtgaaacaaacggcacaggcttcaatccagaaaaatggcaattccagtgccaattttttgtatatccgcaaggaaacgccagaagagaatcgtctgcgtcattcaacaggcattctggaaggcattctcatgtgtattggcttgtcgttctggtttttggctcttttcatgccaacgcccatattaccgtggctaatgttggctgctgttctgtttctgattgccagcttctggccgattttcaggccatcttcttcgcgtaacttgttgaatattagctgcttcagtggtattccgaaacgttgggggatattcagtgaatctgaaccggaacagcggaggaatatctctctgggtggtattgatcttctctatccctcacattgggaaccgtatgtcgttcatgagcttgaccgaaatactgaagttgatatatataccaattgccatgtcgttcggcaggggcgctacctctcattgcatgaggaagaaaaacactatccttatcagcgccatagaaaaaatctgatactggtggttttttccatttttgccctgttggtactttatttttaccagcccgtgagcttatctatgcggctcagttttgcatggctgcatggcagcaatacccaagtcatcaccagcgttactgaactgcaaaatatgcctctgaaggaaggtgatgtactgcgagtcaaaggcatcgggatgtgctacacaccacccagactgaatgataatcccagtggaatcaaacatatatttgccgcgtttgactgcactggcatctactggaataacgatagcccattgcccatgccggaatcagacattatcgaaaatgcatcaacattgattacaacggtcaatgagcaattacacccaattgaacgtagccggaaaaccaaccctggcctgaatgaagccattgcgaaatcgggtatgacactactcgacaatttttcgcaagtcatcttgaagacgcataatttgtgtatggacgagattgattgtattcgtctgaaaagcgcactggtcaatctgagcaatgctgaggattgggatgatctattgaaacaggctgaaagagggaaactgaatggaaccaaagtattattacgttcagtaagtgcagatgcactggaaaagttagttaatactaccacagcatcatttatttatcgggaaattgataaaataagcatgctcctgaacagcccatcgccgggaggcgtcctgctgatcagcgaggaagggaatcagttggttgaattgccttattcatcatttcttgcctatgaatacagcgcactggatcagtggagggaattacagcggctagctgacatattgttgagtgctccatttgaagctgtcggaattgtgacgaaattgtccgaagacgcgaatgggactcgccgtatcaccttgcatagtgaacccgattccgtgactcttattcgttatttgggaagcagcttcttcctggcaatactcatggcgatattgagcatcaatgccattctgatgataagcaaaaggcagagaaacaaggtgcggctccagcgcataggccagtactacgacaattgtttcaactcgaaacagccgccgatggattagcgatgagtctgcgggctgtgttaccctcaatccgttttttgccagcttcgattagacatttgggagaaacaaccatgccgaattcagacaccgatcagactgtgcgcctcgataaatggctctgggctgcccgtttttacaaaacacgctccatcgcgcgtgaaatgattgatgggggaaaagttcattataatgggcagcggagtaagccgagtaaactggttgagttgaatgcagaaattaaactgcgtcagggaaatgaagagaaaatagtgactgttttagcattgaacagtcacagacgcagcgccactgaagcccagcaactttatcaggaaacggaaaaaagcattatcaatcgggaaaaaacggcattggctcgtaaaatgaatgtgctcacgatgccgcaccccgatcgccgccccgataagaaagagcggcgtacactgattaaatttaagaacacgaaattaaacgagtcggaataaccgtctcagtgagatgagagagatttatgaccaagcatgatcaattacaccgctttttgttcgaaagccattctgtccggggagaactcgtttccgtcagtgaaacgtaccagcggatgatggaaaagcaccattaccctctgcccgtacagcagttattaggtgaattgttggtcgcaaccagcctattgactgccacattgaaattcaacggagatatcaccgtacagattcaaggtgatgggccagtcagactggcggtcattaatggtaataatcaacagcagatgcggggcactgcccgtattgatggtgatgtggatgctgcgagcagcctgcgggatatggtcggcaatggttatatggttattactgttacgccaacagaaggtgagcgctatcagggcgttgtcgcgctggaaggggagacgctggcagaatgtctagatgcgtacttcaaacagtcggaacagttgccaaccagactgtttatccgcacaggaatgctggatggaaaaatggcggcgggtggcatgttattgcagatcctgcccggcgcacaggaaggcagcgaagacctgcttgatcatctggtacaactcactgcgaccatcaagggagaagagctgtttacgctggatgtgaaagaaattttgcatcgtctttatcatgaagaagatgtgacgctgtatgagcctcaacaggttgaattccgctgcacctgctctcaccaacgctgtgctgatacgctggtgacgctgccggatgctgatcttcaggagattttgctcaaagatggcaaaatcgatatggaatgtgaattctgtggtatgcactatattttcaatgataaagatatcagcgaaataaagattgtgaaaaaagaatcgctgcactgatgcgattaattatttttccagggcgtaatatacgcccttttttatgtgttcattaatcctttcattccgtgtcctgcgtctcatataaacctaaaaaaagtaatgcaattatcaattttttgataacaatcgctgttaattagtcataattatttattatttcccgcagagaaaaagtgtaactgatcaggagcaacacatgagcgttaaaggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcagttgcggtagatacggggattttcacggggcgttctcccaaagataaatatattgtccgcgacgatgtgacgtgcgataccgtatggtgggctgatcagggaaaaggtaaaaacgataacaaaccgctcagtcaggaaacttggtctcagcttaaagggttggttacacagcagctttcaggcaaacgtttgtttgtcgtggatgcattttgcggcgcgaatgcagatacccgcctgaaagtacgttttatcaccgaagtggcgtggcaggctcattttgtcaaaaacatgtttattcgtccatcggacgaagaattggttaacttcaccccggattttattgtaatgaacggggcgaaatgcaccaacccgcagtggaaggagcaggggctgaattctgaaaactttgttgcctttaacctgactgaacgcatgcagttgattggtggtacttggtacggtggcgaaatgaaaaaagggatgttctcaatgatgaactacctgctgccattgaaaggtattgcatccatgcactgctctgccaacgtgggtgaagaaggcgacgttgccattttcttcggcttgtctggtacaggtaaaaccacactttccaccgatccgaaacgcaagctgattggtgatgatgaacacggctgggatgatgacggcgtgtttaacttcgaaggtggctgctacgcgaaaaccattaacctctccaaagaagcagagccggatatctatcatgcgatctgccgcgatgctctgctggaaaacgttaccgtgctggcggatggcacagtcgatttcaatgacggttccaagaccgaaaatacccgcgtttcttatcctatctaccatatcgaaaacatcgttaagccagtatcgaaagccggacatgccactaaagtgattttcttgaccgctgacgctttcggtgtattgcctccggtctcccgtctgacgccagaacagacccagtatcacttcctatctggttttacggcgaagctggcgggaactgaacgtggtgtgacagaacctacgccaacgttctctgcctgctttggtgcggcattcctgtcactgcatccgactcagtatgcagaagtgctagttaagcggatgcaggcatcaggtgcgaaagcctatctggtcaatactggctggaatggcacaggcaaacgcatctctatcaaagatacccgtgcgattatcgacgcgatcctgaatggtgatattgaagatgtggataccattgagctgccgatctttgacttggctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctgtaagagctgccgtgttaaattcacagcaaaccacgtaaaaccctatctggctggatagggttttttcattcatcgaacattcatcagcaatcagttaggtggcaggtcgaacagcaggatttcgctctcttggctggcaattaattgaagatgaaattcatcccagatagcgatgccatcgctggtggtcgcctgaacgccattgatagtcacttcgccacgaacaacctgaatccagatttttcgcgatttttctatattatattcgtctgtttcgccgtttttcagtgcccaacgccataaagtcatatcctgaaatacttttaacgagtcatcgcgagtatcgggcgaaaggattaactggcgacctttggcagaatcaaagcagcgttgctcgtagcgcggagacaggtcatttttttccggcatgatccagatttggtacaggtgaagtttgttactatcatgcggattatattcagagtgacggatacctgttcctgcgctcataatctggaactctccggcggaaatttgcccctgatttcccatactgtcccgatgttcaactgtaccggaaagcacataagtcaggatttccatatccttgtgaggatgcatgccaaacccttgcccggcatcaatcacatcttcgttaatcactctaagggcagagaaccctatgaaattggcgtcataatagtcagcaaatgaaaatgtatgccaactgtccaaccagccgtgattggcgtgacctctttctgaagctttacgtaagtagatcattttcaaaatccctcaatgttttttgtagtctaattgaaggcttgaaatataaaagattgtaaatttaatcttaaagttcaaaatttttgaatggtagctaagctgagttaagtataaaaaaaagccaacattcaagttggctataaaataaacactggaagcaatgtgagcaatgtcgtactttcacatgaccctgaaggtggtgcactgaaagtaataataatgataatcgttcttattatcgtttgtaaagtgtttttttaaccaaatttagaggtatgactaaaaagtcgatctttacacgggattgtaggtaatgtgatcgcttcgttttttcctttcatttccttcgatattcgattgatgtttattatcatttaataatacaaatattatcaaaaaatgataaaaatgataaaaatgataaaaatagaaaaatggacgatttaataatcaaataaaacaagaaagcagtgatttcattacaggcgatctgcggattaacccataaacgctcctatctcgacatttttatggttactgtattagccgggcttctggggctcgttgtggtcattattctcggttcgttattcggctcattttgataaacgagtacttaatgtagataaggagctatatatgtccactatcgtgttgcctcgcattatggaagtaggcggtggggctatcacccgtcttccgcaggttctgcaaagtatccgcagtaaaaaacccctgatcgtgacagacaaagtgatggttcagctaggttatctagataaactgcaatctattttgcaagatgctggcattgaaagcgatgtttatactgacacagtaccagagccaacggctgcctctattcaggccggaattaagaaaatgaaaagtgatcggtttgatgccgttattgcactgggtggcggaagcgcgattgacagtgcaaaagccatcgctgtgatgggtaaatttggcggcacagtcaatgaataccgtttccctcgtcaattcaatgaaccgggacttcctatcattgccattcccacgacggcgggaacaggatcagaatgtactcgcgtcaccattattactgatgaaaaaaccgatgaaaaattactttgcataggtgccggattcatgccgattgccgctattatcgactatgagctgactatcagcgttccagcaagaactacggcagatactggcattgatgcgatgactcatgccatcgaagcttatgttagccagaaagccaatccctattcagatagtcaggctattgccgctatgaaactcatcggccctaacctgcgcaaggtctatcacgatggcaataataaagttgcccgtgaggccatgatactaggctcgaccttggcaggtattgcattctctaacgcatctgttgcattagtacacggtatgagccgccctattggtgccttcttccatgttccacatgggttatccaacgccatgttgcttcccgctgtcacccggttttctttagatgcagccaaagagcgctatgccgaatgtgcacgcgcactaacttttgcaaaaccaacagacagcgacaatgtagcctgtgaaaaactactaacgactttagtcgatttaaatgaagcgcttttcgtgccaacaccagagcaatttggcattgataaaacatgcttttttgcggttgtggaaacaatggcaaaacaagcggaagcatccggatcaccgagtaataatccacgagttccaaccattgcggaaatggtaaccatttataagcaattgtggaattaatgactgatttactggagaaaaggccatgagtatcgtaggacattttattaacggcaaggttactgatatccattcacgcttacaggatatttataatcctgccactggcgaagtcagccgtcaggttgctattgcctccaaggctaccgctgaagaagcgattgcggcagcacaagcggctttccctgaatggcgtgatactccgccaataaagcgggcacgtattatgttccgttataagcaactgctggaagagcatgctgatgaaatttgtcgtttgattggtcaggagcatggcaagattattcatgatgcagcaggtgaactccaacgtggtatcgaaaatgttgagtatgcctgtggagcacctgaaatcttgaagggagagtttagtaaaaacgtagggccgggaatcaactcctggagcgacttccagccattgggtgttgttgcagggattaccccatttaacttcccggcgatggttcctctgtggatgtaccctctcgcactggtttgcggtaatacctttgtactgaaaccctcagaacgtgatccaagtgctcccctgtatattggccagttattaaaaaaagcggggctacccgatggtgtatttaacatcgtcaatggtgacaaagaagtggtggatacactactaactgacaaacgggtaaaagcagtcagttttgtgggatcaactcccgtcgcgcggtatatctacacgaccgctacagccaacggcaaacgttgccaagcacttggcggggctaaaaaccacgctatcgtcatgccagatgccgatatggagaatgtagtaaactcactcttaggggctgcatttggttcatcaggtgagcgttgtatggcactgtctgttgcagtggcaatcggtgatgaaattgctgatcagttggtcactcagctgcaagaacgcatgaagtccctgaccattggggttcatagtgataaaaataatgattttggccccgtcattacccgcgagcatcagcaaaaagtatgcggttatattacaagtgctgaacagcaaggcgccaaaattttggttgatggtcgtaacatgaaagtttctggttatgaaaatggcttctttgtcggtgccacattgattgatgatgtcactacagatatggatagctataaagcagaaatctttggccccgttttacaagtcgttcgcgttaaaaccatgcaggaagcgatggatattatcgatgaacacgaatatggcaacggcacttgtatctatacgcgtgatggagaggcagctaactattttgccgatcgtattcaggttggtatggttgggatcaatatcccgctgcccgtccctgtttcttaccatagctttggcggctggaaaaactcattgtttggtgatctctacgcctatggtcctgatggtgtgcggttctatactcgtcgtaaaactatcacgcaacgctggccatccgctaacctgcgtgaaggcgcagagttctcaatgccaacataaaattttcctacaataccctgttaattcagggtattttttctctactgcgctctattttatttattccgctagcccttgacgtatctattgcaatttttttaatatgttaacgtaactttcatttgaattacgtaagaagccacattatttaaacataactaagatggaactctgtatgtcatacatgatatatctaacattaaatggtaagaagcagggcttaatatcagcagggtgttcaacgcttgattctataggaaatcgatactaaaagggacacgaagatcaaatacaggtactcagcctgaatcatgcaatttcacgccagcagaacgtgagtcaccagccaatacagttcatcaaaccaatcgataaatcatcaccactactggcaatggcaatagactccaatgagtcactaaatggtggttttattttttatagaacaagccaaatagggcaattagaattattctacgaagtaaaaattacagaagccactatcacagatatttcctgtgtatacccacactctattaatgatcatgatataatgccatatgaaaaagtcacgttaaactataaatctatatcatggaaccatgtgactgctggaacatcagcttatagcatctgggaagatagaatattgtaaacataaaactaagcatataatgtatatgcttagtcacatagctttttattttttacatatttttttggagcatttaacgattttttataacaagtaatatatccattttcttttaatttgaaatcaccgtaccaatatacaggcaaactaatgacaaaacctaaaataccaaaaaatgtaagaaatttaaaaattgaattattgtgttttggcaactttaaaaaaacaaataataaaaaatagaaatgcaaaaataaaatgtcaaaggataaaaaaacaatactgcaaacatcctccatgaaaaaacaataacatccgaaagattataaatcaataaaaattcatcaacagaaaaaaagagagtcgcatttattattaaaaataaaaaaatgtcccaattgctaaagttaatttatttttattattcatctaagcttcttcattattaattttaactccatttagataaaataaatattattttattcgtggataaggataaccaaatggctgtttacgataatctaatttatcagcctcagctagttccttttcacgcatgtagtttatcagttttttactaattttataacggtcatcaagctcatatagcacccaagtcgtaaaagccccaaaacctaacgccacaatagcaactcctaaagcaaaagcaccaccttcaaaaaaaattgctgcaccagcaacaaccccaaagccaaccaaagctccaacagcggttttggctacatccatcgtgatatttccgaaaaaatcataaatatcgtactcatctctaaataataattccattgatctatacagaaaagaaacaataagaactcttctagatgctgtaattattcccgatcgcattgcttgtgttcctatacctatatctatcaccttccaatgatctactctatattttgtagctgttaaaaagcttctgactccggtattccccgtgagctttatcattctatttccatatctattgacatattcagttactcttacgccaaagttactacttaattcatttgctaatcgcataaaggcatagccatctaatatattacccgcatacgttgttacaacatctgctactgaaaatagattatctttccatgataaattagggttcggttcacatatatttgttacaaaatagatagcttcttcaaacgttaaaaaaaacataaagatcttcattgtcatttaattttttttgaaattcattttgaagttcagaatatcttttctctcttattaatttgctatcacttaaaggtactaatgttccattttcaaaaccaatagaaccatccataaatgctctttcaaattcacttctactcatttgacaccccataaaattacataacatggtaatttattgatattttgtctaatatcttatcggactcagctattttttctttagattttctgaattattgggaagcagatcaagtttatctgtcggggtatgacactgcgttttaagttcctcgaccagccgataagtgttggctatggcgttgaagtttctgtccacatctttactgaagaaaaagttggcactgacaccagtaacaatccctatcgacaacattgccccgccaatcatccaccaaaagtagcgctgaagccggtcataacgccattggagatcgtcctcaaactgccccctatatcttcaaaacggggttcttttttttagaatgattaactaattgtaaatattcaggatacctagtgtcaaagatcatgcgtaacacaggaattatgttaaatatgtcacttgtgacggctttttgtatatacaaaaatgtattctatggtgtgacgatggagcttgaatttgaatgggatcccgccaaagcggaaactaattaccgtaagcacgggattcgttttgaagaggcggctcttgtttttgatgatccttttcattggtcaatgtaggatcgttttgaaaatggcgaataccgctggcagacgattggaactgtgaaaggatgtgtggttgttctggtcgctcacacgacacagtttgaagatgggactgaggttattcgtattatcagcgcccgaaaagcggaacggaatgagaggaaacgttatgagcatagttagatataaacgaagcgatttaccgcctctgactgaaaacagggagtctgaactgaaagcattgtctggcaaacctgatagtaatattgattacagtgacatcgcaccgctgaatgaagctttctggaagaacgcgacacaagggcagttctatcgtccggtaaaaacacaggcatcagtcaggattgatgctgatgtgttggcctggcttaaagaagcaggaaaaggttatcagacgagacttaatgctatcttacgtgaagctatgatgcgtgatttgcatcgaaagtaatcttcatacagcccgccaaatcgggctttttgggagccgctcacgaaacggaatttttagcacgttaactccattgaggtgagcagtcccctttttcatgcctggcatgtaacagctgttatgttaatcctgttcagggctggatacgctcgacggaagtaactcgaggcaaggagataggcgatcgccgttatcgtcgttcaccggagaaagacggcaaaaaacggggaacatagttatttgtcgagataactatctgtaatggctagcatttgtgtcggttagaatcgtactcctaaaagagaatctctgattctaatccccgtgagcctatctggtacagtaattctaaatttttctccaatagctgattgaattgttgcgctaactatttttcgctctgaaaaataaattgtaaggacagcgcctatatttgatctaagaagttgatctagcttacccaaacaatattcatttttttttacatgtatatcgatataatcattacccacctcatcttcccctgcatatataacatcatttacacattgtggtttgagatgaaaaaactcagtatctgatactttaaacatcaagaagtcttgagattctcgttgaatacatccaaacaagaaaaaaataaaaaaaatgaagtacaacaatctcggtataatcatgtaagacctcaaatgagggtcgtcaacgaccctcgtatatacgataccatctggctaccaagaaacgatcacgttttgaccagcgctatgacttcgacacctaatcctgtcaataccagcaccgcccttactaacaactaagtattcacctggccctaaggtttgaattgttttcgatgttggctcatcaatataattaatctcgacagaaaatgttgatggagcctgcgagttcgtatcaaagctataacgaattgtgtgtgggccgccgccccatccttgtaaatctatccacggaccgaaaaaaccgggaggcgcataaacttgtcttgaaggcatacctatctcctatagattaaatctatccaagataaaaatttacttaatccatgaaattcattgattgataagcactatgcccaacagggtattttattacagaataaatattgttccgataatcttaaattataacagttggtagaacaaaattagtaaaagggaatgaatctagtggaataatccctaggattatgcagttttgattgtggcaactttacctgattaggcttgtttctcacactgtcagattgaaatctgacagtgcttgccgttctttgatctgttttgatgccaaacgctagcaatttgcgaatcccgcattaactctatgccattgtatttttcgtgtacacgaagctgattcgtcaaggagtaaatcggaaccccaaaggggaccctcacgatttactccttgacgacactccgactaatacacttgtgaaaggtgttgtgaacacgaagtgggcgcaacacctttcaccgatgacaaaacgaaccaacgttcccggagcttgaaatagatttgatgtgttttaaatggtatgagcgggctgtttaactaactaacccgtccgtttaacttaaaagggattaaccatacttcttagcgaaatctttatctgacatacataaatagataataaattcaataaaagaaataacataaggaatgaacgtccagcaaaaaataaggtataaaaacccagttcctatttttcctagataaaatttatgtactccgataaaaccaagaaagaaggctaatagagcagcagttattctgcttttctcgcctgttatttcttctttttgaactgcaccacaactagggcaagaacttgcggaagtgtggatttcttttccacaaccacggcaataaaccatgttcgacatctaaatatcctactgtcatctgtatcatttaaatttatattaaaactatagagttaaaaagccaatgattttcggttgctctgatatttggggtagagccaacagtttcaccatgaaccgccatctgatggaaagctcacactgccaaaacatacacgataaaccgtgttggatggagaacgggaattattgtacgtttagagcattttttaaccgttcaagacacgcaactgattgatctaacaaaaatggatatagcttataagttgtctcactcgtcgtatcgtatttaggttacaaaaaacaggcttaacgtattcggatttccgatctccaagcgcacccctaaaaaggcctgaaaacgattttgagcggtttttggaagactggtgtttaaagagaaaaaatcgcacagtgaagctcataggcgtttttatgcccattagggcatgggaggcggcacttaaaggttgaaaggatcatcgatgatcaacccgctgataacagaggggaactgatcaaggagcaggaatcgaccttcaccctgttaagctgtgagcgaagcgaacccataagcacaagctgtaaagcaatacgatagctggatggtcggagacgaaagaatctgacaacgttcattgcctataggggggttctgtggaagaactgacaaatttgataagtttgagatattagtggtttatcttaacgtctataactatttgataattaacttagaacagcacttttgatagattttttccaacataaccaaatagtgtactttttgataaatataattaagtaacttattgaggtttcagtaactttacatttttgtcaatttttccactggatcccatccagcgaactggaaaacccattcaatgttcgattcccgctgaaactgtatggggacacgggtctatcgggagccggatgcggtagctctgcaagtccggttctgaggaggggcctatctgggcggctgggtaggtttactcaactcgaatccccagtgtgatcctaaattcggtgtacgcaaggatgtacgccagcggtgcccctcaaaatatcattaatgagtttacccggatttcatcgatagcctagatacacacgctgttcagtttgttcgtactatccagtccgtcaaatataagatcctcgatcttgctcacagatctacatatttttcctgatggaaatgtagaaagttacatgtatgtatctgaatgatctctttattttacatttttgctacaagtttgacgaaaatgcaactattaaatatattaaatcataggttatatcttatgcattcaatccatcggagggtaatcatgccggtaccaacgcttaagcatttcattaatggtcagtatattgagtctaaaggttccgaatattttgatctggtcagcccggtcactggtgaatcttatgcgcgttctcctaacgcgactgtagcggatgttgatgatgcttacgcatcggctaaagaggcatttaaaatctggggacgcagtacaccctcggcacggcagcaggcgttgctagcgctggctgatacggtggaaaaaaacgctgaacgtttgattgagtcgcaaagccgcaatacagggcagctcaagcacctgattgcctccgaggagattgcgacgtcggtggatcatatccgcttcttcgccggtgcagctcgctttttggaaggcaaggctacagcggaatatctttctgatatgaccagtagtatccggcgtgaaccgctgggtgtggtagggcaagttactccatggaactatccgttgatgatggcggtgtggaagatagcgcctgctctggcagcaggtaataccgtggtgcttaaaccgagcgatactacgccggagagtactctgttgctggctgaactgtctgctccgttcttccctgccggcactttcaacgtggtgctgggtaatgccagcgcgggttccctggtcgtttcacacaaaacgccggctatggtttccatcaccggttccgtacgtgccggtttgcaggttgcgtcttcggcggcagctaatctcaccagagcgcatctggagctgggtggcaaagcgccggtggttatttttgctgatgcggatgtggacaaagccgtggagatcattgttaccgcagggtacttcaacgccggtcaggactgcacggcagcttcacgtgtgctggtgcatgaatctgtttacgatattttcgtcactaaactggtggcggcagctaaagctacccgttttggcgatccagaagataaagaggcgctgtatgggccgcttaataatgttcgccagttggagcaagtcacagggttccttgcacgtctgcccgctcatgcccgtatcgaaacaggaggtcgtcaggccgatcgttcgggatattactttgaacctacggtgattactggtctggagcaagaagatgaaatgattcagaccgaaatttttggccctgttatcacagtacagaagttcctaacagaacaggatgctatcgagaaagctaacgatgtgaaatacgggttggcctccagtgtctggacccgcgaccatggccgcgcgttgcgtctgtctcgtgagcttgactttggaactgtctggattaacacccatattcctctcacggcagaagcaccccatggcggcttcaagaactctggatatggtaaagatctgtcggcttatggtttcgatgaatatacgcgtatcaaacacgtgatgagttccaacgactaatacaggatgcccataatggatcaaaatagatcttcacgtgacttggtgtcgcgcgcgcaccacgagctgtttactgaccgtgatgtgggggcgcttgaacgttattttgcgccgaatttcatcgaacattccccgttggttaaaaagggtcttgccggattgcgtgagcgggttcaggcacatcctgaactgcaccatgaaatgtatcgcgtcctacaggatggtgacctagttgctattcacggccgttttacggggttagacgagcagccgttggtcggtttcgatctgtaccgggttgccgatggtttaatcgtggagcactgggacggcttagtgccgcagtccgcgcccaacgctagtggccgaactcagttagacggcccgactgaaacgggctatagccatgacagagagaagaaccgcgagctggtggttaactttttcacccgtaccctgatcgaaggacactatgatgagtttagaaactacaccaatggtgaagagtttcgccaacacagccccgatattcccgatggtacggctgcggtcattgcgtttcttaagcaactcaaggatgaagggcagggcctgcattatgcaaaaatccaccatacagtagccgacgggcagtttgttctgagccattcggaaggaagtattgccggagcacgtcacagctactttgagctatggcgtatcgagaacggcaaagtggctgagctttgggatgctatcactccggtaccggaggatgcgcaagcgctgcatcgccacggtattttttaacgttgtttaccgacatgctgaaatccgatgctatttcaatcaggaattagagaatgacggaatattccatcatctatgcaccgctcgatcaggctacccggactgaacaggttgtcgaacgtttaagtaacgcgatcatctctgggatattacagactgatgagcagctgcctaacgaaaacgagctgtcgcggctgttgggtgtgtcaccggtaactgttcgtgacgccctgaatacgctgcgcgccaggcagttgatcgatactcggcgcggacgtcatggtggtagttttgtatgtcaggttcctgttgaggcaatgcggaaatatcatccgttgcggctgatggcttcaggtgaactagcggatttcagcgagtttcactgtgccgtgatcggccacagcgcgaggcttgcggctcaacgttcaacaccgggtgaactgagaaagcttgggcaactgatcgacagctttgcggccgcaacgcaaccggatgcccgtatacagacagatatgcgctgtctgttaaccctggcatcccagtcacagtcggctaggcttgccaatcaggagctggagattcaggccgaatggacgcctttgatggggcttctgtaccgagaggttgccgttcacagcgaggttaccgccgcctggcgtacactcttggctgctctgtataagggtgatgacctagcctgttaccagttggcgcagaagatgattacccaaattactgaccacttgcttgaatgcaaaattcttgcagagatctgatcgcgagtaacacggctgcattcatcccaggagaggggggaggcatatgtacaacgatatacacgtagaacgggccaggagcatcctggacgatattctggtcacggcgcagcaggccaccgccgctctagcggataagacagcgcgtattctattggcgctgccgttatatcatacggcaggtgtccgcttggcgcgggagcaacgcggcgcattgcaaaaacatatccacgatgtactgcgtaataacgcctggtgtaacggggcgggatttgccagttatgcggtcccgaaaacggttgaggaggagggggggtactggacgctggagtggtggcgtcaggaaggggataccattcaatatgcgccgctggaacacaatcaggagcagcgcaggcgcctggatttccgattgtttgagtggttccggcagccggccaactgtcatcttcccgtcattgacggcccctatgtggattatgtctgcaacggcgcctacacgattacgatagcccatccggtgcttattggtggggagtttgttggtgttgcggcggtggatatgctggtctcgacgttggatcggttacttctgccggctctgggcgctatcggtaagccagcattgattattaatgacgatgcgcgtgtcgtgacttcgacagtgccgggagtgcgttcaggttcgttattgaagagccaaagcgttaaccggtcggccgatggtgaagtcccttcactgcgtctggtaattttgccgtcatcacacactgaatcacacagggcgtttgtctgctgaagcccacttattcagattgctcaggagtttttatttatgactgaatctatgttagctaaaaggcgcagcgcggctatcgcaaaaggcgttggcgtgaccacacaagtctatgttgagcgtgcggaaaatgctgaaatctgggatgttcaggggcaacgctatattgattttgccgccggtatcgccgtggtgaataccggccaccgccacccgcgcgtcattgccgcagccagagagcagctggaacagtttacccatacttgtcatcaggtagtgccttatgaaaattatgtagcgttagccgaacgactgaaccgtctggtgccgggtaattttgtgaagaagaccgtctttgttaccaccggggctgaggcagtagaaaatgccgtgaagatcgcgcgtgccgctaccgggcgcagcggcgtagtggctttcagtggcgcttttcatggccgtactttcctcggtatgtcattaaccggcaaagtcgtgccgtataaaatgggattcggcccgctggttagcaacgtttatcgtatcccgtttccgatagagctgcacggtaccagcgtggaacagacgctgaacgcgctggataatctcttcaaaaccgatattgagccgacgcgtgtcgctgccatcatcatcgaaccgatacagggagaaggcggcttctatcctgcgcctcctgaactgctcaaatccctgcgtgaaattgccgatcgctacggtattgtactcattgctgatgaaatccagaccggtttcgcgcgtacgggcaaactgtttgctatggaatatcatgaggttgcagccgatttgaccacgatggcaaaaggtctggcggggggattcccgctggcggctgtaacgggacgagcagagctgatggatgcggtagtacagggtggtttggggggaacctatggaggtaatccggtggcgattgcggctagccatgcggtgctggatgtgatcgaagaagagaagctggctgcgcgtgcgacgcagttgggagagcggctaaaacaatgtctgcatgaactgcggccgcgtgtcccgcagatcgccgacgtgcgtggacttgggctgatgattgcggtggagtttaaccgtgcggacagtcaggaacccgatgctggctttaccaacgcggtgcgtcagaaagcgctggagcggggtctgattctgctgacgtgcggtatacacggtaacgtgatccgtttccttccaccgctgactatacaaaatgatgtttttgacgaggcgctcaacgttctggagtctgtgctgctcgatctgaaccgtaccgccgtttaaccggagggtaactaaggagggattaacccaaaatgagcgtggcggcagggaggaacccgctggttcataagagaggacaataatgcactggtatttaaatgtattaaagaactatgcctgtttcagggggcgagcccagcgtaaggcgttctggtattttgttctgtttcagattctggctgttctcatcatttctttcctggaaaggctgtttgctgttgccaatcccgaaatttatatggggtggttcagcgctatctatctgctgctcacctttttgccagcgctggcggtaaatgcccgccgcttgcacgatatcaactgtagtgcctggtggctactgttacatcttatcccgtttgtcggcactgttatcttactgattctcgccgctctgaaagggcaggcgggcagcaataaatacagttcagggaaccggatccattcacagggaaatcccccgagccaggctaacgggtaatttccggtcataaaggagtgctgaaatggcaatgaacagaagagattttatctctactgccgcgatcctcgcaggggcaggagcactttcatctctacttcccaccacccctctgctcgcccgaaccttaactgcggccgatgcttcggctgtcaatattgaccaactccggccgatgctgttgcaggatgcacagtacagaaccagccggttggggttggatccgcgcatttggaactggcatagagacgtggctgccatagccatgccagccaactactatgaggcctccctggctgattggccggcttttggaagctttcctagagaccagaattgtgaggttgtggtcgtcggcggcgggttgctgggggcttccactgcgctgcatcttgcagaagcgggcgtggatgtgattctggttgaaaaggataacattggttcgggagcctctggccgtaatggagggcagatgacccccggaattgctcgctgggaagctgaaactatgttggaaaaattttcacccgatgaggccaaacgtttatggcgttttgcatcggttgaagcgatgaatcttgtggatgaactccgcgagcgttacggttttgaatgtgaccgcaaatatggtcatattacagcagcgatacacccgggtcatatggggccattggtggctaatgccgatgcccggcgccagctgggagatacggcggtgaaggttattgggccacacgaattgcgggaagagtatgtgcgttcgaatatctatcatggtgccaatatcgacagcatcggtggacaggttcagcctctggcgctgctgcgaggcctaatttatggctttgccagactgggtggacgagtctatgacagcacgaaagtgaagggcatcaggcaggatgccagcagcgcggtcatagaaaccgaacggggagttatcagggcgagtaaagccgtggtactgggagtgcatggctccaccgaagagtttatctccggcccttccactaccgtgccttttttcacctatgtggcggtaactccgccgttgtcggtggatatcaaagaactgatcccgtcaggtctgccagtctacgatacacagttacagatagactattatcgcgaggtgcgcgacaaccgcctgctgtttggtgggcagggcactggcaactcctggtcatcgcgtgatgtgaacaactatttgcttgatcgtatcagaaccgtgttcccacatctggaaaaacccgaattggaatactcgtggggcgggatcagcgatctgaccctgaacggtgccaccgatgcccgtaaaagcggtgacagcgtcccagtatatatggtgcatggctggagcggtcatggagtggcgcagacggttcgtattggcaaagccatcagcgacgatctcaccgaacgcaatcacgactttgccatgcttactcgcatcgaacactcgagtattccgctgggttcccatttctctccggtggctatcccattgattaaaggcgctctaggagtgataaacacagtgaatccggcagatatggtttcgttctgatgcagcgcggctgcaaaagtctggagtggtttttaatcattcaaaataagttattcgtaaattgagagtttcgatggctctgtgcagagacaataaatgtcagtttcactcgacgaaatcgactgcgctgagccagcaggaaaataacaaactgtgttgaccatctgggaaagcctttatagtacgattagtactatttttcccgttttctgaggcaacccctagatacaaaaaaggcggaaaaaatcccacctcaatggtagggattcatgatacttgttttgctagttcgtaattgagcatcacaacaccaagaggttgccagtacctaaccaatccagacgtttttacgatgaaaaatagtttctttgtgaaagaatttattatcatccttaactgttattaggcaagctaattaacaatcgatcattcgatatgataagaactctgtttgaaagaaagtcatcgcctaacaggccatcaaaatctatccgttcatctggaatctgaaagataaacgcagagagcttaacgccgtcaggcgtcacaatggctttcttcgggcagtgctgcgataacttagcacacccctcctttgagcgagtgaaaatcattgtatggcttgcgccagtatcaataaccatacgacgtatcttctcattacccgatgacacactgatttctatcccgttccttgtgcgggtaaacgggatagattgccagcggtagccatcaggaagcgctttaagatggtcggttatcgtcagcacttttgaagcgtagttgataataagcgttttgtttttggcgacacccagccctagcactccatctatgatcagttgtccgttgtcgtctaacatgccgttaccccacgttttgaaaatttcaacgttaacatctgaaaggtgttcaccattaacagtaatattggctgctcttgccattacagcagacttctcaactccaaaaacatcaatggaattttgcacagctgttgtgcgatggtttagctctggaaaaatcgaatcaaagacagtttgagggagataaaaggcaccggatgccccagtatcaattgaaagcttattaacttctttaccattgatattgagcgaaatagaaggagttacatgctcaaggtaaacaatcggcgcagtaatatctgcctttactgcttcaactggaatcactgtaagacacagcgccacgcatacattcaggattctattcatattcagcgatccgttaaggtcagtggataatatttagtgctaactcgtttcccatattaaaacatagcgatgaaaggcttagactacaatgctgtttattttgaaattacttataattgattgatgttagatataatcgacatgtaagacactattttcgttgattttttgtttgttatgttacttgccgctcttatttaaggggttctgtcgcattaaggtgaggtcaggtaatattctgtcttttactctgtaagctgagcatatctttaatacgaaaagtgttcaaacgtctgcattacctgatgaccgcttaatgcgacagaaccaatcatctgcacatcgagtgttaagccctgtcaattggtgcagtcgccttctgaaaatgtagtgttataacaatagcatatctcaaatatagtttttactcaaagagtcggttcaatcgctgaatagctgtatctattgttgagcgggagcacgcaaaattgattctggcaaatccggcataatctgcaccaaattttattccatcatccaaccataaatgagcacggttaagtaactcatgttgcaaattttctggtgcaatgccactgtttctgaaatccatccaaccaagataaagagcatctgcatcgaaaagtctaactttagaaagttgcccaagacattgttgtaataacatccgattgtcacgtaaatatctcaataactcagccaaccatgatgccccataacgataggctgcttcacaggcaacgagtcctaatctattggggatgtgtaatgaacaacatgtataagtgtgttttagttttttgcggatttttttattggcaataaacaaattagaagtctgtaatcctgccatattgaatgttttactaggggacgtacaagtaatacaggtatcagaaaattcatcacagatgttagcaaaaggcaaataatttttatctgtagaaaggatcaagtcttgatgtatttcatcagagatgatcattatgccatgccgtaaacaaatatcccccattgcggttaattcatctttattccatacgtatccagttgggttatgaggattacataaaaaaaacagcttcgtgttgggggtaatggctgcctcaaatacatcaagatccagtgtgtatcccaattctttttcaactaatggtgctgttactatccgccttccattcaataaggcacactgataaaaggggctgtaaatcggtggttgaattaaaatttcatctcccaattgagtaaaagtttgaataattaaactcaagctgttcacaacacccggactctgtatgatccattcttcttttactggccagcgatggtgctgcaattgccattgcataatagcctcaaaaagactgtcacttgctttgctataaccaaaaactccttggtttatagagttatggagcgcatttcgcacttcaataggacattgaaaatccatatcagcaatccataacgggagaggtgcttcatctgtattggatggcaaataaggtgacggatattcccatttgagtagatgagatttagaaaaatcaatcacatcatcgaaatcgtaagtcatataagatcccgctattatgccaatttaaggaaaaatgctttaaaaaaatcataaattatcattgagagctcttaggattattaatccgatatatatatatcaccgccaaaatcgcagaggctaacagaaaatacgtaattatcattgataaccaatcactactccaatacctcataacaatccaggcaattaatgatgaaaatgacatttgtattgtcgcgattaatgcagaagctcgtccagataaatgactaaatggagataaagcaatagttgtcccagtaccaagcaatatggcaaatcccaaacttcccaatgtagctgaaataagatacgaccaaactgatatttttaaaagataaatggtcaagacaaaaccaatcatagccaacaataataatagagccccaccatacaacatggcgatatcttttcctcgccctaataatcgagcagttagcaagctgccaacagtgatggcaattgcattaatagcaaaataataaccaaaccggtcaactgggatatttagggtttcaataagaactacgggggagcttgaaaagaagatcaattgagtggcgaatccaaagctactcgtcaaacatccaagtaaaaatttagggtgacgcaatacctctaaatatcctgaaaatatctttaccaacaaaagagaagtatttctatgccttttcggtaatggtttccataaggcaagaagacaacataataacccgaccccccccaagacataaaagtcagatcgccagccataatgtacagctagttttcctcctatcattggggccagtataggcaccagactgatcactccattaagcatgctaaatacttttcctacttctgcccccttgaagcgaataggaacactagcgaaaatagcaacatacatagctcctgcaccacacccctgaatcaagcgcaatactatgagcaaaggaaaactatgaataaaatacacattaatacttcctaacacataaaaagccccccgcatagcaacacacgttgagagccgaactgatcgaccatcggcccgaaaaacagctgactgaagctcaaacacagtataaatccactaatcaaccattgattcatctcaggtaaactgcctaattcacgagatatcatcggtatactaggcaaacagatatccaatcctaagggggcagcaattaccagcggaatcaaccagacaaactgcattacaatactgtttttctttaccatcaataaatctgctcttctgttttaggaacattttgtttaatgtgaaaacaacgattaatcagaggatttaaccgatgatattgatgggatatggactgataaattgctgatgtcaatgtagatccaatttcatgtttactaaaatcagaaaccatattcgacgcagcaatttcacctcttatccctgagatgaattcgtaaaacgctttgcctttagcttttccttttattccttttcgtccaccttctattgcaataatgtcatcaatattgaaaacttcaatatgttcccccccaagcattttatggttgcgaaaaatatagatttctagatgttctttcgtccctatacgataatttgcaactggaggctcatttgatttatatgaatgaaagtgaatggattgaaatgggccttgctgaaaaacatgagactcatgagcaacgcgcccattacctttataaagatcccggccagcggccgttacccaatttcgctgtgaatatccattgtgacacaaatttatcgaagcagtagtaattattttatcgccatgtttaaaggaaacattactgcaacaatcgatttcaccaaaagcacctaagagagaatccaattggctttcatcatagtgattagccttatcaaaggtatgctgaccaaataattttcggtaatcatttaaactaaactggctgagaacatccttaggacggactgctgtcgcaaaaacgtcaatattgtcgtattgtttttcttcactaatagcagattctaatacaaaggggataatatcaaagtaatgataaccactatgtgaacacttcccataaccttgattataaggatgataatgttgttctataatttccgttggcatacgccattgcccatcagaatgaaaagtttgtacatttgtgactgggcaatttgtcataaaaaaacattctgaaagatatttttttatgatatcaaaggatgtttgatatctacgttgagccattaaagaaaaaacttgatatggattttcacattgttttttctgatacagagaattaagaagatgatagtcttctgcaatttttattgatttgtcaatggatgttgaaatatcttcataagaagatattggtttatccatcaaaatagataacccagagttcagagcccattttgcatattcaatatgggctagaggttcagttgcaataataacaccattaatagcgtgtttttcacaatttcattcaatactatttgaacatccaaacttaattcatcttgattattattaacattatttaaataagttacttctggctgcaacattttcccagataagtataattttatatttttcttttccgatatcaaatccacagctgcacataaatttaatttaggatcatccattgcatcttccagtaatggataatatattctcttgctatgtggaccaaagccaatcaataacagattgaccgtatgattactatttagcataaataactcatttaaatatttttattaaataatgtgtttttttctaagcaataattaccaatgaatagtgcatccatgcctattgattgtctaaaacaattaatcgcatcaactggggactctacaataggcattcctgctaaattaaaactggtattgagtactactggtatacccgttattttatccaattctttaataaggttataaaatttttgattcgaagtagcagagacagtttgtaatctcgctgttccatctacatggatacaagcaggtatatcaagtcttgcttgtgctttcacaggagctactttcatcatataaggcacgggagacaacatgttgaaataaatatccgccttttcctctaaaaccacaggagcataaggtctgaaccattcacgtaatttaatctgactattgagtatttcttttgtccaactgttagatgcagaagcaaggatgctacgattacctaaagctctggggccatattcactacgatcctgaaaccagcctattattttaccattagcaatcatccgtgcagcttgatattcagggtcatttactttttgaatgacaaattcatttttataagagaaaatactttctaaaatttcatcttctgaataaacaggacctaaataaggtgaagaattaaatttagatatttttttatcttgcttccaaaaatactccgctgcggccccaagagctaatccagcatcaccaggtgaaggaggaacataaacattgatattcaattcttcttctaatttacggttcatcacagaattcattgccacaccgccagtaacacatactgtatcgatatgatatttattgattaattcttttactcgattgataattgatttttgtagttgatcctgagcccatgccgcgaggtgcatatcaaagggacgaataacgccggctttatgacgcctttcaggaatatggactccttgttttctgaaccaattttgaatgtcttttgtacaatcataaacatagttctcatcttttaattcagacacaacaccagttttcgtctcagtaaatgccggataacatgaaaaaacggcaggatcaccaaatgaagccagtcccattgtttttcctgactcacgatagctgtcaaatcctagataacaagtcacatcaccataaaaccgaccatatccctgatcgcaaggttgtgtattgtcctgagcaagcaatttcaagtcgttattttcatacaaataataactgacctgttcagctgaattattttccaaaactttcgtatcagttatttcaccaataatattgccggtatgatcagcgacaacaaccaatgcacgcttaacatcagtttggcaaacagcgctcatagcatgggctacatgatgagatttcacaatatgaattttttcgaatccgagaaataaactatcaagatattttttaagattattggccatcgcacctgaggaggtcataggttgcccgaaactaactacagaaattgcggagagatcatctaatgtcaatttgtttctgtataaaatttcttttactgcattagtcacttgtccatcatactttttctttgaaactcgttcttcagcaatcgccataataacctgatttctatcagctaatacgacatttccatcataagtcaccgacccatcgaccaaaataggtatattaattgctaatactatttctttcatgataatttctctattctaactgtttttaatgttttttactcttaataaaaacattaatggaatcgagatggtgttatgttcaaaacaccaccatccttcttcattttcaaatagctgtgagaacgctttgtagaaacttttatcaaattctttaaatttcattaattgcatatcttcgtttattaaacttgttattatctcagataggctatggaaataaacgtattgctcttgattctttaatagaacatccctgtttgcataagaatatttataattagccttaatcggatcaccggatagatgatggaaggaaataaatgagttattgaacgatgtattgtcctggctaggattgctgagcatacgagcaaaaggatgatcatcaataataataaattcaccaccagattttaaatgcgaggatattgttttagcccacaaatttaaatgctgaatccaaatgataactccataagaggtaaaaataaaatcaaactcccctaaattaagagaagataaatcataaacgttagcacaataaaattttgtttttaaaccaaattttcttttaatgcattttgcagtatcaatggctacagaagaataatcaattgctgttacatttgcacctaacatttcaatagcaaaactatctaacccaatatgacattgtaaatgaaggactttttttcctgttaaatttcctaattcagatatctcaatgctttttaatttatatttttgtggatcataactatcaatgttgtaatcagatttatcaaaatgaatttttgctaattcatcccaaaattggatgtttttaccatcataaaaatttttaaacatataattttattttgcttttgcaaaactccctcatatataagctataaacacataattgagtctgatgcagactattaaaaataaattttatttttaatttcattcataactgaataccacctcctgcggaggtggtcagcaacagatgggctcagccaataaggctactcatgggaaaatccgaactgttatccccataacagagaaggatttaaccatgagtagattcaagaaagcatcgcatgtactttggtgttgtcaatatcatatcgtctggacgcccaaataccgatttagaatactgaaaaataatgtaggaagggaggtctataagcagatacggatttcatgtgaacaactcgagatagaaattgtagaattgaatgttcaactcgatcatgttcatcttttggtaaaaatacccccgaaattatctgtatctcaggtgcttgggcatttaaaaggacgaacagccattcgattatttaataaatttccctatttaagaaagaaaaagttatggggaaatcacttttggtcgagagggtactgtgtagataccgtaggtgtaaatgaagaaatgataaggaagtatgtgaagtatcaggaaaaacatgaacatgaagacaatcaattatcgttaaaagggatgtgaagtgaaggctctcagagtctgaactagtaacgcccctctggggcgaaatcaaagccgccttctatgaaggcggatttttactttaataaacgtgttaccgatagcttgtttctttatcatgggctgcataatacaatgcaatattcaatatttgttcaacaaaaaggattacccagttgctgtaaaacataaaaaatatgtattgttataataaaattggctttcatattgaaaatccggttatgtattaaatagttaattgctatgattaactcttgactttttcgtggtgaaacgtggcgacagaaccggaagcctcatgataaggcttccggttcgctgacctaacaagtcattgtagaggcttgcaatcaagccgttatttcagaagcttttcgtcatctttaagcctgataagtgtttgtacgaaaggaattctcctcttaagcagagtacagatttttttggcaggcagtggtttatccaaaacatgaaacccatccagtttttgataataggttttatctttcacaccgagaatcagttcatttcttccttggatcatcacctgtctgtcatgtacattatgatcatcacctaagtgccacagtcatcttcagaagacgattgcacggaatgtcagaagtcatatgcacactaggcttttggtcctgtcaattggtacagtcgtcttctgaaaatgacactatgcaagccttacgggctaactttattgtttctacacaacacaacagcgcctgtgcacaagcccacgcggaactccacgcccattggaagttatatccccccagccagccggtcacatcgacaacctcaccaataaaatacagccccttcaccttatgagactccattgtttttgacgacagctcattcgtatccacgccacccatcgtcacttccgctgtacgatatccctcagtgccattcggctgtacctgccagcattgcagggtagcgatcagttcctttttctgagcaggattaagctgctttagggaaacatccggcaattgctcaagagactgcaaacattccaccaaacgtttaggcagcaatttagccaatgtgttctttagactctgattaggatgggattcccgctctttatccaaaaacgcatccagatccatatcagggagtaagttaatactcacatactcaccgggttgccaataactggaaatctgcaaaatagcggggccggaaagtccgcgatgagtaaacaggatattttctctgaatactgtgccgtcctttgcggtaacaattgaaggaaccgcaacacctgagagtgtttgtagttgttccaataacggtttatgcagggtaaaaggaaccagtgctgcatgggtaggcaagatattgaggccgaattgttccgcaatgcgataacccaaaggagacgcgcccaatccaggcatggacaggccaccagatgctacaacaagtgagtgtgtgcttacttttttccctgccgtcgtaatcacaaaaccctgctcgtctttttcgacttgtgtcacttcgctgcgtaaccggacagtcacctgacctgcctcacactctttcaaaagcaagtcgataatctgttgagcagagtcatcacagaaaagttgacctaaggctttctcgtgataggcgatcccgtgtcgttgaacgaggccaataaaatcccattgggtatagcgagcgagtgctgacttacaaaaatgcggattggcagaaagatacgcggcaggttcagtgtacatattggtgaaattacagcgtccgccaccggacatcaaaattttgcgacctgcttttttgccgttatccagaaccagagcgtttaaccccccttgccctgcctgagccgcacaaaacaaaccggccgcgccagcaccaataatcactacatcaaatttttccattcgtttgtctcttttggccgagttattttgcaggaaatgtactttatcgtggggaactgtccgcgaactacggagaaaaagatatatttggtttaactttttatcgtaaaaagttattttttgtcaaaaaaatatcaaaatattaaatttgaataacaacttgatataattgataaaaataacaggttgactgtcatttcattgtcattaaatcgaaaaaaggtcatatttctcttttcccgctcgcatttgtcactgataatgcgccgcgttcatgtcctactaactggcttaacgtttatgctacatctgtttactggcctggatttttataccagcctaatgttagtacttgctctgttgtttgtgcttttctatgaagccatcaatgggtttcatgataccgcaaatgcagtagcaactgttatttatacccgcgcgatgcgttcgcagtttgccgttgtcatggcaggggtttttaactttttgggtgttctccttggtgggttaagtgtcgcttatgcgattgtgcatctattgcctacagatcttctgttaaatgtcagttctactcacggcttggcgatggttttctccatgctgctggcggcaattatctggaatttgggcacatggtatttcggcattccggcatccagctcccatacgttgattggttccattatcggcatcggtctgaccaatgcgatcgtgaccgattcttcggtagttgatgcgctgaatatcaccaagatgatacagattttcatgtccttgatcctgtctcctatcgttggtttggcgatcgctggagcgatggtatttttactgcgccgttactggagtggtactaaaaaacgtcgtcgtatccatatgacgcctgctgaacgtgaaaaacaggatggtaaacgtaaacctccattctggacacggactgcgctgattctttctgctgtaggagttagcttctcccacggtgcaaatgacgggcagaagggtatcggcttgatcatgcttgtgctgataggtgtcgcgcctgccggcttcgtggtcaatatgaactcaacgagctatgacattacccgtacccatgatgcagttgcctctttgcaaaagtattatgtgcagcacggcccggcactttcccatgctattgagctgaccccggccgcttcttcagtagaagttccggtggatcagatgctccattgcgataacgcacaagcgcagaatgtgctgaatacggctgctgtgatgctgggaagtattcagaacttcagtgagttgaccccagaccaacgtaacaatatgcgccgtatgttgatgtgcgctgctgatacggcgggtgctgtggctaaactgtctgaaaccagtcttgaagatgcccgtttcctgaataaactacgcaaggatttgctgaataccgttgagtatgccccgatgtggatcatcattgctgtggcactcgccttgtctctgggcacaatggtaggatggaaacgtgttgctgttaccatcggtgaaaaaattggcaaaaaaggcatgacctatgctcaaggtgtttctgctcaggtcacggctgccgtttccatcggggttgccagttatacgggtatgccagtgtccacgacgcaggtactctcttctgcggtagcaggtacgatgctggttgatggtggtggtgttcaaagcaagactattaagaacatcatgctggcgtgggtactaacgttacctatttcaattggattatcaggcatcttgtactggattgccctgcaactgatctaatgatgttttagaaaaagggttagcgactgtattccagtaagctaaccctttttattcccttcttgttactttcaggcccacttcaaattgccatggctatcagacatagcacaacagctccacataacattcccgtcaataaaaattgcttccgtaacctttcgtagataaagatgacattggtgtcgtgatgggtgagataaccttgtgaattgatatagtgtaccagccgaatatgtttattgaattgaccgtgggttgtaaaaaaaccattaccatcaacggattgatatagcatcggatctgattggcgcaagattgacaacaatacgcggagcgaagataagcagcggatcacgttaacaataccgacaaggctaactgcccagaagaatgcaataatattgaacatacttcccctcccttaatcttgttgtgatgttcaaatgagatatccatattttcatatagttaagaaaataaaatgataagttgtgatcaaaacaacactaaaaagatatattgagcagttatagtataaaacatcaaatcgtggcgttttagtgttgccaatccatttaatcagcattatggaaggagttcacttatggcttacaaacatattcttattgcggttgatttatctccagaaagtcagattttggtagaaaaagctgtttcaatggcgaaaccgtacaatgccaaagtttccttgatccatgttgatgttaactactccgatctttataccggtctgattgatgtgaatcttggcgatatgcagcagcgtatcgcggatgaaactcgcaatgctctgaaagatctgtctgtcaatgcagactatgagatccaggaaacattgagtggttgcggtgacttagggcaggttcttgttgatgctatcaagcaatacgatatggatttggtcgtgtgtggtcatcatcaggatttttggagcaagttgatgtcatcagcccgtcagctcattaacaccgttcatgttgatatgctgatcgtgcctttgcgtgatgaagaataatctacggttgaaattttattctataaaatcgccggcttatgcaggcgatttttttgtctgaagaaaagatgatgagactgttttggaaattgtcaaaactatttttaaggaaacttataaaaatagttgttgaaatttaagcgtaagaaagtggtatattcagaaagcaaaccacaattacctcacattttcgacaaaaaaataatatggaaaatggctgggggacatcacctctgaatgacaaaaggaagccctaaatgaatatttcaccctctttggtctcatttcttgattcgattcagtctcacaacccacatcaaccggaatatttgcaggcagtgcgggaagtgttgacatcactctggccttttcttcaacaaaatccgcaatatcgtgagcaaagcctattggaacgtctgatagaaccggaaagagttatccagttccgtgtctgttgggtcgatgatcagggtaaagtacaggtcaaccgtgcatggcgggtacagttcaattctgccattgggccatttaagggagggatgcgttttcacccttctgttaacctttctatcctgaaattccttggttttgaacagaccttgaaaaatgcgttgacgacactgccaatgggcggcgcaaaagggggttctgatttcgatcccaaaggtaaaagccacggggaagtgatgcgtttctgtcaggcattgatgacagaactttatcgccatctggggccagataccgatgttcctgccggagatattggcgtgggaggccgagaagtggcctttatggcaggtatgatgaaaaaactgtccaacaatacggcatgtgttttcaccggtaaagaactctcttttggtggcagcctgatccgccctgaagccacaggttacggtctggtttatttcacccatgagatgctcaaacgccacggcatggggctggaagggatgcgggtatcggtctctggcgcggggaatgttgcccaatataccatcgaaaaatgtatggaactgggggcgaaagtcgtcacagtatcggattcaggcggcactgtgctggatgaagaaggcttcacgccggagaaactggctcatctcgaagagattaaaaatcaacgctacggccgtgtggaagagtatgccaaagagcgcggattaaccttcctgaaaggccaggatccgtggtcaatacctgtcgatatcgcattgccttgcgctacccagaatgaattggatctggatgcggcgaagacgctgatcaaaaacggcgtgaaagtcgtcgcggaaggggcgaacatgcctgcgaccatttctgccactgacgctttccttgaagcaggcgtcttgtttgcaccgggcaaagcagccaatgcgggaggtgttgcaacgtccggtcttgaaatggctcagaacgcagctcgtctgagttggaaagcagagaaagttgatgtgcgcttacaccacattatgctcgatatccaccatgcctgcgtagaatatggcggggaaggcaagcagaccaactacgtacagggcgcgaacatcgctggctttgtcaaagtggctgatgcgatgctgtcgcaggggattttgtaattctcatgtaatcaatgatgtttcgcggataagccccatgtacaaacacggggcttgttttttgaatcgtagccgtatcgattagcagggataaatatcgaaacgatgattcttggtggtaatcgcagcggaagccttaacccctgccagcggttccgcataatcaggccgttttaccacaacccgccgttttgccagcgcacgggcgggctccagcaaaccgtccgcgtcttcatcggcgcctactaatgattggaaaacgcgcatctcttttttgaccagcgcgcttttttgccgatggggatacatgggatcgagataaacgacatcaggtggcggtgtaatatccgtcaaggccgtaatgcttgaggtgtggatcagcgtcatacgttctttcagccagctaccaatctcttcattctgatagccgcgctgtaagccgtcatccagcagtgctgctaccaccggatggcgttccagcattctgacctgacaaccgatggacgccagcacaaaggcatcgcgccccaatccagcggtagcatcgacaactgtgggcagataacctttcttgatgccgacagccttggcgacggcctcaccacggccacccccaaaacggcggcgatgtgccaacgtgccggcaacaaaatcgacataaataccgctcagctttggctcatcgagtttgtgcagttccagccgttcaggtgtcaagatcagcgccatgacggaatcttcatcatgaaccagattccagcgttcagccaattgagataaggcgctgttatcagcgccttgttcacagattaaacaaatcttcacaggttattatccactgataccagagcttttcagcattgcatccagtttcggctcgcgaccacggaagcgtacaaacagcgccattgggtcttctgaaccgccacgggtcaggatattatcgaggaaagactgcccggttgtgcgattgaaaattccctcttcggcaaagcgggaataagcgtccgcagccagaacatcggcccacatataactgtaatagccagccgcatagccaccgttaaaaatatggctgaaggtgttggggaagcgtccccattccggtgatggcacaactgcgacctgttttttcactgactgcaaggttggcaggatttgcgcaccttttgccgggtcatattcagcgtgcaggcggaaatcaaacagaccgaattccaactggcgcaggatggccatcgctgcctgataatttttggcggccagcatattatccaacatctctttcggcagaggttctttcgtttcatagtggccggagataaacgccagtgcttctggctcccagcaccagttctccataaactggcttggcatttcaacggcatcccacggtacaccgttgatacccgcaacatctaacgtttcaacctgggtcagcatatggtgcaggccatgaccaaattcatggaacagcgttgtcacttcattgtgagtaaacagtgcgggctgatcgccaaccggcttattgaagttacaggtcagataagcgacaggcgtctgtaattcgccggaagtatgacgcattctgccgacataactgttcatccatgcgccaccccgcttatgctcacgggcatagagatccagatagaaactaccgagcaatgtctgtttttcatcatacagttcaaagaaacgaacatcaggatgccatgtttctacatcgcggcgctctttagcggtaatcgcataaatgcggcgtataacttcaaacagaccttcaatggcacgttgttcagggaaataagggcgaagttgctcatcgctgatagagaaatcatgttgtttctgcttttcactataataggccagatcccacgcttccagctcatcgacccaatagtgtgattcggcaaaatcagtgagttcttccagttctctttcgccttgaccgtgggcgcggttggccagatcgttcaggaaatcgagtacttgcttaggtgttttagccattttggtggctagagagttttcagcatagtttttgaaacccagcaatagtgcgagctcatggcgcagtgcgagaatttccgtcatgacggcactgttatcccactgaccggcatttggcccttgctcagaagcgcgggtcgtataggcgtaatacatttcctggcgcagttcactgtcatcggcataggtcatgaccggcagatagcttggcccattcagtgtcagcaaccagccctctaaccctttagcttcggcagcggctttggcggcggctttggcactgtcaggcataccctccagatcgcactcatcagtgatcagcttggtccatcccatcgtggcatccagcaaattattgccgaactgagagccaagctcagataaacgggcggaaatctcaccgtagcgtttctgtttttccttcggcagaccaatgccagacaactcaaaatcacgcagcgtattttcgatagctttacgctgtggctgagatagtgctttaaaggcttcgctctctttcagagccttataagcctgatataatccttcgtgctgccccatccaagtttcgaactcagaaatcaggggcaggctttgttcataggcttcgcgaagttctgggctatttttgaccgcattgagatgatcaacaggagaccacacgcgggaaagatgatctttcgcttcagaaattggctggcacagattatcccaagtaaatgtgacatttccggccagaactttctcaatcacttgacggtagttggctaacgtctctttcacggctggcacgacatgttttggctcaatggcagcgaatttgggcaatacagaaggagtcagtaacgggttagtcatagtgagcgccttagttgtatgtttgggtatataaaccgctatatcccaatgggttgttgtcgataagatggggataagatacagcgagttcaatgctgatgccgcacttttatgcggataatcggggtctttttatatcagagatctgtgagatgacgaatgagtttagatgtttcgtgggacgcgctataatccctgctcttcatcgttttccttatggaagatcatcgcccccggtggggcggctgggcttcaaatccagatggagccgccagcggctcccggcaggttcaactcctgtgatcttccgccactttttgtctattactgtctttttacttcagcaaaataattcaatttattgacagggtgttttttgtatttcagtggaattttcttgtaatctgaacataggagattctctgtgaaaaaattacgctttgtcatcatgaagttgctgtcactatattgaacaacctacagcaaaaatgaacatcgggtaggttgactacgttcatttctgggcattaatatttggcccgatatatttttcaactgcaccaataagtatagtatgcagggggaaatcatttataaaatccaatattttttaaattagttaaatatagcttatttaaatagaatatttttacattattatttatttatgctgttttctttattttttatatcgttagtgttttgataattgccatgaataggatgatttttgagtgtaataagatcgctttatatattaattacttaaatttatattatattatattatattatattgttattgttggtttaattggataaggggaaggatgagtttataccttcgtctttcaagtttctgcttttctggctacaacttgaaagacgaaggggatgattatatcggtttctggattgagtgataaagtgtatcaagctggttaatacgccggtgataactttgtagcaggcatgttttatcgcctttgcacttctggcgttgctttagccaagccttttggctgtcatgcatctcacccgatatgcccatagcaaataaccctcgtaggaaatgatatttgacgctcatttctatatccagatcattaagccgatgatcagtacagattgctttctcatctggcgctttggcttttgcacaatcaaaactggcggccagactaaggggagacagaataagcagcataagtaatgtatatttcatctactgcccttttttaggaaggatcacaggccctggcccagtctgtaattgcggtggcaatgcttttaacagtttgaatgacagcgctttgcctgttttagagtccagttcgcaggagaatctaatatttttccagccaatgccgttgcgatacatccccgtacctatgagccgggaatcaatcaatcttatactgtttggtgattcatcaccgagaaacactttgtcagcctctttgtgctcccgttgaataacagagagcgctaaaggcctgcaaataaactcggctacttttttagtatctgaccagtcttctacctctttggccgctgatttatctgtcatttgtttatctatttgctgttgcaggtatttttgttggcttgtagacaattggtatgatggcgattgtgcttgtacgaatgcggaaaagagaaggaaaccggcaccaaaataattcaaacattttaagtaagacatagcatattacctcccagtttgagattagaaaagtatggcacaggttttgtagccgtgccattgcctgaattttttccagagaattctcatgcgcataattaattaatattaacagagcattctggtcaatattgcaatgaataatgatgtgaatttacctcgtcctattcggacgaggttttatttttggtcgattaataatgaataaataaaattattgagcagcaatcaagtatattgattcataaggtttaatagatatctctttttccattgaggaaggcgatggataattacttattaatacctgccattctttatctgtgagagaagattctggagaccatagctggttttcatcacttaaatttgcgataactaacatgacctgattctgccagcgacgcagataacaccaaagcgaaggatggtcgggtaacagatccagataatcaccgtaggtcagtatgggttgttgtttccgcaacttaattaattcgtggtaacaatagaagacggaatctttatcctgcaatgcagcttcggcattgagctctggataattatcgcaaggtgctatccacggtgtgccagaggtaaagccggcactggctgaagcatcccactgcattggcgtccggccgttatcgcgggatttctgcgccagaattgccagtatctcctctggtgccatgttttgctcaatgcgttcctgatacatattcaggctttcaatatcccgatactcttcgatacgctcaaagtggggattcgtcatacccagctcttcgccttgatagatatacggcgtaccctgcataccgtgcagcaccattgccagcattttggctgacgtcctgtggtgttggtgttcatccccaaatcgggaaactatgcgaggctgatcatgattgcaccagaaaagcgcgttccatgccttttgatgcataccctgttgccaggttgagaaaatctttttcaaggcaatatagtcaggcttggcgagtgtccatttttcaccattaggataatcgactttcaaatgatgaaaattaaacgtcatggacagcgcactgctatccaaagcgctgtaacggaggcagtgctcaagcgctgtggaagacatctcacccacggtcatcaagcccttgggctggaacacatcacggctcatttcttgtagaaattcatgaatacgcgggccatcggtatagaaacggcggccatctccgtgatcgtcactcggataatcctgctgttttgagacgagattaaccacatccagccgcaagccatcaacaccacggtctgcccagaactcacagatttttttcagctcggcgcggacgggttcatgttcccagttcaaatcagcctgttttaccgcaaacagatggaggtaatattgctggctttcagcatgccactgccacgcattcccgccaaacttggatttccagttattgggcagggaatcgctggagccttcgcgccagatataaaactggcgataagggctattgatatcctgtgcagcctgaaaccacggatgttcggttgaagtgtggttaaagaccatatccaaaataatgcggatgccacggcgatgggcattttccactaaattgtcaaagtcttccattgagccataatcgggattaatggcgcagtaatcggcaacatcatagccattatcaacttgtggagacggataaaacggcgtgatccagatagcctcaacaccgaggtgctgtagataatccagccgttgggtgatcccattgatatcacctgtaccgcttccggtactgtcctgaaaacttttcggataaatctggtagataacgctatctaaccaccaaggttgctgttcagtcataaaaatatctctaaggaattaatgcgttagctcatttctgcgatagaccagtacggtaagcagcataggcacgacaatggcgatgatcatggcaataaggtagaccatccagaactgcggcttgatagagagaatacctgggatcccaccaacaccaatgccattagccgtcacatgattaaggccacataccagcccggccagacccgctccaatcatcgcgcagaacatcgggtaacggtatttcaggttgataccatacatggcgggttcggtaacgccgagataggctgaaatggctgccggaatcgaaacctcgcgttctttctgctttttgcttgcccagataatgccggcaacggcagagccttgggcgatattggataacgcaatgataggccagatgggggttccgcccgtgctctggatcatttgcagatcgattgctaatgtggtttggtgtacgcccgtaataaccagtggtgcgtagaaaaagccgaacagggctgcaccgataggagcgaaacttccagtcatcagactcttgacgacccaagcgaccccatcaccgattgcgcgtcccaccgggccgatcagcgcatgggcaaggaagaccgccagcagcagcgaaacaacggggacaattaccagataaagataatccggcacccattttttcagccgagtttcaatccatcccaacgttaaacccgccaatagagaaggaatgacttgcgcctgatagccgactttggaaatggcaaaccagccgaaatcccagacttccggtgtttgctgcccaagcaggtaagcattcatcaactgtggtgaaaccagcgtaatgcccaaaacaatacctaatactggggttccgcccatttttttaacggcagaccagcagatacctacagggaggtagaagaatatagcttcaccgatcaaccagagaaaaccatggatggtttgccagataggatatagctgggcgagtgttttgccttcactgaaagggatatccccaatgatgttacggaagcctaatattaacccaccgctgattaaggctggcagcagagggaaaaagatctcagcaaaatgtgaaattgcattttcataccatttcatattttgtcgggctacctgtttaacttcttctttattaacggattgtttccccgtattttcaagcagagctttataataaatgtctacattggttccaataaccacctgaaattgcccggcattggtaaaacacccttttaccatggatagctcttcgatggccttggcatcggcattttctggtgaatggagaacgaatctgaggcgggtaatacaatggctgacagaagcaatattctcttttccaccaatcaaagtaataagtttttcaagatccttctgatttacttgatttttcttcatgcctttctccttagtatggcaggagtaataagtaactgagttttgctattaacagaatgattactctcgtgatgagataattcaaagactgaagtaatggctgatttatcctagtcagatttcaggtttttgaatatgaaaagatgttttgtttgagttttggatcacattttattctattggtttgaaactaaaaggctttttatatttgttttattgattatttaatggaatctaatttctttagtaactaatagatcttgtatatgagttttgttggtttgttgtgtgttttcaaccaatgaaggggggagataaaagaaaaaagacaattatctaatcaaatagaggtaattctggtgttttttgattagctgattcaggataacgatattttcgttaatactttataagtaagagatatggataagtgtgttttcagtagtcatatctataattccaactaatattcatactactgacaataacggtgtcacagcagtcagcggtatcacccgctctgagcttaaccattttcttaaatatcaaatggtaacataaactaacttttaggatatcgcctttatggaatttcttcctagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctagctatgatgaatttctgatattgataaatatgacggcaaaattggaagataatatcaatcttttttatattaatatttacccaaatagaaatgacttacattaataagttaatttatattagaatcaagaataaaaaaatataacgttttatttacaattaattacaatcgaaatcagaatagagactataattattaatgtcagatttatttcatcgtatgtcaattattaccatttaaattgttgggaaataggaaatctgtaattagttaattaaatttagcttaattgcttatgtcattaataataaaataaaaattaaaggataagactatgaacagcacaaatgaaataaatatatcatttccacataaaaaaacattagaggccatcctgtttttatctgcttttttattattttcatttactcaacctgtctattctatagaaatgaaagctgccccaaaagactctcagccacaattgttcaggagaagaccaaaaattaaaattctatttgcattctctatagaagccgctgaaaagcttggatatgtgtatggtagtgagctgaaagataagaaagcaatagagcaaatgaatgaggttgcagatttaatgatatcagttggcaaccgatcattcagaaattcctatatacattttgaactgggaagaacaaaggttattgcatcttatatctctgaaaagaatcttatgacccatgaacattatctggattttaatatgactggtatgttaaagcagcttcctggtacccggaataaaaacgacaaaaaaattatttataggtttaaagaattttatttactcgaacaatctcgtattgctctgaaagcagatgtggttgtattgatcataactgcaaaatatcatttcaataaaaatgagtgtggaagctcatttgatggcaaaaagggaattaatagagatactgcgtatatggtggtcagactcccttgtatgattaacaaggaaaacctcgatttcaactatcacttagggcatttgataggtgcaagcgatagcgtgaatagtggtggtattagtaaagaagatgaatttttttatgggcatggttacatacaaaataagcataaaccttattggcgaaccattatgactcgagctgaggactgcccaagttgtactgtgattaattattggtcaaaccctctggctgaagttaatgagatacctacgggaatatacagaactaataataatgcgttgctatggagagtgcatggtcgcaaactcgtaagagtctatgaggagttttataaaaataaggggaaatcgccagttctattactgcagcgcccagttaaaaacaattatatatctactcaaaattagattattcatattatattttaagattaacgaagacgtcatacgacgaatgatgagtgtaaattgattctatattttgtttttattgaaatattattttaaggaataatgatatgggtaacaataatgaaaaaacagaattagtgaataaagacaagggcatatactcaaaagttatttcaatagatgtcggtgatattaatggaggtggaggtggaggtgcggatattaaccctataatttgcgttaaaaatattaacaatgatgtgattgattattataaactagcatttcctgaagaagagataaatggagccgcaacatactcagtaatattggcagctttttcctatgacatgccaataatattgaaattcattgggtctgaacgcattgccggtgttattatcgataccgatatcggtgataaataaggtcagtagtaaatggaataaagaaatatttacatgataagaaaccaatttttataaaaaacaaaattaaatttacttaaaaatatttaatttatgactaggtgatttctgaattctgtttgttttttgatttataaataattattttgaggaataataccatgaacgaaaatgataaatcagaaaaaaaattaatcttagtgaggccggctagtgatttattagttaaagacgtaataattgtttcgttggaaactaacattgcaggtaacaatgttaatgtgtcatttaaatatttaaaaaatccaaacattttcaccaatttttttcttaattatcctaattataaaatgggtggaggaggtatattcgcaacgttactgtcagctttaatcaatcaatttactgtaacattaaaactccttgattatccctatccggcagaaataatttatattacaggtattctcgttaaaggagtggatactccgccttaaactatatgctaattttaatctgtgattttttgcagttctactattaactgtttttgatgataaatagcaccctctgacatttggacacggacgtccataatatcctcagggtaagatctcgtattttaatttaatatggttattttggctgaaaacaaagcaggccttacttttatggaatcctctttttaccattcaaagatagacctctcctaaccttccaccttgttatctcagatgttccatattttcgcccctttcccatatagaatcgttaccatgttgtcggagaccgaaactgtaatccttttgataacaatcgtattttttgctcatagaatagtcacatttcctttcaagatactcttttttgttgtaataaccacttatctagttcatttgcgaactgctggcgatcacgttggtttaacgtagcaggccctcccgtgtggatcccactcgcccgcatcgtatccataaaatcacgcatagccaggcgttcacgtattgtcgcttcactataacgttcaccgcgcggattgagtgctattgcacctttttcgatcacttcagcagcaagaggaatatctgctgtaatcactaaatcaccgatttctgagcgacgaacaatttcattgtcagcgacatcaaacccagcagggacttgtaatgtacgtaaaaaagcggatgcaggtacacttaatcgttgatttgccacgaatgtaacctgtactttttcacgttctgctgcacgatataatacttcttttataaccttaggacatgcatcagcatctacccatataggcataacagattcctctcaatttcatatttttagctacatcgaggctatttaacacaggttcatgaaggtagttaaagtaatcataagttaaataccaatgaccgtgacgctcactcggtttctatgagttcaaactcttcaaagaccagttccatgttttcggaataggtgccttctctctcgaaaaaattttgatgctctttcctccagtacgaaagactcagatcgccttcaccctctttttttttccagataccacgaggcttgccagctcatcagctaattcaggtgagtcacccaattaccaactagaatctgatggatatttttgatatagctgttttaggggaagcataaattttctgtatgtaagttaatcgaaggggttaatttaccagaaatagtatcacaagataagttcgttggtcgccgactttttctgaccagcgaaacgggttaatgcgggtagtttcgccagcggcatctgtttcgggacggtaaggaacggtgatcacttgattcagagacaggcaggaatcatggaacattttttgctgctaaaaatagttgtttattttgatatttattcaaaataaatacaaatatataatatttattaaaggtattttttaattaataattagtgtgtcaatatcggtgtttttaaattatatatatctttatatcttttaaattcattgttacaagcataatttactcatattgaagaggctgccgtgacaggggcaattagcagccttctattatttctggtgatgtaatactgtgcatgcattacccagtattattttcctcccaatattaaccttcttatttctgatgcaatcgaatcaagctgtactgcggtcacgctgcggatatccgcctctacttttcccttattggcttggtattcccgcaagtagatcgccgtttttccctgccggagttgtgccagaatgtcgaaggtatttttgccaatcatctgttcgtcaaaagtgatctcagcacgggcgatatcgcgccctgcgctgtcccataccactttggccgacacgcctttgatgcggttcagtctgtcaataaaaggtgtcattcttgccaccatgtccgcgccagactcttttttgtcggtgatatagcgctcaatggccagtgtcaggccaagaatgccttctttgccgattttcatggcgcgcccgatgccgtaactttgccgcttgacccaattcacatagggctgtttgccgatcaccaacccactggtggggccttcaatcgctttggcaccgctgtaaatcaccagatcggctcccagctggtaatagagcgttaaatcttcctcggcggcggcatccactatcagggggagctggtgctcctgtgcaatgcgggcagcttcggctacggtcagcatgcttttctgtacggtatgatgtgatttgatatagagaatggcggcggtttggggcgtgattttggcggcgagctgtgttgcgctgcattcgttggcaaaacccgcttcaatgactttaccgccacccagcgtaatcatggtgtcaacaggagcgccgaagttgacgttatgccctctgggaagaatgatttcacgggggactggcttctctgaacgatgcagattaagcagcaaatcatcatcatctttgacaatcacggcagctatcgattgggcgatccctgctgaagcacaggagacaatgattgcgctgtctacgcccagcaatctggcgatgtaatcaccggttttatcgactaaatcggccatctcaaaataatgattcagcccagtagcgacctgctcaatcacatcagatcggggcgttgaaacgcccagtgcggtcatgcgtcccgccgcgttgatcactggccgcaattggtatttttcatagagagatttcatcgactgtgctcctttccacaaccacaatatgcgtacccgcaagaatggccgctattgggataaattgttgcgtgccaatcctgacctgtccttccgcatcgaacagttcaatgcgttgatttttcaattcaaaaatcgtgatatcgccatcaagaccccgctccagccgacctttgcgtggcagatgaagtaaatccgcagggttggcggttacgcagttaagaatttgttcgggcggaacgcccagggtgaggaatttggtcatcacgttggcgaggctataaaccggcccaccgacgcggtttttttggtaaatatcggaactgatcatatggggataggcgccgaaccttatggcttgttcagccacagtgaagctgaaactctctgtaccatgtcctacatccagaacaacgccgcgtgacagtgcctgctgaatggcaggtttcagattacctttatcatcgaggatacggttaggcttgccgttaaagcagtgggtaatgatatcgccttgggtcagcagatcggcaatttcctccagattgggcggtggattgccaatatgcaccatcagcggcaggccactggttttttgtctgagtttagaatagagagctttagcctggatgagcggttggaggccattttcacccaccacgcttttgctcatgcgggctttcagaccgatggcaaatccagcgtgacgtctgacagcatcttgcaggcgggaagcgtcgattttggttaagtctgccagttcgttctgactacgcatgcctgtgcgggcgatattcaggaaagcgtagacatgagtcttcaccctgcgcgccacggaatgaaaatggtcgatatcatccgctcctgcgctgcccgcatcgaccaccgtcgtgacaccactggctgccccaatcaaatcgggttcatcaaaatagagaggcgattgcggataacagtgagtgtgggcatcaatccagccggcactgacaaagtaatgaccatgaagatcaatatacctgatggctgataatcctgtcgccgccaaggggccaatggcggcaatccggccatcattgatcacgatatcaatgatagccccgttgatcagtttcccctgtttaatgattaagtcatacatgatacctgtccttttgctatgggcatgattacgctgtcacagggaaaaaatagccgagtatcatggcgcccaaaattgccccgcctgctaccggttttttccacacataaaacagcagtgcgccaatcagtgaaccaacgccaatcggaatagaagccgtcattgcagccagaataattaaggggccgaggaaacggccggaagcattgcctgcacccatcatgacatctgcgccaaaggtggagtttccctgtgcaacggtgaatttgcgggcgaggatgatcagcagaccaacgccaacgccgagtaacatgccagtgattagcgccgcccagaagtgggttatcagaaaatcaaacccgccggccagcagcagggcgggaacacccagaccaatcccggtttgcagggcgccaccgatatccaggatcccgaccagtgatccttcgacgatacgggcgaacaggaaactggcaccaaatgccgccaccgtgccataagcgccggtatcaatgccggcgcgcagcatggcgacgaaagccacttcattgaatgccccgaatccatacaccacatacatatgcgtaccggcgaaaatcccggctgacagcagaccgacaaacagcgggaatgaccattctgcgtaccagaaatcaggtttgttcagttcagtattcatgattatttacccctcatcagttgatggatatgttgcagccagcccggtgcatccagcatgaaagaggtcagcagtttaagatcgaattcacggaagaagccgctgagggcaaacagcaaaataacggcgatcagcatggtacgggtgattttattccaaccactgtcatccacgcccttaccgatcagaatgcctaataccagccccggaatggcgttgcccataatcagttgcgcgcagccgccgaacaacgtggcccagaaaccggatcggcggccggcatccattgcggccagccagaacaagacgggcatcacggtattgaccagtaaattggcggcaggcaccagcacgttggtggcagtggtctgcaaggcagcgggaacggcagaggccgtggtgttcaggaacgcgaccagcaatgccccgataatcccgcaggcgatggccatttttttcgggttgtgcagggtttctgcgacgttgcgatttttgatcatcaaggcggccgcgccccaattgggaatgatgcggtgatcgacatcttgtgtgaacgcccccgcagcaacggacgaggcccacgcattaaagaagaaaccgaggccgaaggagaagtgagaggcaggatcgccttcgcaggcgttcagttcgcctaacgtgcgaaaagcgcccatgccctgtacggttggcgcatggaacatgcgtgccgctccggcaccgaggccgaaaccgcacaggccgccgatcaccagcgacatgccgagtatttcaataaaagacgcggtagcacccataggtttttctccagatcattttctgtcggcatgattgtgatggtttgaagtggattgtttgaaatggatagctcgcacatccagcaaagagacattgacgaaaacatccagcacgacggaatagtgttcacgctgacggggcaggaaaaagaacaggaacttctccgtcgtgaccttgctgatggcgctgacgatggcaacgtctttcggttcgatgcgcaggatgatgtgagacgttccttgcagtaccgtgcgctgtacggcattcagggcatcggcgatggctttctgtttggtatcgccggagccgctgacccgaaccgatgtttcaatcaactctttcatggttggccgcctgttttttgattaaagcgcgaaccaggcgctcgcccaactccgctttatccataaaaccaaacccgagcaccgtacaaccttcacggatcgcggtttctccttcttcgatggagcgcataccgtgacgtactgggtagccatatttgttttgtgcggtgattgcgcccgctccgccactgccgcaaaaagagatgccgatatctgcctgttcgtgatgcatcacatcacccagtttcatatccgccgcgacgcccggaataacaatcgctttgccgcctgctgcttcgacacccgccgcgacgtttttccctttgcccaaacggtcaccgataaccacaatgatttgttttttaacaattttggttgatgtcatgggttttgtctcctgtgtgctgagtgaggattaagggttggaacgcgcgacttcaaaatgcacggatagcagataagcctcttcaacggccagtccgggcagcgtttcgacgacttgtgccgccaatgcgatagattccggcgaaacttcgtcaaacagcgagttatccacttctggcaaaggttctcctgttttggctctcatcaccattgccctgatatgggtggtcagcatctgctgttgtacttgcgtggtataagcacccgccgcttccagccactgtttaataagtgccagtaatctttggctgaccgcttcgggatcaaggttgcctttcgccatattgaaacgcatggggggtttaagcataaaatttttccagtcaaatcgatcacgacgcatcgtcgagtttcccgccatcgggcgtaatacggtgaaatgaccttatcgattttatttgtggctttggagcaggctaatttccgcttcgaagtggaaatcaaccgaaaatgaggtgttgttgcgctatcttgtgggatttttgcataaaaacgaaggcgccatgattttctcaacctgagaatgtggtcacattatagccagatatttctcgttgatttttgctgacgggaaagacgtgagattagactgagcggccaagactgtctttggcgatgatctgaaaatcatggaaattccggctgcgtaatagccgtttagtggctttttcccggacaaacgtgacaaacagatcataaattgccatcgcttcttcataatcctgtttgctgatggcgagcaggaaaatgacattcgcccgcgtcttcgtttctttgctccattcgatacctttgggcgccagaaccgtgacgacgaccgttttgagagccagcaatcccaatgaatgtggcagagcaatattctcccccaataacgtagaaacaatggcttcccgttcaatcaacgagggacagaaatcctctctgacatagccgcccgcccgcaatttcctgcacagggttttaaacaggatttcctgcgtgatatcttccttgatcaccataaaataacgctcgtcgaagaaacgctccaaaatatagggacgggtttgttccatcattgtcagccgtcctatctgctctaattgataagcagtagggaagggagcgattttgacgatgggtttatttttctctgacagacgcaaagtggtaatgacgaaattttcttccacatagtccaaggcgttgtattcatggagtggcagtacgcgctggatcttgagctgcggaaattcacgggcgattttggcctcaatcatccgccgcgtggcattgcctgaatcggtgacaaccagaacatgcgtcgaacctccgtaatggcgctccaacccaacgccgatatgcaccgccagataccccagttcatcttcactgatgacgaagggaagttgatcttcgatacgggtcagagcgcttaccgtgacttcataggcgaaaggataatgttgcttgatatccgccagtagcgggtttttggtgctgatttgctgctgcaaccggctgattaataccgttaaatgtgttgcgagatcgcttcttagcttgctgtcatggcgtaaatcatagttataggacgtattgatatcgttgaggatttcgtctacccattgatggctgttgggtgtatgcggggtgggattatcgtgttggggaattctctgtgcggcaatctgtcccgcgagataaccggcttctgatgcagatatttcgctgcctagcacgcagatcaaactttgtgagatttcatatgccacattttgtattgcgttgtcccattcatggacgacaccttgtgtcagctcatggcggcgggtaattctgagaatggaaacggcacagttaaatatcagatattggcggccttcgttgttcaggcggataccgaatcgagtcaggctgttttgcaggattgtttcgatataagacaggtcgatatccgccagaatatctgtcctgaactggctgagtgacggttcgacttcgagcgaaaatcggcgtaatagtgtgtctgtcagacaggatcggataatgcgttcattgccggtcagtcgggttccgagacggggaatactggtcagttgcaggggatatttactgacaatttcacgtaccacgcccatatcatgttgcaacgttcctcggctgatagaccaggcttccgcaatatcatccagtttgactggctgagtagccagcagcaatttcaacagcaatgcatccacccgatcgctggccgtgcgggggatcgtctggatcatttgcttttgttttggcagcgaggcgaataaggtgtgatcctcaatgctgagagaatatccgcttccccgtttatagaggatctgagcgccgtaatgacgtagagcgttgttcagttccgtaatatccgtgcgaatggtgcgactggaaacaccaaagcgttttgccagttcagcctgcggcaatctttctttgtggatcacctcaaaaaggtgggctagacgcggataagggaacaaggccacggagatacctttaatttattattattcggtgtaacttcgagcgatttcttcgttgaataaacccattaccctatcaggcaggtaagaaattgattagcctttttgagtgatctcagtggaaaaacaggctgacattttcatgtctgtgaacctgcgacagaggaaagttgtacggatattgcttatggcattaaaaccgcagcagggaaaatgactggcacattttttcctgacgatatgggaaaaataattatttagatcgtgcattctctatcgtcagtcttgctgattacactatatcagccgatgaaatgcgctggtggagcaaaattctgcggatattttactgtaataaataatgaggatgactatttgttttgtatattaactttaccataagttaataataatttcattcattaatagtattattatctctatagttattaaatgatacccacgtaataatcaaaaataagatgtatcttactggacagggatttgatttatcaataaaatattttttattatggcatggtatttttttcaagaacggatttcaacaaaatcaaaaggataattaattatgtctagatttattatcagtcggaataacaagtctttacttaatgaaaccgtattctatcttacaaaagggaatatgcttacattaaagatcgatggtttgaatagtaataccaaaagacatcttaaatttcaatcgaataatacgcttgtgtccatttttcaacgtgataattatctgtttagagaacaaaccttgcaaataacagctctgagtatgggagtaagcgtggttagagcggtggatactgatatagattactgtccctattttgcagaaggcgtcgctgaggactgttttccaccattaacaattcatgtcttatccaaaatatcgattccaacggacttaactgccgagcagaaagcgattttaatggtgcttttagcggaaacgacgtcacctgaaacaaaaaaaataaagtacaatgaaaaagaagctaaagataccatgcaatatatgcatgatgttctattgaacagaatccggtctcctaaagcacatgagcttgatgtgcccagacaggggaataaattaatcgggctcatttcagggccacggacaatagaggggtttagccaataccccaatattaaaccctctatacaagatagaattaatggtatgatagcttctgctaatgaaggtagtaattcaaattttttagcttatcgtcgattaattaaaaatgctattgatatagcaaaaagtaataaaatctccaatacagagattattgcatggagaactggaagtgctgagcctcctggttcaaattttacaaaattattttcattacaagggcaggatttttataagctggctgatagttatcttaaataagagattttatatgaaatatttaattggtttatgcatgattctgttctcgttaactgctttttcaaagcaagatgaactggatttcaaagcttgggaaaagacgggaagttggggaatctatgactcaaaaccagataattattttaagccgttaaagataaataactataaagagggttatttacgctcatttagttatcttattaagcggtttaatttacaaaatgtgaataatgaatactgtttgattggttacaaatggaataaaacaaaagatcgcgatgagcgtgaacgtattattgttttttggaaaacggctaattatctgattgattgggatctgccggatggtgaggacgatcatcgttataaagccattatattcagcaaaccctttattgatatgaatgaatctgttgttccttataaggaagcagaaggtgcgcaggctttatgggctaaagaaggcgttattcaaatgatgaatgattgtgaattgaatgggcaaaaaatcacgataacaccttctggggtcaggtaatatcacaactgccttcagtctgcgggcagttcgtgtttaaattggtggtaacaatatacgcctattgaatgtgcggtttcatataataaatgcaacatcgttactctggaagtaaacatattcgtgttccttgaaaatattatgactaattttttgagttagttcggcctgattctgaaaagtgaaattacagaattacagccaagaagtagcatgctatgtatgcaaaatagctgtttccccaaatgcgccatggatacagtcatattagttgaaaattgactaataccgcttaaactctcggaatggaattcttgtggttttttaaaaatcaccagttttttgtgaaactaccgattcttaaatagctaaatgagtatgccacgctcggcataaaatcggctaaaaatatctactgacatttttacatcaatttgactttgagtgttagcaccagaaggattatgaaaggttatttcttcgggtgtagcgttagtcaccagcacaagatgtccgccctttttttcaggtaatcgtgttggccatctgatactaggatgaacggaagctatatataaactatcttgggtaaaaaccccatgtatcttttcggccgccataccggtcactatttgagagaaaatcccaaattgttccgataacattgaaactacaggggcataaatcattccttttatatgctcattttctatctggtatgctccgtactcggttgccattttagttaatttcagcaatgggtaaattttccctgagcgagctgcaagcaacattttaagacaagccataccacagatatgatttgcccatttcgcatattcctctggggaatctgcaccggattgttcccatagcggatcatgactaagtggaagttgatggtgaataatgtcattggctaaatggaatgattcccactgagaaaaataggggactttcatagtctctccatgaacataagtaaaatcgcgataacagcaacaaaggaaaataacatttgttcagagagtttgccttcacgatagacaagcactgaaattagcataagtaaaggaattctgagagttattgctagatatccgtagctgacaggtaaataagtggcaatagcatagttaaaaaataattctggtaaaacccagataattgatatggaaagccaaaatttcagtggaacaaaagaaaatttatttttctgatagaaaaaaacaacaaatatattccctatgccagtaaataataaataggtaaaccaaccactcgtgggaatccctgttcggtccataattgcaaacccgattacacagaatatcataatgaaaaacataagcttacttcgtctgtgcatgcttttaatatgaccaatcatagtgaaaagaattccggcgacaaaaagaaggttaatactgaggatcgaggcaaaggtaagattagaaccaaatatcagtatatcaacgagtgcaataaacccaagagatatagggaatacataagtggcagatgaaaggcttttgttgataagattttgttgtgctatcagcattatgcctagaagcacccctttcatcaatccagcagatatccctgttaggttaaggaaatcagatggagttgagatgcccgtggttatggcgacaggaagtagagaaaggcacgttaaaaacgtgccagcgccaataataaaagcagtattctctggagatacacgttctgcaacttttttaagggcaagggttcgcaaagtcgttagtacgatgatcaacaaaaaaacaccatattgtgctatgttcaattgagaggccttaacatagacgaagtattattattttccggtgttagagacaatgcggcttcaatgtgagcatcgatagaatcaattatttttattgaattttgatacaccctatcattgacaactaaaggaatttctgtacagccgagaatgacggcttctgcgcctaattcagctaattcatcaatagcacgatacattattccacgggatgtgtcagtgagcgcatagcgacatagatcctgataaatagaatcatgtatgacttgccgagtcctggatctaggtattaatacgtttattcctttagcttcaagtcgtttcttataaaaatcacgttccataacatattgagtaccaattaacccaacattggaaaccttcatgctgagtaatttatttgcggtggcatcaataatattgataattggaatattaaccagttttgaaagccgatcgcaagtattactggttgtattagaacaaataaggattttttttacttcggcttgcgcaagttgatgaactgctttactgagaatgttaaattcagtctcattatcatctcgcttctgggcggcaagtatttttgaaaaattgaggctgataatagccagatcggcagattcaaaatctttaccagtattctgcacagccatatttaaacgtttataatattccatagttgatgcccaactgacaccgccaattaatcctattctttccatttttttacctttactcgataatgtagttaaaaatagattttttttcagaaatgttttgtgatgaacatgataggtgaataaacaagctaggtattgataatttgtgtccttttaacatcttagggaatatgctatttttcatcatgcccgggatcggatttgattcaagaaagtatatttcttcagactcggtaacaataaagtcaaatcgacacataaattcatatccagtagattcaaaaattttaatagataaatcttttagtgttctcgttatccctgaatcttgtattaaaaggatttcttctgctttattaattcgatgcttttcatcatgaccgaaaaaaccattctttgtgattatttcgataacattgagtgctattgctttcccttctattcgaatgcaaccaacagaatactcttttcctttgatgaattcttgtaccaaggcaaatctatcgtattcaaaaatatttttcaaattatccaatattgattttttttcattttccagattaacatatttatttgtaaataaagaagcgcctaatgaattgggttttataactattttttcttcagggaagttatcgctaatcaatgaaaatgctttttctagattaccttcagttaagagtaatgttttcggtgatcttaaagagggtaataaactattaatatagtgtgacatatggtatttactcatagagagcgaggaaggaagtacactaccaaatgttcctttaattttaaaatacttagcaactccttggatatgcccatcctcacctaaattaccatgaagaagattgatgtgaaattcgttttgttcagacatccttttgattgctgtatataaatctattttatctccagaatgagtaaaatcatcgggagaaatataaggtgtataggtgttatataaaacagaaccatctttatcgaaaaagtatattgaattaatatttctatcaaaattaagctctctgaaattttttataagattatcaaaagaactaactgatgctggatgttctggggaaattccaccaaaaatgatcgataatggtatagttgtttttgtgtcgctaggaaaataaaccatatatatttcctttttttgattttttaagaatataattcatgcgttgaaattaattcaagcacactattcatttcaatgcaataccttttggtgctttattttaaaaaaagaagaaaataaaaataattattaattatttctatgagtatttataatggtgaatatttacaagataatatttttatgtttaattaatttcatcctgattttataaaagatgtttttcaggttgacattaggctagcctaaataaacacagataatcgtgttctggtaaacttattaaaaagggtaattatctgattaattgggatctgccggatggtgaggacgatcatcattataaagttataatattcagtaatccctttattgatatgagtaaatctgttattcattataaagagactgaataaaaccagatttgaaatttattaactaatattacgacaaccccctattttaaagggggtcgtggctttataaatcaccatctaattcatcgactactgatttttccaccaccgatataacccttcaatatccgctgaagtgagcaatttcatcgccgcttttaattgctccagcggccagttccaccactgcatttccagtaacatcgcaatctgttcatccgaaaagcgttttctgatcaccttagccggattgccgccaataatagtgtaaggttcgacatccttggtgacaagagagcgggtgccgataactgccccatcgccaatgtttacgccgggcataataatcgcttcggcacccatccagacatcattgccgataacggtgtctctcatcggctggtagccattttgagcatcggcaaaggccggctcttccgacatatagaaaaacggaaaggatgaaacccaatccaaacgatgtccttgattacccgccatcataaaggcgactccggtgccgatggagcagaagctgccgatgatcaatttatcgacatcaactgaatcgggatacaggtaacgggcgcagtcatcaaaagaatgtccatgataataaccggaatagtaactgaaacggccgacctgaatattcggattagtgacttgttccgctaaggttttgcccttaaatgggctgtcaaaataattttccatataacccttattgctatctgatttgaatttgaaaattacaattggtttttcggcataaagtcttggctgaatgtcagccgtttgcgtcccggttccatttctgccagcggttctacttcctgtaaggtatttttgcagcgtgtgacgagatcctgatattcaccgtttccagtccagctcttgttctgtcaggtcgcgcagagcacggtcgggtggacaaaactgcttggatggataaccggggttaaaccatcaatttgatagacaggcataagtatttcctcaaagggtcagacgataccggattcactgtgcagaacaccaaaacggcggtaatacgccgctcccggttgcggaagtgtgccaatggtggtttcacagcgttcgctgacgtaacgtgtcgcagtaaggtctattcgttggtagatattggtacacaagttacgggcaacctgtccttcccattgtgctggcagtaaagcatccggcagcagcggatcgcgcagcaccactcggcggtaaaagtgaataagcagcagacgtaactggaagctgcgttctggtgtcaggtcggcttcactgcaatcttgcagcagcttcattaagggacggaatgagacgataaactcgtgatagtgttttaccacctgatccagtgaccaactggccgatacccgctctttcaggctttgttctgagcggggatagggatagtctgcccgaaaatagatcacggaatcactggcgttgagttcgccaagcagggcgggaatatcactttgcgcgctgcttggtgccgccatcagggtactgttgagctggccgaagccaagccagctcagttcttttttcaggcggttgcgttcttctttggtcgtgccttccagcagcagtagatcccatttgccatcccactcaggctgttcgctcaggtagattttgctctcggcatggcggaattgattcatgccacgctcggtgatgcggtaatagctgcgacggccgattttctccactgccagccagccctctttttgcaggcgaaagacggatgtccgcacaaaacggtcactgaaccccatcggctccagcaggaggctcaggctgcccaaccatacttcaccaccacggtgactgagggcatccccaaacagagagatgatcagcgatgttccactaatgggctgggcatcaagggcgtgtcggataaagtcgtcgagtttgtgtgccattttttccattatctgctcgcaaatgtgtcatgccattagcataaccggagaaatataccctgcaacttgaaatctactgggtatacgttcggaaaaccgccaccgttgcacgatgagataacctcaacggtggcgaatgattactcatgctggcggtggtcgatcactctgaccgccttgccttctgagcgggggatgtctccgcagttgacgatactgacctctgtactcagccctatcatggatttaatgtgatggcgcaactggtggcagatgtcgcagcgttgttgagcgtcaagccgctccggctcttttagctcgaccttgactgacaggcagtcataattgcctgtgcggttcacttctaactggtaatgaggcgacagctctttgaagcggatgatctgttcttctacctgtgatgggaagacattgatgccacggataatcagcatgtcgtcagagcgtccggcgatcctgtctatacgacgcatatgacgggcagtacccggcaataaacgggttagatcgcgggtgcggtaacggatcacgggcatggcttctttggtcagggtcgtgaaaaccagttcgccggatttaccatccggcagtacgctcaggttgtcaggatcaatcacttccggatagaaatgatcttcccaaatggtggaaccgttagcgtgttccaccgattccatcgcgatccccggccccatgacttcggacaggccgtaaatatccaaggctttgatgcccatgcgcgtttcaatttcgcggcgcagcgcttctgtccaaggctctgcgccgaaaatgccaacgcgcagggagcatttgctggcatctccgcccatccgctgttccagcgcatccagtaaagtcaggcagtaggaaggggtcatcatgatgacgtcgggtttgaagtccagaatcagttgcgcctgtttttcggtctgaccgccggacatggggatcacggttgcgcccagacgttcagccccgtagtgtgctcccaaccctccggtaaacaggccgtagccataggcgacgtgaactttgtctttggcacttgccccagcaaatcgtaggcaacgggcgaccagattagcccaatggtcaatatcccgctgggtataacccaccacggtaggatgccctgtggtgcccgatgaggcatggatgcgcacgatttgttccatcggaacggcgaaagtatcgaacgggtagtgctcccgtaaatcctgtttggtggtgtagggaaatttggtgatgtcctcaagttgcttgaaatcactgggatggatgccggcggtgtcaaatttgcggcggtacataggcacgttgttgtaggcgtgatggagcgtccattttatctgttcaaactggtgcgcctgaatttcgtcacgtgaagcaaactcaatggaatcgaggtgttgtacgttgttgctcatagtttcctgtccctttgttgatttgtttgtaacaggttgttgtttttatgtgcaggtgtgggttatttgccaatacccgatataagttgttgccgttacgatacgcgttcaataatcatggcgatcccttgccctacgccgatgcacatcgtgcacaaggcatagcggccggcacgccgttccagttccagagtggcagtcagcgccagacgcgccccgctcatacccaatggatgacccaatgcaatcgcgccaccattcggattaacctgttctgcatcatccgatagccccaactgacgcatgacagccagtgactgcgcggcaaaggcttcattgagttcaataatatccatctggttcaggctcaggccagtgagctccagtaccttgcgggtggctggcagtggcccgatccccataatgcgaggttcaacgccgcaggtagcggttgcgatgatgcgcgcccggggtgtcagcccctgctgcaaagcggccttctctgaggcgatgatgagtgccgccgcaccatcattgacgccagaggcgttgccggcggtgattgttccgtcagtgcggaagggggttttcagccgttgcagttgttcgaatgtcgtctccggtcgtggatgttcatcctgtgagacgatggtcgctacctcttttttgttggcagcgggcagggtaacgggggtgatttcttccgccagaataccccgttgttgggcgctggcggtgcgttgctggctgcgcagggcgaaggcatcttgatcgtcacggctgatttgaaactgggcggcaacattctctgcagtttctggcatggagtctgtcccaaactgctgctgcatcaggggattgataaagcgccagccaagggtggtatcaaagatctgtgcttggcggctgaatgggctgtcggttttacccatgacgaaaggggctcgggtcatggattcgacaccgcccgccagcatcagttgcgcttcgccggctttaatggcacgggcggcaaaggccaaagcatccagaccggagccacatagccggttaagggtggtcgctgacaccgaatagggtaaccctgccagtaaaaccgccatgcgtgccacgttgcggttatcttcccccgcctgatttgcgcagcccagaatgatgtcatcaatgtgttgccaatccagcgagggataacgtgccagtaatgcctgtagcggcagagcggccagatcgtcagcccgcaggccggaaagggccccgccataacgcccgataggtgtacgaatgccgtcgcagataaacgcatgggtcatgattgttgctctccctggctctctttcagaatagaatgaccgagacgatgagcgtgaccccggaagaaggccactattttgccgtcctgattgataattttgacgtcatacaagccagtggttttgccctgatgctgcataaaagcggtggctgtcaggtggtcaccgctaaaggccgggcggataaaatcaatgctgcaaccggatgccaccgctgccagcccttcgctgttgcaggcataggcgaaggcggtatcggccagactgaacaggatgccaccatgacagctttgatggccgttgagcatgtctggtttaatggtcatgctcacttgggcgacccctgtatcaacatggtcgatgtgcattcccatattctgggcgcaggcatctttggcatacatggcttcaatgcagcgctgagccagttggctggaagcgttagcggacatggttgtgctccttatcttgatcccgctggagatgcagcgttacatagcctgccgccagttggcgtaacagaggtgcaggtcggtagcggggttcaccataaaattgctgtaagttttccagcgtgctgagaatgtgccgccagcccagttgttccccccatgccaacgggccgatggggtaattgacgccgtaacacatcgccagctcgatatcttcggcgctggcgatgcctttattgatggcatccagcgcttcgttgcacaacatggccacggtgcgcatcgtcagtaaggccgggtaatccggcaggagaaccacctgcttgccgagagattgcaggaaactgatcactttttccgtctgcagctgggtgttctggcaggccgagctaagagtgatgatggaagcagtctgatgattggcggcaagatcaaactgtaccactggcgccctgatttcatcagcaagctgtgcgctggttttaccttgtgtcagcgttaatataacgtcatcaagctgtaatgctggcggctgggaaccggtatttttgctttcttcgagggcgattccatattgtggtaacaacggttttaacagcgcggcaaaatgtggcagagttccccaatcgcccgttgcctgaatccgcgtaggccgtatttgctcttggagggtttccaaccggggtaatggctgatgtttttctttgccatcataaacataaaacccccgaccgcgcttacgtcccagatgatcggcttctaccagctctttttgtcgcagtgaaggctggaagcgcggatcaccgtgaaatgcgtggaacagggattcggtcacggcataattaacgtcatgaccaattaaatcggtaagctgtaacgcccccatcgcaaagccgccagattctttcattactgcatccagtgtggcgggggaagcaatgttttcttccaatgcgcgcaaagtctccgcataaaacgggcgggcgatgcggttgacgataaaacccggcgtagagcggcagactacaggctgtttttgccaatcggtgacgagacttttgagtgcggctatcgtttgagaagatgtttccaacccctgaacgatttccaccagcttcatcagtggcgcggggttgaaaaaatgtagccccgccatgcgttggggtgaagccagcacacgggcaatggcggtaatcgatagcgatgaggtgttgctggcaaaaatggtttcggctgaacagagcggttccagttggcggaacaggttctgtttgacctccagttgttcgataatcgcttcaatcaccagtgcgctcggtgctagtgcctgtaaggagtcaacctgtgtgatgcgctgcaatagggcttgggttgcgccagcttctgctttgcctgcctccacacgctgatgcagacgggtgtgcagcgtctccagtgcacgctgtgccgcttcacccttcacatcaaacagcaggacggaatgccctgcttgagcggcgacttgcgcaatgccgatccccatcgttcccgcgccaatgacggcaatcgggccgtgaaggatcggacgatgatgtgctggcgtgttcatgattatctccctttgaactgtggttggcgtttgtcaatgaatgcactgacaccttcacggaagtcttcactgcgtccgcacaggcgctgtaaatcacgttcgagattaagctgttgatccaagctattggctgcggcggcataagtggctttcttgatgcaactcagcgccaccgttggctgggtcgccagatgttgagcgagctcccgtgttttatcttctaacgcttcgggttcgatgacctgccagatcatgccccattccagtgcttgttccgcgctgattttgtctcccaataatgccattcccattgcccgggcatgtccgattttatgggggaggaaccaactaccgccggcatccggcgtcagaccaatgcggcagaaggcttgaataaagctggcggtacgggaagcgatcacaatgtcacaggccagtgcaacggagacgcctgcgcctgctgctactccgttgacggcgcagatcacgggtttgggcagggaagtcaggcgacggatcagcggattgtagaaacgttcaacggattggccgagatcaggaacgtcaccctccgaggtgatggcgttgcgatcatttaaatcttgtccggcacagaagccccgtccagcgcctgagagcaggacacagcgcacggattcatcctgttcagcaatcttcagcgcttcacttaactgttggtgcatttcctcgttaaagctgttaatgcgttctggacggttgagcgtaatgctgaggacacctgcttcaatatcagtgagtatcattgacatattttccatcgatcagaaccctttgaatgttggtttacgtttttcaagaaaagcggtaatgccttcttggcgatcggctgtccccgccagagcgacaaattgctggcgctcggcgagcagcccttgtgacaggctggtttcgtatgcagtcttgagtgcagccttagccgcccgtaacgccagcggcgaaaattcactgatgcgtagggcaatctgttccgcgcgttccagcgtcagagcatcgatacagacttcgctcaccagccctgcctgctgtgctttttgggcgtcgatcgcctcgccagttaggatcatttgattggccagtgctttgcccacactgcggattaaccgctgtgtaccgccagcgcccggcatcaatcccaatgtaatttccggcaggccgaagcgggcactttcaccgcaaatcaccagatcacaggccagcaccagttcgcaacctgcacccagtgcgtagccattgacggccgcaataagaggtttggtgatgttgtgcaaacgctgccagagttgtgggcggcggtctgtcattgccgtcgcaacggtctgctgctgtagttccttgagatcggtgcccgccgcaaaatagcttgatgaacccgtaatgacgatagctccagttccggtatcggcatccgcctgttccaattgctgcacgagttgctccagacagtcattgctgagggcattgcggacttctggacggttcagggtcagcgtgcgtacccgttgttgctggtggcataaaatccattcgtgactcatggtagctcctcatttttgacggtgctagatgtcaaaatccacaaccacgccgtcgcctttcggccacgactggcagcttaagatataaccggcagccagttgatccggctcaaggctgtagttcacgctcatatccacttcaccggatttgaggcggcatttgcaggtggcacacacgcctcctttacaggcatagggcaaatcggcaccttgacgcagtgccgcatcgagaatgctgtcatcttcggtgttcatggcaatgttcagggtgcggccatccagatgaatctccacatgggtttcattgcgttcagccagattggccgggcgaacagcggtgcttgatggattacgcccggtgttgaaacgttccgtatggatacgttcggacgccatgccggcctgctcaagtgcagatttagcatcatccagcatggctgctggcccgcagagaaaggcctgttcgaactggctgaaattgagcaggatcttgccgaggcgttgaaggtgttcgctatcaatgcggccgttgaacatcgggctatcggtgatttcctggctgaaaaggtacagcacctgaaaacggtgcaggtagcgatttttcagatcggccagtgcttctttgaacatcacggaacggctggtgcggttaccgtaaatcagcgtgaaggtgctatccggttccagcgccagtgtacttttgatgatcgatagaattggcgtgatacccgaacccgcagcgattgccagatagtttcccgctttgttcccatcgggatggtggccgaaattgccttgtggttgcatgacatccagctcatccccgactttaagctgctggttgatgaacgtcgaaaaacgtccttgataggtggccttgatgccaatttgtaatccattgtccagtggtgaactgcaaatggagtaacagcggcgtagctctgcgccatccacccgtgccttgagtgtcaggtgctggccgggttgatagcaaaagagggctttcaactcatcggggacatgcagtgtgacggtcacggcatcaggtgtttcccgctcaatcgctgcaatgcttaagcggtgaaaagtcggacgatgaaaagtagccatcttttgctgctccctaaactcaaatacatttgaaatagtcgaagggttccagacactgctgacagcgatagagcgctttgcaggcggtggaaccgaattcactgattttttcggtctcatggctgccacaacgtgggcaggtgattgtttctgtctctgtcggtttttcacaagccaggccctgcggaggcgcgatgccggactcccgcagacgttgcttggcatcagcattcatccagtcagttgtccacgccggtgtcaggcttatttcgatagtaatcggcgtaaagcccgcccgtgccagtgtttgctggatctcattgatcaggtattccgttgccggacaaccggagtacgtcggggtgaatatgactcgccagccggtttgctgaggggttactgcccgaaccatgccgagatcagtaatggagagtacgggaagctcaggatcggcaatctggtgcagacattgccagatctgatggatagccggcggctgtaatgtgttaacttgctgttccatcatcccctcctttcgtgatcaacggatggttaccagttacagttgggataggtgcgttgcagatactgcatttccgccagcatgtatcccagatgttcggtatgcagcccctgtttaccaccctgtcggtagggtgtttcctgcggaatttccaatgtggcttgggcgaatgtctcgttgatgatttgccgccaaggttcgtacaaagtacggggatcgactgcagtaccatcttcggtcagtcgttgttccacttcatcgcaatagaacagttcgccagtaaagcgccacagttgattgaccgattgctggattttctcgcggctcagttctgtgccatcccccagccggatcatccagccacggctgaaacgcaggtgatattcgacttccttcaacgatttggtgctgatagcggccaattggggatcgcggctctgccctagtacctgatggagcaggacgtgataagcatcaataaaaaactgacgcaccagcgtatcgttaaagccgccgttgggttgctctaccagcagcagattacggtattctcgttcatcgcggccaaatgccagccgatcttcatcaaaatccattccataaagtgtggcggcgtagctgagaaaatggcgtgactgtcccagcagatcgaggccgatattcgacagggcaaggtcaatttccagctctggcgtatggccgcaccattcacacaggcgctgtgccagaattaacggggtatccccctgccgtagcacataattaagcagatcatgattgggtggagcaacgctatgtgtcttcatatttcagctcttacatattcttgatgccatcaggaatggtatagaaagtcgggtgacggtagattttgtcttccgagggatcgaaaaaagccccgcgctcttcaggttgtgatgccaccagatagatagatttcactacccagatggagcaaccttcattgcggcgagtgtagacatcgcgagcgttctccagcgccatttgatcatctgctgcatggaggctgccgacatgacggtgagccagcccctgtttgctgcggataaagacttcatacagcggccaatcggtatcaatcatgttttgtctcctgttccggtcatcaattccggtaatgaaacggattaagcggcattttttctggctgccattttcttggcatgcactgaagcggcttcacgcacccagcttccggtttcccaagcttggcgtttggcttccagccgttcgtgattacatatgccctgtcctttgagcacttgatagaattcgtcccaatcgatttcaccaaaacggtagtgccccgtggtttcatcccaggccagttcgggatcgggtgcggtcatgcccagtgcttccaattgcggaacggtgctgtcgataaatttctgccgcaattcatcgttgctgaaccgtttgattttccatgccatgctttgggcgctgttgggggaatcattgtcattggggccaaacatcatcagcgtcggccaccagaaacggttgatggcatcttgcagcatcgcgcgttgggcgtcattgcccgccgccagtaccataacggcttcataaccctgccgctggtggaaactctcttccttgcagattttcaccatcgcacgggcatacgggccgtaagatgcccgacacagggcgacctgattgatgatcgccgccccatccaccagccagccaatcaccccgacatctgcccaattgagggtgggatagttaaagatggatgaatatttcatcttgccattcagcagcttctggtagatgtcctgacgggtacagcccagtgtttctgccgcgctgtacagataaagcccgtgtccggcttcatcctgtacctttgccagcagcaccgctttgcggcgtagtgtcggagcgcgggtgatccagttggcctccggtaacatgccgacaatttccgaatgggcgtgctggccgatttgacgtatcaggttttggcgataggcatcaggcatccagtctttggcctcaatggaaagatccgccgcgattttggcgtcaaagtacgcttgaagtgagttagttgtcatgctgcctccattatgattcttatttttttattttaaataaaaaatagaatcattttatataactgtaaatctacaaattgataacaaaaatatcaaacacttaggttgtatatttgtcgtacacatcacaatatgaatttttatttgtttaaaaacaattaattaatttttattgttggatgggagtaagaatattaacaagtgatcgtccgcaaatgttttgcttttgttaatttattgggtggtcttgctgatgagttatatgatacataaatgccatctatttacttgatgattgattcattaatgcgttcggcggagaaaaaaatgcaacagttaaccagttatatttgtggtgcttgggtttatgggcagggcaacgccagagccattcatcatgcggtgagtggtgaagccttgtatcaagtgtgttcagatggtctgccactggcggatagtctgggatatgcccgtgaaaaaggcggtaaatcgttgtccgccatgacgttccaacaacgtgcgcagatgatgaaagcggtcgcgaagcatctgcttgctaacaaagaaacgctgtatgctatttcagcagaaaccggagcgacccgtgcggatggttgggtggatattgaaggcggcattgcgacgctgttttcttatgcagggctggcggggcgtgagttaccggatgataccctgtggccggaagatgagatgatcccgctttctaagcagtcgcagtttgtggctcgtcatatgttgacttcgcgtcccggcgtcgcgctgcatatcaacgcgtttaacttcccttgctggggaatgctggaaaaactggcaccaacgtggatggccggtatgccagcgatcatcaaacccgcgacggcatccgctcaattgacgcaggcgatggtcaaaatgatcattgatagcggtctggtgccggaaggcgcactgcaattgatctgcggtggcattggcgatctgtttgatcatctcgattatcaggatgcggtgacttttacaggatcggcgcagaccgggcagaagctgcgtgtccacccacgactgatcgaaaaatccattccgtttaccatggaagccgattcccttaactgctgtatgttgggcgaggatgtaacgcctgaaatgccggaatttggcgtgttcatcaaggaagttgtccgcgagatgacggccaaggcagggcaaaaatgtacggccatccggcgtattatcgtgccagtcagtcagcttgaggcggttaaacaggcactgcttaaacgcctttccggagtgaccgtcggcgatcctgcgctgccggaagtgcgcatgggcgcgttgattagccttgaacagcgcgatgaggttcaggccaaggttgatgaactgttgagtcacggttgtgaacccttgtgcggtggttctttggatcaactggtgctgaccggtaattccagcagcgagggcgcattctacccaccgactctgctctattgcgctgatccggtgacacatcaagccgtacatggcacggaagcttttgggcctgtttccacgttgatgccgtatcaggggacagaacaggcgatagcgctggtgttgatggggcagggcagtttggcgggttcgctggtcacggcggatgagcagatcgcggtgcaggtgatccgggcaacagcgtgtgcccacggccgtatgctggtgctggatgaagcggcatcggcggaatctacggggcatggatctccactgcctatgctggtacatggtgggccggggcgtgccggcggcggtgaggaactcgggggactgcgggcggtgaaacactatatgcagcgcaccgcgattcagggcagcccaaacatgctggccgccatcggccgtgaatgggtacgtggtgccaaagtgaagtccgatccggttcatccgttccgtaaatatttcgaacagcttgagattggtgaaagcctgctgacggctcgtcgtactgtcaccgaagctgatatcgtcaattttgcctgcctgagcggagatcatttttatgcgcacatggataaattgggtgcggcggaatctctgtttggtgaacgtgtggcacatggttattttgtcgtgtcggcagcagcgggattgtttgttgatgcagcggttgggccggtgcttgctaactatggtatggaaaacctgcgttttattgagccggtgaaaattggcgatactattcaggtacggctgacctgcaagaagaagattaagaaagcccagaaaacccctgatgacaaaccgcaaggtgttgtggtgtgggatgtgcaggtcttgaatcaggagcaacagccagtggcgctttacagtattctcacgctggtggaacggcagcaaggggattttaccgcgtctgagtaggtgcggttgagataaacaaatcggagatttgttgagtaaggaaactgaaatgcctgaggatatttgtcaaagaaaataaaatagcggtgatcctcaggctgttctctaaagtttgaattcgggttgaattttatctgtagaataggtgagttgcagttttcggaataattcttccaagaaagtaaagattttatgatatagcagtcaaaggtattaccttttaatattaaggtggacaaaatggcgacatcagtaaaacttgacgataatttaaaaagccggatccagaatttggcagaagtgcgccagcgttcggctcactggataatgcgtgaagctatacgtgattatgtagagcgtgaagaaaaacgtgagtccttcaaacaggatgtattgcgagcctgggaagcgtatcaagagaatggattacacctgacacttgaagaagccgacgactggttagcaaagctcgaagcaggagataatacggagttacctgaatgccacgtttgatctggtctccggcggcccttactgacgtacaaaagctctatcgttttctagtcaagaaagatgaagcagcagctcgtagagctattaaaacaatacgtgccagcgtgacaccagcctgaagtaggacgccctgctgaagatatggatcccgtattccgagaatggcttattgattttggtagcagtggctatattgacttgtatcgttttgatggtgaaacagccacaattcttgcggtgcagcaccaaaaagaagcgggatactaaattatctagaaaaggagagagtgacgctctgttgtttaggtaagttttttcggttgggggaagtaatgatggaaatctgccatttgctaatattgagttcagtatattcaggcttttttttagtgtattaggttcttttaccgtaactttcaagccatatcgtatatcaatataatcttcaatatactgtttcatcgcccccaattggcgggacgaaaatcttttccacctgcgaaatctaggtcttcactaaaacggttaccaccataacacaggctcaaagatgttcctccctggaagccgtgcgaaatccgtacgatcaattttcatagaccatttccttttcaaccaagtgtgtgtttctgcctactcgctttagatcacggtaagctgcctgtttatttgctagacgaagtggtctgccaacatcttggatgtggttgataatgtctgatactgctcttttagtatgggtaaattcaaccgtaccaaaaggtgtgttgtattccccctttctacccgtcgtcatcaccgtcagccgatcaatggggatttgtgagatagctccgtattcagatagagcagattccaaactgacatagttgtattcaccgcgtcgcattgttttggcaatcaattctagtgtgtgaagtcctttgtgtcttgataaggtgaacacgtaaacccctttacaagcacgcgataagataccttgcttgactagacgactcagtccggcttcaaaagagcgtttgctgtcttccgaaaacagtttagcgagatctctactggtgaagacgtaacgaccttgttgatcgagcttgtttaagcagtgaatggctgtagtctggttcatcgcattaagtatacacttatacgcaattaacttgaagatgcaggacttaaagtctggaaattatctgttaaccgggtggtgagttctttcgctttttctggcaatgtgacatgaaaaaagtgatgcagcgtttcacggaatgtttttgcctccgagaaatagatattatttcgtacctgctcattcgcatacttccataatcgctcaatcgggttgaggttagggctgtaagggggcagataatgcaactcgatattcaggacctcggcaaaaaattgaactatttcagcgcggtggtaaccggctccatccagaatgagatgaattttttgtgaaagcggataggtttctcgaattgagccgaaaaacaggacaacatttttcgcgttaatcgtcggatattcacgaataatggtctcttcaatccgttgcaaattgagtgcgcccatgatgttaaggcgggtccggctgcctgtggtttcgaccactttgacatgctctcttccgcgcctcatccagccgtaacttaattttgtggactgggtaggatgcatcgcatcaataaacaaaataggcgcattttggccacattcagctttcaacgcgttgtaggtctcaataaagtgttgctgtttacccgcatcggatttatgaggcgttcccatcggcttcttgtagctgaacccttggcggtggagccattttgtcatcccagccacagtgaaagtcacctgccagcgcgcccagacacaagccacaatttgcgcggtagtgtgcatcaaatttgccgtcagatactccactaattctgtcgtttgttcggcagataaacggctttcagagccgccattttcaggggcgagtttttcctcagagacgtaatccttcagatggcgactcaccgtactttcatgaatacgcaaagcctgggcaatcatctgggcagtccagccttctgaggccaaaagcacggccttgatgcggtcacgtacacgcccatcacgagtcgtatcgtgcatcaattcgagggcttctttttgggcatctgtcagagtaattgtcatgggcgcgatcttgatctgatacgaataaaaaatcaagcatcttcaatgacgatgggtatatatcattataaagtgagatttgtgtacacatattagcatggcactatatatacgtaaataacatatataaatggtatatatgtctacttaatgaatgtgatgatattattttttattttaggcgtatttctcaaatatgttattcccaatccggaaataatgaaattaaatagaagaaaccatatgaatattagatagttattgtaatagtaatttgttatattatcgcgatatttaccacataatataatcaatattactcactataaattcaattggcatattggtattaaataaataattgtttaggtttaaatatgattatttatataaattttatgttatttaaatataaaattaatgaggtgaatattttaatgagttatattttataatgtaaaatattaatgttttaaattaaaagctggggtctgtatcatcaattagacaggaatgtggcttgactaaacttaaactgagtgtaatagtcaatatgaagcaaaactatttattaacgcctgatgatgtttcctattttggtctcgttaatccaaagtaccgggtaaataataaaaacagatgaattaccttatgtaatgcagtaacagaagggatagtttgtttaatgtttaagttaaataataatcaggcgttatattttttgctttcttaatagagttaccgctgttttgctttttttattgactgcttttctacaaaatactttcccgtaaaatacgtatcactgtttctgccccactgcgattggggttaatgcgaatcatgcgtttttccagtgtaggatctgcctgacgaaatgtaccggaaatacggtaaaacagaggcgggatttcaaacttggattctgcacccactgggtaaggtaatgctcccagcccatgtgcggcagtcagtaccacttcggcgatgggttcgtgaaattccaccaataacactttggattgagcattagccagaaatgcttgtttcacctgcggcaattccccctgattcaatcgtgtcaccaacgtttcattaacttctgcctgtactgcatgggtcactggcgcggacaccagcccacgcaatgcttccattgcctgatagccttgtatctgacagccaccggagtacatgctgcggcgtagggtctcaatcgttgtttgtttgccgacaactaagccgactccctgtggccccagtaacttaaaacaggaaaaactggagagtgtcgcgccatattcgcagccaatatgcgccactttcatggctgcatagttatcatcgaccaatgagggaatttgatactgatggagtatggcgagcacatcttgcagggcgtagctgtcatctatcttctgtcgtgtatgctggatcaggcaggcagcaggttgatattgccggatggccgctgcaatttgttctgtatgattgaaatctgcatgcaccacgtgaagccccatctgttcaatcgatatcttggtcgtgggataaatcggtgcatcgtggacgagcaacgtagcgttgggactgaccaatgctgccaaccccgcgcgtagcgcccctgttccggctccattgacaaaggctgccgcctcagcaccaaaatgctccgcgatgaccgcttcaatacggtgggtcatccggggttggtgcagatccgggactaagcccagatcaccttgcgagagaaaatcagcgccaggaaagtgacgacagataatatccaccagtttgaactgctgctgctgggcttgcgccatcgtcatactttgcaatggataggttttcattttcttactttattcccagcagatagagcacgttggcaaggatacccaccgcaatagttgcgattgggccgatagccatctctaccaaaggacgtttggaagtgcggttgagcaggtagatacccgccacgatcataaagcctatacctggcaaaatagcgttggaggcaatcataccaccaaccagcagggcgacttcgagcattttggtgatcgcggtacgaatatgaccactacaggcttttacgccagggtatttatccagccaaatggcgattttcgctagcagctggatttcaatgaacatggtgataccgcccgcaataaaggcgatccacgggttgttggttgccagacccgccacaaacacgaatttcatgccattcgggctgtaaactcccgtggctatcgccgtggtgccgaccagcgggacaaagctgatggcgcgtgccagtgcgaccaacagggcgttggtctgttcgccctgcgccattaattgcagggaaaccgggccttcggccagcaggctgaaagacatggtcgcggcacttgcggtcaggccgccgcagaggatcaacagccatttgtttttctggatgcgttcaatacgggtagagaacagcccgactaaaacttcattggctcctttctgttccgctgactgggctggacgctcccgcatcgcaaagtagaacatggcagtcatcgacaacagcaatgctgcgccgttgggatcgagactgaccggtttttcgatcatgccaccaaagctgagcgggccaatcgccttggtggccagatagcctatcaacgcggtgagcatgacccatagccctttgcgatagccatattgataacccacaactatcgcagggaacagcgcgaagcaggcgacaataggatcgccaactttcttgaggtcatcggtgaaattcaccggcagcatggcaaacagttcgacgactgagcgcaggccggcgagcaaggcaatggcatacagggcgccgatgatacccgaggcgataaaccctcttcggctgttggcacaccagatgccgatcatatcagtgccgagcagcaggctgtgaaccagcacaatcggcgctgccagtgaaaagggaataccaaagccgacaaccagaccgatgctcagggcaaagctggtcgcggcgagagccttgcggctcatccggccttcaaggtattccggtagcagtgggcgcagaccatcatggaaaacagcaataccacggtttgccatcatggcagcaatcgcaccaatggcagcgagcaacccggccttggaagggtcaacttccatcaggctcatcagaaaactgtgaagatgttgtgtggcattgatatcactcatgacatgctcctcaccgagaaacgatggtgttgatgatcaccggcaggacaacatcaatatcctgacctgtaaaaccgaatgcttttttacctgctttcacatgggcaatgatctcgtcgtcagacaggattttgcccggcatactgatggtgacacattgattcaggccgataagggcgatggcgattgccagtgcgccacccccaccggtattgcatgcaccgagatagtaatctgcatcaccatttttaatcgccatagcggcttcaatgtcattcatgatggtaattgcagtggctttgtctcccgctaattgtcgaatgccttcggctattctttctttttctatttgtccaccaacgacaaatttcatgttgtcctccctctctttttattttgtatcgaattgctgatttattgaaaaagctaattttcggaaaatacaggggttagaaaatttaagtcttagaaaagccgtgtcggaaaaattgtgcaggattatcgcgtaacatgagatctatctgcgtttgggaaaaatcggctgccaatagcatcggaacgaatacggttaacagataatcgaatccaattcccccgttactttttaaatgagaacggcgagtgatatcttgggagagcatcacttggctcagcaggccacgtttggcgacttcccgcaacatggcaatgcgcccgctgtctggatagtagttgtttttgccaatcgtatcgaattgtacccacgccccttcttcaagcaggggaataatcgtgtcgaggttatctttcagatcacaatgaccgatagccacatgtgcagcggaaacgccaaattctttgagcagagacagttgctcacgtcccattgtacttaaggtggtatgggtggagatagggcagccagtggcatgatgtgccagagcggcggctgcaaacactttcttctcatccgttgtgatttgatcaaggctggaaccaatttctgctatcacaccggcttttagcccagtaccgtcaatgcccgtttcaatttcagcaatcatatcgtcggcaatcgcctgtacacttaattcgctgaaatgaacggggaagaatggctctttatagtaacccgtcgaagcaatgatgttgatgtggctatcacgcatcaaatccagtagaaagctggcattgcgccccatgtagcagttggtcatctccgcgatgttccgtaggccaagggtataaaggtgacgaagttcatcgacgatcagatcgtattggtctaaccgacagtcgagactgcctttcgcaccagagagatcgatatgcagatgttcatgtacataggtatagcctgatgtatcaatacaggtattttgcttcgtgcccggatatgggttatttaattgattgtttgatgaatataacagcgtctcaccccgacgtttaacctgatattcttggtagcccgcctgtttgagtgcgtcttcagcttcatcaattctggatgaggaatacggagcggaatgtgtgggtgtattcccagtctgtttctggtatcccataaatatttctgtagcatcatgcggtaaatcgactagagcgaaaataacattatttaagggataaatgatattaactgtaatgccctgattggaaaattattgaaaataacctctgtttttccaatttccttggctgtcataaataccttcaagctttggtgagcctgattgaatgccggaaacgagcgctacgtcgctgcgggtgacaaaaatctgggtacggaagcacatgatcactgggctgccgatagggtggataccggatatcgggagatggtaatcaatgcagggatctcccagactcagtacccgcacggttttgggggagcgcgcacattcagggaaaaccagcgcgtatttcatatgcccacgtttatagtagccgccgccatagcagtaactgttgccgtcgtaatggtgggaaacctcggtgatatagaccattgagatcttttcaggttcgcggccactgatattggcgggtatagtgccggtcagggcatgtcccggctcaaggtgggtagcaccatattttgccagcagggggatggtattgcagcttgatgctgaaggcgcattgatttgtgagagttcaatgccaagctgttcaagtctgttgcgcgccctgaggagggtctgcaagttgatggtgggcagggttgtctgatatcggacattccactctaggcaggggaaatgggttaaaccgctcaacttaatgcccggcatggtttttaatatgtcaacggttgtatccagttcatcgaagaggatgcctgcttcctgagagggtaaggtgatatcacgcttatcaaacactttcagcatgatgggctgaacccgtcccaatttctctgcggcatctgagatcgcctgcgctttttcaatggaaaacaccgtaatgatacccggatgctgtttaagcatggtttctatcaggtgtgcaggggtttgtaccaaatgaccgatgtggcatagcggtatgccatgctgactcagggtatatgcctctctgaaatccacggccacgacaccggggtaaccgagttcaatgagcttttgagccagccaaggattgcgaccaatctgtttggtcatcaaatagagttcaacgccatattgctctgctgcttgcagcaaacgtcgaccattgtccaagacctgatcgacatcaatgatgtaagtgtctggtaatattgcgccttgctgccaaaggtcttttgctatttcaatcaatttggggttctgttttttcagagcattgataaacataggcttcccttcatggctgcaatgcggcacggctgtgtgaaagttaaaaaggctgagaaatccaaaatattcatttttttgaatatttatagtgtaaacaaaattcagggaattttggttgcaagtattaaaccatataaatttaccaacagatagccttcttcgttggggtgcagtgtgactgtgaatttttccaacaatgcgcgatggattttgaataattgcgcacagtgctctgactgctcgattttggtcaagatgttattttcaagtggcaaaacaatttcgccacgacgtgagcgcatgaaagcactcgccatgtgggtaagcgccatttcgccttgtggatgatggacagggattaaccagatatcttccagatcatgcacaatatcaagcatgttatcgtagatatcttgatcaatgacgccaccttgcaacaggatagttagccgttgttctaccattgctttttgttatacgtcaggttaattgtttgatttggcttaatgggcgtcaataaaccggttcgattgtgcctgcgaccacgttttgttgatgagtcagcagcacctcccgatcaaccatggtgtgcaggagctgctggatggggatgttgtccttacgagccaaaataacggcttcggaggctttgataaagcactcactgtcatccgggagctgagtcatcaaaccttgtgctatcagttcgtgaccttgcccgacgttccaaatggccgcatcaatgtggcctttcatgatttgattcaggcattcgtgataggagacctcgaccatttcaatctcttttccttcaaaatactgatttgtcattattttttggtctgctgaagtactgtccaacccaacccggcgaatggaatccatttcgccatgacgaaagattaatctatgcctgtctgtataactttgtgtccctagtgaaagcgcaatatataaatctttattttctgggtgctgctctgcggcaagtctcgacgttactgctaagtcatagatgccattcagtaagcattcaatgcggatgtctgagccacgcatatgtgcaaaataaaaaggaatctctgcacacaatacttttaaaccactggccagaccttcataggcacgggtataaggaagcggcatcgcgcagaccacattgccgatatcggcgtactctaagagtaatttatggttaatctgcgaaagaaagctgccattacgaccacgacgcttaattccaaccgcttgtgcctgttcaagagatttcaatgctgcttgcattaaacctacggacaatccacattctttagctagtaactcaatagttttcaggcggttgccacattgctcagagaggagataacgagctagaaacgattgtgcaatcccctcttttttaatgaatgtttgactcatcatagtaagcttttatccattctggcttatcttcataaatttgaacataaatcgcaataagcgaattatagaaaggggattaatatcacaattgaaaaaaaaatgaaaatttaaaaaagtaattaaattcaatattatcaatattttgaatatatatttaaatttgatactgaagatataaaaatcagcgttatgagagaatatagggaaatctgcgtgtagaccctatctgtctgctgtgtttaccttactggatggtgatttttgctacactatttgtcacgtaataaaatagtcagattatattttgcttattatttttttagtaatcaattggaaatttaagtgaaatagatgcattctttatctgttttatgttattactattttctctacgttattttttcatataaagaaaataataaaattaaatcaatatcatattggtttagtcataatatgtagggtacttttctgcttgggactggaaaagataatatttttataccatctcattccttttctttcataaaatttgatggctaatgtgttctgttccaatacttccagccaaagccattgtaacccctgttcctgaccgagtttgactatatggtcaaagacttgctcaccgtatttctgcccagtctgatgtggcatcagatggagtttatgcaaatagacgcccgttaaatcgctatcagggatcggttcatggaaggcgattttgccaaaaccaatcgggtgatcggtttcagcaataaaccacttgtgattgggggtgcggagtgagtccgatattcgttctggtgaacgctcttcggcgacatattcttccaattcggctttgttatgccacaaatgggaaaagtgaaaacgatagctttcctcaatgagctgggataacagcaccgcgtctctgattgtcgcttcccgaatggttaacatagagtaacctccaaggttatttattagggatcaggctatcatcggatatttcgttgatcagccgcttttcttccggacagtcaccgaaacctgcggcagtatggatatggcctgttcccggtaaaataattaaatcagcttttcgacatcctaccatgtcagtagaaatatgattatttaaataaccagttgaataaaattagaaattaagacatttcagtagaaaatagggatgattgatttcgaaactttatggtcattttcaggaaagaaaatgagcgggaagatacttttaggatagggatgaaaaagattatgcgcgaggaaagataaaatggcgataagagattatcgccattttttagcagggataggattagccttgtgcctggcttgattgaacgttctgtgccagccagtcagcaacacgttgtttctgttcatcggtcagccacatacccaatttagtccggcgccagatagcatcgtctaactgagtcacccactcatgttcgaccagataacgcaactcagcttcatacaggccgtggccgaagaactcgcctaaatctgtcagggcttctgcgcctttcaggattatctggcagttgctgccgtaagtacgggcatagcgttgtgccacaccttctggcagccagttatgacgctggcgtagcagacgtgcataaccatcgcgatcatggccttccagttcaccgcccggtaatttgccgtttttggtccacgccttacctgcgtttggatagtactgtaccagtttttccatcgcgtgttcagccagcttccggtaggttgtcagcttaccgccaaagacggacaacaatggcatctgcccctgttcatcctgtacatccagcgtgtaatcacgggtgatcgcctgtggtgaatctgattcatcatcgcacagtgggcgaacgccggagtaagtccagacaacatcactacggtcaagctgtttcttgaagtggtcgttatagactttcagcaaatagccgatctcttgatcgtcaattttgacttcttttggatcgcctttgtattcaacatcggtggtgccgatgatggaaaactcatcattccacggaataacaaacacgatacggttatcttcgttttgcagaatataggcttgaggttcatcatgcacgcgaggtacaacgatatggctgcccttaatcagacggataccgtaaggtgatttcagtttcaacccatcatcaaagaagtttttgacccacgggccagtcgcgttgactaaacctttggcgcgccatgtatcggttttgcccgtggtgagatctttcgcttcaaccatccagtaacccttttcacgccatgcgtgggtaacttgagtgcgggtacggacttcaccgccatgtttctggacttcctgtgcgttcaggacaaccagacgggcatcatcaacccagcagtcggaatattcaaaaccacggctgatggagggttttagcacggaatttgcaccgaactttagccccttgctgcttggcagactaacgcgtttacccaagttatcgtacaggaacaggccaatgcggatcatccaggccgggcgcagatgtggctgatggggcaggcgaaaacgcattgggaatgcaatatgcggcgctaatctcagtaatacttcacgctctgccagtgcttcactgaccagccggaattcataatgttccagatagcgcaggccaccgtggatcagcttggaactggcagacgaagtcgcactggccaagtcttgaccttccaatagcaggactgaaagtccccggccagccgcatctgccgcaatacccgcgccgttaattccgccgccgatcacaatcaagtctttggttcccattgcatccccctctgaaatgttcgaaacagttctttaatgctcgttttcgctcaaaagattgtaatcaaaatttcatcaatcgccaacctttaactaggaaaaaatctattcgcgtgatgcagatgacaaatttttatcatatatataagattaataaggaatttgtgggaagcaaattgagggcagaaatctgggagcaggggcttgcaacgggaagccccaccttatttatatttcaggtggggaaatgaataaaatgtggttagcacagttccaatttgacactatgctgctcaatgattttctggatgctgacaggaggtgctttatccgtgaacaggaaatcaataaggttcatgttgccgaggttgaccattgcactacggccaaattttgaatggtcggcaaccagcatcacgcagcgggagttctcgataatggcgcgtttggtacggacttcatggtaatcgaattccagcagggagccatcgctatcgatgccgctgatcccaagaatgccaaaatcaaggcggaactgggagatgaaatccagcgttgcttcaccaataatgccgccatcacgggaacggacttcaccacccgccataattaaccggaaatcttctttccccatgaacaggctggcaacattgaggttgttggtgacaatccgtaaatcccggtgattgagtagtgcatacgcgacggcttcgggggtggtgccaatatcaatgaacagggttgcaccatttgggatctgggtggcaacctgccgggcaatacgggctttttcatctgaccacatgattttacggtcatgataggcggtattgacggagctggagggtaatgcagctccgccgtgatgacgctggatcttatttttgtctgccagatcatttaagtcacgccggatggtttgcgggctgacatcaaagtgttcaaccagctcttcagtgctgacataaccttgaaggcgcaccagctcgattattgcatcatgtcgctgagtttgcttcacaacattcccctaatgttttgcatagatggattataattgaccaacgttatttggaatattattaatttttttgtttacgtaaattatcccatagccccatgagtaagccgatgattaaccctgaaaaatgagcggcattggcgatatttagtgaaaacatatcgaaatagccaaccaataaccagatgaccgagatagcgattaaccctctggggacactgatccctcttttgggggaaatttcaccggttagccaaacatagctgatcagtgcatagaccacaccagaaagcccaccaaaatgcgatccactgaacaatgattgtgcccagtcagtgaaaaccgcagagactatcgtaatttcaaagagttttccggcacccatattcctttccacctgactgccgagataccaccataacgcgagattgaacagaacatgtgtcagtgagaaatgcagcagggcagggctgacccagcgccataattccagatattgttcaccattaggccatgccagccagcgcatgacattggaatcacccgccgcctgcatccagagataaactaagatacagagagcggtcacggagatagtcagcgggccggactgacttttcagggtgctcaaattcaggctgttgtgatatttaaatgaataacccgatttgccagcttgccaactggcggcttgatagcgttcattgagtggatcgcgggaaaattggttaagttcctgctcaacaaaacctaaccggctttcatcttccagccacaactcaaccagcgcaggttcattggtagggcgcatagtcaagttaatgccctgtgtcgccatataatcaataaaggcctgagccagtcgtggattggatattgaggttacgtggatcattgcgcgttttatctgccttaagttgaagttaatcgcacagggctaattagattggaatcagtatgttaagaaactatagcgtgttaacggcctcaggatagcttctctgccatacgtcaaagccaccattaacactgtaaacggtttcaaaacccatattcacaaggtattgtgcggcgccttgactactgtggccgtgataacacatcaccatgacaggctggtcaaaatcagcttcttgcaggaggttattgagggtttcattggtcagatgaaatgcgcctgttgtatgtccggcacggaaactctgtggatcacggatatccaccataacagcagttttattcagccaatgctggtaggcttgttcagggtttattgtttgaaaacggtccataaatactcaacgttatttctaatactttccatttaaaggcattaatttcttaataatcgtcttttatgactttacgccttcccaacgtttccattggaaaggcgtggaaatactggctaaaaatgctaagaacagaaaaagggtcaaaaaatacaaatcaagaatcagtaataagagtgttcgccacgctggtgttcagtcaggtctctgacccctttcaactcagggaacatattcaacagctctttttctatcccttctttcaaggtgacatcgaccatagaacatccattacaaccaccgccgaattgcaggatggcataacctgcatcggtgatttccatcaggctgacacggccgccatgacctgcaagttgagggttgatctgcgattgcagaacatactcaacacgctcaatcagtggggcatcatccgtcactttgcgcattttggcgttcggggctttcagggtcagctgggagccaagttgatcagttacaaaatcaatgacggcttctaccagaaaaggggcactgatttcatcaacataggcagaaatctggtcaaatttcagttcggtatcagtggcttcaacagcatccggtgggcagtaggaaacaccgcattcagccgtcggggttcccggattaatgacaaaaacgcggatctgtgtgcccggttcttgacttgccagtagcttggcaaagtgcgcttgcgctgcttcagtaatattaatcatgtcatttgctcaatagttgactgtaatagttgactgttctagttggttataatacgcccatttataaaggaactacaaggttcggcatattgcccaggcttgcacggagtgggcaccagcacgaatcaacaattgtgaggcttcatgcaacgtcgtgcccgtggtgatcacatcatcgaaaatcgcgacattttgatcggtaaaatcgccacgcaattgaaaggcatgcttaagattggttttccgttgagtggcagataagccccgttgtgtaagtgtagcacgcgagcgccacaaaagatcgggctgatagtggcattgtagccagcgtgataacggctgggtgatcagttcaatttgatcgaatccacgttgccagcgttttttgctgtgcaggggaatgccgagtatacaatccggcttattccagcggccatcacgataaccctgcaaccaatgcaggagaaacagacgggctaataccgtcgcgagttgtggggtgccgtgatatttgtagcgctggataagccggcttaatggcggggcatagtccgtaatggcgatgagatgttgccacggaggtggattcttcaggcagcggccacagggaaaatctctcgattccgcaggcagagcacagcgcggacagacgcattgcagccgttttaattgctggtggcagatatgacagatcccatgatgagcaaaatacaaactttgatggcatagccaacagtatccaaccattgttagcataggttccttccttgatgacaaataagatgagaataacaatgaataagttgttttggcagataatgggtgaggctccacgcgatcttgtgatgctgcacggatgggggttgaattctgaggtctggcgttccgtggaaacgcgattggcttcgcacttccgcctgcatctggtggatttgccggggtatggtcgcagccagccgtatccggcaatgactctggcggaaatggcggatgccgtatggcagcaggcaccggataatgcgctgtggctgggttggtcgctgggaggattggttgccagccgtattgcattggatcatccggcgcaggtcgcgggtctgattaccgtggcatcttcgccaaagttcagtgcggaaggtgactggccggggattaaaccgactgtattgcaggcttttgagcatcaactgagtgaggatttccagaagaccgttgaacgttttctggcattgcagaccttgggcactgacagcgcacgtcaagacgcacgtttactgaaatctgtgatattgagccagccgatgccgaccgtggaagtgctcaatgcagggctggaaattctgcgtaccgatgatctgagggcagaactggcgcaactccggctacctttcttgcgtctgtatggttatctggatggccttgtgccgcgtaaaattgctgcacggctcgacaatgagtggccgcatactgattcggtcattatgcgtaacgctgcccatgcgccttttatttcccatcctgatgaatttgtggatgccttaatggagtttgtggttaacgcaggattgtgattgttgcttattacccataaccatcaagttatgggtaatcgacagtttattcggaaggataaacttcagtgacaatttcaggtgcattgaggatggtatcaagaacagggcagttgctttcgacaaaatcaataaaatcgcggatctcttgttcggtattatcggctttgatatagaatttggaggtgattttggaaaaccccattttggcgtttttatttctaccggtgaagccatcggtatccaattccccttccatttttacctgaatatcaatcaaattgattttatgtttgcgggcaaaacttttcgccacaatacattggcaagccccgaaagccgaaagtaatgcttccacgggattcattgcttcatccgttcctcccagatttttgggttcgtccacatggaaggaaaagccacgtgttgaacatttcattttgaggtggccggatgattctatttcagcagtgaataactctttaggcatattattatcctcaggttattaaatattgacagtactaacgcccagataataagagaacggtttttatttttcaatttatgtttggggaatgcgattttaacctttcatatggaaaaataaagcggtaaatatgaagaatatagcaataaaaaacagcagtaattcccgaattactgcccaattgggtgaatgagaatcgttcgaatgatggaaaaaaccagttgatacttattgttgcattacaaatgtaatgcagtatgcttgtaatacaattgtcaccacataaggattgatgatgagcactattcaagtaagggttgatgaagatctgaaaaaggcgtcttacaaggcttttgaaaaactcaatgtgtctccatctgacgcgttgcgtctgtttctgcgttacgttgcagagaatgaaaaactgccattttctgaagtatcgctgattgtggctgaaaatgataatgatgaagatattttagacgttgttcgtgaacgtatcagaaatccagccaaacgggttagggttaaccttgatgaaatttaatatcgacttcgacgaacgcgccttgaaggagtggcataaactggataaaagtatacgggagcagttcaaaaagaaattgcgtaaactacaagaaaatccctatatagaatctgccagattacacggtgatctggcgggttgtttcaaaatcaagttgtgttcgtccggttttcgtctggtctatcaagtgatagatgaagaaatcgttatttgggtcatcgctgtaggcaaacgagaagattcaatggcttatgatatagcgaaaaaacgtcttggtgtataaaaaaggggaattatatctcaagcggtattggctaactctctgagaatagcccgcctgattcaccacaccagacaggcatcccctcagttttttaccatcagttgatacaccttaatagcgcatttctgcgtttctggacattgcttgcagccgccgcttaggcaggaggaagtatcgacttcctccaatttgcccattgtgacgagttgcttgagcatggcttccaccatcggtagcggtgttgaaaactgatggctcagtgaccttgcatcggtgcgcccgttgagggcgacagcatcccggattttcaacaggctaatcatgtctggctcctagtggcaactactgtcagagcattcgcagcttcggcctgcggtgttattgaacgctatggtgactctgctgcgagcacggcgtaagccgataaagaccagtacgttaaatacaatcacggccagaatggtaatcaggctgctttgtggatgcgcagaaaatgtcgtgacttgatagaacactgccgccagcgaataagcgacatccaatccccacaggatggagaagagcatccagccacggctggtttcacgggcaatcgcccccattaccgaaacacagggtacgtacagcagtacgaaaatcagataactgtaagcggaaatggcggaaccaaatttagcactcatcgttcccatcgcgctgctatccatattgccatcgcctttactggcctcaatcgggttggaaagggcgctcagagtgaatgtctctttcaggctgttccatgtctccgcaacggcacctttcagttcatccagcagatggaattcatctggattgaatggcgcttggttgatgttctcagcggtatacagggtattcagcgtaccgacgacaacctctttcgccatcgcaccggtgatcaggccaaccgtcgcctgccagttatcggaatgtacgccgataggatacaggagtggtgtgatcaccttactgacagaagccagcgcagattcgttgatgttatccaccgctttgccagagaaggagaagctattcagggcgccaatcagcatgctggcagcaacgatcactttacctgcacggatcacaaaccctttcagacgctgccatgactggagcagcagggttttggcatgggggacgtgatagaccggcagctccatgacgaatggcgatgcttcaccgcgcatcagggtgtgtttgaggagcaggccggtcaggacagcgactgtgataccgagtatatacagagagaagacgatgctggcgccgcttttaccaaagaaggcggcagcaaagacggcaaagatggccagccgtgctccgcaggacataaaaggcgccatcatgatggtgatcagccgttcacgcggtgcgtccaatgttctggagcccatcacggaaggaacgttacagccaaagccgacaatcaagggtacgaaagatttacccggtaagcccagtgattgcatcagtctatccatcacaaatgcggcacgagccatatagcctgagtcttcaagaaaggaaaggaacaggtacatcaggccgatttggggaaccagtggcagtaccgtgttgatcccccccccaacgccttgggcaaggaaaaccgtcaaccaatccgggaagtgaagtgtgtggccgagccagcgcataccatcaatgaaaatggcggtggaagccccatcgaataggggttgcagcgcgccgccaagattgatagccagcacaaacatcagatacatgataaacaggaaaatcggcacacccagccagcggttcaagatcactttatccatcgcctgagtcagcttgtgcggtgtcgcggcacgggtatcaatgacagccaggcacagcgcattaatcgcttgatagcgtgaatccgcaataatcagttctggctcgtcaagctgctgttgttgcagacgcattttgctctcagcgagctgcgactgcgtcagtcctgctcgctcacggctgtaaatgtccccttccagcacctgcaaagtcagccagcggcgctgttgcggattgaaattctgagtcatctggctggcaagatgattgacttcctgcaacaaggaatcgggatattcaacccgtataggttgggaagacggttgataatggtcgatggtttccttcagtgtatcgatccccgtggcacgggtagaaaccagcgggataaccgggcagccgaggcgttgctccagcgccgcaatatcaatgttgatatgttggcttttggcgatatccagcatattcagcgcgacaatacaggggatgcccagttcaattaattgcagcgagagatagagattgcgttccagattggaagcatcaacgacattgatcaacatatcggcttcaccactgagaatgtagtggcaggcaatctgttcatcaatggaggtctgctccgaaatggtcgtgagggaatacgttccgggaaggtcgacaagctcgatttgatgctcatcggtggtaaaacggccggtcttgcgttctaccgtaacacctgcccagttacctacccgttgtcgggagctggtgagttggttgaacagcgtggttttgccggcattcggattaccgatcagacctattgttaattgtttcatcatactttttgccaatcagggaatgagactttctgtggtactttgttggtgactgtactgaatttcattcgagtggggtgttatctagtgtgataaacgccaagtcttttttacgcaggataagattgactctgcgtgtttcgatttgtacaggatcgcctaaaggagccacgcgaatgacctgaaatgtggaaccaggtaacatccccagtgacaataatttctgccgataggcggggctaatctgtgcagaaaaccccagaattttataacttcgatttggaagaagtgacatataaacttccattaaaactgaaaaggtaagtgattataagaattattatccctaatcaagcaggaaccacaagaaaaaagtacgtttattatttctgattttgattgtgagtgatgataataggcaatatccataatgtttatttatcactgaattttgatggaagaaattgatattaatcaaattaatggttatttaattgaaaataaaagacattgctactattggatattcaaattaatatttgtttgttgataaacagaatgaatggtttcaacgtgaaagatgaaatgaatacctgctattacaagccccgataacatatggggcttgttgatttgtttttttaattcattttatgaatgtatctgtttgccttttggtggatgtgccaattcacttagtggaacaaaaacgcggccatcatcttgctgattgtgccaaagttcggaatcgtatacccaccattcttgaacatctaattcataaaaccgtcggcggccatggccgtgaaattcactgagaggccgtgcttttttctttctgatattttcatcaggaaagaggaagttaaagtagtaatcgtaagtttcctgcagttcattgtacgggatttcgtgagcctggccgataaactgtgcccctgcaagatccagtgatgtgtcaggattgacccggttgcggtaaagcgagccactgactaatgggttgatagaaatttcgtgcgaatgacgggtaatcaatttcgaataccagatcaggcgtaatggatcgtatcttggaatatacagcagtgacgctgaccaaggtgagcctgaatcaggatggtgagtggcaaggctgaaaaatcgtatattgctgagtaaatcaaaactgcttttagcatatttattcataactttttcctcaacagaatgtatctgtatatcagagcattatggaattattaatctgttatatttttatattattcaataggctttcatgaatatgaaatttattgaatgatagattatacggagtattggcaggaatagtcagtcataatgactcattcaaatttgttatattagtaataaattgagtcaattatatgaaggcaatcgcatttttactgatgggatgagtgggaagaccgtttatttctcctaatgccatcatgttttgaaataaaaatatatttagtgataattagatggtgtcgtcatgagaaatttcgtgcaataataatgccccaccattccatcataagagttgattaaccatgagtacacctgcacaccgccgccacgatatttcagatcgcgtctggagcctgcttgaacctcatttgccaggacgtcaaggcgcttgggggcgtgtagctgaagataatcggcgttttatcaatggggtgttttggattttacggacgggtgcgccttggcgagacctacatactgattatggtgactggaaaaatacccaccgtcgtttttgtcgctggagagataaagggatatgggaaaaactgctcgaacaatgggttaatgaccccgatttcgagtggttaatgattgatgccagccatattaaggttcatcccgatgcggcaggcgctaaagggggtaatcaggatatggggctcacaaaagggggctcaataccaagatacatttggccgtggatgcgcatggtatgccggtcagaattattattacaagcggtaccacagcagattgttcacaagctgagaccttaattaaaggactcgatgcagagcatctattggcggacaggggctatgatagcaacgcaatagtagaaaaagcagaacaacaaggcatgcaagtccagatccctagccggaaaaatcggaaggccgccagagaatatgatcgtgagctctatcggcttcgccatttggttgaaaatactttccttcatcttaagcgctggcgtggtatagccactcgctatgcaaaaaatagcgcgtcttttcttgccgcagtgcaaatccgttgccttgttctttggctgaaaatctcatgacgacatcgtctaataaccccgttttaagtttgtgagttatctatttgttacgaataaggtctgttgaccctctaactggctcaaacgagccagttagaggatgattatctcgaattaacgctttttgccaaatgcagcagccagggcatcactcatggcgctgttggacaatgccgttgatcccggagagcgggaagtctggcggtttctgtcattaccattgcgttcgttgctattacgcgggttactgctctgagaaccgctacgacgtgccggagcttcgccgggttgctcatcaagacgcatagtcaatccgatacgcttgcgattcaggtcaatgtccatcaccttcactttcacgatatcgccagtcttgactacagtatgtggattttccacaaaacgatcagatagtgaggagatatgcactaagccatcctgatgtacaccgatatccacgaaagccccgaagttggtgacgttagtgaccgtcccttccagaatcatgccgacacgcaggtccttcatggtctcgacgccatcagcgaaagtcgctgtcttgaattcaggacgcgggtcacggccgggtttttccagctctttcaggatatccgtaacggtcgggatgccgaatttatccgtggtaaagtcctgtgcctgcaaaccacgcagggcaccaggattgcccatgagttcagacagggattgttcggtagtggccaggattttctcgacaacctgataggtttcagggtgaacggttgaggcatccagcgggttatcaccctgattgatgcgcaggaagccggcacattgcaggaacgcttttggccccagacgattcactttcaacagttgattacggttgtcgaagcggccgttttcatcacgccagttcacgatattctgggcaactgacttggagagtccggcgacgcgagtcagcagagcgaccgatgcggtattcaggtcaacaccgacgccgtttacacagtcctcaaccacggtatccagctttttggcaagctgagtctggctgacatcgtgttgatactgaccaacaccaatagattttggatcgattttcaccagttctgccagcggatcttgcaggcgacgggcgatggaaacggcgccacgcagtgaaacatccaaatcagggaattccagtgctgccagttcagaggcggaatagacggatgcgcctgcttcactgactatcactgtctgagctttgacgtcagggtattgcttctggatgttggcaaagaagcgttccgtttcacgggatgccgtaccattaccaatggcgaccaactcgacttgatacttggtgcacagagcagcaacggcggcggcagctttgacttcttgcccggtatgcgggtaaacggtatctgtggcaatcagcttgcctgtagagtctacgacggcaactttcacccctgtccgtaaccccgggtctaatcccatcgtggcgcgcatgcccgcaggggcagccatcatcagagcgttcaggttacgggcgaaaacgttgattgcttcgtcttcggctttctcgcgcaacgtccccatcagctcagtttccagatgcagcagcaccttgatgcgccatgtccagctcaccacggctttacgccaactgtcagccggcgcgttattcagccgcaggttcagatgatcggtgataatctgttcgcaatagctctctttaggggcttcctcaaattgaggatcggcattcagagccagttgcaggatgccttcattgcgcccacggaacatggccagagcgcgatgggatggaacggtggcaatcgattcatggtgatcaaaataatcgctgaacttggcgccttcctcttccttgccttcgacaactttggcgaccagatgcgcattcttccacagatattcgcgcactttcaccaacagagccgcatcttcggcaaagcgttccatcaggatataacgtgcgccatccagtgcagccttggtatcggtaacgcctttgtcagcatcaacataggcggctgccgccagttctggcgtttgttgcggatcttgccacagcaggtcggccagtggctccagcccggcttcaatggcaatttgcccacgggtgcggcgcttgggtttatacggtaagtacagatcttccagttctgttttactctgcgtggtattaatcgtctctgcgagctcaacggttaactttccctgttcctcaatagatttcagaatagtctgacggcggtctgacagttcgcgcagataacccaggcggctttcgagttggcgaagctgagtgtcatctaaacctccggtggcttctttacggtaacgggcgacaaagggaacggtattcccctcatcgaacagagtaatggcggcgagaacttgctgtggctgagcctgtaactcaccggcaatgattcgacttaaagattcattcatggtttggtttcttcaactttcttagcggctgtagatatcatcagatattgcacagacagtgccagattcatctaacataataatggcatggttcaaactggctccatttatacgtgcagagcgcgataatttccagtttagcgcgatatttcggtcatgttgagacagatttcatcgaatatcttatgggttaagatatagtactccgccattaatcatattttctcaagtgggttttttcatggctaagagtaactacattacccgagaaggctggcatgcgcttgatcaggagctgaaatatctctggaaagtcgaacgtcccaacgtgactcaggctgtttccgatgctgcggcactgggagaccgttcggaaaatgccgagtacatttatggcaaaaaaagattaagagaaattgaccgtcgtgtgcgatttttatccaagcgtcttgatgcactgcaaattgttgatcctgatccgagacaggaaggcaaagtcttttttggtgcatgggtgaaagtcgaaaacgaaaaagccgaagaacatatttttcgtctggtggggccggatgaatttgatcctgccaaaaagtggatttccattgattcacctgtggccagggcgctgcttggcaagcaggtggatgatgaaatcaccgtcatgactcccaatggtatggcgatttactggattctggagattggctaccagccgttgggggttagtctctactgaagtttggggtttctgtgagagtaatggatatggcgggcatggagcatcttgggagctgaaacatgcaagagagttataaaatccttgttgttgatgatgatatgcgcttgcgggcgttgttggagcgttatttatcggagcagggttttcaagttcgtagtgtagcaaatgcagaacagatggatcgcttattaaccagagaatccattcaattgattgtactggatttaatgttgccgggcgaagatggcttatctatctgtcgaagattgagaagccagcataacccgatccccattatcatggtgtcagcaaaaggggaagaggttgaccggattgttggccttgaaatcggtgctgatgattatctcgtcaagccttttaacccacgcgaactgctggctcgtatgcgggcggttatgcgccgtcagagccatgagttaccgggggcaccaaggccggataatgcggtagtgaagtttggcaaattcaaactcgatcttggaacgcgtgaaatgttccatgaagatgagcaattgtccctgaccagcggcgagttttctgtattgaaagttttggtttcccatcctcgcgagccattgtcgcgggataaattgatgagtctggcacggggaagagaatatggtgcaatggagcgctccattgatgtacaggtttcccgtctgcgccgcttgattgaagaagatcctgcccatccccgttatattcagacggtctgggggctgggatacgtttttgtgccggatggaagcaaggtatgaaaaggctctggctctcgctgcgcgctttgttcccccatgttctgtatttaactttggtaattgtgctgggcagcctgatgatcagttatctggctgcccagagactggtagagatggaaaaactctcatttgccatcgtgttctcttatgtctttgccagtgttttcacggctgctttgactgtttccatcccattctggttttacctccgcgcccagatacagctattgagaacgatgcagaaggcagtgagaaagatggaaaaagggaaaatcgttgcaccactccctgaagcgggagctccggccatacgctcgctgatccgggcgtttaatcaaatgttaacgggacatacagcgctggaaacggatcgcgctagcttggtggcgggtgtgagccatgacttgcgtacgccactgactcgtatacggctggcgatagaactgatagaagggaaagaaaattttctgcgggaatctatcaatcgtgatattgaggagtgcaatgcgattatcgatcaattcatcgattatcagcggtctgggcagaatgtgccaatgtcatgctgcgaattgaatgggctgcttgacgaagcgattactgtcgaaaatgacggtgtcggaaatatcgaaagtcacctgtcagccaaccccgttttcattatggctaatccactgtcaatcaagcgcgccttgaacaatatgttcactaacgcccaacgctatggacagggatggattcgggtcagtagtggcgttacggagaagtctggctggtttcaggtggaagataatggcacagggatgacagaagaagagagcgctactctgttccagcccttcacacaggggcaacgcgttcacaataatgggggtgtaggcctggggcttgccatcatccgacgcatcgtcgatatccatgatggtgacatcgaagtcggaaaaagcgaaaaaggtgggttgtccatgcgcgtttatatcccacgggtgacgaaataataacgccccttcaaaaggggttgtcataaaaatgtcatgattaatacattttactgtcattgaattaacctatttttcccctgaaccattttttcagataaaagcaaagttgttgacgtagtttgacgcttgtttttaattaatgatgcgtatcccagcaggagggagtatgaaaccaatgcgtaccaccgtggcgagcatcatggcagcagcacttgccatgacatccctgtcttcgtttgctgcttccagtctgacgggggcgggtgcgacattcccggcaccggtatataccaagtgggcagattcctaccaaaaagaaacgggcaataaaatcaactatcaaggtattggttcttcgggtggcgtgaaacagattattgcccataccgttgattttggtgcatctgatgccccgctttctcatgaaaaactcgcggcggatggcctgttccagtttccaacagtgatcggtggcattgtgttggccgtgaatatttctggcatcaaatccggccagttggtcttagatggcaaaaccctcggtgacatttatctgggcaatatcaagaaatggaatgatccggcgattgccaaactgaatcccgacctcaaactccctgatcagaatatcgccgtcattcgccgtgcggatggctctggtacttccttcgtcttcaccagctatctgtccaaagtgaacagcctctggaaggaaaaagtcggggtgggttcgacggttaaatggccggccggcttgggtggcaagggtaacgatggcattgccgcgttcgtccagcgtttgcccggttccatcggttatgtagaatacgcctacgcgaaacaaaataacctcgcttataccaagctgatttcggcggacggtaaagtcgttgcgcctactgaagcgaatttcagtgctgcggcgaaaggggcggattggagcaaaagtttcgctcaggatctgacagcccagaaaggtgacaatgtgtggccgatcacctcaacgacttttattctgatccacaaacagcagaaaaatgcggcgaatgggattgaagtgctgaaattcttcgattgggcttatgagcagggcggaaaacaggcgaaagatctggattattctgtcctgccgcaagaagtcattggacaggtacgtgcagcatggaagcgcgacataaaagacagcagtggcaaaccgctgtactaaattatctttatattaaccgttgttgaatcggtcactttgattcatccccctttgcgcccttttgctgagggggaaattaacccaaatgagaattaagcgtatggccgaacgtaaaacggcactgaaagcaccaagcaaaaatggcgatattattttcagcgcactggttagactggctgcgctgatgacgttatttctgctggggggcattatcatttcgctgattattgctgcctggccgagtatcaagacctttggttttagttttctatggaacaaggattgggatgcgccggcagagcaatttggcgcactggtgccgatttatggcacattggtgacctcactgattgccctgattattgccgttcctgtgagttttggtattgccctgtttttgacggaactggcacctaactggttgaaacgtccgctgggcgtggcgattgaactactggccgcgatccccagtatcgtttatggcatgtgggggctgtttgtctttgccccgctgttcgccacttatttccagcaacctgtcggtgatgtgctgtcgagtattcccatcgtgggagaactgttctccggcccggcttttggtatcggcattctgacggcaggcatcattcttgccatcatgattattccttatatcgcttccgttatgcgtgatgtgtttgagcaaacgccggtcatgatgaaagagtccgcctatgggatcggctgtacaacctgggaagtgatttggcgtatcgtcctgccttacaccaagaatggcgtgattggcggcgtcatgttggggcttggccgggcgttgggggaaacgatggctgtgacctttattatcggcaatacctaccaacttgacagtctctccctctacatgccggggaatagtattacttccgccttggccaacgaattcgccgaagcggaatccggcctgcataccgcggcattgatggaactggggctgatcctgtttgtgatcacctttattgtgttggcgttgtcgaaattgatgatcctgcgtctggcaaagaatgaggggcgctgagatgacaacgggcaataatcatcagccacgtgcggttggcgcgataaatacggcggagatgaacaaccgtcgccggatgcaggcatggcgccgccagaaaaaccgtattgccctgttgctgtctatggcaacgatggcatttggcctgttttggttgatctggattttattctccaccgtcaccaaaggcattgatggcatgtcgctggcactgtttaccgaaatgacacctccgcccaacaccgaaggcggcgggctggcaaacgccatcgtcggcagcgggctgctgattttctgggcaacggtgttgggtacgccattgggtatcatggccggcatctatctggcggagtatggccgccgctcatggctggctgaagtgatccgttttatcaacgatattctgttgtcggcaccttcgattgtcgtcggcttgtttgtttactcggtgattgtgacaaaaatgcagcatttctccggttgggcaggggttatcgcactggcgttgctccaaattcccatcgtgatccgcacgaccgaaaacatgcttaaactagtaccggacaacctgcgcgaagccgcctatgcgctgggtacaccgaaatggaaaatgatctctgccattacgttaaaggcttcgatatccggcatcatgactggtgtcttgctggcgatagcccgtattgcaggggaaaccgcgcccttgctgtttacctcgctttccaatcaattctggagcactgatctcagtcagccgattgcgaacctgcccgttaccatcttcaagtttgccatgagtcccttctctgactggcagcaactggcgtgggcgggagttttactgattaccttgtgtgtactgctgatcaacattgtggcgcgtgtgctgtttaagaataaaaagcacggatagaagcactgatattttcaatatgcaataaaaaggcatttaagagagaaacaactgatgaataaggctaacgacattgcaggaagaaaaatccaggtacgtgatctgaacttctattacggcaaatttcacgcgctgaaaaacatcacactggatattgcgcagaataaggtgacagcctttatcggcccgtcggggtgcggcaagtccacgttactgcgtactttcaacaaaatgtatgaactgtatggcgaacagcgggcagaaggcgaaattatactggatgacaccaatatcctgacggataaacaagatatcgccctactgcgtgccaaagtcggcatggtgttccaaaaaccgacaccattcccgatgtccatttatgacaatatcgcttttggtgtgcgtctgtttgaaaaactgccaagggctgaaatggatgaacgcatccagtgggcgctgacaaaagccgcattgtggaatgagaccaaagacaaactgcaccagagtggttatagcctttccggtggtcagcagcagcgtttatgcattgcccgtggtattgcgatccgtccggaagtcttgttgttggatgaaccgtgctcggcacttgacccgatctccaccggacgtattgaagagttaatcagtgaattgaaatcggaatatactgtggtgatcgtcacccataacatgcagcaggccgcgcgctgttctgaccacactgcatttatgtacctcggagaattgatcgagttcagtgacacagacacgctgttcaccacacccagaaagaaacagactgaagattatattacaggccgttacggttgatatggagccatatagcgtatggacaatctgaatcacagcaaacacatttccggccagttcaatgctgaactggaacatattcgcactgaattaatgacaatgggcgggctggtggaagaacagctcagtaaggcgattctggcgatgcacaatcaggacggggagctggctcggcaagtcatcgaagatgaccataaagtcaatatgatggaagtgacgatcgatgaagcctgcgtccgtatcatcgccaagcgccagccgaccgcgagcgatttgcgtctgattatggtgatctccaagaccattgcagagttggaacgcattggcgatgttgcggataaaatctgccagacggcgctggaaaaattctcgcagcagcagcagcccttgctggtcagcctggaatcgttgggacgccatgctatccagatgctacacgatgtactggatgcctttgcccgtatggatctggaagaagccatccgcatctaccatgaagataaaaaagtcgatcaggaatacgaaggcatcgtccgccagttgatgacttacatgatggaagatcctcgcaccatcccaagcgttatgaccgcacttttttgtgcccgctctattgagcgcatcggggatcgttgtcagaacatttgtgaatttattttctattacgtcaaaggacaggatttccgtcacgttggcggtgatgaactagaaaagctgctcaccaaagaccaatgatcttaactgcctgaaacgcgggaattttattccggcgtttttggctttcttattcctaaagatgataaacatatcattttatattatttcaagtgctatattgaaattgatagcttttgtcggacaataaatattttattaccaacaggggtgttcaatgaaatttcgcaatcaatcccgcgtagcggctgttgcgctgctgaccagtctggcattggtttctggtgtggcgaaggcagataaacttgatgatattaaaaaagccggtacggtacggattgcggtattcgacagtaacccaccgtttggttttatcgatccgcaaacgaaaaaactggcgggctatgatgtggacatcgccaacgcgatcgccagtgatctcggtgtaaaactggaactgcgtccgactaacccagctaaccgtattcctctgctctcttccaagaaaattgacttaattgccgccaatttcacgatcaccgatgagcgtgccaaacaggtcaatttttccatcccttattttgccaccggacagaagttcattgcccgcaaaggtgtcctgaaaaccccggatgatatcgccaagctgcgcattggggcagataaaggcactgtacaggagatcactctgcgtgagcgttatccgacagcaaaagtcatctcttatgacgatactccactggcatttgcggccttgaggaatggcaacgttcaggcgatcacgcaggatgatgcgaaattggttggcttgctggcaaacgtaccggaagcgcaaaaagcggattttgaaatctcacccttcagcattacccgtgaatatcaggctgtagccgcgaccaaaggggaagatcggttgattgatgtggttaaccagacgctactgaaactggaaaaagagggtgaagcggagaaaatttacaatcgttggtttggcgctgagactaaatcggctcagccgcgtggtgatttcaaattcgccccattggatcgtcaggcaaaaccttaatctactttaggaaaataacgcctgaaactagccccgtttttgcggggctttgctgtttgtttatgcggtgaatgatatgtttgagcaatttattaccgagcacttactggctcctgagtatctgcgatggctctggcaggggttcctgatcaccttatggctctctgcctgcaccatcatttcttcgaccttactgggcttcatgattaccgcagcacgggacagccagatcaaaccgttgcgttggctggttacggtttacaccacgatattccgcaatacacccctgttggtacaactgtttttctggtatttcgcctccggccaaatcttaccgcaggccgccatgatttggctgaatacctctcatgaaatccccattgcgggtctgacattggcatggccatccttcgaatttctggcggggtttattggcttgacgctctattccgcgccttttgtggctgaggaactgcgggcaggcattcagggcgtcggccgtgggcaaaaatacgctgcccatgcattggggttaacgggctggcaggccatgcgctatgtcgtgctgccgcaggcattgaaaatcgccatgccacccctgttggggcaatacatgaatattgtcaaaaattcctcattgacgatggcgattggtgtggcagagctttcctacgcttcccgtcaggtggagacgcaatcactgcaaacctttgaggcgtttggtgtcgcgacggtactttatattgccattattgcggtgatggaaggttggggacagtggcgtcaacagagagcactggcgaggggatactgatatggactttaccgttattacggaaaactggcgctacttgttgctcggcacctttcctgatgggccgttggaaggcgcggcgctaaccttggtgatcagtatcatggcaggggtgatttccattgtcttgggtacggtggcaggtattgcgctggcgatgttgcgaggcttctgggttaacctgctcgcggcaatattgggcttcttccgtgccattcccgtgattatgctgattttctggacttactttctgctgccggtggtgctgggaatggaaattcccgaaatcaccactgtggtctgcgcactggcgttgatcacctccgcttatctggcgcatggcgtcaaagcgggcattctggcgattggtgaaggtcaatggcgggcagggttatcgctgggtttcaaccgttgggaagtgttgtggcatatcgtcttgccgcaggcattgagaatgatggtgccgtcatttattaaccaatggattgccttaattaaggatacttcattggcctatattgtgggcgtggcagaattatcatttttggcaacacaggtaaataaccgtagcatggtatatccgatggaagtctttttatttgttgcgctggtttattttgtcatgtgtttatcactggagctcattgccaactctgtcgcccgccgtttttcgatacaacgggaaagaacaacacgtttcggtttctggcgtaaaaaagcattgatagtggttccaaaagttaatatttgagcctggtcagatattttgtggttgtattaatcctttgttgttaaggcaggggatttttttataacaagctaaaaaaactgtagattatactgtttactcgtctgattttcccttaaaaaagccaaaagttttatatatatgactgtgtgatgttttgaaagataataggtgtttttttgatgcaaaacctctctataatggttaaatatgaatcaggctaatcatggcaaagggttaataaaatatggcaaattcgatttatgtgacaattaaaggaaagcttcaggggctgatttctcagggatgttctacactggattctattggcaataaattccagttaggtcatgaagatcagatttttgtattacaatttaatcatggcatttctcgtgcacaaaacgttgcacatcagcctgttaaatttattaagcttctggataaatcgtcaccattactactgatggcaatttcaaacaatgaagaacttgatctcatgtttgatttttaccggacttcgcaagcgggtgggcaagaacgctattactctgtcaatttaagaaacgcaaagctattaaatgttaatgttcaatatccacattctgtgaatcataacgatcggcagccagaagaggttgttgcagttcaatataaagatattgtttgccaacatcatatagcgggtacatcagggtattgtgtttgggaagaaaccgtttattaagtcgtataaattattttaaaactgtatacaattaaataatcatgagtggtgattaaaatgcaatttgacagccttacatcacaattaagaaatgaatttgatgaaagtaagctaccagattttcagcatgccagaatgtttggttccatacatcatggtgctgacaatatcgattttcagattattgctgatgcattggattgccaccgtgatttttatggtgccggaattatttattcagatgggttatttaagcgttatttggtcaggccatcaaaaagacgtggaagccctgttttttctgagttaacacatattattatcttcaatcttgaagcaggcaatgctccagaagctgagctgacaaaaacggtttctgaaccgagtctggtgtgggaaattggatcgacggcgctttcatgtggtggggctgtggcatttttgttaacaacggctggctctggtgctgcgataccctttactggaggggcaagttccgcaggtgtagtcttggcttacgctgggtttactgcgagtagtcttcaatgtatgaatggagcatacagaatttataatcttactgggaaaggagacgaaggcgtggagcatattggttggttggattcacaggattggtatgtgaccacgacaaccctcttagatatcacgtcccttgcttctggaacagcagctttaaaagaagcctatcaaacttatagggtaatgaaagccacttcttctcgtcgtgcagcagaatggttgaacaagatgccacggtatgaaaaaaaacgattaacagaggaaattatacggtatcataatcctggaatttctaatcgagaaataaaaaatttaatatattcggggcaatatcctaaacgttatccaacggaacaaattcgccaaacactcaaaaatcatttaataaatacactttcttcaggtggtgctttcgctggtagtggaatgactggagtaatcaggaatcctgcaagtatagttacatcaggtaattatataattggtgcaatttattctattgctgttgaaaaacccgcgagttatatttcaaatggatattaataaaaagagtgataacacgagaatcttcatgagtataaaagaatttatctataatgttagattgaattctcttttaatagaagtgatgaatctagatcgtagattgaagataaatgactcatcattaaaagaagaaattggatataaacagtttaaatatcattttaatccagttacgtcgaaagtgtattttctattggggataattggatttagtttggtcttatcatcttcaatgcttttggcggttctgatttcttatgtaatagatagtggagttaataagttagctatcattccatgtatgttattggttttttctattctttcattaatattttttagttttttatctttagggaagggaggtaaggaaggaatttacatacatcgtatactatatcaatctatattagtcattagtgttttattattattatttgatagttcgccatttttacattttttttattatgcattagttatggctttttctttattgattaaatttattatgaatagttattcttattttaatgcagtaagagatatgaagcttttcagaattgctcatgtttttctgactaaagatacgcaagaaatattaaacatgcctcggaaagagtctaaaaaacgcattaaagaagttgaatttcagagacggcgtgagattaaagagaagaaaagagccaaagaagcagcaggaaaataaaatttatatacccatcgtcattggagatgcttgatttctaattcaaatcagataatgctaaccaacatgaaaaagatgcccagacatgagaggaaacggctaactgaagaaattatgcgacacaataattcaggagtatctaaccaagcaattaaagatacgatagaacaggggtggtacattaaacgttatcttatagaatctatacagaaggcattgcggaaccatctgagagattttctcatcgcaactggtgggtttgtaggtagtggaatgacaggaacaattaggaatccagaaaatatattaacgtcaggtaattatatgattggttcgatttactctattgcttacggaaatcctgctagttatttatctgaatgattctaataattatattgattacatgaatacattgattgtgataacgactatatgaatatgaaagattttattttaaatacagaatttaaaaaactcttgggtaaggctaaggatctggaagcaaaaataaagaatgctgatccagtgttaaaaaatatcacgttgaatgatcttagttataataaatatttttcttaccctggtcggtttaagataggttttataatattttttattatgatagtttatatggcttttttttcaggtgtagcggtagctatacctagtttattaatagaaaatacaagttatgaaataaaagcattttcttttgttttgtcattaatgcttagtgcttttatttcattttctcatattggtcttactttaagtggatactattatggccctgttatccaaaaatatacaaatactgttgtattcttttttagtttgtctatgtcttatttgaaaggagtgtatgactctgatttcttttatttttctgctatagcgttatgttgtttgtttatcaagttaatgttgaatggtaaatattattctggttttatatgggctaaaatgtgcatcagggttgaacgtattgtttttaatgatgaattggataagataaaaggatttaataaaaagcagttaagggaatattcaagaactataaaatcgaaaaagcgtaagaaataatagataggaaaagaaagaaaatagaaccgaatggggaaagctaaatggacataaaacatatattaactaacaaccaattcagaagtattttgactctgtataaaatcacagataatagaatcagaaatagtgattctttacttgtcgacgcaccggatatcgtcaggcttaagggtaaaataatgtctgccaatgaatctccacaaaaatcattatgttatttaactcattgattgtgcttgccgcaatcgtttactttttttaccttttcagggtaacgatttgaataagtttcctgtaggataggtcgaaaacttcgttttttgggaataaatattatatgagcacactcaattctggctctgcaaatcaacagggtctgcttcagcgcgtgtttaagttagaggaacatggcacgacggttcgtaccgaaatgatcgccgggtttacaacctttctgactatggtttacatcgtctttgtcaatccgcaaattttggcggtggcgggaatggatatcaaagccgtatttgttaccacctgcctgattgccgcatttggcagcattatgatggggttgatggccaatcttcctgttgctgttgcgcctgcaatggggctgaatgcgtttttcgcttttgtcgttgtcggggcgatggggatttcgtggcaggtcgcgatgggggcgattttctggggtgcggtagggttgttgatcctcaccatttttcgcgtccgttattggatgatcgccaatatccctttgagcctacgtgtcggtattaccagcggtatcgggctttttatcgccatgatggggctgaaaaatgcgggcattatcgtgccaaatccagacactatcgtctcaatcggcaatttcgcttcccataatgtcctgctgggaacattgggcttttttatcattgccattttggcagcgcgtaattttcatgccgccgtactggtttccattgtcgtcacaaccgtcatcggcctgatgatgggttatgtggagtatcacggtatttttgacctaccgccaagcgtgatgagcgttgtcggaaatgtcgatgtcaaaggtgcgttggatatcgcattgtccggcgtgattttctctttcatgctggttaatttgtttgattcttccggtacgttgattggagtgacggataaagcgggtattgcagacagtagtggtaagttccctcgcatgaagcaggcgctgtatgtggatagcatcagctcggtagcgggctcttatgtcggaacgtcttcggtgacagcctatatcgaaagctcttctggggtttctgttggcgggcgtaccgggctgactgctattgtggtgggtatgctgtttctgttggtgatgtttgcttccccgctggctagtatggttccggcgtatgccactgcgggagcgctggtttatgtgggggttttaatgacctcgagcctgacacgggtaacgtggaatgatctgactgaatccgttcccgcctttatcactgcggtcatgatgccattcagtttctctattacagaaggtatcgcgctggggtttatcgcttattgcgccatgaaactgggaacggggaaatggcgtgaaatcagtccttgcgttatcgtcgtgacattattgtttgtgctgaaaatggcgtttgtcgatgctcactaactagcagggatgataagaaaaagcctggtattcactaccaggcttttttttagttatcgttactgattattttcaggggcaacgaaaccgatacagacggtttcagttttggcactcggctgtggctggaaggagaattcttccttgtagctgatgaccaacactgaccattgcttgagtgtagactggaagttttcctgttcgcagctcttacctttctctcccaccaataacgcaccctttttcacaatattgctctctttgatatggcgattatacacattagggggctcgccattacctaactcccaaggctgtattgtttctgggcggtaatgactgtaaaacgtcaaccattgatgcaagtattcaccaccaacataatgtagtggggttgggtaaagttcattccagcgctgatccagctggctggtgaacgtttttatacctgcgaatttttgccctgcaccacggacattggctatcatcacactgatataacccacccaaaccaatagcgcacatattgccaaaccccgcagcgtatttttcaggggtttgcgggggagtacagtcagtgaaccgacgagcagcgcgggtgctaccgtcataaatggttgtagccattcggtcattcgcccgccctgattgaaggaaaaccagccataaataatcagcaggggcagtaggataacgatattgaccagcgcattggattgctgtttcggccagccaatccgtccgcctgacaggtaaataatcgtactaacgataatcaggggatagaacacggaaagtaccgcgcgcgtggtatgcagattaaatccttgctgaatctgggaatctacccatttaaacgcggcgaagtcgttatgcaccagccaccagccgttgggcaatatcagcatgaaccagagtgcgatagcgagataaaacaggggctctttatagctacggcgcactttgggtacgaacagagagagcaaaaagacggagccaatgatagaaagtgaagaatatttccccattgttgccagccctgtggtgagggcgaatgccagccaccatttgggatgatcgtcaatggcccgcaggaaaaatagcagtgcccacggccagagcatgactaacagataattatcattataaggaatgatatcgaagttgatgatgccggacagattcagtgtcagcatggcaagccacgccagttcaactttacctgtcaaccggaaggctaatcgccagacacccagcattccgatagcaatggcaacaaagtgggtgaaataccagtaaaaactgaaggaaattgtgctgatgtgtatggcaggtagcatcactgtgcccaccagccacggatttttgggtgagccccactctccattcatcccccaattcaaggcttctacagcatcataaggtacagtggggtcgagtgagtagcttgcgattacccacaaaagcgcatagcccgtgatccaaagaaacaacggcatgcgataagacgaagtatcaaaaaaacgcatagcggcaaatgatcatattaattgagttaaagttccgtagaatattagctgaattttgaacaattagtgaatgacattggatgttataggtggtttctgttagattccgcgaaaaatattctgattaagcgagtagggtcacaagctatgaaccagttaaagaaaaagtcaccagcgaaattttcggctggtaagcaaaaaagaaaaagccgcgaagagttgaatgctgaagggcgtgagcgtaaacgccagaaaaaacacagtggtcacccatctggcaaccgtaatcacggtaatgacagtaacaaaaaccgttctggagacaagccggggcaagatccgcgtatcggcagtaaggttccggttcctttgattattggcgaaaaagtcgtggtaaaaccggttgtggaaaaaccgaaagccagccagaagccccgtctgtcaccacaggaagagctggcaatgctggaacaggatgagcatctggatgagttgctggcacgtcttgagaagggtgaagagctctctcaggaagaaaatgcttatgttgacgagaaacttgatcgtatcgatgagttgatggaagagctgggcattaatctggaagaagatgacagcgaagaagagaagaaagaagatatcatgcagttgctgaagggtaagtaatcccagcataaatttgtcgcgatcataaaggtagattcattctgataaccctacttataaccacagtattagtatgttatttattgtggttattgggtaaactatggcagctattgagacgtaaaaatcggttgagtcgtgccatcggaacacagcgctgcaattcggtaaaagcgttgcgtttcggggggcgaaaacaacggaaggaataaatatgtcagagcaagccattgtttgggatttacctttgatccagaaatacaactattcagggcctcgttacacttcatacccaacggctttggagtttaaccaacagtacgataatactgcttttgcgcaggccgccgcgcgttaccccgatcgcccactttctctctatattcatattccgttttgccacaagctctgttatttctgcggttgcaataaattggtcactcgccagaagcataaggcagatgactatctgaatattctggaaaaagaaatcacggcacgagccagattattctcccagaggaaagtcagccaaatgcattggggtggcgggacgccaacttatctcgacaaaacacagatcagccgattgatgtcggtgctgcgtagccactttgattttctgtcggaagccgagctttctattgaaattgatccacgtgagatcgagttggatgtgattgaccatctgcgccatgagggttttaaccgcctgagcatgggagtacaggattttaataaggaagtgcagcatctggtcaatcgtgagcaggatgaggattttatcttcgaactggtcaatcgcgcccgcgaaacgggttttacttcgaccagcattgatttgatttatggcctgccgaagcagacatcagagagttttgcctttacattgcagcgggtgctggcgttgtctcctgatcgcctgagtgtgttcaattatgctcacctgccggacttatttgcggcgcagcgtaaaatcaaggagcatgatttaccaagcgcagaacagaagctagatattttgcaggacaccattgctaccctgacgggcaatggttatcagtttattgggatggatcactttgcccgccctgatgatgaactggcgattgcccagcgagaaggtgttttgcatcgcaattttcagggatacaccactcagggagagtgtgacttattgggcatgggcgtttctgccatcagcatgttgggcgatagttattcccagaatcagaaagatctcaaaatctactacgcggcggtggaagaacagggtcatgctttgtggcgtggtttagtgctgacacaggatgactgtattcgccgtgatgtgatcaaagatcttatctgcaactttcggctgacttttgcagatatcgaacagcgttatgggctgaatttcgccgactattttgccgaagacctgcaactgttggctccgctagtggaagatgggctagtagatatcacggagaagcagattcaggtattgccaaaaggacgtttgttgatccgtaatgtctgcatgtgctttgatagctacctacgtaatcagatgcgccagcggcagttttcacgggtgatatgaagaatactattattaacaaacgatgaagcaatattaacgcaattcattgatctatcagaatactgtctcagtaatagatgctatctattactgagaggcttttaacctgagactcggatattctggttaccagagttaataatgtaaaaaggtctgatttgagtcagtaaattaatcacgattctatccccaactccttcaatttccgggtaatcgtattccttccccatcccagcaaacgtgcagcttcttgtttatggccgtttgtatattccaacgcacaattgagtaaggtacgctccagcaacggcaaagcatcggaaaggagatcagtgcgtccctcttttaaggcgttctgtgcccactcagccaattgtcgcggccagtgttcaggtagtgcagaacgggaggagggaaaattgccgattttttccgttgtagggttctcaatcagatcggcaggcaaatcttgtaccagcacttctttgctggctgccatcactgtcagccagcggcagacattctccaattggcggacattccccgaccatggcagatgcatcagggcgatttcggtatcgggatgaagcaccttggcctcgacgcccaattctttggcagtctgttgcagaaaatggtgtgccagacggggaatatcttctacgcgatcccgcaaagggggtaattgaacacgaatcacattcaggcgatggtagagatcttcgcggaacttaccttccgtcacccgctgttcaaggttctggtgggtggcggcaataatgcgcacatcaacttttactggcgcgtagccacccacccgataaaattgcccttccgccagaactcgcagtaagcgagtctggatatccagcggcatatcgccaatttcatccaggaatagcgagccaccattagcttgctcgaaacgcccgtgtcggacttgattggcaccagtaaaagcgcctttttcatgaccaaacagttctgattcaatcaagtctttcgggatcgccgccatattcaaggcaataaaaggggatgaagctcgtgggctgtggcggtgcagcgcgtgggcgaccaactcttttcccgttcccgattcaccattgattaagacactaatggaggaacgagaaagccggccgataatccggtacacctcctgcatggaaggggcttccccaatcatctcagaaacagaggctgctacttgcggattgcgcgatgattgatgttgttcgcggtaatgactcaacgcccgctcaaccaatgcgacagtttcatcaatatcgaagggttttggcagataatcgaatgcgccttgttgataggcactgacagcagcatccagatcggaatgggccgtcatgataatgacgggaagctgtggattgctctgttttatctggttaagcagactcaagccatccaaacccggcatgcggatatccgacagcagaacttctgggcagtcctgtgagagtgccgtcagcacggaatcggcattttcaaaactgatgcactccagacctgcgccactcagcgcccgttcaagtacccagcggatagaactgtcatcatcaacgatccagacttttcctcgttgcattattatcccctatttcttgctcggttatttcttgataggcaggtaaatggaaaattccgtgtgacccggccaactggtgaattcgattttgccagcgtgttgatcgataaggttacgggcgatggataacccaagtccagttcctccttcatgcccactgaccatgggataaaatagcgtatcctgaatgttgggaggaatgcccgggccgttgtcttcaatatcaattctggctaccagacgatagcgttcaccatgtaaggtgatttggaacgcggttcgggttcgcagggtgatcgttccgcctttctcccccaaggcctgtagtgcattgcgggtcatattcagtaaaacttgttcaatttgatcaggataatgcgccagttctggcaggctgggatcataatccttgatcaaagtgacattggcgggcatttccagtgataccaactgatagattcgttcaaccacatggtggatgctctggctgatccgggttcccggatgctgtggccccagcaatcgatcaacgagggcgcgcagcctgtcagcctgctcaataatcacttgggtatattcccgcagggagggatcgggcaacgcttttgcgagcagttgcgccgctccccgcagcccgccaagggggttttttatttcatgcgccagcccccgaaccaattcccgcgcagccgcctgctgtgcctgttgtatctgctcttggcttaaacgacgctggctatccataggagcgagttccagcagaataaactgttcggaaatgggttgggcactgagcgacatcacatgagagtgattattgatcaccaatatcacttcgttatcggtaaaaccatgacccctgatcaaactggaacgcatcaattctgtgtccagtgagagatagctgaatagtaccggaaggggagtgccgaataatttacgcgtactttgtgccagtagttgcatggcggaatgattggcatagcggataatcaaatcgttatccagtaccaagacactgttaatcagtgagtcgagtatgtgttctgctttgggaaaatcagccatcgtcatccaacctttgcacttttttggtgcattgtaccttattcagacataaatcgagcagtctctccgttcagtctgtgatttgttcatcaagtgtcatctgccgtcgcgaatgtgcaggaaaaggacccatccgaagatgggtcaaaagtttcacggcaacaaaaaaggatagtcgtaatgccatcaagcattacacgctgtaatacagttcaaactccagcggatgtggcgtcatgcgtacgcgttcgatttcaccatgcagtaatttgatataagcatcaatggcatcatcagtgaaaacacctccacgagtcaggaattcccggtctgcatccagagcggctaacgcgtcatccagagaagaggctacggttgggatctcttgagcttcttctgctggcaggtcatagagatttttgtccatcgcatcaccagggtggattttgttgatgatgccatcaagacctgccatcagcagggcagagaaggacagataagggtttgcggccggatcagggaaacgcacttcaatacggcgggctttggcgcttgccacaaccggaatgcggatggaagcagagcggttacgggctgagtaagccagcatcactggtgcttcaaaacccggtaccagacgtttgtacgagttggtggttgggttggtaaaggcattcaatgcacgggcatgtttgattacgccgccgatgtagtaaagcgccagttcggacaggccaccatatttatcacctgcgaacaggttggtgccatttttggacagcgacatgtggcagtgcataccagagccgttatcgcctaccagcggttttggcataaacgttgcggtcttaccgaatgaatgggccacattgtgcaccacatatttgtaaatctgggtttcatccgcttttttggtcatagtattaaagcgggtcgcgatttcattctggcctgcggtcgccacttcatggtggtgagcttcaaccaccagccccattttttccattgtcagacacatggctgaacgcagatcctgagaggagtccacgggaggaaccggaaaataaccgcctttgatgcccggacggtggcctttgttaccgccttcatagcgtgttccactgttccatgcggcttcaacatcatcaatatggtaataactacccgaaatggaactaccgaaacgaatgtcatcgaacagaaaaaactcaggctctggcccaaacagaaccgtatcagcaatatcgcttgcacgcaggaaatcttccgcacgtttggcaatagaacgcggatcacggctataaccctgcatagtgccgggttccaggatgtcacagcgcaggatcagtgtggcatcattaaagaagggatcccgcattgcggtcgttggatctggcattaacaccatgtcggattcattgatccctttccagccaccgatagatgaaccgtcaaacattttgccatcttcgaagaagtcttcatcaatctggtgggcaggaatggtgatatgttgttctttacctttggtatcagtaaaacgtaagtcaataaacttcacctgatgttcttcaatcatggacaaaacatgttcaacggacatactgagttctcctggttgacatcagcctgataatacggagcaaggaacatgcggcgttatctaatgggctgatgatgtgtctctgtatagggtcaatgcttataaaattgatacttatgagaagagtattgcgaaaagcgtgccaactttttaaaagtctttgagatcagcagatgagtgggttggagggtaaaaaccgaagagatcacagtcaagttttaagtaaaattgcactaagttagtgaaattggtgagcaaaaaaacaaatttgcaccattatggtgaaaaataagggaagtgcagaccattttgactgatgtgtgagagtataaaatctatggttacctccgtttttgcaatactcattttgatgtatggttggcttgcataaatctatccggcttcaaagagctatttttatgcttagtactacagccgtaaagattgcaaaatcaatgtattatcagatacgcgataaactgagaacttatatgacctcaaacagagacatttctcttgctcatataaaagcgttgaaaactctcaccgtgggacatcattcccacggttttctgttaatttcattggcactttcttaatcaccacgttgtccttagtccgattttggccttcagctcgtagctgtgtgcaacttgttctatcttatgtggtacatgtatcagtattatagcaatttctatatatgcaacatttgtatctagtagccggatgatgtgaatatctttaagcgtggcatacaatgtgttgatttgcataaaatataatatttaattgtatttgaatgacagacaagccgcatagcggtttgtctgattactgataatgtgtattcgttcaggttcactttggtagttatcaaattgtgtgtcagaccaagttactattcacctgaatcaggctcttctctcttccttaaaataaagggaggcaccacatgcaaccacctgtcaaaatctggttgatgatttttattattacggggttgtacgccggacaatggcattcggttaaggaaaccattaggctatagatacctctaaccctttagaggtgacagtcaaataataaagatattgtatccatctgggagaaaatgccgtcgttattttcgatcgtggttacttcagttattacatgctctatcaagtcatcttaagcaacgtgaatgcgttatttataattcaggaagataacagtaatatgagtacgaagctttttatgatttgtatcataaacgatggaatatagaggagttatatgaaatttccaaatcaatattagatattgaggattttcattcacatactgagaaaggcatcagacagaaaattcaggaaaatatattattactctatctggcaagaatatctgaaaatgacctcaaaggcaggagaaatgatacattttgccatcttcaaagaagtcttcatcaatctggtgggctgggatggtgatatgttgctctttacctttggtatcggtaaaacgtaagtcaataaacttcacctgatgttcttcaatcatggataaaacatgcttaatggacatgctgaactctcctgggtcacgtctgcctgatagaacgatgcaagaaggatgtcattttatcttaaaggagcatttctggatgatcaatttttataaaactggtgttgcatagagaaaagcgaaaagtgtgccaacattaataaattatttaatatcaatatattgttatttggtgactaaaaaatcacggggaaagaggatagtttttaaatatactcgccccaaatcggggagtgaagaaaacagaattacaccctaatgatgcaattgagcgtttgatcaatatatgtaagcaataaggcgcaatctgtcatataacatcaacgttgattgcgccttctggtttagagtgaactaactattattctggtatcagatatcatcttaatccatatagtaggtcagtttaccctgtaatcgtgcttgtactgcattgctatctccaccaccatcagaaccaccccatgtatggactttgttatctgctgtcagagcaagaaatgctgttcctgttgcgtagatggctcttacattcttcatttcaggttggggtataaagttaacactactaggttcagcattttgccaggttaatacggtaccatcttgacgtaatgccgcagatgcattagctgagcaagttatttgaaccacatctttaagagctataaatttctcgaacactgggccgtcgtcataattctgtattccaccccaatatactttgccatgtggagggatgcctcccggcataagatatttttgtttagtggtagctatatctactccattactagatgagtcgccatcggagccggtgttggtggtgtagcctagggtcgaccaactatataatgtaccatcacggtgaagtgcgtaattaccggttggcgccccaagattcgaaataaagggagtcgttgaagcagcttgtataaaatcttgatgtggggggttaaagtcgccaaatacacttgaatcaccccaagtagaaagattaccactttcatctataacggcgaatccccttgttgccattgatgtaatgtaacgtggtttggaaatagaagaataacgcggctctatattccagttctccattgatgaaccccaccaacttattatctgttccgtaccgggattatatatagtaatagccaaactatttcctacaaaaacattcttcccatccccaagataagtataaataccagtcattgttccccaggcttccatctgctggttagcttccgaaacagcaaaaaagctatttccaccggctcccacatcatcaaaggaaccagtagggagatcagaactattagaatcaccgtgataccataatgtacctgaacccacattaagcccagcataagaggggccatttgtagtaatggttttaactccagattgaatataggaattaccgaaggttcctccccaaccaaccatggtgttgtcattgagtagcacagcaaaagcagagggatatggctcttccactggatcgttaaaatctgcctttggaagacctagcgtaccaccattaccaaacacattgattgggtttattttgagcttgttaccttgttcgtcttgaactgaaatggggagccacggagcagaatcatagaaaaatggggaattaatatgtgaaaaaggagaagtgaatgatggtgttccacctatataagtccatgttactggatgtggcttaccctctttagtccaagcagtcagccgctgtggtgctttaagcccattagctacagcaaggtcagcataacgagcccccataacgataaagggttctttatctgatggctgagaagatgtaccattaataacttttacatataaaggttccgagtattcaacattaccaaagtattgtttacgagtataggaggctacatattcctgagctggaacatcgtttttgtgaatttttccgaccaagataggatcagctaaaccatgagggtctgaaacttcatagttaaactctttaacaaaattaagaataatagtgtctttgttacttattccttcgtatttagggacgtacaatgaaatataatcatctattttagatttatctaaaacaccatctttaactccagagataatgggtgcagccagtaatgcatcttcattaatcataattcattcctttaattaatataagttatacaaaagaaagtaaaattttaaattcagataagaaataatagtgtaaataaaaatataatgattatctaatgaataataattatcacatttatatattatatggttatgtcattgtatttaacattcaggcggtgtaccttcattagctgtactaattcttcctttccaagattttgcttggatggttccattgtcacttgtggcttggtaatcaaattgaataagtcctgcatgacaatcttcatattgaccacagccattaagaatattatatggaatactgattactccgacagcggttttaccatctggccctggtgtttcaggtatttttccagggtaagttttgtgaggactgcgataatttgcagtgatattcagttttaaatatattttgcttcctaatggtggtttggttttatcatcaggatcgttagttcctgtaattaggacaaataacccctcactatatttatttttataataattagatatattatagcagttaacaacattattttcattaaacccaatgcattctgtggtgggaaattcttgtataatattattttggtcatcatgtccaaaactagagtaaaccacacatttatcataataagttggagctggccagggttctcctgagtatgttaattctaatgattttgaatataaaatattgctattgttatgggaaacggtataggcgaattcaatagtcatatctatgggaaacatagaatagggaagtggtatcttataatctccaagattgttaatatcttcaacagtataataataatcattatattttccattgactgaaaaatgaatgacatcacctcttctacaatcattatatttttctactttgacaagaaatgttgtttgtccttcattatttaattcacctccattaaacccatctattcttggagctgccagtttatcattatcatccggtgtattcttatcaataatttgcaatcccccttctgattctatttgcccggatacaccatatacttcagtgtacaaactaagaatcagtgcttgagattctttagggtatacatgtaaaattaaacgtccttttttatctgtatttaagatcatttcattatcattattaaatgataaaacatctattttatttatattatcagatttatagaaattaactttttccaaactgaaaatagagttggcagaaattacaacagaaagattaggtattgatttttgattttcgtctttaacgaatgctgtagctcggacaaatttcccctttggtggaatatttttattatgcggaacctgtatgtaatgtgaatcccattttaaaattaaagaattatgatctagagtcctggctgtgtattggatgggtattgtggggaagttatcatctgatgaaccgatatcaaaagtaatagtatcaccatcattgacttccggtgatacttgtaagttaacaataaacaatccaaatccattacccaattttatattagaggagtctatatatatgatagctgtattattacttaaatagaagtctgtcttaggagatatagatgtatcagatgttaaagtaactgtaatagctaattgttggcctatgataacactagagccgctaggaagagaaagttgcatattactgggcatattaaccaccatgtttatttttattcatgtaatagattatattgacatgagaacattatgttagatcaatttttataatcagggtatgaatacatatcagtgtatgtaaaataatttaaaaccatattaatataattttctcatgccctatatctagtattaatgatgttttttaagagtatatatcagtgtcaattgtcgcttgccaaatgtttccatatgttacattgagatcggtatctttcccaacttgatagtcaaaataaatcatacttgatctatcttcataagactcccgatctttcaataaatcatgtggtattggaaatgttaatgctacattttttccagcatttcctgctgcatatggcattatgcgtgtacaagaccaatgaataattccggtttttgaattaatatataaatttaaagttacttctgatcctagagccacttttgtgctgtcattaggatcattggtaccagttatttgtacaaataatcctgcgagatcattagtttttttgtattgagatatcgtattattatcaacagtatcatatacaatgctgtcaggaaaaatcccataactagaatacacttggcaagtattgtatatcctgataacatctgcccagggttgattttgttgatttcctttgtaagtcaaagtcaatggtctagatttatatttagttatatctcctagggctctgatgacaatatagctaaaataggaaaaatgatcgttctctttatcaaaaatgtcataaggtaatggaaaaaatttacttaaataatttttacctgaaatttggatgacattaccagtatatttattattaacgataaatagtatgtaatctccatcctgaacattgtcatactctggaatcctgactaaaaatttactttccccatctgagattagatctccttcaataaagttgagtatttctggttctggatacttttcaggaatttcatctaatgtatgatcaacaatatatattgcatgatctgctggaattggttttgtgtctcctaatatttgagaaaacaatttaagtattaaattctctgattttataggatgtatgaaaaataaaacattaccttgcttatctgcttttacaaaaaaaccttcatagtttttttcagatacagttgtaatttctgttctgttattagaatcatatattttaattttttttaaattggaattagaactgtcagaaataaatatcttttttccacctaagggctttccatgtatatccctgatagttgctgttactttagtatatatttcatctgtattattattggatgattgagaaatagatataaaaggagaatcaatgtgtaatattaatgattttagattcacgatatctttagcagtattaaccatacttccctctattatttatatattaaaaaataaaatgacaaaaatttaaatttaatgcaaatctatatttattaaatgagttaataacatagtaggtttgttacaattaatctaaattatctataacccattgtataatgaaaaatagttatcactaatgtatctattactatagtaatagatctatatcatcttatgataatcaccattatgaaattttttaaaacttcataattacagtgtattttacgtcaaatggtgatttaatagtattaatattaaggccgtaattacaaaaaaaacaatgttacaaagagggtgatagcaatatattttatctataatcccattttatttcgttgtgataataatattgccaattatcacaaccacaccgattaattgttttgttaaggccagaaattatcattagtcatcatcagtttcaatttctgccgaccaaatttctccatattgatcattgccgtcataaaatgtatagtcaaagtaaatataacctactccaccatcttgatatagtttaacatctttaacatcatcgaatggaatatgaataacagcggatgtcctacctgaaggctgtacctttatttttcctggataaattttagcataactcttatctattgagtttagatataacttcaaagttacaggaatatttaatgggactttatctttttctctattagggtcttgagtacctaatatttcaacatataatccttttttctggccatctgggtattgcattattgcagcataattaattgaactatcatttgggattatagcatctgattcagtaccaaggctggtatatacgatacatgcagcataatttctttctactactggaactggtttatatataacacctcctttataagttaaaggtaatgaaacagatttttcctctaatatatttccaaaacctctgatgataacatagaagaaattagagtatacatttttcgtgaaaatatcatatggaatttcagttgaggtgcttgaatcattattattatctactcgaataaaatatttcgtatattctccatttacaaaaaatagaatgtaatcacctagtgtttttccagggtagtgtggaatgtcaatttcaaatttagcactcccatctgattttagatactccccccaaaaattaattatttcaggcatatcaaactttattttcatgctgtccagagaattattaacgataaagattttatgtttagcaggcattaaccttgttgagtcgactatatttgtatataagtttaaaacaacaggaagagattgatgtgggtgaataaaaaataatatatccccacatttatccgtttctatagagaatccttctctaccatcttgttttactggggtaatttctttattttggtctgaaccataaattttcacattctttaaatttccagaaatagaatcagatacaaatatggaaatgttaggtaaagaattaccgtatatgtcttgaacttttgcggtaaccttaatttttcttccatcaacaccttgagtagatagattaggaacagccaaaaatggaaaacacacatctaatcttaatgattcaaagtttattttattactattcatgtaatttttctttttagtgtgataatggaatttattaggctaattcaagattaatttttattaattatttattaattatttattctggtcgtgtgtcaatcaatccttcccaaattttcccataatttttttcatttccaatgttaaactcataatcaaaataaatactacctggaccaccattatcataggggtagattttattcagaaattcaaaggaaatatgaaaggacaatgatacaatgccttgactaccgacctgtgttggcataggtaaggtccaggatttatgggtattacgatttgatgactggatatatacgtttagtgtgactttataatttagtggaacttttcctggtatattattcccccctaatacctcaacaaataatccagtatttggtgtgcttggattgtccaaatatctttttatactatcataactaatacctgtgtcaggttgtatctctgctttaccaataccaaggctggtatatactttacagagatcataatctcttgttacatttgtaggaggattatatattgcaccgcccatatatgtcacagggtatggccttgaagttttcgaaccagctgcttccccaaaaatgactatgtaactaaattcgtagttaatagaaatattaaaaatatcataaggcagagagtatgagtattttccttgtcctagttctgtatttgggttactaacagaaacataatatccactatacttaggcgtagtatcattatcagttttaatcataaatactatataatctccgcgtttactgttatcataattatctatagaggcataaaaatttggctctcctgtattagaagttaaaggtcctggaaatccccctaatatgtcgggttctcgtagactatccatagggttagggcgttccgtgttaataaaaaatagaggggatgttgctgggatgtagtcaaaggcgtctataactgaacacctcaaatcaagcaccattgaaagcgacttttctgggtagatataaaatacaatactaccatctgattgagaattaagaaataatccatcataagtataaaattgttgtggtgtaataatattaccgttattatccttaatagtacattcatgtaaattatttgatctaaaagaatctatatatattggaacaccagatagtgtctttccgctcttatctgtcagtatcgtagatactttggttttatttgttacagaactgtttttaacattaaatgtatctaaaaaaacattgtcaatagtcaattccaatgaatcggggtttattttgttaaggttgcatttaaatttcaagggtgtcatgttagctacaggaagggttgttcctacattaaaaataatttgatcctgttcagttaaagcgctacttacacttaacattataacacaggtataatttattattttaccttccttatttgttattggtttaaaatctaaatgatccgttggtggagtgatattagttacggttgtaaatttagctttgacatctccagataaaggagtatctggtgttaaagtaagaataagaacaaagctttgtcctattatcaaagtggcattttggttaagtgatgctgttaatgggttttttgctgttgttttcattttattacctcaagaattttatttttaaaatataattaaccaagggtatttattttcttgttatacaatctttggtgacttcacatttgcaatataaatacatcaatataaaaagtataatgacaaaaaattatcatctgataaccgctctatatcaccagcataaaattcttacttaagagaaaaattagggttctgtcgcattaacggcgagtttatcagtcgtatccggtgtgattgtttttttaacacagttagtcgataaaacagttctattggcgataaattctggctctgtcgcattaagcggtcatccggtaagctcccttgtttttgagcgaatccagagtgatgtccctgatccgaaacgcgtttaaacgcctccattatcctgttgatattatcgcttagtgtgttcgctggtctctgacctacattctgagcttgcgtaatctggaagaaatgatggctgagcgagggataaccgtcgatcattctacgctctgccgctgggttcatcgtcgggttccgttgatgggcaaacgttatcggcggagcaagcccgccattgggcgtcggtggcgaatggatgaaaccgatatcaaaatcaaaggacaatggcgttacctctaccgtgctgtagactcagacggcaatacggttgattttttgttgaccgcctatcgggataagagtggtacaacaaagccgcgctagacgagttaaatcagggaaaaccgaaggataagcagctcaatatccggcaaatatctatggtctcacccatttttgcaatactgattttgatctcttgttggtttgcttaaatctacccggcatcaataggggtaaaaatgcccgcgccatgataagttccgctcccgatggatcttaaaagtatcacgacttcattaattcattatttagcttaggtttttatcggatcgatttgccgttcatgtcatcaagaatcagtcttcttaaaaccggatggtaacttattgaataaaaatataattattatttaaaaccgtttcatttatgacctttcaactatggtctgttgtgtgataatagctcaggctattctggccagtttgtttgccaatgcgcagcacgcaacacaggaatgttttcttgttagctgcattttgacccaatcggctaattttcccgacagaggcgcaatgttttggataaacactctggcacattgaacccgtaaccagcgcaaatttttgtctcctcgcttgctgatccccaagagggtatttctcccgcctgaggccgcaaaatcccggctgcgcgcatattgcttaccgttacctaattgtgcagagagtgcgctcgcggttattggcccaacagcaggtatcgcaacaggataggaggccatcttgtatctcaataacctgattgaacaggatcatcgcaggcgaatacgccctattctgaggttcaaaaactttaggcgggctcagaccgtattagctgggattgaacgggtttgcatgttgcgcaaagggcaatacccgcaagaaccagaatatccaatttcaccggaggcctatttctatcaactaacggcataaaaataaatcaaaatactttcgctcgagatctctctgctaatgcgacagaatcttaaaaatagcgttttagataaatcactatacccataagataacttttagttatcaattgataattatctttcattacaataataaaaatattttctaatatagaagattaggagaatagcctgattttatactgattcagtaaaaatcaggctgttaattataatttgatgtattttggggtgcctatatatgtcatcatatattcgtaaattcattggtttttttatctttatttgtgcattagttatgctttctatactgatgaatgcctttgcagatggtaaagataacgtagacatttttattagtgaatcaagtaaaaaaataattaatgagaataccaatgatacttcagaatctgatgccaaaaatttaatcgccagaaatattcaaacagtaggcaatatcctatcatcttctccttcggatttagcagagcaagctaaatcctatactttgggaaaattcaacagtactgtctcttccgaagctaaaaaatggttatcacagtttggtactgccagaatcaattttggtctggataaaaagggaacgctggaaaacaactccctcgatttattgctgccactttacgacaacaaagcagactggctgctattctctcaattaggctatcgtaacaaagacagtcgtaataccataaacgttggcttaggtggacgctatttctatcaaaactggatgtatggcatgaatactttttatgatcatgacctgacgggaaataatcagcgtttaggtttgggaggcgaaatttggggcgactatatcaaactctccgccaatgcctattatcgattgagtgaattacaaaaatcacggaattttaagaattatcatgaacgcccagcaaatggatatgacattaacggcgaatttttcctgcccgtctaccccaatctaggtgcgaaactgacatacgaacaatatttcggtgataacgttaccttatttaatcgcaataccagacagaaaaacccaagcctggctaaattaggtttaacttataccccaattccactgataacaatgggtgtggattataaacagggcgaaagcggtcatactgaaacgcagtttttagctaatttcaattataaactgggggtgcctctcagtgcgcaattatcgccagaaaatgtggcttcaatgcgtacattgacaggaagccgttatgatttagtggaaagaaataataatattgtgcttgatcatataaaacaatccactattcaactttctataccccagtctttaattggttatagccatgaagaaaaaacaatatcgactacaaataatcctgataataaagttgaattacaagataataaagaatttatcaaaaacggcggtaagataaatgttaagggaaaccaaattttcattacattccctacatatcaacttagtcatagcgagacaaataattatcctgttaatttcagtgtatttgaaaacagtaccgtaaaaacagcgtctaataatggaataatgaccttaattgtcaggccatttgtagtaaaagaaaaagaagtcagtcctatagaaacattacctgctgatggtaaaaaaacttatctctttactcctgttataacctacgatgccgtaggtaaccagcctttagctcaggttacccttgataatgttcaatggacaaccgagccagaaattggcgaaaaatcaggactacagtggggaaaacctgaaaaaacatcaaaaactaatgagaaagggcaattacaagcagctttaaccagtactaagcccatcaaagatgtgaaagtattcctgcaaatggatggaatgcctaaaacgcaagtaggaacggtgagttttggagaagatacttcacgttttcaattaggtgaaataaacatttcattaccaaacaatatgaaaacgcctctaacagcagatggggttcaggcttatacctataaagctgttgttttatatggtaagaatcgagtcccaccaaatacatcaatcgccgatataaaatgggatcacgatcataaagagatttcgactttgaaattagtacctgatggtgacaaaaccgatagtgaagggcaattgatcgcaacattgacgagttctgaacccgtcaatcatgtcactgtgactctttcgattgaagggcatccagaaaaaccagctggccgcgtttctttcgaaccggcagaaatttcgctaaaacattcaccttcaggaccaatattggttggtgaaacatatactgttaaagcaacaagtaacgataaagattcaccgaaaaatctgccaataacgtgggattttgatgctcctcagcatgataaagttacacataattatactgctggtcattcagaggcaacatttagcagcagtgtggagcaggtagttacagtaaaagctgctattaatggttctctgccctcgcaaacagatttggttttcaaaagtccatcaattgagaacataatgttaagctctgagacaccaaatggaacaatttcgcccggagagtcatataaatttatagccaccgtatttggtgctgatggtaaaactccctatagtggaagcactattccatttgagtggagaattaaatcaccaacagatgctgaaaaggcgggtctatctttatcgccctcaggaaaagtaactgctgtatccgatggagcattaaacgcagaattaacaagtaaaaaggatacatctgctgttacagctgctgaagtatgtctgactattgttgatgctcctcaatccccaacaacgcgtaagtgcatagattcaattaattttaaatctccgcctgtggattttgatattaccagtgttgaagtccataaggttgtggtcgatggtattgaaaaaccatttgatccccaaaaaccgctgcttggcaatggtgctgacaaatacaaatacagagcattgattacaaagaaaggaagtaaagaccaagaaaaaattgcaaatcatacatttaatggtgtggaatggacacgcaaccagaaacaaatcgacaataaatacttatctgaacctgaaacaatatcattaaaaacagatgatgatggatatttatatgcaacattagacagtaatgttggagttggtaatgaaaaggatatcgaaaagacatttatcaacgtgacattgacaataccgagtgaattacccagtggtgaacccaagagtaagggttctgctaatttggtgaattttattccaaagcctgaacaagcagtaatgtttgtttataatcaatataatgaaaacaagaatataacctttcaggaaccacatccttataattattttcgatcgttaaatgcagagctgagagatccccacgagccagagaaaaattttaatcagcctgaagttatatatagttacagtgatgcaaaatcagattttgaccccttattatctttaggagaaaataacaaaggaccgatagagttttatgctgtaggcagcgcaacagtaaaggcaacaataaataaagatgatggaagaatttacctatatgaatataaaataaatataaaaaaatatcctttacttccaacttatacggggaatgagaatcaaattaatctatatggttatcatactgctgatagtcccgtgatatgtgaactttctaatactcctcctggttctgctagattcggtgaatctatcactttttctgtacaggatcttagctcttctattggcggtataactgcattatctaatgaatttaagaaccttaatgattggggttttttccatccagaacaaactcaggccgactcaaaaacaattcaatataaactaaatgatggatcgaataaatatgtaatttttaatcctattactgacaaagaaaatacagatataaatgcaagtggattattaatttgtgaaacaaacacaaaaaaatcaaattaattggtgaatccacataataagtgaaatttttgaccgttgttgattggtgggttctgtcgcattaaatcctgtttggataatatggcattttttattggttgaactgacgatgtccccgactcgagaagcgttcaaacacctgcattatcctgttgatatcatcgctcagtgtgttcgcgggtctacgcgctgagcttgcgtaatatcgagaaatgatggctgaacggggtgggggatgcagatggagagcataaatctatggtcaccctcctcaatgcggaagaatcgcctcagcaggtgattgaaatccggcaaaatacctgaataacctcattgagcaagaccatcgctatgttaaacgtcggatacgcccgatgctgggatttaaatcgttctgcggggcataaacgttgctgatggggatagagtgagccatcatgctgagtaaaggacaatgtcttcaaaatgaaggcgagaatttatcgccagcagagctgttttatcgactgactatgtaaaaagcaatcacaccgaatgcgactgataaactcgccgttaatgcgacagaacccccccccagatatctgctgtcagagcaagaaatgctgtccctgttgcgtagatggcttttacattcttcatttcaggttgggatataaagttaacgcgactaggttcagcatgttgccaagtttaatacggtaccatcttgacgtaatgccgcagatacattagctgagcaaattatttgaaccacatctttgaaagctataaattcctcgaacactgggccgtcgttataattctgcacttcatcccaatatactatgccatgtggagggggtctccccgcataaggtttttttgtttagtggttgctatatctactccattactatatttgaataaaaataatttatgtaaaaatatcatttattaataacattcttttatttctttattttaaatcattctttccggattgagataaaatcggatcgaatagttattttcttttgctcataataaattagccctcttggtattcgtgtttatataaacgtgattggatcttcaaaagaatgaaaacactataaatataagtctatttaatgactaattaaaataaattatcactactgaatctgaaaatttcttccctatttattcagttttaataagtaaagttatattaaatcatattttattgatggcatcggtattaactcgtacaaagacacataaataaccctgtaaaccacaaaaaatattctcactatccctatttataacattattatttcttataaaaaccgattggaataataatattttaaattaattatttagttgattttaattagttattgcaatagaaaaaaatctagtggtgcaaaggtcaaacagagcaggtatcattaagcccaccgcagaactgtatcttgttgacgttctagatgtactgattacatcctctcatcatggtatctcttcctgtacagacaaacttctagggtgatgagcttcacatttatttcactctgtagatataacgtgtaaaataacagcatatttgtgttagatgaatgcgcgttgcgttctgcacgctgtatccgtttaatattttctcaaatagttaaaatggtaaaaatacttgtcaattaataacttaagaaatatcgccatcatcgctcacgtcgaccatggcaaaaccacgctggttgataaactcttgcagcagtctggtacatttggcgaacgcgcagcaacgactgagcgtgtaatggattccaatgatctggaaaaagagcgtggcatcaccattctggcaaaaaacaccgccattaaatggaatgattaccgtatcaacatcgtagacaccccaggccacgccgactttggtggtgaagtagagcgtgtgatgtcaatggttgacagtgtgctgctgctggttgatgcgatggatggcccgatgccacaaactcgctttgtaacccagaaagcctttgcccacggtctgaagcctatcgttgtcatcaacaaagttgaccgtcctggcgcacgtcctgactgggtcgtcgatcaggtatttgacctgttcgtcaacctgggtgcaactgatgagcaactggacttcccgatcgtttatgcttctgcactgatgggtattgctggtaacgaacacactgacatggctgaagatatgactccgctgtatcaggcgattgttgatcacgttgagccgcctaaagttgatctggatggcacattccagatgcaaatctcgcagttggactacaacaactatgttggggttatcggcattggcagtattaagcgtggcactgtaaaaccaaaccagaacatcaccatcgttgacagtgaaggcaaaacccgtaacggtaaagtcggtaaagtcttcagtcatctgggtttggatcgcattgaatctgctcaggcggaagccggcgacatcatcgcgattaccggtctgggcgagttgagcatctctgatacgctgtgtgataccagtgccgttgaagctttgccagcactggcggttgatgagcctactgtcagtatgtacttctgcgtaaacacctcacctttctgtggtcgtgaaggtaagtacgtgacttctcgtcagatccttgatcgtctgagaaaagaactggtacacaacgtggcactgcgtgttgaagaaaccgaagatccagatgcattccgcgttgcaggtcgtggtgaactgcacctgtccgtcctgattgaaaacatgcgtcgtgaaggctttgagatgggcgtttcccgtccaaaagtcatttaccgtgaaatcgatggccgtaagcaggaaccattcgagcaggtcacactggatatcgaagagcaacatcagggtgacgtgatgcaggctctgggtgagcgtaagggtgaactgcgtgacatgctgccagatggcaagggtcgcgtacgtctggattactctattccaagccgtggtttgatcggtttccgtacagaattcatgaccatgacttccggtacgggtctgctgtatgcgacattcagtcattatgatgatattcgtccgggtgaaatcggtcgccgtcaaaacggtgtgatgatttccaacggtcagggtaaagcggttgcttacgcactgtatagtttgcaggatcgcggcaagctgttcctcggtcacggtacggaagtttatgaaggccagattatcggtattcactctcgttccaatgacctgaccgtgaactgtctgacaggtaagaaactgaccaacgttcgtgcatcaggaacggatgaagcaacgacactgtctccatatctcaagaaaacactggagcaggcgctggaatttatcgatgatgacgaactggttgaagtgactccgcagtcgattcgcctgcgtaaacgccatttgactgaaaatgatcgccgtcgcgcaaatcgcggcaaagaaatgtaatttcaccgctgtttaattgtgtgtgcaaattgcgtatgaatagcttagggtgctccggcactctgagtttctttgacgtttcttcagattgacatccacgctaataacctacctgtacctccactcaaaaaattgttagctttttcaacaactcttaatcaaaagcgtaatttgtctgttttttatcatttcactcttttttcttaacaaaattatgataaaagtacaaaacgacaatcgtcagtcaggagggattatgctgtatattttcgatatgggtaatgtgattattgatattgattttaaaagagtactggctgtctggagtaacctgagtggaacaccactggcaacattgaccacaagattttcaatgggagaggcttttgagcaacatgaatgtgggcaaataacggatgctgagtttgcagatgtgttgtgcgatgaaatggaggtctcgctcagttttgaacagttcacggaaggctggcatgcgctctttattgatgtcagacagaatgttattgaactgatgaataaattgcgtgaacagggacatcgtgttgttgtactgtcaaatacaaaccgcctccatcttgattactggccacatcattaccctgagattgcagcatctacagatttcctttatttatcccaagatctgggcatgcgcaaaccgaattctgacatttttaaatacgtgcttggagcagaaggtgtgaccgctgaacaggttgtattttttgatgatgttttggtaaatgttgaagctgcaagaaaaataggcatcaatgctattcatgtgactgacaggaacgtgattcctgattactttaaggcacatgatttctcccttcccacagaaacgtaacttattctgcccttgccgaggcggtttaccccactttccttgcccgttttgggcaaggatgacatggataacagacaaaaaaatgatcgcattaattcagcgcgtaacacaggcgaaagttgttgttaaggatgaaactatgggggaaattgagcaggggctgctggttttactcggcgttgagaaagaagataaccagcaaaaagcgcagcgtttatctgaaaaagtaatgggatatcgggtattcagtgatgagcagggaaaaatgaatctgaatgttcagcaggctaatggtagtttgctggtcgtttcccaatttaccttggctgcagatacccaaaaaggtttaagaccgagtttttctggcggtgctgaacctcaaaaagcagatgaactttatcgctattttgttgaacagtgccgggtaactggtgtaaaaacagaaacggggcaatttgccgcagacatgaaagtgagtctgacaaatgatgggccggtgactttttggttgcaggtatgatatgcagacacacttcaacagagtgacgggtataacaataaaaaaactcatcgtttgctgcatgcgctctcctgactacacatgacaacacgcataaaaaaggggttgttcctatgtaccatctgagagtacctcaaacagaacaagagctggaaacctattatcaatttcgttgggagatgctgcgcaagccgcttcatcagcctatcggttcagaaaaagatggttacgattcgatggctcatcatcaaatggtggtggatgaacacggtaatccggttgctgttgggcgcttatatatcaatgcagacagtgaaggcgctattcgttttctggctgttcatcccaatgtgcagcagaaaggactgggtacattgattgctatggcattggaatcagttgccagacaagaaggtgtgaaacggattgtttgcagtgcacgggaagatgccgttgatttttttaataaattgggatttaaaaaccggggtttgatcaatggtgccagaacgtctcccattagccatttcctgatgatcaagcctatcatgagtcttgatgatattctgcatcgtccggactggtgtgcggagttgcagcaggcatggtatcaacagatccctctgagcgaaaagatgggtttacgcattacccaatatactgggcaacgctttattacaacgatgccagaagcggggaatcagaacccgcatcataccatttttgcgggtagcctgttttcgcaggccacactgacagcatgggggctgatctggctgttgttacaggaacgccaactggggggcaacattattctggtagatgccaatatccgttaccgacagcccattacggggcgccccaatgccgtcgctgatttcaataacatgagcggtgatttggctcgccttgcccgtggcaataaggcacgggttaaactggaagtacaggtcagcggtgaacagggcgttggtagcgtgttcaccggcacttatctcgtgctgcctgtcgaacgccccgttacagtttaattttggggcaggttttactctcggcagtttcactttctgcgcttgtattacctgcctctgctgtatgaacttccgttgaaggtgccgtagggtgcgctattgcagcgccatctacggctccagctggagagcagttactgcttaaaattagcccctgagcaatggactgtgagtctttgtttgatgatttatcttcagcagtcagtgtgccattgatggtacctttaatatcatcagcagagagattacctgttatggtgagtgaaaaatttccttcaccctgaatagtgagtggtatccaaccccatcgtggcaggatgcctaaatccgcattcattcccttgaaattaagcacaaaaggtttttgggctgtttgctgttcagctgaaccgctagcttgtagtagtccatgaccgttgaaggcgttcagtttatcaatcgttagcttgtcatttgtagcgtgtaattgcagatagggacgagttatttcaattttattaaatgttccactggccgcctgtaaggacgcctgaccctcccataatccccacctgccgtttttcaggatattcatggtgtccacatggcctgagagagtggtgagctgaaatgggaaatccggattaacatcaatcagcagagtattattgacgctgatatcatttaatttcagccctgaaatccactccggtgcagcgtttttgatatcgtttcgccatgtgggtggcaggtcataaactagcccggttactgagctgttactgaacgtcagttgacggtttttgcgatcccactcggattggatgttgaataaccctttttggtagtgggtcgtcagatgagcgacagtaaaagtatcaccagaaaaatggagttgccccagtgtgttgctgaactgagcgttattgaatgccatattcatgacattgaaatcaatcagcccatctttagctttccagctcccattcaccagtcccaggtttttgatggtggtatccaggtaatcgacagaccaatttttcccttgtagcttggcattggtgatattgaggtctttaacatgaatggccggaagatgacgggttttttcttgcaacgtgctcaatgtcatcggtgattgccagcgtatattgctgatcaggagattattccagcgccagctgccgtcaggtaactgccggccatccccagatatagccccttgcagaaatgccgcaccaaaagtgtcgatagtcagagtcttattctggtagctgccctgcatgataaccttttcaaagggaataccgttgaaactcatagtactggcactaaactgatactgcccattgccaaacgggtttcctgcggtaggcatccaaggggtgatgccacccgtgatattttcccctttaatttgtgtatgggggttttctaactgaatattcatctggtttagttgcagaatgtctgcttgcaagagggagggcaattgatcgcctgccagtatcagtttcccttgttgcaatgttagccgatggaggttacgcggtgtcagcaggtgttgccatttgagatccagattaacggtattggcattgagtgagaaagcgctttgctgatcatggatattcacgttgttaagcgttaatgtcgcaggttgtagccagttgtgaccgatgctttcaatgctgatctcgtagtggccttgtctgttgagccattggtttaattgtttggttccccagtgcgtctggacaacgatataaatgacgataattgccaaaatcagcaacagcaaaagagtaacaaaaaatttccttaaccacttcatgatctcacctcagtatgacctcctgataaagactctttatgccgtaaaacggatattcacacaatagtggtgggggggattgataatcaatcagtgtgtttctgaagaaactcatgttgatattgcgaggggttacgcaaacaaagtgaaaaaactcccactgaaaaagcgggagaggaaatcagaggaatgaaaatccggccgctatttttcctgcggaaaaatcaggttcagaagaattgcagtcagcccgccagcggcaatgccggaagatagcagatttttcacccactcaggtgcaaactgtaaaatcaagggttgttgggatacgcccaaaccaacggccagcgacaacgcgatgatcataatggcgcgacggttcagtggctcgcgggagacaattctgacaccggatgcggcgatagtaccaaacatgacaatggtggcgccccctaacacgggttcaggaatatgttgtacaaatccggctacggcggggaacagccccaacaggatcagcatagaagcgataatgtaaccaacatggcggctggcaacgcccgtcagttgtatcacaccattgttctggccaaaacaggagttcggaaacgtattgaatactgaggaaactatcgaattgaggccatttgccagtacaccacccttgatgcgtttcatatataacgggccactgactggctgttctgaaacatcggaggtcgctgtaatatcgccgatggtttccaacgacgtcaccataaaaatcaggataagggggatcagtagattccagtcaaaagacagtccgtaatagagcggagagggaacggtgataacgggcgtgtctgttctgggtgttgcatgaggttgcatacccatgtaccaagccaccagatagcctaccgccatagcaatgaccagagaagcaactcgcaggtagggattgcgctggcgatttagtagcacgataacggcaagaacggcccctgccagcagcagattttcaggcgcaccaaacgtaccgttttgaatggcagagtaaccgccgccgatggaagtcaacccgacttggatcagcgacaggccgataatcatcacgacaataccggaaaccagcggcgtaatgatttttctagccagatgcagcacgcgggaaagcagcacttcggtgattgccgccaccatcagcgtaccaaacagagcggccatcatggttgggatatctgctcctccatttttaagagccagtcctcccatgatcagtggcgcaacaaaattaaaactggttccctgaatggaaagcaagccagagccgacaggcccccaggagcggatctggataagcgatgctacccctgatgcgaacagggacatgctgataatgcgctgtgtatcctgttcggacagccccagcgcctgacagatcaacatggcgggcgtgataacggcaacaaacattgccagcagatgctggctggccgcaaacagtgcgtgtagaagtggcggtttatcttctagacggtaaatcaattcgcagcctgatttctcgggcgcttctgatgcagagtgttcacgggatgaggtaaccatgatgtgaaattccggatggacaaaaaaacatattttaatgatctgccttattaaggcaatcgtttgcgctaaatttttataatgaataacgatttgatttcgtcacacttttaaattttttaacttgtgtttatcagtaattttttttctaatccatcccttagctgctcttggcgtttttataggatgattataacgtcgcattaaattcacataactttaacaatagatggggtacatagatgtatcagctggatatttatggcacgctcgttgcggctacgctggttttgctactgggaagaaaactcgtacaatcaattccattccttgagaaatataccatccctgaaccggttgcaggcgggctattggtcgctgtcgttttgctggccgttaagcagtccacaggttgggaaatgagtttcgatttatctctcaaagaccccctcatgttgatgttctttgccaccatcggcttgaacgcgaaccttgccagcctgaaagcaggcggaaaatttctggtactttttgtctttgtcgtgattgggttgctgctggtgcagaacacagtgggtattgcactggcgaaaatgcttggacttgacccattaatgggattattggctggttccatcacactttcaggcggacacggcaccggagctgcctggggtaaagtattctccgaacgctatggttttgataatgcgaccgaagtagcaatggcctgtgcgacattcggtttgatattggggggcttgattggcggccctgtggctcgtttgctggtgaaaaataccaaagcgccgggcttgggggcagatgataccgaaattcctactgcgtttgagaaaccttataccggccgcatgattacaccattggttatgctggaaaccatcgccttaatctctatctgtttgttggcagggagttatattgagaaacagctagagcatacgatgtttgaattgccaacatttgtatgcgtattgtttgttggggtaatcctgagtaatggcctatcgctgcttggcttttatcgagtatttgaccgagcggtatcggtactgggcaacgtcagcctgtcattgttcttggctatggcgttgatgagtctgaaactgtggcagttggcttcacttgcattgccaatgttggtgatccttgtggtgcaatcgatagtgatggcattatatgcgattttcgtgacttaccgtgtgatgggcaaaaattacgatgcttctattctgtcggctggtcactgtggtttcggtttgggagcgacaccgacggctatcgcaaacatgcaggcaattacggatcgatttgggccatcacatatggcattccttcttgtgccaatggtaggtgcgttctttattgatattgttaatgctgccgttatcaaaatttatctgttgttaccggtattcccgtctatagcaggctaatttgattcgtttttaatcttgtcagataacttggctaaaaatgccgctgaaatattcagcggcatttttttgcttacattgctgcgggtatcttggtcttgctggtgccttgggtgtcgatatcaggcatgactatattgtgagcgatcaggcagccagcgctcaatcagtgcctttgcatgttccggataatgctgatggatataattggagatacgctgaacttccggtagcattccctgatcccgcagtaaatcggcgatcctgaattcagcattgcccgtttgacgagtgccaagcaattcacccggcccccggatttccaaatctttctgggcaatcacaaaaccatcgttactgtcccgcagaacttgcaggcgcattctcgcggtgttggtcagcggggttttatacagcaggacacaatgtgaagccacggctcctcgacccactcgcccacgaagctggtgcaattgagccagccccagccgttcaggattatcgatgatcatcaggctggcattgggtacatcaacaccgacttcaatgactgtggtggcaaccagtagctgcaactcaccctgtttgaaggtatccataatggtctgtttttctgcggatttcattctcccgtgcaccagaccgattttcagatccggtaatatcagagccagttcttcgctggtggcttgagcggcctgcgcttccagaacttcagaatcctcgatgagagtacatacccaataagcctgacgtccttcatccaaacaggcacttttgatgcgctggataatttcatttctgcgggtatctggaatggcaacagttgttactggcgttcgccccggcggcagttcatcgatgatcgaggtatccagatcggcataagccgtcattgccaaggtccgtggaatcggtgtggcggtcatgatcaactgatgagggtggaagccttgttcacgtcccttctcccataatgcaaggcgctggtgaacaccaaaccggtgttgttcgtcgatgataaccagtgccagacctgagaatttgacctgttcctgaaacatcgcatgtgtaccgaccaccatacttacttgaccgtttgcgatggcttcctgctgtgcctgacgcgctttgcccttttgtttgccagccagccagcccacttgaatgccaagtggttcaaaccattgacggaaggtattagcatgctgttcagcaagcagttcagtgggtgccattaatgcaacttgcttaccgtgaacgagcgcccgtaaagcagccagtgcggctaccagtgttttgccagaaccgacatccccttgtatcaagcgcatcatcggaacgtttttttccaaatcttgctctatttctgccactactcgtgcctgtgcatctgtcggaacaaagggcaattggctcagaagctgctgttttaaagcattatctgcggtgagcggctgggcatgaaagcgttgagcaccggctctgaccgccagcatacttaaatggtgcgccagcaactcttccagaatcagccggcgttgagctgggtgtcggctattatccaaatcagtcagcgaaacatccggcgggggacgatgcaaagtatgcagtgcgttaggaaggctgatgatcttgcggctaaattcttccggtaataactcgttaatgacacaggtatcaagaagttccagcgcctgctcgattaacttacgcagtgttgtctgacgcactccctctgtcgtgggatagatgggggttaatgtatcctgcaactgaacgcgttcagcgtgttgctggactttatattcgggatgaataatctcaggcccctgattcccgcgccggatttcgccataggcaatgacgtgcttcccttctgctaaattattcttcatggcggcggtgaaattgaaaaagcgcagggtcaatactccggttccatcactgatttggcaggtcatgatgcgacgacgcccaaaagtgacatgggtacgcaagacctcacccgtcacggtggcataaacaccgggcagtaaatcattgatggaatacagacgggtttgatcctcataacggagaggcagatgtagcagcaaatcctgtagattaaccagccctaatttggcgagcttagtgacctggctggcaccaacaccatgcaaggtggttaaggggatagcatcaagtagtcggcctttcatgcgatttctccgtcggtgtgatttatttccctgttgatggtgcagtcgttgcctgcattgctgcccaccatgattcacttgcgatgatttgcccctgctgatcaatcagtggctgttccagccccttacagcgtgaaactgccgccaatacgggatatctcccttcgaaaagtaacctttagtttcggttacggctgactcgcatcacatctggcataacacgtatcttacgcataatattcgccaactgaatacggtcttgggtcgtcagcctgatgaaagcacaataaacgcgaccatctttttcctccgtattcatgctctgaatgctggagttagcatcgttgatggccgccgtcagattcgccagtgcgccttgatggttaaacatatcaactttaatttcggcgataaaatcgctgttgacatctttatcccattcgacaggcatgaatttttccggctctttctggtatccacggatattacggcaggattcgtggtgaataaccagaccttttcccggactgatatgagaaatgatcggatcgccagggattggacgacagcactttgcaaaagtaatcaaaataccgtcagctcccttgatgggcagtttacgggtgctattgttgttgtttggtattttttccgttgcgcccagcaaattccgtgcaacaaccacgctcatagcattacccagtccaatttcagccagtagatcatccaatgtggcaagtttcattcttaccagctctttggtgatactttcctgaggaatatcagtaattttctttccgttgccaagcgcatgattgagcagacgacgccccagtccaatcgaatcatcccgtttaagatttttcaatagctggcggattttggcgcgagctttggaactgacgacaaagttcagccatgctgcattcgggcgtgcacccggcgctgtaataatttcaacggtctgcccactgctaagtgtttgcgacagtggataaggttggcgatcaacacgtgctccaacgcaggcatgaccgatgtcggtatggacggcataggcgaagtcaaccgggcttgcccccgccggtaattcaacaatccgcccttctggcgtaaaaacgtaaatctcatcgggaaataaatcagatttaacgctttcaataaattcaaaagaacttcccgcactttgctgaagctccagcaggctctgcatccagcgttgggcgcgaatttgagctgtagtgcctgattctccttgcactttatatgcccagtgtgccgcaacccccatttctgccatctgatccatatcttcagtacggatctggacttcaacagggacgccatgtgggccgataagagaggtatgcagggattggtagccgttggctttggggatggcaatataatctttcactctgccgggtcgaggcttatacaggctgtgcatttgccccagtacacgatagcaggtatcaaggttgttgatgatgacgcgaaaggcgtaaatatccatgatggagtgaaaacgctgttctttcaggtgcatcttgcgataaatagagtagaggtgtttttcccgtccactaacggtgcattggatgccagcgtccgttaatctgccttcaatttccgacagaattttctggatcatctccttgcgattgccgcgagcagctttaacaacctctttaatcacacggtaacggttagggtgcagtgcttcaaacccaagctcctccagctccgttttcaggtgatgaatacccagacggtgagccagtgggctgtagatttccagcgtttccctggcgatgcgccgccgtttgtcagggcgcagggagccaagggttcgcatattgtgtgtacggtctgccagtttgatcagaatgacgcggatgtcctgcaccattgccatgatcattttgcggaagttttcagcttgtgcttccttcttgttacggaagttcagcttatccagtttggagacaccttccaccaacccggcgacagccgtgccgaatagctgttcgatatcctgaaatgtcgctggcgtatcttcaatcacatcatgcagaagtgccgccatgagtgtctcatggtcaagacgcatttcggccagaatacaggaaacagcgacagggtgagtaatatatggctcaccactggagcgggtttgcccttcgtgggcatcccgcgcaacaacataggcctgtttcagtagaactatctgatcttcaggcaaatatttgagaacaagctgattcaggctttcaaacaggtacaaggcagacctaccgtaaaattagcgacgaccttcagcgatgacagaaaccgctttaatttctgcggcatcttgttcttgttgctcctgacgctcacgaacatcaagaattttattgttgatgaggccttgttcgatttcacgcagagcgataacagtcatcttatcgttttcttctgctacgagaggatctttaccgcctgattgcaattggcgtgctcggcgagcagcgaccaacactaggtcaaaacggttaccaattttttctactgcgtcttgaacagttacgcgtgccatatgtgtgctactccacagataaataaatgactgggcataatactgaaacttggttcagcctgccaataatttgctgattaaggcatcatgccgttgagcctgacgatctaatcgtatacgctctgaacgaataatagattgtaaatcggctagtgccgtattgaaatcatcattgataatgacgtaatcatattcgccgtaatgttccatctccgcgaccgcctgagacattcgtttgtcaatgacttcatcgctgtcttgaccgcgaccacgcaggcgacggagcaattcttccttcgatggcggaagaataaaaatgctacgggctgccggcattttctgccggacttgctgcgctccctgccagtcaatatcaagaaaaacgtcaacgccactggctagtgtatcttcgataattttgagggatgtgccgtaatagttaccaaaaacacaagcatattccaaaaattcatcatggctgatcatattctggaattcatcaacagtgacgaaaaaataatgctcaccatgattttcgccagaacgcgttgggcgcgttgtatgtgaaacagaaacctgagtgtcatacaaaggctgagtttttaataaagcctgaataaggcttgatttgcctgctccactcggcgcagaaacaatatataacgttccttggttcatgatgatttcttgactgattgggtattaataaatgcaagcgcaggaatataaaatcccacatagtatacacggatacgtcaacccatgcagcgttacaatacatgccaacggacatttcaacaaaattttttcttaacccactaatattaatgaatcattttgcgaaacaatttcaggaaaaataaacggttgcagaaaatgattatgtatttttcgaagcgtttcgcaaattagtcttttcctgcttggtaaaagttccactgctttttattctttgctcgtgtttaagggacgtgtggagcagggatgcttaattttctcatcatgatattggcgctgttgtttggaatacctgtggcattggcgggaatggcagagcaggcgccagcaaaatttactgaaagcgtagaaaccggcagtacaggaaacatggcggattgtcctgtttggtcacaggagaaaatccaacgtgaaatgcagcacctgacacggcagatggcggagtgggatcagctttatcgtcaacagggtatcagtgaaatcgatgatgaaatctatgatcaactattggaaaccctgacactttggcgaacttgtttacatcagacgtcagacagcacgttttctgttgctgtgccacgggaggggaaacatcctcaccctgtgcagcataccggcttaaacaagctgaaagggataaaggaaattcatcagtggctacagggacggtcggctgtttggctgcaacccaaagtggatggtgttgcggttacgttggtctatgagaaaggccgactggcggggttaatcagtcgtggcaatggttcggaaggaacgaactggatggacaaaagtccatttattacccgcattcccaaacagataaaaaatgcaccggagcgcttggtgttacaaggtgagctgttctggcagcaggatagtcaccgccaatctattgtcggtagtcaaggagcgcgcagcaaagtcgcagggctgatgatgcgtaagtcatctgcgccagaacttggtcagatagggatatttatctggggctggccagatgggccagatgagatggcggtaaagctggagcgattggcatcaatgggatttcccaccgcacagcaatatagccaccgaattatcagtgcgcaagatgctgagaaaagatggaaatcctattttatccagccacttccttttgctacggatggcgttgtcttaagacaggaaactgagcccactggccggcagtggcgcgcaggctcaaacagttgggcggttgcctggaagtatccattgcagcagcaattgacaaccgtgagagatgtccatttcaagataggccggacaggaaggatctccgttttgctggcgctggaaaaagtgaagctggatgataggcaggttaggcgggtcaatctcggttccgtcagacgctggaaacagtggaacgtttatccgggagataaagttacggtagcgctggcggggcatggcgttccgaaactcgataaagtggtatggcgtattgctgaacggcctgatattcagccaccgaatgcgcaggactttcattcgctgagttgccttgtatcccatgatagttgccagcaacaatttattgcccgtctgacatggcttggggaaaatctgaaaatgaaaggcgttgggcaaggaacatgggtagctttggtgaaatatgggctggtgacacatttaacggattggctggcgctggatattgtacaacttactgaagtgccaaacataggaaccaaacgtgccgagttgatttttgcccaattccagcaggcaagattacagccgctttcgtcatggcgtgaagcgatagggttgccttatgccaatcgatttacggatgaaatgggctggcaatgggatttgctgttatccgaaacaggcatgaaaaatccattaacggcaaagcaaaccgcaaaaattgcagcctttttgcagcatccagagattaaagcgttagttcatgcattaactgtatatagaattggagaaaagcagggaagtgaggagaataaggttggggagaagaaagaagcggagccgataagtcattcagaagcaagggagcaagagcgtgctcccgatgctcttaataatgtcagtgatcagaaccgtcataattgaagatgggtaaaccaagacgataacggatagcaatcaatcgagccgccagccctgcgataagcgtaatcaggatcacgctgttcgggtgcaatggcgtgtgtaataacccgatatatagccaagcggcagcgaaagaaacacccgcatagatctctttctggaataccagcgggatagtattacaaaacatatcgcgcagtaccccgccaaaaaccccggtaatcacggcagcaatggcggcgatgatcgggctgtggttcatattcagcgcaatttgtgcaccaataatggaaaagacaatcagaccaatggcatcgagaatgagaaataaacggcgcagatgtttcatcatgggggcaacccagatagtgatcaccgcagcgcaggcaacggtcacgatataggctgggttttctacccagccaagtgggtaatgacccagaataatgtcacggacggagccaccaccaatggccgtcacggaagcaataatgataacgccgaatacatccattttccggcgacctgcggctaaggcgcctgtcatggcttcagccgtgataccaatgatataaaggacactaagtagcataagtttgatcaaatggaataacgtagtagtaaagtgtaatgttggaataataacgtctcgactgaaattttttagccacatttacataagattagtttttattatgcgaaactccgcaaaataaggtaggaaaatggtctttaaggaacgccagattacattcgacagccgtagccatcagataactaatataaatatctggactcctgatagccaatggctggtatacgacgttcgccccagtggtgcgtcttttacgggtctcacgatagaaaaaattcatgtcggcagtgggcaggtagaagtgatttatcaggcgcaggatggagcgcacgttggtgtagtgacggtaaatctacaggagcctgttcgctatgcgttcatccacggtccagaaaagccagataggcagtggcagtatgattttcatcatcgccgaggtgtgattgtctctgatactcagccaaatgtagccgtcaacattgatgcgctggatattactcccccttatacacccggtgctctgcgcggtggtacgcatgttcacgttttcagccctgatggtaaccgtttgagttttacttataacgaccatgtgatgcatgaacgagatctggcgcttgatttgcgcaatgttgccgtggctatccctctgagagcagtcattccaccgaaaaaacatcccagagaatatgatggcagttatttttcggttgttgtcagccgcacgacagcgcagccacgttctggcagtgatgagatcaatcgggcttatgaagaaggctggattgggcaacagggatatctcaaagaaaatggtcagtggcagcgttgggcactggcttttattggtgatacccgtgctgagaatggcgaaaagataccagaaatttatctcgttgatttaccggagaacaatgaggattatgccattgagggcaaacagcctttggcaggaacagaagcaacactgccagcaccaccagcaggtgtgaaacagcgccgtttaacttttacccatcaaaatcgctggccgggggtggtaaatgttccccgacactggctgagaacatcaccggatggcagcaaaatcggatttttgatgaaagacgaaacgggtatcgttcagttatggtacatctcgccaaatggtggagtgccaatgcaactgactcacagtgcatatcacatacagtcggcatttaactgggacagcggtggtcggttcatcgcctttgtttgtgacaatagtattatgctctgtaatagccaaaatggcgaaatgcatcggctgacagcacgtactgatgatgcaccttctgcggatgcgattgtgatatcaccggatgaccgatatgttgctttcatgcgtgatattgatggttatcggcaagttttgattgtcgaaaccggcatcgctggtgtgggggaatagttatgtttcagcgttcgtattttctggggctgttgctgtggcagttgagcgttgctccagtttttcaaggcgatgcttaggtgagtgttcagcttggtctttgctggaacgggtataatcataggggaacaggagcgtatccagaaaggcagagaacgggagatccacggcgagcaaaggtttcatgacccacccggtactgtcatctttcagcatgccaatgctggcttttgctccagagtaataaccttgataaggcccgctgtgggtcattatgctggagcagccagtgacaagtgaccatcccagtgtggtacacaataatagaagcactttatggtttttcatcgtttccatgatctcagtgagttaatttgccgatgctcagatgctttatgtgcgctttaacattgctttttccaaagcatgaaaataaaccttgcatattattcactatagtcaggtaatactcagtttgctatagcatttatcgttaaatttaacgattttttgtgacggaaatttaaattccacttttatgtttgtttaaatgtaaacataaaggcaaattattgaataatttattaacaatacgaataaattattcaatttaatatcgatttaaactatttatttatatttaatgaatgtttggctaaaccaattttttattaaacaaataaagtcttttccaaatcgtatgcggcggtttatccactggtgatgtttttgaggattatgtcacctcaaatattggcgattattttctgggcgatgtgatgtttaaaaatgattttgaataattaaggatattttcttgattcattaaatgtgctttagatcacacaatatggctcaatcgtctcaatttcacatagtaaaggcaatttaaggcaaaaaaacccttcttattcaagttattagattcgggtttttctgattaaatagactcagttcagggaaagagtataaacagggattgttttcctttcctaattgtgtgaagaattctttttggattctaataactactgtcctgttcacaggtaaaagtcctcgttatcatcttgctccctccccctaaatgagggagctttttttgtgtccaaatcagcggatcgcttctctatgcgcgatctcaatctcttccgacagaatgcgaatgccttcttcgatcttttccaaatcaggtacatagttcatgcgcatacactgatgagcatgaggccagttgtgctccagacctgggaagaaaaaatgacccggcaccattaacactttccgtttcttcaagcgctgataaagcacttccgtggtgattggcaggtttttgaaccagagccagaggaatattgccccttccggcttatggataaggcagcgatcttctgacatatggcgacgaatgatctcaatcacgttgtctacccgcgttttataaaatggctggatgacattttgagataggcggaatagatcattgcgtctgatcatttccaacgcgatagcgggacctacaccgcccggtgcgaggctaataacaccattcatattactgacagcactgatgattttctcattagcgatgataatcccgcagcgggaacccggcaggccaagtttggacaggctcatgcataggataatattgggattccacagtggcgtcgcgtcattgaagataataccggggaacggtacaccataggcattgtcgattaacagtgggatctgatgttgttgagctagcccatctaagcgcagcaactcttcgtcagtaatgacattaccggtagggttggttggacgggagacgcaaatcaggctgatatcttcggaaatattcaggtgatcgaaatcgacccgatacttgaattggccattgggcagcaactcaatattcggtttattggcgacaaacagcccttcatccagaccagaatcggaatagccgatgtattcaggtgcaagagggaataaaactcgcttcatcgagccatcttcactgcggccagccagtagattgaacaggtagaaaaaggcgctttggctgccgttggtcaatgcgatattttgtggatggatctcccaaccgagcttttcctgtaactcttgggccagtgccgctatcagcgtatttttcccttgtggcccatcatagttgcacagggtttcgcccaactggccgcttgacaccagatcagccaatatctgctgaaaataatcatccatttcaggaatatgggcaggattgccaccacctagcatgatggcgccaggtgttctcaggccttggttgagatcattcatcaggcgggtaattcctgaatcttgtgtgaatttgtttccgaattgagaaaatttcataacggcgtttgcgtctgttgttttataggagaaagggacaccataccccgccccttattggggcgcaatggggtcaagcctgttctctgtgttgttatatattacattatgattattcattgaatttaaaaactgggtcttttgaatttctccagctttatattttaaagtgaatttatcacctgtttttatgcactgatttcaacttttcggcacaggcaacttgtgaggtgatcattaactaaacccgccgcttgcataaacgcatagcaggttgtgctgccaataaatttgaagccccgttttttcagtgcatttgacaggtcatcagaaatgggggttctgacaggaacgtctgtccgtgatttccagtgattaatgagtggggaatcatcaacaaaatgccagataaatgaactgaaatcctctccttgatcggccattttcaggtaagtgcgggcattgtggataatggcattgattttggcacgattgcgcacaatagccggatctttgagcagttgttcgacatcgttttcatccatgctggcgattttgaccggatcaaattgatggaagcatttccggtagccctgccgtttttttaggatcgtcagccatgataaccccgcttgctgcccttcaaggcagagcagttcaaagagctgctggctattcttcagtggcttgccccactcattatcgtgataggcaagataatctggatcggcggtgacccaagcacagcgaatactttccttgttgatgaattccatatctttactcccacaggcgatggtgaataattaaacttatattaactgtataaatatacaagtaaagaggctcggataagatttttttatactgcagcaaaattggcgggtgatcagtgctgtatatcttacggtcaaagggtatactgaccgctttcgtttaaattcatatgtatcgcgtgatgtatcgcgtgtggattcaacatgcaaaagtttgataccaaaacctttcaggggctcatcctgacattgcaggattactgggcgcgtcaaggctgcaccattatccaaccactggatatggaagtcggcgcaggaacttctcaccctatgacctgcctgcgcgctttagggccagaacccattgcggcagcttatgtgcaaccttcccgtcgtccaactgacggtcgttacggcgaaaacccgaatcgccttcagcactattaccagtttcaggtcatcatcaagccatctccagacaatattcaggagctttatctcggttcattgaaagcgttgggactcgatcctaccgtccacgatatccgttttgttgaagacaactgggaaaacccaacgctgggcgcatgggggctgggttgggaagtttggctgaacggtatggaagtgactcagttcacttacttccagcaagtcggtggtcttgagtgcaaaccagttactggtgaagttacttacggtctggaacgtctcgcgatgtatattcagggcgtggacagcgtttacgatctggtgtggagcgatggcccactgggtaaaacgacttatggcgatatttatcaccagaatgaagttgaacagtctacctataattttgaacacgctgatgtggatttcctgttcacctgttttgaacagtatgaaaaagaagcacaggagctgttggcgctggaagcaccactgccactgccagcttatgagcgtattttgaaagctggccataccttcaacttgctggatgctcgtaaagcgatctccgtgactgaacgtcagcgctatattctgcgtatccgtaccctgaccaaatcggttgctgaagcctattatgcctcccgcgaggcgcttggcttccctatgtgtaagaagaattgagaggccatcatgattcaacagactttccttgtggaaatcggcacagaagaattgccaccaaaggcgctgcgttcgctagctgaatcctttgcggccaattttgaaacagaactgaaaaacgccaatctgggtcatggtgaaattagctggtttgcagcccctcgtcgtctggcactgaaagtggcaaatctggctgtggcacaggctgatcgtgaagtggaaaaacgtggcccggctattgctcaggcatttgatacggaaggcaagccaaccaaagccgcggaaggctgggcgcgtggctgtggtatcacggttgatcaagccgagcgcatggtaacggataaaggcgaatggctgctttatcgcgcgcaggttaaaggccgtgaagcgaaagaacttctggcggatatggtgagcagttcgctgggcaagctgcctatccctaaactgatgcgctggggcgataaagaaactcagtttgtccgccctgtgcatacggtcacgatgctgctgggcagtgacgtgattgagggggaaattctgggcatcaaatctgatcgcattatccgtggtcatcgctttatgggcgaggcggagtttgcgattgataatgcagagcagtacccggcgattttgcaggaacgtggtcgtgtcattgcggactactatgcacgtaaagcgttgatcaagcgtgatgcagaacaggcagcgatgcagcttggcggtgtggcagatctgacagacagcctgctggaagaagtgacttctctggtggaatggccagtggttctgacagcgaaattcgaagagaaattccttgaagtgcctgccgaagcgctggtttacaccatgaaaggcgatcagaaatatttcccggtttacgataaatccggcaaattgatggcgaattttatttttgttgccaatattgaatcgtctgatccacagcaaatcatttcgggtaacgaaaaagtagtgcgcccacggctggcagatgcggaattcttctttaagactgaccgcaaacagcgtttggaagacaatctgctgcgtctggaaacggtactgttccagaagcagctgggtacactgcgtgacaaaacggatcgtattcaggctctggctggctggattgccgaaaaaatcggtgcagatgtcactcatgcgacccgcgcgggcttgctgtccaaatgtgacctgatgaccaacatggtatttgagttcacggacactcagggcgtgatgggaatgcactacgctcgccatgatggtgaagcggaagatgtggctctggcactgaatgaacagtatcagccgcgcttctctggcgatgagttgccatccacagccgtttcctgtgctgtggcgattgccgataaaatggatacccttgctggtatcttcggtattggccaacatccgaaaggggataaagacccgtttgcgctgcgtcgtgcggcactgggtgttctgcgtattctcgttgagaaaaaattgccgcttgatctccagaccttggcagaagaagccgtgcgtttgtatggtgacaaactgaccaatgagaacgtggtggatgatgtggttgagttcatgctcggccgtttccgcacttggtatcaggagcagggttacagcgttgatgctattcaggcagtgctggcgcgtcgtccgactcaaccggcagattttgatgcccgaatgaaagcggtaacgcatttccgcacactggatgaagcggtttcactggcagccgctaataagcgcgtttccaacattctggcgaagtcagaagagaagctgaatgacagtgttcttgcttctgtattgaaagccgcggaagagatccaactggcgacccatcttgtggtgttgaaagataagctggctcctctgtttgcggaaggcaactatcaggacgcgctggttgaactggcttctctgcgtgaagtggtggacgcgttcttcgacaacgtgatggtgatggatgaagatcaacaagtcagaattaatcgcctgacactgttgagtgaactgcgcgagttgttcttgcgcgtggcagatatttcattgctccagtaaatattgctgcattgttt

SEQ ID NO: 16866 - DNA, 189458 bp, Xenorhabdus bovienii
tgcattacacagcaaaaggctggtttatacctatttatacacaaatttatccacagatggatattttggtaaaatttgtcgagcatcacgcaaacgttttcgttacaattatcgcaggaaaaaacaccacgtgattttttctgattgtttcgaaatgttattgcggatgccattttttctctcaatatgctggttttttctcaatagcacagtcttgttttatgaaattcaagggatcataccaatgcaacagcttcgtccaatccgtcgtgccctgctgagtgtttctgacaaagcggggattgttgaattcgccaaagccttatccagtcgcggtgtcgaactgctttcaacgggcggcaccgcacgcctgctggcggaagcagggctgaatgccactgaagtttctgactatacgggcttccccgaaatgatggatggacgagttaagacgcttcatcccaaagtacatggaggcatccttggccggcgtgggcaggatgatgaaatcatgtcactacaccagatttccccgattgatatggtagtcgtcaatctttatccttttgcacaaactgttgcgaagccagattgctctctggaagatgctgttgagaatatcgatatcggcggcccaacaatggtccgctctgccgccaagaaccacaaagatgtcgcgattgtggtcaacagtcaggattacggcaaaattattgaagagatggataaccatcaaaattccctgacccagctaactcgttttgatttagcgatcaaagcttttgagcataccgcggcctatgacagtacgattgccaattactttggcaaactggttcctgcttatcatggtgaggcgaatcagccatcaggccgtttctcccgtacactcaatctgaacttcattaaaaagcaggatatgcgctacggtgaaaatagccatcaagatgctgccttctatatagaagagcaaattgccgaagcttctattgccacagcaacacagttacagggcaaagcactctcttacaataatattgctgataccgatgctgctctggaatgtgtgaaaacgttcgccgagccagcctgtgtaattgtcaaacacgctaatccttgtggcgttgcagttggtgcagatatgcataccgcctatgaccgtgcatttaaaactgatccaacctctgcatttggtggcattattgcttttaaccgcgagttggatgccgatactgccaaggcgattattgagcgccagtttgtcgaagttattattgcgccttctattaatgaagaagctctgccgattctggcaaccaaacagaatgttcgtgttctggcgtgtggcgaatggcattcgccagttgctggtctagactttaagcgcgtcaatggcggcttactggtgcaggatcgtgacttaggtatggtggcagaagctgatctgaaagtggtttccaaacgccagccaacagagcaagaaatgcgggatgcgctgttctgctggaaagtagcgaagttcgtcaaatccaacgcaattgtttacgccaaagataatatgaccgttggtattggtgcaggccagatgagccgcgtttactctgccaagattgcgggtattaaggctgccgatgaagggttagaagttcaaggctgtgccatggcatccgatgcctttttcccattccgtgatggcattgatgcggctgcggcagtcggtgtgagctgtgtgatccagccgggtggttccattcgcgatgatgaggcgattgctgctgctgatgagcatggtatcgccatgattttcactggcatgcgtcatttccgccattaataataggagcgccagatgaatatattgattattggcagtggcggaagagaacatgcactggcatggaaagcagcgcaatctcctttggcagataaggtttacgttgcaccgggtaatgcaggtactgcactggaagcaaatctggaaaatatagacattgctgcgacagatattgctggattgttggcttttgctcaaaaccacaatatcggtctgactattgtagggccagaagctccgctggttatcggtatcgttgatgctttccagcaagcagggctgaccatttttggcccgaccaaagccgccgcccagttggaaggctctaaagccttcactaaagattttctctcccgccatcagatcccaacagcggcctaccaaaatttcacagaaattgagccggcattagcctatctgaaaaagatgggagcacccattgtcattaaggcagatggtctggcagccggcaaaggtgttgttgtcgcgatgacaatagaagaagcacagaatgcggttaaagacatgctggcaggaaatgcgttcggagatgccgggcatcgtattgtcattgaagaatttttggatggagaagaagccagttttatcgtcatggtagatggtaaaaacgtggttcccatggcaaccagccaagatcacaagcgagtcggcgatggcgatactgggcccaataccggaggaatgggggcttattcacctgcgccagtggtaacggatgaggttcaccgccgtgtaatggagaaaatcatctcccctaccgtagaaggaatggctgccgagggtcatacctacatcggctttctttatgcaggtttgatgatcgataagcagggagagccaaaagtcatcgaatttaactgccgctttggtgatccagaaacacagccgatcatgatgcgcctgcgttctgatctcgtcgaactgtgtctcgctggagcacaaggccagttaagcggaaaaacatccgaatgggatacccgtccggcattgggtgtcgtactggccgcaggcggctacccagccaattatgccaaaggtgacgttatcagcggcctgaatcaggaagcggatacagacgaaaaggtttttcacgcaggcacagctttcaaggataaagacgtcgtaacagcaggaggccgtgttttgtgtgttaccgcgctgggcgacgatatcgcagaagcacagaaaaaagcttacctgggagctgagaaaattggctggcaaggatgtttttatcggaaagatattggataccgagccattgctcgtctgaaataagttaatgcagaaccgatagaatgaacaatcgacgaaagtgacagaattacagtttatctttcgtcggttcccaacggcaaaaatcatcattggcgaccaatagtaactgttttccttctggcgcatccagccatgcaatggtcaatatgccagcactattcttttccctttccttgagccatgcccgatcttcaggctcaaattgaatggataattgtttctccgaacaagtagtcactttaccatcctgccaatgcccctgtaccagatggacatttccggccattaaagcgtcactgatttcttttatccgtttggcatcaaaccgcaggcgaacaatctcatcgctggaaagcggttcactgtgttcttttgcctgccgctgcataaaaataaccttgttatctttatcgatccgcaatgtttcgtctattggataattatcaagtacagagcggcggatctgccacaaattaccgtaacggtattcgtaaaaagtcacagaggtatctgtattacggtaagggctgtaaacactcataatgacttgaggttgactgttttgatcattcaagcgccataaacggataacacctccgtcggtaataaaaccactggcactgaagagcggaaccttaggttgaaccgagcaggcgctgagcaatgagataaaacccaatgctagcagcccctgtagcatcaacaaaaggggcgttaaattcccctctatcttcttttttcgcaatacgattacttaactgcgtctttcagtgctttgcccgcagagaaagcaggtacgtttgctgctgcaattttaatttcgttaccagtctgtgggttacgaccagtacgttctgcacgatgattaactttgaaagtaccaaagcccaccagttgcactgaatcaccatttcgcagagattcagtgattgcattcagagttgattccagagcagttttcgcctgagttttagtcagaccagcttgttctgcgattgcatcaactaattcagtcttattcatagattatccttacagtgtgtttatcgtttgcaaagcatcgagtgcgacggatatgccgatttgacagcacccctgcatacacgcaccgatagccacttcttttcacccccaatgtagaacagagtgagggtaaatgtgaagtctttaaatccggcaattcaagcactaagtcatattttctgagttattgctccaaatttataccgatgttgctaaccttagtctcgcgaaggtcagcccttaatcctttaattaattctatatcccgttcttcgcagtctgccaataaacggtaaatttcccattgaatatcccattcctcttcaatggcaggcaatgcctttaactcatcctcagtcatttctctaccggcctgcgtcatttccagcatagcaacggtacggatggatatttcactgacggctattgcatgttctaacgttgcaccgctcaaacgagaatgaatgacttcacttaatgcaatgcacgcatcaattgctggatacacaccataaatatcatagctatctgctgatgggataatggtctctaatttttccagctggctatcaaaatttacttttgcatctttgacgatcaatgtctcccacgccagatctaaaatacgacgatactgtgcggggtcagcaaaccctgtctgacgacaaaacacctgataatttggatacattcgctcacatagactagccataaaagtccaatgttgccaactttcaaatttctctaaccgcaggtggatcgggtttcttaacattagccgttactcatgatgcctaatttgcgtcgaagtttacctgaaaatcaagaatatccacacatttccgctgcaattatagatttttctgcattgtttgcttaaaaaatggtctatttgaggcaatcccatccgcccaacgggtcggctcaggcaatctatatcccttcatgcactgttcaacccagaagaccgaactgtcaagactgaccttatggccgatggaaatatagagcggattgcacctttttttacttcgccatacaacgccaatctgctccgcatgatccatcaatggttgataacttccgacagcatctcccacaggcgggtgctcaccacacagtcggcttttggccaccccgatagtcgggatatccgcaagtaagccaaaatggctggcgacaccaaaacgccgtggatgagcaattccctgaccgtccaccatcaccagatccggccgtaagctgagtttttgccatgctgccatcaacgcggggtattcacgaaatgaaagtagaccaggaatataaggaagcacagtatcaattctggcgacctgatactctagcaattcaagcgaaggataatgcaggacagcaatagcggcacgagtcaccgtaccgtttttttcaaacccgacgtcagcgccagcaattaattctggcgtaaaaggcgtagactcaggaatcgcggaagtagaagtcgtcacgaaagaatcatgacggataacctgctgtgctttttctatttgttcctggcgtaacgcctttgtatcaatcatgaagtcatcggtgatatttttctgaaagtctgtgtaccgcttcgacgaatgctccggcatgttccggtgggacatcctgatgaatgccatgccccagattgaaaacatgcccattacccataccaaaatcctgcaaaatcgtcgaaacttcctcttcaattcgcgctggagcggcatacagcatggatgggtccatattgccctgcaaggcgactttatcgccaacacgacgacgggcatctgcgatattcgttgtccaatcaagcccaagggcatcacagccagttgccgccatcgcttcgagccattgtccgccccctttggtaaacagggtcacaggcacacggcggccttcgtgttcgcggatcaatccgtcaacgattttatgcatatattgcagagaaaactcccgataatcgcgatgagacagaacaccaccccaagtatcgaaaatcatgacagactgtgcacctgcttttatttgcgcgtttaaatatagaataacgctgtttgccaatttatccagtaacagatgcaacgtagcaggttgggcatacagcatggcttttattttggtgaacgccttgctgcttcccccttcgaccatatacgtcgccagtgtccacggactacccgaaaaacctatcagaggaacttgacctgccagtgccttacggatcgcacgaacggcatccatcacatagcccagctccatctccggatcaggtacagggagtttctccacatccgcatggctgagaatcggagagtgaaaacgcggcccttctccgctttcgaaatacagcccaagccccattgcatcaggaatagtcaaaatatcggaaaacagaattgctgcgtccaatggaaaccgacgcagaggctggagcgtcacttcacaggccagttcagtatttttgcataacgagatgaaatctcccgcctcctgccgcgttgctttatattcaggcaaatatcgccccgcctgacgcatcatccatactggtgtgacatcaacaggctggcgtaataaggcgcacagatagcggtcgtttttcaactcattcatggcaagctcccttgattaattggccgcaaaattctttggttacggtcagtttgactttcactataaaaaaccggcgcattgtaacatgccagaaatcgaacttctggcacaactgcaataacgtgagccattcgctcatcatctcggaacagtttacgtgttacgacatagcgcaaccgtctcttcgatcaaacggcgggcaatcgtatccgacggagggatcaaaggaaggtcatcatagtgataccaatctgcgctgataagttcaacgggatcatgttggatctcaccgctgtcataatctgccagaaaccccatcatcaatgattgcgggaaaggccacggctgggaagccacataacgcaggttacggatcttgattccactttcttccatgacttcacgatgcacggtttcttccagcgtctcccccacttcaacaaacccggccagcaccgtgtggataccattgcgatggtgctgatgttgcgccagcagaatatggtcatcacgacggatgccaacaataacgcatggcgcaatttgcggataataacgttcatggcaatgattgcacaaacaggcccattcatgctggctatgctgcatttcatggccacaatagccgcagtgatggtgtgagcgataaaactcggcgagttggatgccacgtcctaccagttgaaacaatgtggagttctgagaagcaaccatgcggggagacgccatctctgacgccattttctgacacaccagccacacagtctcgcctagccactcaccaataggccgcgccatatgaccttgtaatgaccattgtctggctgtccctgacggcaattcgccctgtggcagccaaactagattctcaaggctgataacccaccagcctcgttccatacctgtcagtttttgttgaatcatctaccgcaccatagttccaatgacattgtgtccaaattcagcatcagcacaggatactccttttcatcgtatcctgtctgaacatcgccatgattcaatcaatctatatcaaaatctatttatttcgaaatgagacgctcacatttcccaatttttcaccgatactttccttgaccaacaaattttggacaatatcattcactggcatatcagtcgatgagctgaaataaacacaattttggaagtgatattcaaaaaaactattgaggaataatgactatgtcacagcagattgcggtatttgatctggatgatacattgatttgtggggattccagcctgctttggacggaatatttgtgggaaaaagacattattaccgatcatcgttttatcgaggcagaccagaaaatgatggctgactacagtgctggtaaactggatatgcacgattatctggcattcaatttacaatcactgaatcaagtacactatgaacaggttgatatttggctgacagattttgtggaaactaaaattaaacctatcttttatcccgcagccaaaaaacaattggctatctatcggcaacagaacattcccatcattattatttctgccaccgtttctttcgtggtgaaaaaaatcgctgccgcatttggggtgccgacagccatgggtattgatatggtcatggaagatggctgctatacggacagtattttgggaatccctaccttccgtgaaggaaaagtcacgcgtttgcagcaatggctgacagagcagaacttatcacctcagcatatctccttttacactgattccatgaatgacctgccgatgtgtttatttgctaacaaagtgtttactgtcaatgctgatatacggttacaaaaggaagctgaaaatcatggatggagacaattgagctgggtgttataaagaaaccatttctacatccaatatattttaaattttcggatatagttcgtcgttatttttcttactactttataacgacgtttcctttccaaaaaacattacaattttcttattaagaaataccagaaccaactaaaaatacagtaaatacagtaaatacagtaaatacagtaaatacagtaaatacagtaaatacagtaaatacaataaattactataaaaatatgcatttgtttaataaaaaatccatttattcacataaaataatcagataacccataattaaaccatattatagacatattatagacatattatagacatattatagacatattatagacatattatagacatattatagacatattatagacatattatagacatattatagacatattatagacatattatagacatattatagacatattatagacatattatagacatattatagacatattatagacatattatagacatatttaactaattgtttaataacaaaataacattcatttctatacttatttaaatgatgaatagtgatttgaatattcataacggaatgggataaaagccttcccacgcctgatgatttgaaggtactcacctaatgttgcaacattaggtgaaaatgccacagaaaacatgtcgatgaaattaacgccagatcaatggcgttatgaatggtatttcaaatgcggatacagtgaatgctgagtaagcgaatacccagtctactgacttgctaaaccaatcataaaaacacataagttttaagttgtagttttcacaatccgctctatactctggggtgtttttttcttgtcggagtgcctagcgttcaacgtatatcacgatgaacacaggctgagaccgttgattcgggatccgcagaacctgatcgggctaatacccgcgaagggaacaagagtaatcatcccgctggcatatcctcctgtttctatagagatattattcagcaccaaccattactccctgcgagctccagacaagcaattttctcaacttaagcccattccggtaggcgatgctcccattcgcataacggacaggctataacacagtcaggaatttgctatgtctaataatactgttattccaactactgatatcatccctgcggccgatgtctcgccaaaaacccatccggcacggccacgcaaggcacagcgggatgcagcacaggaatttatcaattccgttcaaggcattaccttccccaactcacgccgaatttaccttgcaggctcccgcaaagatattcaggttccgatgcgtgaaatccagttatcaccaacactgattggcggcatcaatgaaaatcctcaatttgaggaaaacgaatccgtgcccatctatgatacatcgggtgcttatggtgatcccgactcggtgctggatgtgcgagctggcttgaagaagatccgtcagccgtggatcaaagagcgtaatgataccgagccagttgctactctcagttctgactttacccagcagcgccttgcggatgccggactggatcatctgcgtttcaaccagcttcctcatccactgaaagccagacaaggcgggcgtgtcacccaattgcactatgcacgccaaggcattgtcacacccgaaatggaatttatcgccctgcgagaaaatatggggcgtgaacgcatccgcagtgaagtcctgctccaacagcatccggggcaaagtttcggggcgaacttaccggagaacatcacgccagagtttgtccgtcaggaagtagccgctggccgggcgattattcccgccaacatcaaccatccagaatccgaaccgatgattatcggccgcaattttctggtgaaagtgaatgccaacatcggtaactcctccgtcacatcctccattgaagaagaagtggaaaaactgatttggtctacccgctggggtgccgatacggtgatggatctctctactggccgttatatccacgaaacccgcgaatggatcttacgtaacagtcctgtacctatcggtacagtccccatttatcaggctctggaaaaagtgaacggcgtagcagaaaacctgacatgggaaatgttccgcgatactttattggaacaagccgagcaaggggtggattatttcaccatccacgcaggcgtcctgctgcgttacgtaccgatgacggccaaacgtctgaccggcatcgtctcccgtggcggttccattatggcaaaatggtgtctctcccatcatcaggaaagcttcctctatacccatttccgcgaaatttgtgaaatctgcgccgcctatgacgtttctctgtctttgggagacggtttgcgccccggttcaattcaggatgccaatgatgaggcgcagtttgccgagctgcataccctcggcgagctgaccaaaattgcctgggagtacgatgttcaggtgatgatcgaagggccgggacatatcccgatgcaattaatccgccgcaatatgacggaagaattggaacattgccacgaagcgccattctatacgctggggccactgacaaccgatatcgctcccggttatgaccatttcacctccggcatcggtgcggccatgataggctggtttggttgtgcgatgctgtgctacgtcacgccaaaagagcaccttggtctccccaataaagacgacgtaaagcaaggtctgatcacgtataaaatctcggcacatgcggcagatctcgccaaaggtcatcccggagcacaaatccgcgacaatgccatgtcaaaagcccgttttgaattccgctgggaagaccaattcaatctggcacttgatcctgaaaccgcccgcgcctatcacgatgaaaccctgccacaacaatccggcaaagttgctcacttttgctctatgtgtgggccaaaattctgctccatgaaaatcacgcaggacgtgcgcgattatgcagcaaaactggaacaggaagcaggcatggaacagatgtcagaagaattcctcgctcatggcagcgagctgtatcacagtgctgaggacattagcgatgaaaaatcagcctgaatcctcaacaattccacaagccccttttgcctcaaccgtgcaccgtttggggctttatcccgtcgtggattccctgacgtggattgagcggctactgaaagcgggcatcagaaccctgcaactacgcatcaaagatctccccgaagatcaggtagaagaggatatccaatccgccattgtattgagccgccaatacaatgcccgcctattcatcaacgattactgggatctggccatcaaacatcacgcctatggtgtgcacttggggcaggaagatctagatatcgcggatctcaatgccatccggcaagcagggctgcgtctgggcatttccacccatgacgaacatgaactggcacgggcaaaagccctgaggccttcttatatcgcactgggtcatattttccccaccgccacgaaagagatgccttcaaagccacaaggcctttcggcattgaaacatcaagtggaaataaccccggaatatcccaccgttgccatcggtgggatttcactggatcgcgtgcctgatgtcgttgcaacaggagtgggtggcgtagcattggtcagcgccattactaaagccaaagattggcggcaggcaactgacagattacttcatttgattgaaggaaatgatcggaggctcttatgttaaacgaccaagaatttatgcggtacagccgtcaattgctgctggaagacatcggccctgatggacaggaaaaattaaaagcaggaaaagtactgattgtcggattgggtggattaggttcacctgcggcactctatcttgcagcggcaggcgtaggccacctttatcttgcagatgatgatatgttgcatgtctcaaacctgcaacgccaaatcctctatcgcacagcagatattcccgcaggaaaggcggttttggcagcgaagcaactgactgccctgaatccgctggtcgaagtcaccgtgctgaccgagcggcaagatcgtgaatcactggaaaatttcgtccgtcaggtcgatctagtactggattgctgcgataacatggcgacgcgtcatgctatcaataccgcctgtattgcagaaaataaaccgctgatcagcggtagtgccgttggtttcagtggacagcttatcgtattcgaacccccttatttgcacggatgttatgcctgtctctatcctgatcaggaagagccgcatcgcaactgtcgtacagccggtgttttagggccggtcgtcggggtgatcggcacgttgcaatcgttggaggcaatcaaaatgctggtgggtctcccctcctccctgagcggaaaactacgactttttgatggcagacagcagagttggagcacgttacagctaacatcatcatcgcagtgtcctgtgtgcggaacccatgcctcaaaatctggttccacaaaacctgatcgcgcagaaaccgtttcaggcaaaacacgctcgggaagagaggtcgcatgaacattatcgtcaacgatcaaccgatcacactgagtacgtcgatgacggtgcaacagttactcgaacatgtacaacgctcccaatcaggcaccgctttggccattaatcaaaccattattccacgctcagagtggaacacccatcagattaatgacggagataatatcctgctgtttcaagccattgccggaggttaattatgttaaaaatcgctgatactctctttcattcccgcctgtttacgggaacaggcaaattcgccaatgcaaatttgatgatcgagtcgatacgtgcttctggtagccaattggtcactatggcgatgaagcgcatcgacctgcatggcaatgacgatggcattctcgccccactacaacagttaggcgttaaattactgcccaatacctctggggcaaaaacagcagaagaagcggtgtttgccgctcgccttgcgcgggaagccctaggaactcactggatcaagttggaaatccatcccgatgtaaaatatcttttgcccgaccccatcgaaacgctgaaagctgccgggcaattggtaaaagaaggattcgttgttctgccctattgcggcgctgatcctgtcctgtgtcgccttctggaagaagtcggctgtgctgccgtgatgccattaggcgctcccattggctcaaacaaggggctgctgacgcgagattttctgcaaattatcatcgaacagtccagagtacccgttgtcgtggatgccggtatcggggcaccaagccatgcactggccgctatcgaaatgggtgctgatgcggtactggtcaatactgccatcgccgttgcccgcaatcccatcaaaatggcactggcattcaagacggcgattgaagctggcgagctttctcatcaggctggtgtggcaagccagaaatcacatgcagaagcttccagtccactgaccgattttctgggggcgttatgacagacaacacagttatgactgatcatacatttcgccagcgctggcagcagttggattgggacgacataacactgcgcatcaacagtaaaaccacgcaggatgttgagcgagcattaaaccgcgatcgtctggcaatggatgattttatggccttgctctctcccgcagccctgtcttaccttgagccgctcgcccaacgtgctcaacaactaacgcgccaacgattcggcaataccgtgggattttatatcccactctatctttccaatctgtgcgctaatgactgcacctattgtggtttctccatgagtaaccacatcagacgcaagacactcaatgaacaggagattgaagctgaatgccaagccatcaaaaaactggggtttgaacatatcctgttggtcacgggagaacatcagagcaaagtcggcatggattatttccggcgctatctccccattatccgcagccagttcagttctatcacaatggaagtccagccattggcacaggaagaatacgctgaactgaaaacgctggggttggatggcgtgatggtctatcaggaaacctatcatgctcccagttaccaactgcaccatctgaaaggaaaaaaacaggattttcactggcggctggaaaccccggaacgcctaggacgcgcaggtatcgacaaaatcgggctaggtgcgttgatcgggctgtcccctagctggcgtaccgattgttatatggtggcagagcacctgcttttcctgcaaaaacaattctggaaaagccgttactctatttcctttccaagattgcgcccctgcgcaggtggcgtagaaccggcttccctgatgagcgaagctgagctggtacaactcatttgtgcatttcgcctgctagcaccggatgtggaactttccctatccacccgtgaatcaccgtttttccgcgatcacgttgtaccactggcaatcaatcatgtcagtgccggttccaaaacccagccggggggttatgccgacgatcatcatgaactggaacaatttacgcctcatgataatcgctcagttgttcaggttgccgcagcactggtgaaatcaggtttacagccagtctggaaagactgggataattatctgggacgttagtttcgtttcttagagcctatacccatcgtaattgaagatacttgatttttcattcgtatcagatcaagatcgcgcccatgaaaattactctgacagatgcccaaaaagaagccctcgaattgatgcacgatacgactcgtgatgggcgcgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacagacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgtgtataaacagcaacactttattaagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaacaatatctatttctcggaggcaaaaacattccgtgaaacgctgcatcacttttttcatgtcacattgccagaaaaagcgaaagaactcaccacccggttgacagataatttccagactttaattcctgcatcttcaagttaattgcgtatatataattaggctctccgttttatatctatatacgatgaaaactgccctgtttttcagttgacagaatccttgatgaaatctggcttatcactggtttgaaaaacaagggcggttttgggattattattttctctaactcaaatcatgcaggtgtcttttcagcgatgatttcaaactaaaatcggagaactttacctgcaacccttctcgttccggcgaacaacacattgctccgataaaaatccgctgactgtcaacagcaaaaggcgataaccgcagtaacggccatttcaccccatcagtggaatattgcagtctgatcactccttcaccataagtcagccttaaccagaacttatcaggattacccggaaagacgcccatcgcccagtcagagcaagaattcgttagcacactgccgatcgtcgcctgaccatcagaatgctcaacacctgcttttaaccaatgttgctcatccaccagcagcataatgccagcctgatcgtataaatgttcaaaacacccttcgatacaaatttggaaagtaaaacccgcttcaacatgaatatcatcaacatagcgaccaaaaacatggccgctatgacgctgaaagccataccatgtatcacgccaaaaatcagttttaatatctgtcgtcacatggagtacatcttcttgatgcttccacgaggcaggctcattaagccaatggcagtgctgcaaattcatcaatagttaacctgttattttctggcgggatgaatcaatccatagcccgctaacaatgtaagagaaagtaaagcaatacaggcaaaagcgccatgcaatgtgacctgatgagccaaacctccgataattgcaggccccagcaggatacccgaatatcccatcgtagagacggcagaaaccgcctgagaatcaggcatgactttctgctgccctgaagctgtgaaaaacatcggagccagattggataaacccgctcctatcatcaggaaagaaatacccaatacaatcatgctggatgccagatagatcaggacaaaacccgaagtagccaaaattgcacttgccagaaaaacccgccggtatccaaacatcgagataattttatcgcccaaaaagcggccacatgtcatggtaatggcgaaaagcgtgtaaccaaaccccgcctgatggctatccatattatggacactactcagcaagatcccgctccaatccaacatggagccttccatcagataaacgacaaagcaaagaaaaccgagcaggatcacaataccacgaggcaaggcaaaagatggggtattgcccgtttctatgtgatccaataatccgttccatgctggcagcaacaatagaataatgaataatgccactgcggacatgacctgaaatggggatattcccatcaacaacagtaaactgactgaccctgcacccgcaattccgcccagactgaacaacgcatgaaaaccggacataattggctgctgcaccattttctcaacattgactgcatgaatattgatcaccacatccgtcgcgccaatccccacgccgaacataaacagcgcacaagctagtgcccaaggggttggcaatatacttaaccccggtagcatcaaaattgccagcagggcaaacaggggaaaaattttcctacaaccgaaacggctggccagcatccccgccaaaggcatcgtgataaaggaaccaatgccaaataccagtatgagcaaccccatagcaccatcatcaagtgcaaatctctccttaaccaaaggaataagaggtgcccaagctgccatactgaagccggcaataaaaaaagcgagccgtgtcgcgatgatcggctgctttatcgaagaaactgcatattcctcagacaacttaattcctccataaccctgttctctagaactatcttttctagaaccctatgttccaaaacaatgtactctgacgcacaatcatgccctccacaggttttgctggaggacatcaatattgcttacattgctattgcacttacattagcatcacgctgacagcgaatttatcccagaaaattgcggaatatccgtcaattcaccaataatacaagtcgcctgcccgtactgttcagccaccgacaaatcatgaggccaagcatatacccacgggatccctgcttgttttgctgctgcgatccccagatccgtatcttcaatcaccaaagtctgctgaacatccatccttttcagctttagcatggcaaggtagggatcaggaaaaggtttagttctttcaacatcatcaccggaaatcaaggcaggttcatcaaacaaacccagtaaccccaaattagccagacaaacggcacgcggtgcggtggaaacaaacccaaaagcaatgtcattttgctgtaaggccgcgatgagacgagtcacccccggacgtagataatgtgcagataacttttcctgataaaccgagataatcttgtcggtaatgccttgctgctcgagtaatggaacaccaatttcattcagtgtttccgccagactcaaaccaatcaattgctgtggctgaatatcacgcgtgtgatcaggtgccagtccacacaacacatcaaaatgcagttgttcactatcgacaatgaccccatcgatatcaaaaatgacattgaatttatccatcagaaatattccattacttaaagtcagccatacggatcaataccttgcagtttggtgtactgagcggcacttgagctttctcggcaatatcacagcccacggtgagaaaagcctgctgataatcctcaaaatcaaagatctgactaatcaggcgttcagcggggataacaccatcccggatcatggcgtaagcacgctcaaaactgttgttcaaggagtcaatcgaaccgatgacagaaagacttttgtcggcaattttcagaatatcaagattggcatgtttatcttttaaagcgacattcagcaacttaccgcctgcggctaaatggtcgaaaacatattcggtcagttgtcccgtggtatctacacataaatcgatcagggctgatttatcaccgtattcctgcgtcaacgcttcatcaaaatcggtatataaccgacattctgccggcaggttgttgatagcaaactgcacacgactcgggtttttctcgatcatgaatgccttaacaccccgttcatgcaacgcccagagatacagcattcccatagggccagccccagctaccacggcccgaatattggtatgggtgatccccagtttatccactcccgtcagtgtgcagctcaaaggttcagtcaacgaagccgcttccatactgacatgctcatcaagcttgatcagcgagctttctttcgccaaatactgctcggcaaatgccccatcgtaagaaacccccgcttccgtccccaattttttctcgcagtgattgggattacctgtctgacacatcctacaatgtccacaggagtatgtcggattgataacaacacgatcaccaatctgaaaacgggtaacatgactaccaatttgcgtcaccactcccgtggtctcatgccccaatgtggttcccggtaccgctacaggataagaaccagtaatgattcctatatctgtgccgcaaatcccacatactgcaatatcgactaccacatcatccgattcaatgcagtgcaagggttcaacttgctgaatctggacattccatacttggttgaatttcagggctttcattatgcaacctctctgtgcttcggtgcagaaaccgtcaattcagcgaatgccagatccagtttatggagaatttcatgtaagtgttcctgtgtacaaaccaaaggaggacgtaccttaagcgcccgccctttgccataacgggagccacgcaggatcaatcgttgacggctggcggtttcaatcacctgtgccgcaaattctggggttggagtatcaaaaccgaacatgtagcccatgcctctgacccccgtgatttcagggtatttatgctgtaaggccaacaatccatcacgcaggaaagcctcgttctgctgcacattttccagaatggaatcatcttcaataatatcaataacttcgttgagagcgactaaagacaagggattagcaccggaagtactggaatgctcaaatgattccaacacatccagcgagctgcgcatcagcacaccgccagtcggaataccaataccccctgcccctttcgcgaacacaatgatatctggctctaattccttggcataacctgtcgatgcaaagaaagttccggtacggccaaaccccgtctgtacttcatccgcaataatgatgatgccgtgctgatggcagatttccctgattttacgatagaactccacggggaaaacggtgttgccgccattgccctgaatcggttcaataatcagacatgcgatattgtcactggaacccaactgaatgaactgttccagatcggcatattggctctctttctcattcgagtcaggttctaccatgacactggcaggtgctggaatttttatcgaaccatcaatactgatatggaagtctttaatcctgaacgcattgccggagatctgcgctgttgcaagagactggccgtggtgggcaagaaagaacgagataatgccagagcgtcctgtggctttttgggcgatacgaatggcaccttcaacagctccagaaccggaaacatcccgcagccacattctgtcaatgccttctggtgtatgtttcaccaatttggtcaaaatatactgtgacatttctcgcgtataagcagaacttaaatgcgtacatctatcaatctgttgcttgagtttttccgcaactctgtggttagtgtagccaagcggcaaattaaacgtacctgatgccgcatcaatatgcttttcgccatcgatttccaaataaggaccgtgaccaacaaaacgggaaagcatatcgtcaagatgatttctattttccataagcactaaccaccattagttatttttaacaattatgagcgtaccaaatgtaatgagattagcttagacccattcaaacgtgatatctatcacataaaacccataaaaaatataaagttattttaaaaattaatttatatttaaattgcatataatttagtattaatatttatttatgttattagcaaaaatattactaaacttaaatattcattgattcaacactcaaccccattatttgcatcaaatgttgagcctgttgaatagcatcctgccggtgggtaatgcccattttctgatacagattacggatatgcgtcttgatcgtggtcgcggcgacctccagttctgcggcaatttgatcgttactgtaaccggaataaatcaaccccaatacctgccattcacgctgagtcagcgggctattgcggataagttccggtacatcagggtgtgtaagaagctgctcaacaaacgtttcatcaaaatgggcaaatttatgccgatgctggcgattaatttcccgcaggatacgctgggcacggtgttgctcaagttcaggcagaatattgagctgaataagctggcgcaattgttgagccatcaactcaccttcaagtacaaagtgactaataaatcctgtgcggttagccaaactcagggcttccatcaaaacagcctgtgcttcagccttgtgtccaagctgccagtgcagcagattacacagcaatagattgcggttcaaatcgcttatcagcagcaattctctcgcgtacttattcagcattcccaggataggttcagcttcctcatactgaccaagtaggatctgtgcacgggcgatattgcgccattgattctgattgaaatggttattgaagctttctggccgttccgcctgtaccaaccactgagtcgccgagccgctatcttccaaattctgccagataatgacgcgtagcttgtcggtattggttcgccagtcacgatgataatgcccgttattcaacagattttcgcagcgggacaggtaacggcgggcattatcaatatcccctcggatcaaggaacatttcgccagttgggtcaggcattgtaattgctgctgaggctggacgctggacaacacttccaggcctcgacgcgccgcttcttcagattcgtctatccgcgcccaacaccacaaaagctgtgaacgaatgcgtaacaggaattcgtgcatcggcaactgttctaaatgctgctcacgaatcaaatcaaaagcgtggttttgaatttcataggctgcctgcaaatagccctgagccaataagatctcactttgctgcaacaacgcccacaaagcatagtgataaacatggcagcgtcgggcaagttgctccgtttgcttcatcaatgccaatgcatgggacaattcccctttacaatgcagaacttcccctttcaccgacatcgcaacaatccggccatattcattgtcgggcaaaagggctgccaaagccttctcagccagcgtatcagcatcgtccggccggccatcgttaatcgcaacttgggcacgcagggcatcaaattctgccagcaattccggctcaataatgatttgtttctgcttcagcgactgttctgtctgattcaataaagcattcacttcataataacgatgctggctctgtgccagccatgcctgtaacagtactagacgcggattttccagtaattgctcatatggcagtgcattcatgcactcttccaatagtgacagcttgctgtggttaaacagaccccaagcatgttgcagcaaaatatcacacaacagtacggtatctccggcagccagcgcatggtgaatggcttcccccggaaaaccctgcatcaaccagccttctgctgcggccctgtgcaattctggcaatttcgcggccatttcccactggcatcgttggcgcaggaatgaggcaaacagaggatgaaaacagaaccattcgccagaatcatccatgcgttggataaacagcccctgacgttcaatatcctcaaggcgttgctggccattatcctctcccgtcagacaaacaatcaggccatcattcatcgagcgcaggatagaactgcgcagcaggaaatcccgcgtatcctgatccacacgatttaaaacctcatccacaagataatctgcgagatggctggcattgatccccgaaaggcgttttgccgacatttccgccgtattgcctgactgacgggcagaaagggcaataagctgcaaggccgtcgcccaacccgcgacgtcgttgcataactgtttgcaattatccgcacccagtgggctggccagccttttatcaaaaaactgctgggtttcctgataatcgaaggccaattgctggctatcgaattccaataactgttcacgcacacgtaggttagccacacccaacgatggcaaatgacgggatagtattgtcaaagtcagattttcaggctggtgacggaggaaaaagcgcatggcttcatgaatgaggttattctctatcaggtgataatcatcaatcaccagaaagatcggctgtttccattcactaagttcaataaacaactgcgcaaacaatgcgggtaaattggcatactgatgcttctgagccagaacgtcactttttacacaatgcccctgtgttgcctgctgaatagcagcgatcaggtagctggcaaaacgttccggctgattgtcactgtcatccagagagtaccatcccagattactctgtccggcagcccattgtgacatcaatgtagttttaccataccctgcggggctggttatcaataccagacgatagtgctgtacttcactgagcagttctaacagacgctcgcgcatgaccatattattaaggcgaagggggcgactgagtttcgatgggataagcattgatttcttcccttcataagcaatgaataaaactgataccaaaaccctgttcaatgttattgattcattttcaccactaacattcattaatgcccaaccaaatttagagaaacgcctatcttttgcaaacaggttggttgatttcattgtgttaagttgcaccctgtcacattctttgcttacaatttttcctgttcccaatgaaattgcgaaaagcctcgaaaaaacgggacaagtaggaaacttttcctatcaagttgttgacccatttcttctgccacctgccttgctgtttatttaaatacggccaatggctacgcccttgcactcctccctgtgaatatccccgtaggatgatgcctaccgcctcaagaatcttcagcatatcccgctaaatcacctccatattttccttattcagtgacaggatgaagactccatgcaacagcccaaattagataaagccgtctttcaagccgcgcttacacgccagtggcagcgctttggccttagttcagcacaggaaatgaccccacatcagtggtggcaggccatcagtgctgcactattagaattacttccctcttccagccagaaccatgcccatcagtttcataaccctaagcgtcatgtgaactatatttcgatggaatttctgataggccgtctgacagccaacaatttgctgaatcttggctggtatgacgatgttcaggcttatctggcagaagatggactgactttgagtgacttactggaacaagaagctgatcctgcattgggcaatggtggtctgggtcggctggcagcctgttttcttgactcaatggcgacgattgatcaacccgcaacaggctatggccttaattatcagtatggcttgttccggcaatcctttgatcaagggctacaaattgaggcacctgatgactggaagcgcggttcctatccgtggtttcgccataatgcccaattgaaagttgacgtaggtcttggcgggaaaatcgtgatgacagccgaaggtcatgaaacttggcttcctgcctttaccttgattggcgaagcttgggatctgcctgtcattggctatggtaatggcgtcacacagcccctacgcctgtggcaagcaacgcacgataatccttttgatctgtcacttttcaatgacgggcaatttctgaatgctgaacaacagggcatcgaagccaccagcctgaccaaagtgctttacccgaacgataaccatcaggccggaaaacgcctgcgcctgatgcagcaatatttccagtgtgcctgtgcgatggcagatattctgcgtcgtcatcagcaggctggccgcaaggtggaagaattaccacgctacgaagtcatccagcttaacgatacccacccgactatcgccatccctgaaatgatgcgtctcctgctggatgagtaccaattggattgggaaacagcatgggaaattacagggcagactttcgcctatactaaccatactttgctgccagaaggtttagaacgctgggatgagcatctagtcagtgaactgctgccacgtcatcaccgcattattcaggaaatcaaccgtcgcttccagaaaaccgtggagcaaacctggcctggcaatcaacaggtgtgggaaaaattagccgttattcacgaaaatcaggtaagaatggctaacctctgcgtagtcgcctgttttgctgtcaacggtgtagcagcattgcattcatccctaatcgtgacggatctgtttccagagtactatcacttgtggccggaaaagttccataacgtaaccaatggcgtcacaccgcgtcgctggttaaagcagtgcaatccagcactctcctcactgattgaccaaaccttgaatcatgaatgggttaatgatcttgagagcctgaaacaactcgaaccttatgccaacgatgcagctttctgcgaagcttatcgcagcatcaaacaggaaaataaaattcggttgtccaactacgtcaataaagtcatggggcttaagattgatccccacgccatttttgacgtacagataaaacgtctgcatgagtacaagcgccaacatttgaacctgctgcacatcctctctctgtatcgacagattcaggagaatccgtcactggatatccacccccgcgtcttcctgtttggcgccaaagcagctccgggctactatctggcaaaaaatattatcttagccattaaccatgcggctgaaaagattaatcatgatccgatcgtccgtgatcgtatcaaaattgcctttattcccgattacaacgtttccaccgcagaattgatgatcccggcggctgatgtctcagaacaaatttctactgcaggtaaagaagcctccggtacaggcaacatgaaactggccttaaacggtgcattgaccattggcacgctggatggcgccaatgttgaaatcgccgaacaagtcggcaatgacaatatttttatcttcgggaacaatgttgaagaagcaaaagccttactgaaaagtggctacaatccacgggagatcctccagcagaatcctcatctacaaggcatactggatgcacttgccagtggcgaattcagccacggagacacgcaggcattcgatctcatgctgcatagtttggttgatggtggtgatccttatttagtactggcagattttgactcctactgccatgcccatacgcagattgataccctgtaccgtaaccctcaacactggacacaccgtactattctcaacactgcccgcatgggtaaattcagttctgaccgagctattcaagattaccaacagcgtatctggcaggccaaataaggttcatcatggaaaataaacacctcgacaatttggcaacagaggctggcatagccgccgaatatattaatgcctacgggaaaccgcaggctatccctgccgaaattcggcatcggatattggcagccatgtatacagatccaccggccaataggccggtttctgatttacctgttttaaccgtgcctgtggttaaagtgatgactcaaggtcagacaatcactttacctttgaacagtacagaaaattatcggtggcaaatacaaacagagcaaggagagatatttcaaggggattgccaatatcaaatcactctgccggctaaccttcctctgggctatcacacactgacattagtgccaatacaatcaatatcagcaaaagaacctcatacccagcacccagttatgcagattattgtggcgccagaacgttgctatgagccagaaacgctgataaatggcggaaaactctggggagcctgtatccagctctataccttgcgttcagaaaataactggggaatcggcgattttggcgatctgaaatatatgctgcaagaactgacgcaacggggtggcgcatttatcggcctgaatccacttcatgccatgtatccagccatgcctgaagacgccagtccctacagcccttcttcccgtcactggctcaatatcatttatattgatgtgaaccaggtagaagatttcacatacagtgttgaagctcaaaaatggtggctattgccggaaactcagctcaagctccagcatgtccgccaaacagaattagtcgattacaccagcgtgatgacattaaaaataacagcgctgcgtctggcttatcaacagttccaaacccgatccgctacagatcacctgtacattgcttttcgacaatttgttaccaaaggtggtaaaagcctttactctcaagcagcctatgacgctctgcaccgtaaactctacgacgaagacagcgcttactggggctggccggtatggccagaaaaatatcgtgaacctgatagcgatacggtgaaggaattctgccaatcacattggcaggaagtcgagtttttcctctggttacaatggctggccgatacccaattagctggctgctttaccgaaagccagcacaatcatatgccaatcggcatttatcgtgacttggctgttggtgttgcacaaggcggctcagaaacatggtgcaaccgaacggtgtattgcaccaaggcatctattggcgctccaccggacatactcggcccactcggacaaaactggggcttacctccgataaacccacatgtattacgagcccaagcctatcagccttttattgaattactgcgtagcaatatgcgccactgtggggcattacgtattgatcacgttatgtcactactcagactatggtggataccacaaggagaaactgccgataaaggggtttatgtccattatccagttgacgatttgctggcgatactggcgctggaaagccaacgccaccactgtatggtgattggcgaagatttagggatcgtgccagaagaaattgtcgggaaattacatgaccgaagtgtctattcctataaggtgttctattttgaacgggatggacacggagaattccgctcacccgatgaataccccacacaggcaatggcaaccattactacccatgatttacctacattacgcggattctggcaaaacaaggatttgatgttgggggaatcaatcggcttatacccagataccactctacttgatgggttatatgatgaacgtaagcattgtaagcagaagttattggacggtttgaaccgccatggttatttatctgcatcactgagcatgacagacacgccagctccgatgtcagcctccatcaatcaaagcatacatcgctacattgcccacagtaccagtgccttattgggattgcagcccgaagactggctagatatggaactccccgtcaatattccgggaacgtccacagagtatcccaactggcggcgcaaactaagcattacgctggaagctatgttccaagatgaacatatcaaccacttacttcaaacggtaggagagtaccgaaggtaaattccgtaatcacttaaaccaccatcgatagttgttctatcgatggtggtgtagctttttaactgaacatcaccccttcacgctccctgatgttaacccaccgactaaccagcgctgtgcaagcaggaacatcacggtgatagggattgcggaaagcaccgctgcggcagcaaaatccccccagagggagctttgagggtgaaggtactgttgcattcctaccgccagagtataactgtctacatcccgcaacagcagtgacgccacaggaacttcggttatgacaccaataaaagacaggataaacactaccgccagtattggcacggaaagcggtaataatatcaaacggaaaacttgccacgatgtcgccccatccagcattgcggcttcttccaaagaaccatctagcgtttcgaaataacctttgatcgtccatacatgcagtgcaatccctcccatataggcaaaaatcacactaccgtgagtattaagccccataaatggaatataggcacctaatcgatcaaagagcgcatatagcgccaccagcgaaagtaccggagggaacatctggaaaatcagcatcccttttaacaaagtgcttttgccacgaaagcgcattcgagcaaaggcataagcacaggtcgttgacaaagccacaatccccgtagccgtaatgaatgcaatttttactgaattccacaaccattgtatgacggggaatggtgggggggtgacacgtccatctggggattccacgctataaccaagcgccagtttccagtgttcccatgaaattgtttcagggataagactacctgtggcaaaatttccaggtcgcaaagaaatagcaatcaccatcaacattggcaataagatcaatgcaataaaagccagcattaacatatgtgttgcccctacccgccaccgttgtgatttcggttgcaccatcgccattacccgttctcctcaatcaaatttaatacgagtcgctttcagattaatgatggctaatgccccgaccaaaaggaaaatcaacgtagcaatagccgcagccaaaccaaaatcctgtcctccgcccccttcaaaagcgatacgataggtataattcaccaaaagatcggtataacccgcaggggttgttgtaccaatgcgatccggcctgccattggtcagcaactgaactaaaacaaagttattaaaattaaaagcgaaactggcaattatcaacggagtcagcggcttaatcagcaatggaaaagtaattctggaaaaattctgtaatggcccagccccatcaatggccgatgcctcataaagatcatcaggaattgacttcagcagccccatgcaaaggatcatcatatagggataccccagccacgtattcacgataatcaacatcgttcgcgccagtgttgggtcggtaaaccactccggtttcaaaccaaacagcccgttaagcagcaggttgatttccccaaaactctggttaaataaccctttaaaaatcaggatggaaataaacgaaggaacagcgtacggcaaaataagcagtacacgataaattgcccgtcctttgagcgcctcccactgcacaatacacgcaaggatcatacccagcgccaccgtcaatatcaccgttagcagggaaaagatcacagtccagacaaaaatcgaaagaaagggtttttggataccgtcatcctgaataacccgcaaaaagtttttccaaccgacagaaaccgtgaatcccgggcttaatgttccctcactccagccgccctcagcgttcgtggcttgatagaaccctgtatccatattcggtcgatattgtgtccccgtttgattgttggtcagggtgatgccgtcttctccaatggaatgaaggggatgtatgccggaaaactgacgcagtgaactcatacgtaacttactgccatccggcagaacagtaacaagctgacctaacgcctgccgatactgagttatggttcgcaatgcggcggcatcactctcaaaaaccttttcctgcttatgcaaaggtagaatgacttcttcccccgcagatgtagataaagaaaaaggatcagataccagtaattgagagctactaggaacactcaaggccagtacccactgttcagattcaggataaagtttgaaattaaatgtctgacctgcctgatattgacgactcatcaacaccgtttgagcccgttcaaaagttagttgatttgtactgctatagttcgtgaaagcaatggcgacagtacaaataagtggaaacaatacaaacaggctcatgcccgcaattcccggataggtataacgccaagcataagccttacggttagcaaagacataaataccacttcccagtaataccagtgtcagcatggcaaacaggtattcaccttgggcatacatcaatacaatcaaataaccggtaaaaaataggcacagactgactccgaaccattttaggacaggatgcgaccaccattctgttttgtccaatctcgctgacatcatgcacttcctgttactaagagcctatcccaatagacactaacgctccttctataccgttcatctttcaaattgccgccaacaaagcggcaacttgaaatctattgggtataaaatcaggaacctgttattcgtttatttagctattcgattttctgcatcattaagcgcggcatcaatagcttgccgaccattcactgcattaaggacagcactgcgcatggcataccaaaaactactcatttgcgaaacattcggcataatttcaccttgctgagcatttgccatcgtggcagcaatacgtggatctttcgcaaggatatcctgataagatttcagcgccacagcccccaacggtttgtccttatccactgttgccaagccttcgttggtcagcaaatagttttccagaaactccttcgccaattctttattaggactagctgcattgattccggcggttaagatgccaacaaacggtttagagggttttcctttaaaggttggcaataaagtaaccccataattgatcttacttttgtcgatattcgtccaagtccacgggccattgatggtcattgctgttttgcctttattgaaagccgcttcagcaatggagtaatcgatatcagcactcagatgtttgtttttcaccaaatcaaccaagaattgcatccccgctttggagcccgcattattcactccgctatccttggtgttataggcaccattctccactttgaaagcgtagcccccatcagcagcaatcagtggccaagtgaaataaggttcctgcaagttgaacatgattgcgcttttattctgctttttcagttcattatccagcgcagggatctcttcccatgtctttggcggagatttcactaaatctttattgtaaataagagaaagcgcttcaactgcaatgggataaccaatcagtttgccatcataacgaaccgcatcccaggtaaaaggaaatagcttgtccatgaacggttgatcaggtgtcacttcggccaataaaccagattgggcataaccaccaaagcgatcatgcgcccagaaaatgatatctggcccatcaccgttcgcggctatttgagaatatttttcttcgaatttgtcgggatgctcaacagcaacaggaatgcctgtctcttttgcaaatttctcaccaacctgtgccagcccgttgtatcccttatcaccgttgatccaaatcaccagcttgccttcttccagctttgcaaaagcaggggcagagagtatccatgtcgttaaaacggaaagcatcagagcgcgagcacccactttcagagttgtttttgtcatcattccgtccttttcgtcgtttgcaggttcaagatgaatttctcgttacaccgctagaaaatggttcccagtgtgcaatcaacggaaggcaagctcatcctcccctgttctacgcctcaccataaatgagtgtgaacttgattacaaaaacactgaaaatcaggatgttaaccttaaagagacatcaatttttgcgatttaaatcacatcttgctcagtgatttttcacggaatctctcaatcacattaatctcatcctccttatgcctcccccataaaaaattatgggatggaggatttttattcctgttattttgcacacaattttgccaccagtttttcactaagtttttactacaaacatgaaactagggtgacaactccgaggggaacacatgtccagcgtcacactccgcaatgtatctaagacttatggtgaaactgtcatttccaaaaatttcaaccttgagattgaagaaggggaatttgttgtttttgttggtccatcaggatgtggaaaatcaacactgttaaggatgattgcaggtctggaagacattacctccggtgatttactgatagcaggacagcgaatgaatgatgttcctcctgccaaacgcagtgtaggtatggtttttcaatcctacgcgctatacccccatctgtctgttgctgacaatatgtcattcggcatgaaactggccgggatcaaaaaaagcgatatccagaagcgagttcaacaagttgcagaaactcttcagctcgcccatctgctggatcgtcgccccaaagcactatcaggagggcagcgtcagcgagttgccattggccgcactctggtcgctgaaccgaatatctttcttctggatgaaccactctccaatctggatgctgcactgcgtgtccagatgcgcatcgagatttcacgcctgcatcaacgccttcaacgcacgatgatctatgttacacatgatcaaaccgaagccatgacgctggcggataaaatcgtcgttttggatacgggcaacattgctcaggtcggtaagccactcgaaatttatcactaccctgccaaccgttttgttgcgggcttcatcggttccccaaagatgaatttcctaccagtcaaagtctctgccacagcagtcgatcaagtacagattattttgcctaacgggcagcatgtctggctaccagttgaaagtaaggatgtcactgtcggtagcaatgtatctctaggtatccgccctgaacacctgctgcctaatgatgtggccgacgtaacgctggaaggaacagtgcaaatcgtagagcaactggggaatgaaactcagattcacatccgcatacctgcaattcaccaaaatttggtttaccgccagcctgatgttgttctcgtggaagaaggagcaaccttcactatcgggttagctccccatcgctgtcatctattccgcgaagatggaactgcatgtcagcgtttgcataaagagcccggagtctgaacccgtgccataaaaaataacaggagaatcattatgcgtatcttacctctttcattggccatgctgactggtttgttatccatgcaggccactgcggtggagttccacggttatgcccgttctggcattggctgggcaggtaaaggaggagaacagaaatgtgtccaaagcaccggtgcacagagtaagtaccgtctgggcaatgagtgtgaaacctatgcagaactaaaactagggcaagagttatggaaagagggtaacaagcgtttctattttgataccaatgtggcctattccgttgcacagaaagatgactgggaatcaaccaacccagctttccgcgaagtcaatgttcaggcaagcaacatcattgactggctgcctggttcgacgctatgggctggtaagcgtttctaccagcgacacgatgtgcatatgatcgatttttattactgggacatctccggccctggagcaggtttgcaggatattgatttgggatttggtaaactttcccttgccgtgacccgcaatacggaatccggtggttcgcatggctggatcgccgataaacgcgatgaagttccgacttccaatgatgttttcgatgtgcgattagctaatttacaggtgaatgaaggtggcactctggagcttggcatcgactatggacgtgccaatgcgcgcaagggttaccatctgaatcaaaaagcatctaaagatggtgtaatgctgacagctgaacatactcaaagcttgttaggtggctttaataaatttgtcgtacagtacgccactgatgccatgacttcctacaatagtggccattcagaaggtgctagcgtaaacaatgatgggcatatgttacgtatcctgaatcatggtgctatcaatattacggataaatgggatctgatgtatttagccatgtatcagaatatagatcgcgataatcgcaacggcaacacatggtacaccgttggtgtccgcccaatgtacaaatggacgcccatcatgagtactttgctggaagtcggctatgacaatgtgaaatctcaacgtaccaaagacaccaacaatcaatacaaaatcacgctggcacagcaatggcaggcaggtgacagtatctggtcacgcccagcaatccgtttgtttgcaacttatgccaaatggggtgaaaaatggggctatgcaaacaaaaataacggttacaagggtgttgcctacaatgattcgtcatcacaccgtttcagccgtggtaacagtgatgaattcacctttggcgcccagttcgaagcttggtggtaatggattcagacaaggctaatacaatgaaaataaaactgctttcagtttgtctcagtactctgctttgctatgcacttcccgcagcgagctatgcagcacctgatacagcaatgcctgacagttctgacaatgtagttgtgcccgatagcaaactgcacaataccacagcacctgcgctgactatgtcgtccttacagaaattaaagtggctgccagctaatactcatgccactcagactattatcctgaatagtgcatcatcccagattaatgaaggggatattcaaggagcggtagctgcatttgcattgccagccaaccaaggttcattagagatcactctgaatagcctgataaaggataagcaggtttattcgcccaatgtgttagtgcttgatgagcaattgcgccccgcagccttttacccaagtcattattttcaatatcaacgaccgggcatcatgtcagttgacaggcttgaagggacgttaaaattaacacccgcattggggcaacagcaaatttacctgctggtttataccacccgtgctgatttgcagtcatctacacaaatggtcgatcccgctaaagcctatgctcagggagtaggtaatgccgtacctaatattcctgatccgatggctcgccatacggaaacaggaacattaacgctaaaagtgaaatcagaacgcgatgccggtaatgtcctgattggtcaggccttctcagcacccgcgccaaaacctgtcacggtcggctccatgcaaacagcaacgacagccgttacaacactacaacctgttgttccagctattatccccaaaaacaaaccagttctaagtgataccgaaaaatattttaatgacgccattaagaaagcgattaatgacggtgatattgataaagcactacatctgctggatgaggctgaacacttgggttcatcaactgcaagggatacttttattattggggttatggtaagaaatgagatattcatttaacaatctataacccctttattaaccagatatttttttaaaatttttccgaagaaataaatatccaagataataatacaaatatattgtaattctaaaaggataaccacttattattcaataactcatattccacatccgattattaataaattacaaaaatatctcatcccattaattagcaaccatttttgccattttttcaatagaatcggttcgtaatatatataaacgcttcagtgcaaatgggttatctcccaattttaccttaccctgtttggttgtgactgctaaatgaaatcctgcatttcgggctgcatccatagcttgctggttatatccaccaaagggataggagagatagagaacatggggattgaattgtgacagtgcacggcgagaacgttcaaaatcatacagaatggtgtgatatgaacggctgaataatattggttgtttgtttttccccagacgatgcaaaaagtgggtatgagactgaaaatcaaacacatcctttgtagcatataatgcagaaagattcataaattgcaggtcttcagaattccattcctgcggataccgcttaattctggatgaaataataaaaagagtcgctttctgtccattctttttcaagattggataggcataacggtaaatagatttcaatccatcatcaaacgtcagaccaaccacttttgcaggtaagttgagagtcccattcagatagccttccaactcatacaatgaaatcgtggtgtaatctgcctgtttcaaataatccatttgctcgcgaaaagccgataaagaggtcgttgttgaggtatggagaaaacgcttattctctttatctttcagaatatggtgataagtcagcaaaggaataccatgatccagttcggcatcctgaccactaatgtaacctacgcgatcccctagatttacttcataccacgtctggtctgagggatctttcagtttgtctaaaattggatagcggagattagcactcagaatcgcaatcgatgaactattaacttcaggcgtgctataaacccgaacatccttaaaaatcattaaattttcgctgttttttttatcaagagtagcgagcgggacattgaaagatacagattttttgacttcttttagattttctttctcaatatagccttgaccattaccaaaatgaaattcgtaatgatcatcctgatcgcctttttcctgagccgcctttagaaaatgacctttctttaataatccaacctgaacaatatgttcacctacccgagcatatatttcactgtctttagtcacctccatgtaacgatagtttgataaattgtggtgctgtgctaatacaggattggaaaagaaactaaaaaacagtaataaagcgacttcaataacatagacgattcggctcattttattttccatccaataaaaaatgccctccaccaagagagggcattttatgattagcgatgtgtatagaagatgattctatacaccataatactactgtttatcgctgctgctaccgaaacctgcattcaacaattcagcaaggtttgcagtcgcttcgtcaacactgacttgtggcgcttcaaccacttcgtttgcgtgacgacggcggatgcgctcctgatggtacgcataacctgtacccgcagggatcagacgaccaacaatgacgttctctttcaggccacgcaattcatcacgtttacctgcaacagcggcttcagtcagtacgcgcgttgtttcctggaacgacgccgcagagatgaaggattctgttgccagtgatgccttggtaatacccaataggtcacgatggaaggtagccgctaatttgccatcaagctccagcttacggttcgcgactttaacacgcgcgtattcaacctgctcgccttcgaggaactcagaactacccacactcgcgatagtcactttacgcagcatctgacgaacgataacttcaatgtgtttatcgttaatcttaacgccttgcagacggtaaacttcctgtacttcgttggtgatgtaacgggcaaccgcgtgaacgccacgcagacgcagaatgtcgtgtggagattctgggccatcggagatcacgtcaccacgttcagcaacttcaccttcgaatacgttgagctgacgccatttagggatcatctcttcgtaagcatcactgccatccaatgggctgattaccagacgacgtttacctttggtttctttaccgaaggaaacaataccgctgatttctgccagaatagcgggctctttcgggcgacgtgcttcgaacagatccgcaacacgtggcagaccaccggtgatatctttagtaccgccagattcctgaggaatacgcgccagcgtatcacccgcagaaatagatatgccatcttccagctgaacaatcgctttacccggcaggaagtactgagcaggcatatcagtacctgagatcagaacatccttaccctgagcgtcaacaattttcagtgccggacgcaggtctttaccgctacctgtacgttctgcactgtccagaaccaccagtgatgacagaccggtcaattcgtccgtctgacgagtaatggtctggccatcaaccatgtcatagaactggatgataccggatacttcactcacgactggcatgatgtgtggatcccagttcgcaacggtttcgccgccggtcactgtctcgccatcacctttcgacagtaccgagccgtaagggactttgtagctctctttggtacggccgaaatcatcaatcagacgcagttctgtattacgagaagtaataaccagtttgcctgctgagttagtgacgtatttcgcgttgaacagcttcagatgacctttgttacgtacctgaatgctggattctgctgccgcacgagatgccgcaccaccgatgtggaacgtacgcatcgtcaactgtgtacctggttcaccgattgactgtgccgcgataacaccaactgcttcacctttgttgatgatatgaccacgggcaaggtcacggccgtaacagtttgcacagacgccgaagtctgtctcacagcttactacggagcgtactttcacgctgtcaacggagctttcttctaacagatcacaccatttttcattcagcagggtattacgtgaaaccaaaatatccgctgtacctggtttcaggacatcttcagccgtcacacgacccagtacacgctcacgcaatggctctttaacatcaccaccttcgataaccggagtcatcaagataccgttgtgagtaccacagtcatcttcagtcacgaccaagtcttgggcaacgtcaaccagacgacgagtcaggtaaccggagttcgccgttttcaatgcggtatccgccaaacctttacgagcaccgtgggttgagatgaagtactgcagtacgttcagaccttcacggaagttcgcggtgattggggtttcgatgatggaaccatctggtgttgccatcaggccacgcatacccgccaactgacggatctgagcggcagaaccacgagcaccggagtcagccatcataaagatgctattgaaagaaacttgctgttcttcttcgccatcacggttaataacagtttcagtagacaggttttccatcatcgccttggcaacacgttcgtttgccgcagcccagatatcgataactttgttatagcgttcgcccgcggttaccagacctgactggaactgttcctgaatttcggccacttccgcttccgcttctgcaatgatgccttctttcttctcaggaataaccatgtcatcaatacctacggatacccctgaacgggcagcgtaagcaaaaccggtatacatggtctggtcagctaagataacggttggtttcaagcccagaatgcggtaacaggtgttcagcatcttagagatagcttttttgcccaacgcctggttaatcagcgagtaaggcaggccacgcggtacaatcatccacaggatggcacgaccgacggtggtatccaccagacccgtattggtggtgacattgccttcgccatctctcacttcttcagtgatacgaactttgacacgggcgtgcagagaagccagaccggcgcgataaacgcgttcagcttctttaggaccggtcaaaaccatgccttcgcctttggcgttaacacagtcacgagtcatgtagtacagacccaatacaacgtcctgagagggaacgatgattggctcaccgctcgctggagacaggatgttgttggtagacatcatcagcgcacgcgcttctaactgggcttccagcgtcagcggtacgtgaacagccatctggtcaccatcgaagtcggcgttataggccgcacacaccaatgggtgcaactggattgccttaccttcgatcagaactggctcaaatgcctggatacccaaacggtgaagggtcggtgcacggttcagcagaactgggtgttcacggatcacttcatcaaggatatcccatacgaccgcttcttcacgctcaaccattttcttggcggctttgatagtcgtcgccagaccacgcagttccagcttgccgtagatgaatggcttgaacagctccaatgccatcttcttaggaagaccacactgatgcagacgcaggtatggccctacggtaattacagaacggcctgagtagtcaacacgtttacccagcaggttctgacggaaacgaccttgtttacccttgatcatgtctgccaaggatttcagaggacgcttgttagaaccggtgatcgcacgaccgcgacggccgttatccagcagcgcatcaaccgcttcctgcaacatacgtttttcgttacgtacgatgatgtctggcgcagccagatccagcaggcgtttcagacggttgttacggttaataacgcgacgatacagatcgttcaagtctgaagttgcgaaacggccgccatccagaggaaccaatggacgcaaatccggtggcagaactggcagaacggtcagaaccatccactctggcttgttgccagactgaatgaatgcttccaacagtttaatacgcttggtcagcttcttgcgcttagtttcagagttagtttcgttcaactcttcacgcaaagtctcacattcgttttccagatcgagatttttcagcaaagcctggatcgcttctgcgcccatttttgcatcaaattcatcaccgaactcttccaatgcatccagatactgttcttctgtcaggatctgcgcacgctcaaggctggtcatgccgccttcaacaaccacataggattcgaagtacagtacgcgttcaatgtcgcgcagtggcatatccagcagcaaaccgatgcgggatggcagagatttcaggaaccagatatgagcggttggagatgccagctcgatatgacccatacggtcacgacgaactttagtctgggtcacttcgacgccacacttctcacaaatcacaccacggtgtttcaaacgcttgtatttaccacacaagcattcgtaatcttttactggcccgaaaatacgtgcgcagaaaagaccgtcacgttcaggcttgaacgtacggtagttaatggtttccggcttttttacttccccgaatgaccacgaacggatcatatctggagaggccagagcaattttgatcgcatcaaactcttcggtcttagtttgcgctttcagaaacttcaataagtctttcacgaaatagctcctgtcggagttagacctgttaggtgagtggcccatgccactcccccctatgctcagtgtaaccactggctggtaaactgcccggcatattcataccggacagtaccagcgggaaaacgatttattcgtcttccagctcgatgttgatacccaacgaacggatctctttcagcaatacgttgaaagattccggcatgcctggttccatctggtggttaccatcaacgatgtttttatacatcttggtacgaccgttaacatcgtcggacttgacggtgagcatttcttgcagggtgtacgcggcaccgtatgcttccaatgcccacacttccatctcaccgaagcgctgaccaccgaactgtgctttaccacccagcggctgctgagtaaccaagctgtaagaaccggtagaacgggcatgcattttgtcatcaaccaagtggttcagtttcagcatgtacatgtaacccacggttacctgacgctcgaactgctcaccagtgcggccgtcaaacagtgtgatctgaccggacgtcggcaggccagccagtttcaacagctctttgatttcagtctctttcgcaccgtcgaagactggtgttgcaattggcataccttttttcaggttttcagccagacgcagaacttcttcatcagtgaaagtattcaggtcaactgtctgacgggtatcgtcaccaagatcataggctttctggatgaattcacgcagtttggcaacttcctgctgctgtttcagcattgcattgatcttgtcaccaatgcctttagccgccatacccaagtgagtttccagaatctgaccgatgttcatacgtgatggtacacccagagggttcaatacgatgtctacaggtgttccgttttcatcgtaaggcatatcttcgatcgggttgatcttagaaataacacccttgttaccatggcgacctgccatcttgtcaccaggctggatctggcgtttaacagccagatacactttaacgattttcagcacacccggtgccagatcatcgccctgagtgatcttacggcgtttagcatccagttttttctcgaactcagttttcagttcgtcatactgttctgccagctgttccaactgattctgtttttcttcatcagccagacccagctctaaccagcgctcgcgcggcagtttgcttaatttttccgcttcaattccaccggcaaccagtacggagtgaatacgggcaaacaagccagcttcgaagatacgcagttcttctgtcaggtcttttttcgcctgacgcaactgcatttcttcgatttccaacgcacgcttgtctttttctacgccatcacgggtaaagacctgcacgtcgataatagtaccggcaacaccgtttggcacacgcagtgaagagtctttaacgtcagatgctttctcaccgaagatcgcacgcaacagtttttcttctggcgttaattgggtttcacctttcggtgtcactttaccaaccagaatatcgccacctttcacttccgcgccaatgtaaacgatgccggattcgtccagtttagacagtgcagcttcgcccacgttagggatgtcagcagtgatctcttcaggccccagtttggtgtcacgagacacacaagccagttcctgaatgtgaatggtagtgaaacggtcttcctgaacaacacgctcagatacgagaatggagtcctcgaagttataaccattccatggcatgaacgccacgcgcatgttctgacccagcgccagttcacccaaatcagtggatgggccgtcagccagtacatcaccacgttctaccaattcacccagagaaacacatggcatctggttgatacaggtgttctggttggaacgcgtgtatttggtcaggttatagatatcgatgccagcttcacccgcgtacatttcgtcttcgttaactttaataacgatacgggatgcatctacgtactgaatcacaccaccacgcttggcgactgaagttacaccagagtcaacggcaactgcacgctccatgcctgtaccaaccagcggcttgtcagcacgcagagtcggaactgcctgacgttgcatgttcgcacccatcaatgcacggttggcgtcatcgtgttcaaggaatgggatcaaggaagcaccgacggacacgatctgctgtgtcgaaacgtccatatactgaacctgatcacggttgaacaagctggattcatcataatgacggcaagtcaccagatcttctacgaagtggccttcttcatccagcacggtgttagcctgtgcaatgacgtagttaccttcttcgatagcagacagataatgaatttcatcggttactacgccgtcacgtaccaaacggtaaggggtttcaaggaaaccatactcattggtacgagcataaacggacaatgagttaatcagaccgatgtttggaccttcaggcgtttcgataggacatacacgaccgtaatgggttgggtgtacgtcacgtacttcgaagcctgcacgctcacgggtcagaccgcctgggcccaatgcagagatacgacgtttgtgagtgatttcggacagcgggttgttctgatccataaactgggacaactggctggaaccaaagaactctttcaccgcagcagaaattggtttggcgttgatcatgtcctgtggcatcagggtatccagatcgcccagtgacagacgctctttcacagcacgttctacacgaactaagccaacgcggaactggttttccgccatttcgccgacagaacggatacgacggttacccaagtggtcgatatcatccacttcacctttaccgttacgaatatcgatgagcttcttcatcacatcagtgatgtcttctttgctcaggataccggaaccttcaatttctgtgcgatccagagaacggttgaacttcatgcggccaaccgcagacagatcatagcggtcttcagagaagaacaggttctcaaacagattttctgcggcttcacgtgttggtggctcacccggacgcatcatgcggtaaatttcaaccagcgcgctcaggcgatcattggttgggtcaacacgcagagtttcggagatgtatgcaccgtgatccagatcgttggtaaacagagtctcgatggttttgtgaccagactggctcagacgcgccagcagatccagagagagctccatgttagctgcacagatgatttcaccagtgttctggtcgatgtaatcttttgcgacgactttacccgcgatatattcgacaggaacctcaatacggtctatctgatctttttctaactggcgaatatgacgtgcggtgatacgacggcttttttcaacataaagcttgccgtttgcttcaatatcaaatgaagccgtttcaccacgcagacgttccggaaccagagtcatctgcaatttgttatcgcgaatttcgaagaccgttttgttgaagaacaggttcagaatgtcttcagtactataattcattgcacgcagaataatcgaagccggcagtttacgacggcggtcgatacgcacaaacaagttatctttaggatcgaattcgaaatccagccatgaaccacggtaagggatgatacgtgcattatacagtaccttaccggatgaatgggttttacccttatcgctgtcaaagaaaacgcctgggctacgatgcaactgagatacgataacacgctcagtaccgttgataacgaaagtcccgttatcagtcatgagtggaatttcacccatgtagacttcttgttctttaatgtctttgactgtgccttctggcgcttcgcgctcatagatcaccagacgcagtttaacgcgcagcggtgcggaataagtcacaccacggatctgacactcttgcacatcaaaaacaggttcaccaagacggtagcttacatattgcagctcggaattgccgctgtaactctgaattgggaacacagaacggaaggccgcttccagtccattttggccttcaggatcttgctcgataaacttctggaacgagtcaagttggatagaaaggagatatggaatatccaaaacttgtggacgtttaccaaaatccttacgaatacgttttttctcggtataggagtaaaccatagggttcctcagctcgctgatcagtgacccactctgcccgccctttaggacagcactctgcaacactatttattcgaacagaaaatagaatattttccgtaatactcattgctattactcttaaatcatttcattgcgctacctgactaccgagctacccgagtggatcgtagctgagaacgcagtatattaagtcgtcaataggaaagggtattttgggttgattagcagccaaacagtgtgaaatgctactaactccctacagcgcaaaaaggctggcgattaaaaatcgccagccatcagcctttaaagtcaggctgcgaacttaaaactgatcttacttgatctcaacagaagcaccagcttcttccagagattttttcagagcttcagcgtcgtctttgctgatgccttctttcagagcagctggtgcgctttcaaccaggtctttagcttctttcagacccaggccagttgcgccacgtactgctttgattacagcaactttgttagcaccaatgctagacagaattacgtcgaattcagttttttcttcaacggcttcagcagcaccgccaacaacagctacagctgcagcagcagaaacgccgaatttttcttccatcatagtgatcagttcaacaacgtccattacagacatttctgcaactgcgtccagaatttgttctttagtgatagacataacaagtgttcctaaaattcagaaaaaatttatacgttaaaaagcaacgaaggaaataggctattaagcagcttctttctgatcgcgtagcgcagccagagtgcgaaccagtttgcctgcagaggcttctttcatggttgccatcaggcgtgcgattgcttcttcgtaagttgggagtgttgccaggcgatcgatattttcacctgaaataaactcaccttcaaaggctgctgctttaatctcgaatgctgggttcgctttcgcgaattctttgaacagacgagcagctgcgcccggatgttcgctagagaaagcaatcaaggttggaccaacaaacgcttctttcaggcactcataatccgtaccttcaacagcacgacgcatcaaggtgttacgaacaacacgcatgtaaacgccagcttcgcgacctgctttacgcagttcagtcattttacctacggtaacgccgcgagaatccgcaacaaccgcagacagcgcgcctttggctacttcgctgacttcagcaacaatcgcttgtttgtcttgaagatttagtgccattagcttcttgctcctggattaaccgggaaaacccgggactcacttcactcaaagcaccaagcgtgcctgagcgctgaaacacggtgagcagaatccagaaaataaatttcatttggctctgtcaccgtctacgcaggatattaagtaatcacttacgcctgcggtcttggacggggcttggattaggccaagctccaaccgaaaactgttttctacctaatatagattttatataacgacttatattagttgttatatacaatataaggcaaattttaagcgccagattttagacaaatccaacgctaaggtaaagcgttattcactttcagcctaaattaggctgttgcgttcagaccagattggtcgattgcaacacctgcacccatggtggtagacaggctaactttcttgatgaaaatacctttagctgaagatggttttgcttttttcagcgcaactaccaaggcttccaggttttctttcagtttgtcagcgtcaaagtcaactttaccgatggtggtgtgaatgatgccgtttttgtcgttacggtaacgaacctgacctgctttagcgttctgtacagcttcagcaacgttaggagttacagtacccactttcgggtttggcatcaggccgcgaggacccagaatttgacccagttggccaacaacgcgcattgcatctggagatgcgataacgacgtcgaaattcatctcgcctttcttaatctgatcagccagatcgtccatacctaccagttcagcgccagcagctttagccgcttcagcgtttgcgccctgagcaaatacagcaacacgtactgaacgaccagtaccgtgtggcagaacagttgcgccacgaacgttttggtcagatttacgagcatcgatgccaagattaacagctacgtcaacgctttctacgaatttggcagttgccaattctttcagcagagcaacagcttcgttgatgtcatattgtttagttgcatcaactttaccacggatagtgcgcatgcgcttggtcagtttagccattgattaaccctccactaccaggcccatggaacgagcagtaccttcgattgaacgcatcatcgcgtcaacgtcagcaccagtcatgtccgcagctttagtttccgcgatttcgcggatctgtgcgctggttactttaccaactttttctttgtttggtttgccagaacccgatttaacgcccgctgcttttttcagcagaacggcagctggtggggttttggtaacgaaagtgaaagaacggtctgcgtaaacagtaataacaactggaattggcaggcctttttcaatgctttcagttttcgcattgaacgctttacagaattccatgatgttaacaccctgctgacccagagctggaccaactggtgggcttgggttagccatacccgctgcaacttgcagcttaacgtaggcttgtactttcttagccatctatatttcctctatatgggtattatcgcctcaaaaagaggctcccctaacgattcaggccccgtctaaaagaccaggccactaaaaacaatacttaaaaataaaaggcgcgaaattgtatgataatttcacaccctttgcaagccagattgctcaattaagcatcagattaggctttctctacctgactgaaatccaactcgactggcgtagcacggccaaagatagaaaccgaaactttcaagcggctcttctcgtaatcgacttcttccactacaccattgaaatctgcaaacggaccatcgctgacacgaaccatttcgcctggctcgaacaaggtttttggccgtggtttatcaccaacctgctgaagacgatccataatagcatcgacttctttatcactgattggagccggacggtcagatgtaccaccgataaaacccattacgcgcggtacactgcgaaccagatgccaagttgcatcgttcattaccatttgtaccaagacataacctgggaagaatttgcgctcgctcttacggcgttggccactgcggatctcaacaacttcttctgtcggcaccatgacttcgccgaaagaatcttccataccatctaatttgatatgttcacgcagagattgagcaacacgaccttcgaacccagaaaatgcctgtatgacataccaacgcttttttggggattcagacattttttaaaacctcaggcctgtaataaatgaaactaaacgcaccagtataccatccagcccccacaaaatcagggacatgacagctgtcaccgctgcaacaatcaatgttgtgtgcagagcttcttggcgagttggccaaatgactttacgcatttcaacgcgggcttcacgggcaaatgctaatgtggctttacctttcgcagtccagaatgcaactgctcctgcaagagcaacaatagcaacgacggctatcgcgcgcagagccaggttatactcccggtaataataattacccacaatagcaactactagcagcactgccaccagtaaccattttgctatatcaagaccacgcctgctttcttgagcattgctattcgcactcataaaccaacctgtaactatgatgtaaatagatagccagcttgcctcgcaagagcaaaacaaatcagaccgaacccaaagataattgtaattgtatctgacttggcaccataattcagtaggacttttcgtatctgcatgataacaaagcccatccgttgtatcagagcctatctcaccaataattcgctacaaccattgagtaatgatccactcattatcagacaactattgatgagataggttcttcttaagacaacgtataaaaagggcatctgtcgatgcccttccagaatgaacacataaaaaaattatgcaatcactttagcaacaacaccagcacctacagtacggccaccttcacggatggcgaaacgcagaccttcgtccattgcgattggagcaatcagggtaacgatcatgttgatgttgtcacctggcattaccatctcaacgccttctggcagttcgatagtaccggttacgtcagttgtacggaaatagaactgaggacggtaacctttgaagaatggagtatgacggccaccttcatctttgctcagaatataaacttctgattcgaattgagtgtgcggctggattgaacctggtttagccagtacctgaccacgttggatttcgtcacgcttagtaccacgcagcagaacacctacgttctcaccagcacggccttcgtccagcagtttgcggaacatttcaacgccagtacaagttgttttcaccgtatctgtgataccaacgattgcaacttcgtcacccactttaacgataccacgctcaacacgaccagtcactacagtaccacggccagagatggagaatacgtcttcgattggcagcaggaatggcttgtcaatgtcacgctctggttctggaatgtaggaatccagtgcttctgccagttcaatgattttcgcttcccactctgcttcgccttccagcgctttcagcgcagaaccacggatgattggcgtatcatcgcctgggaaatcgtactgagacagcagctcacggacttccatttcaaccagttccaacagctcttcatcatcaaccatgtcacatttgttcaggaacacgatgatgtatggaacgcctacctgacggcccagcaggatgtgctcacgagtctgtggcattgggccatcagttgcagcaacaaccagaactgcgccatccatctgagcagcacccgtgatcatgtttttaacatagtcggcgtggcctgggcagtcaacgtgcgcatagtggcgagttggggtatcgtattctacgtgagaagtagaaatggtgataccacgcgctttttcttctggtgcgttatcgatctgatcgaatgcacgagcgctaccgccgtaagttttcgccagaacagtggtgattgcagcagtcagggtagttttaccgtggtcaacgtgaccgatagtaccaacgttaacgtgcggttttttacgttcgaacttttctttagacacgactctattccttaatatcgctccctcatcacgaagataagggagccaaaagatagtaaacccgaaaacttatctagctttacgagtttcgataatagcctgagcgacgttgctaggcgcttcgttgtacttcaaaaactccatggagtaagaagcacgaccttgggtctgagaacgcaggtcagtagcataaccaaacatttcagataatggtacttgagcacgaacaattttgcccgttgctagatcatccataccttcgatcataccacggcgacggttcaagtcaccgatgacgtcgcccatgtagtcttctggtgtttccacttcaactttcatgattggttccagcagaactggtttcgctttcatgaagccttctttaaatgccatggatgcagcaattttaaaggcaatttccgaggagtcaacgtcatggtaagaaccatcaaacagggtaactttaacgtcaacaattggataaccagctagaacaccgcctttcagctgttcacgaacgcctttatctacgcctggaatatattctttaggaacaacaccaccgacgattgcgttctcgaacacgtaaccgtcgccacctggttccagaggctcaacacgtagccaaacgtgaccatactgaccacgaccacctgactgtttagcgtgtttaccttcctgctcaacggtattgcgaatagtttcacggtaagcaacctgaggtttacctacgttcgcttcaacgttaaattcgcgacgcatacggtcaaccagaacgtcgaggtgcaattcacccatacccgcgataatagtctgaccagtttcttcgttactggatacgcggaatgatgggtcttcctgagccagacgtcctaaagcgatacccattttttcttggtcagctttagtttttggttcgatggcaacagagataactggctctgggaattccatacgctccaaaatgattggcaagttcaggtcacagagagtatcacctgtagtgacatctttcagaccgatcgcagcagcgatatcgcctgcgcggacttctttaatttcttcacgtttgttggcgtgcatctgaacgatacggccaaaacgttctttccggtctttcactgggttaagaactgtatcaccagagttaacaacaccagagtaaacccggaagaaagtcaggttacccacgaatgggtcagtcgcgattttgaacgccagtgcagagaacggttcttcatcgctggagtgacgctctgctggagtatctttaccgtctggcagcattcctttgatagattcaacgtcagttggtgctggcaggtaatcgataactgcatccagcatcgcctgaacacctttgttcttaaatgcagaaccacaggtaactaggataatttcgctagccagaacgcgcttacgcaaagctgtcttgatttcttcttcagtcagctcttcaccgcccagatatttgtccatcagttcttctgatgcttctgcagcggattcgatcaaattctggtgccattcctgagccagctcaaccatgtcagcagggatctcttcgtactcgaaagtcacaccctgatctgcttcactccagttgatcgctttcattttcaacaggtcaacaacaccagtgaaggtatcttcagcgccgattgccagttgaagtggaacagggttcgcagccagacggcttttgatctgttctactacgcgcaggaagtttgctcccatacggtccattttgttaacgaacgcgatacgtggaacattgtatttgttagcctgacgccatacagtctcagactgcggctgaacaccaccaactgcacagtaaaccattactgcgccgtcaagaacacgcatggaacgttctacttcgatggtgaagtcaacgtggcctggggtgtcgatgatgttgacgcggtgtggctcatactgtttagccataccagaccagaatgcagttgtcgcagcagacgtgattgtgataccacgctcctgctcctgctccatccagtccattgtcgctgaaccttcgtgagtttcaccaattttatggttcacgcctgtgtaaaacaggatacgttcagttgtcgtggttttaccggcgtcgatgtgagcactgataccgatattacggtaacgtgctataggtgttttacgagccatgttttcctctctcgtgggcgttcaattttgagaacgagtagccccgagaagctacccagaacatattcactacgaaggaattaccaacggtagtgtgcgaacgccttgttagcttctgccatacggtgaacgtcttcacgtttcttaacagcagtgcctttgttttcagccgcatcagataattcattcgccaggcgcagagccatcgacttatcaccgcgtttacgagcagcatcaacgatccaacgcattgccagagcattacgacgaaccggacgaacttcaactggaacctgataggtagaaccaccaacacggcgggacttaacttcgacagtcgggcgcacgttatccagcgccagctcgaatgcttccagatgacctttactagaacgctgagccagggtctcgagcgcactgtatacaattgcttctgcggtagattttttaccgtctaccatcaggatattcacgaatttggccagcaattcagatccgaattttggatctggtaaaattttacgttgaccaattacacgacgacgtggcatggaaatactccgtttcgaatttcagggttgtccaaaactctacgagtttattttgacattaaagtgaaaaatgtttggccttacttaacagagaaccattaagcctttggcttcttcacaccgtacttagaacgaccttgcttacggtctttaacaccagaacagtccagtgcaccgcgaacagtgtggtaacgcacacctggcaagtcttttacacgaccgccacggatcaggataacggagtgttcctgcaagttgtggccttcaccaccgatgtaggaagaaacttcgaaaccgttagtcaaacgaacacggcatactttacgcaatgctgagtttggttttttaggggtggtagtatatacacgagtacatacgccacgcttttgcgggcaagcttccagagcaggaacgttgcttttcacaactttcgagctacgagatttgcgaaccagctggttaatagttgccattattaaaaaaactcctggtttttttgcttcgtaaacacggattttatcctctgtcagccataatgacaaaacatgaggacgcggaattttattgctgacttgacgaggtgtcaagaaatatacagcttttctatgctggtaaaatacctgcaatgacaaggtatttactgacaaagttcagataatgtctaccagccaaaattttgcggatgtttcgctgttaagctaacaaagcctttgtagtctatcacctgtacacggtctgaaatctgctcaaccagcccccgtgcaatcaaatcttcctgcaaggcataaacacgggctcccgtacggatcaattcagccaaatagcgattgtcattgatccccagcagcacgccattttgcattaacagaacatcatctgcatcagagacaaggcccagcatcgcattgaagtcatcatggtaaggtgagcgactcacagtatataacatgttacccctccgcaatagattaaaatttcaacacaacatcatatcctgatagtacttcacgtattgccgccgccgggagaaattccgcctccagcacaaggtcgcttgctgggctgcctccccgagcgttcagatcatcgaggcaaatgtagcatttatcaatgtcatacaggggcagtagcttaaatgttgagatgtaatcacgcgccagaattgtctctggctgctgattggccaacagttggaataccccatcagaaataaagaatacgccaatttgctcagtcaatgccgatgttgcaagcagcgcatccagaccttccctgccagcagaagatccgtggggagcttcagtaaaaacgaaggcgatttttttcatcagaaccctcaataccgggtatgctcctagaattgtaccacgcgatcacacagcatcatggcttcagccaacgaacccaatccactgagctcaaacccatccgccagattcacggcggacagattgagttcgttggcctgctgttcatctgtgacaccgcgacgcagtgccgctgcaacacaaataaacaagttgaattggtgctgggcggctattgcctgccacgccctgaccagatcgaactcatcactggcgggagccaccagccgactgccattttggacaccttcgcgataaaaaaacacgctgtgcagtttatggcctgaagcaaccagcgcctgagcaaattgataggcactgctggcttgctgagtgccataagccggcccagtcaccagcaggcaataagacagcgatgacattatttctccgaactcgcgtattcaccatttttaaactggcgaatataaagatatacggtatgtttggagatattcagacgatcagcaacctgattaatcgcatctttaatatcaaaaatccctttctcatagagattcaggacaacctgtctgtttttcgcattattggaaacattgcgatcagcattcacttcttcgatagtaaattccagtgtctgtgccacaagatcatctactgaagaggcaaaattaacgtttgaagacacctcatgcgttttttcaggaataaaggtttgaataatctcagagaaaggcacatccaggttcatattaatacacaaaagcccaatgacccgacgagagcgattacgaatagcaatcgtgacggatttcatcaatgcaccgctttttgcccgcgtgaaatacgctctggaaacactacagtcttcatctgtaatgtcgtgcagcatccgtaatgccaaatccgtaatgggagagccaattttacggccggtatgctcaccattagctattctgacagctgaacatttaaggtcctccagtgaatgaagaacaatttcacaatgcccaccaatcagcatagccaagccatcaacagcagcttcgtaagattttaaaatttcatgatccgtttcactgaacggttggttttccagtaaatcaatatcactgttatcaccggataatagtggggtagacatgcaatacaccatccttcaagctcagactttgcctcaccgaaaatatcagggcgagatttattataaaatcacattaatgcaacttaacagaaaacatttcaaatgttctgtgttctattcagaataatgacgttaaaaccacattgaattgccgtcaagcccttgctgcacagaccgcagagttttatcacagcttttatactcaatatacctgaaatatgaaaaagttatttcatttaataccgttaaaaaataataaatagcaaaaattatttttctgtcgttatggcttattacttatcaatttgaggtaaataccgagataacaaaacaggggctatcagcccctgctatcacattacgtctaattattgtggaaattattttgccttggcagccggcttgatatccagcaattcaatatcaaagactaaagtagaattagcaggaatactaggaagacttgctttgccataagccaaatccggtggaatgaccagagtgattttcccgccttttttcacatgctgtaaaccttctttccagccgggaataatacgatccaaaccaattgtcaggggttctttgcgctcataggagctgtcgaacaccttgccatcgatcaaactacctttgtagtttacaaccaccgtatctttttctgttggtgttttaccactcccttccttctctattttgtagagaagcccggttttagtttttacaacacccgattccttggcaaactgctcactgtatttagcccctttttcagcattttcatcagcttctttctctgccttagcttgtgctgcatttttcactttaacttcaaaagcgccaaggatctgctgaatttcttgatcattcagtttgcttttatcctttaatgcatcttcaacacccgccaataactgagattggtctaacttgataccgagcgattcctgctcttttaatgaagcgcccatgtagcgacccagagaagaacccaatgcataagcgttttgctgattttctgttttaaacgcactattcagttttacttcgttttctgtattagcagacaatgcctgcggtacactaaatgccattgccagtgacgctgccaataaagtcgtttttaacaatgatttcatcctattctccaatcagtttttttgggattcaccgtccgcaaaagctacgtgaacgaactcactataactgtctgcggaaaccgaacacaatactcgtcatacattggcttcagaaccattaaaacaaagaggtttcatggtaaccctcttttatagaatgttttgagtattatagtgccaacttgattaaaataatcattccgacacgaaattaactaaccaaagataagagggaagatagtggaattatccgaatttgaacaaagatttgaacagctagaaaccaaactggcctaccaggaagtcactattgaagaactgaataaagaagtgagaaaacaacagatagaaactgaaaagctcaaagagcaactacaattaatgtccgaacgcctgaaaacccaccagtcgtcgatcatcgcaccgctctcggaagaaacaccgccccctcattactgataccattcccgccttttcaggcagaaaaatacttgccaaggaaggcgggaacacaaaaaagagaagcttcatctgcgcttcccttttttctgcttaacgattaatggcagccgccgccacagcatgcatgctcttcatgatcgtggtcgtgatcgccacaaccaccctgaccatgcacatggccgtgagccaattcttcttcggtcgcttcacggatagcaacgatttcaacgttgaatttcagattctggccagccagcatgtggttgccgtcaacgacaacttcatcaccttccagagcggtaatttcaactggcacaggccccatgtctgtatcagccaagaaacgcatacccacctgcaattcatccacgccaacaaaaacatcttttggtacgcgttgaactaaattttcatcatactgaccgtatgcatcatttgcttcgacgctaacatcaaaacgttcacccgcctcacgcccttccaccgctttctctaaaccgctgatcagagaaccacggccatgcagatagtctaacggtgcgctcaccggagactcatcaaccaaaacaccttcttctgttcttacttgataagccaggctgaccaccaagtcttgtgctactttcatgacatctcctacatacccgaggggaaaaaaccccgtgagggaaaatttttacggctaaaaaaatgctgctgattgtaacggaattctacttctctgtacctagcgacagcaaaatttatccattatttgttgttcatacattgaattattgtggtttaaagataccgataacctgttcctgctctctaacatgaggcgccacggtttcatcggtttgccgctgcacatgcccacaatggacacactccacaatatcgactttattttcctgccacatcgctagcgtatcctgcgactgacacttgggacaaaccgctcctgcaataaaacgtttacgactgactgacatgattcaccccattgctatttatattcgtcccagccttccggccggcgacgctcattaagcatttcccgttcaaacagttcttccaattccctgcgagcctctttcacacgggatatctgcgccacgtcgccatgtaactgaggcatcagctcacgtaacatacgcatatccagacggcggaaatgctgctgggcgcgataagcctgatgtggatgcattccagtcttaatcaatgccttacgaccaagttccagagcactggaaaacgtttcacggctgaaatctttaacatcattctgcaacagctcatgcgcttccagacgccctctcgcccgcgcaataatatgcaggtgaggaaaattcttctggcacagatgcactatcgccatggtctcttccggctcatcactggcaatcacgatagcctcggcttttgccgcccccgcagcacgcagcaactcccgctctctcgcatcgccataatacaccttatagccataacgacgcagcgtactgatggcactggcatcacgttccaataccgtgatacggattttattcgccatcagaaggcgccccactacctgcccaaaacggccaaatcctaccagaatcacctgtggttcattatcctccacaaatggctgttcactgtttttttcttcctgggcattataatacccagccagaatacgttggatcaactgcatcactagaggcgtcgtcatcatcgacaatgtaacgacaaccaacaacagtgacatttgattctgatccagcacgctctgccccagcgccgttgagaataaaacaaatgcaaattccccgccctgactcagcacgccggaaaactgcaaacacgatgagtttttcaagccggcaagcctgccgatcacatacagaatgaaaatttttatcagaaccagtcccaaaacactgaacaatacccctgacaaatgagtcaacagtacgcccatattcaaagacatgccgacggaaataaaaaatagccccagcagcagccctttaaatggctcaatagaaatttccaactcatggcgatattcactgtcagccagcaaaaccccggcaataaaagtcccgagcgccattgaaaaacccagttcctccatgaaaatcgccgctcccagcaccaccaacagcgccgccgccgtgaacacctccctgacatccgatttcaccaccaaccggaacagtgggcgcagcagatatcgccctcccagcaacatgcccgcaaaagcaacaaatttcagcccgacccgataccagtcactggatgccgtactgcccgccaacagaggaatcagagccagagcggggatcaaagccatatcctgaaacagcaggatagaaaaaccgagttgcccgctttcactgctggtcattcctttctctttcatcaactgtagcgccatggccgtcgatgacatagcaaggccaattccaccgataacagcggcctgccatgaaaaatttgtcagacacaggaataaaatcaacaccagcgcagtcaatacaacctgagccgtacccgcaccaaagatagatcgcctgagctgccagagtttagctggattcagctcaaggccaatgatgaacatcaggaaaacaacccccagttcagagaaatgcagaatttcctcgacatccttaataaaccccagcccccacgggccaagtacaatcccggcaatcagataacctaataccgccccaatcttgaatttctgggcaaggggaacagccacaacagcagcaaacaaaaacagtgttccggcgcttaacagcgctgaattctccataattacatccctcccaaagacaaaggcgatttcagccattcccgataagcattcgcgtggctgacgagcacttcaggtcgttggcgcctggcccaataaatgatcatgggtgataaccaatgcatatgacacatcgatgccgttaattcgaaaggacggagaatttcttccatcggatagaggttatatccacctctccggtaagcgccttcgggttctcctgtggtgatgacggaacgccaatactttcctctcagcgccagttctgacccgccgacaaagtcacggctcaacacgcgatccatccactctttcagtaaagcagggcaactataagtatacaatggatgctgaaaaacaatgatttgatgctcacgcagcaatttctgctctaaaggcacatcaataaaaaaatcgggatagcagccgtatagatcgtgaagagtgacatgctccaacgcctgcacgggctgtagcaaaacatgattagccacagagatctgtggttctggatggatatataacagcaatattttaggcggcaatagcatcattccccctaggacgtgtcaggacacctattttccgctaccatgcatgtcaagcgatcaaatcgaatacatacaacgtgtaattattaacttaacatattctataacagacaacctctatgattgttttctcatctctgcaaatccgtcgcggcattcgcgtcctactggacaatgccagcgcaaccatcaatcccggccaaaaagtgggattggtgggtaaaaatggctgtggtaaatcgaccctgctttcattactgaaaggtgaactccaggctgaaaatggctccgtaacatttcccaacaactgggcgctggcgtgggtgaatcaagaaacgccggctttggaaatttcagcactggaatatgtgatagacggtgaccgtgaattccggcaactggaacagaagctgaaaatcgccaatgaacagaatgacggtcacgccattgcccatcttcacggccagcttgataccattcaggcatggacaatccgtgcacgagcatccagcctgctgcacggcctggggttttcccaaccccagttggaacaatccgtcagttcattttccggtggctggcgtatgcggctcaatctggctcaagcgctgatttgtcgttccgacctgctgctgctcgatgaaccgaccaaccacctagatttagacgcggtcatctggctcgaaaagtggctgaaaaactataccggcaccttgatcctgatatctcacgatagggactttcttgatccgatcattgataaagtcctgcacattgaacagctgattttggctgaatacaccggcaactactcctcctttgagcggcaacgcgcggctaaacttgcccagcaacaggctctgtatcaaagccagcaggaaaaagtgactcacctgcaaagctatattgaccgttttcgtgccaaagcttccaaagcgaagcaggcacaaagccgcattaagatgctggagcgcatggaactcatcgcccctgctcatgttgataacccatttcgtttcagcttccgccagccggacagcctgccaagcccgcttttggtgatggaaaaagtcagtgccggatatggtgaaaaaaccgtgctggattcgatcaaattaaatctcgtaccgggatcacatatcggcctgttggggcgcaacggagcgggtaaatctacattgatcaaacttctggcgggtggacttgcaccacagcggggcgagatcgctttagccaaaggcatcaaactggggtatttcgcccagcatcagctggaatacctgcgcgcagatgaatccccgctgcaacatttagtcagaatcgcaccacaggaaacggaacagcaactccgtgactatctgggcggctttggtttcaaaggtaatcaagtgaccgatccgagtgggcgtttttccggtggagaaaaagcccgactggtattagcgctgattgtctggcaacgaccgaaccttctgctgcttgatgaaccgaccaaccaccttgatctggatatgaggcaggcgctgactgaagcgttaattgatttcgacggtgcactggttgtggtatcgcacgacagacatttattacgctccacaaccgatgaactttatctggtacatgatggcaaagtagaaccgttcaccggcgatttggaagactatcagcaatggctgactgaacagcaacgccaacaaacgcgtgaaaatcaggaaaaggaaaaagcggcctcaagtcccgatgcttcaatgaatggcgctcaaaattacagtgcccaggagcgtaaagatcaaaaacggcgtgaggccgaatttcgcaaccagacgcagccattacgcaagcaacttactgcccttgaaaaacagatggaaaaactgggcacagcattggccgggtgggaagaaaagctgtcagataacacaatctacgaaaatgatcgcaaaactgaattgaccgaatgcctgcaacaacagactcaaaccaaatccaagttagaagatgcggaaatggagtggctggatattcaggaacaacttgaacagatgagcaaagcatttaacgcggatcagtaaattaatttattttctttaacttttcgaaattattgggcattgatattcaatgcccaaatcttgaaaaaaccgtcccttgtttacaaaacaaaaaagtaaacacattcaaacgaacagctattttattgacggtaaaaaatgataactcatttatctagaaaggttatttacacttgaaaaacacctgagcgtctaattagcatttcagactccttattgagaataatcttaccactcaactcccaaataccatttccgtaaaaaatttcataacaacaattgagagtaaaacgatcaatagtaaaacggtgccttgctaactgacttacaaattagcaaccaatgcagaaaaattttcaacatcatcaatcagatgatcatcgattgatttaccccatattacgccgagttctatttttttatccgtttcaacaatttccagcaaattcatataatactcagggatcgagctgataatacgttgaggaacacacgtatacgcactattttttgtaatcatctccatgatgagcataatgtcattagtctttaataacaaatgcttactgtcacccgtataaatagggaatacgttaaggcaatcggttaactcaacaatatcttttttttctgatgaatgaaccggaacattcccatttccaagtcgacttttctccgccctaaatttaggtatcagatggctccttcttttaaaaagatagaccagtttttcagtaaaaatctttttcggctccaactgagttatcgcagccagaggcatcaccgcaacatgtagcattcccgcattcaacaaactgatctgctgctcaaccgacagcccggtcatcagcgccaatacgacattccctttcttatccgcgatctgcttttctatctgagaatagttatggataggaaaacaagacccaacatataaatgcctgataatatcttcctttgaatcaaaatgaacccgacttttaaactgttcatagtgagataaaaattttcgggcattttccagcgtcttatgcccgaagtctgtcaatctcgttccatttggcccccttaggaataatgaagcaccaagaataccttccaacccgtgtattttcttcgtcaaggcaggctgagaaagataaagcctttctgaagctttatgataattaagagtctcagccaaaacgataaaagcctcaagattgcgtatatccatgttctctcgctcaatgattgtttaataactacaaaacattacagactcatggtgatagcattttaacttagcgttttgctaaaggttttatcaggacaactggtcaaaatgttaactaataaaatgttagttaacaagggtacaattagcaaaatatttattaatgcagtattttaatttactttataaataattacaatggaaactaaaaaccaaaatacacaactgacggtacagcaccaagaaaacttcaatctatacctgtcaatacaccatacacataatcacattactggttattttatatgtcgtacaatttggactatcaccagaaaaaaaataatgaactgacagttatcaattgataacttttatctattggtaacccatattagggaataccaaacccatgaaaagtaaaatatcatactactaaactattgtgtgagtaatttaatcaacagatataaagaaaaggatatatacctggcttactcgtatatttgaacaaaccatagataattcacattcactttattacattatctattttatgcctttaattttatggctgtttttatatttactcttgtgacgcattaataaacccccagctttaattaaaaataacacattaaatacaactgtaaatgctaaacactatcataaaacgagtaaaaataatttcaaaaaaatacagtaatagtgacagtcagtatgaataatgatgtttttattgcatattaatcttggtaaatagtatctgtttttatttcaaattttgaaggtttttgatatcagaatattctgtattagtaagttattttatagtgtaatgggttgggtttggtcacgtattcaatccgttgattggtatcaaacataatattcacgttcaatgaaagtgctgatgactttatcgtgcatacatggacgccccttatttgccaaacaatcgtttgtcatgaccagaactcggttaagattgcagtcatacatccggactttagttgaggccgtcgccttttcgctgaccagactcttatcatttcggcgcgctatgagcgcttgcacgacaccagagttttctgatcacggtctaacctctcttgccatcacttctcgattgcccgtgcaacctttggaaattacttttatatgggctccctgatttgcactttaggattttagtcgcttgtttccgggctcccataatccgcctcaaactccctgccatgtaccagcaacgcccagataatcctggcattcttattcgccagcgccaccacagcaatattggtattacgtctcgacaacagactattcagccagttttctgttcggccagttttctgttcggccggttttctcttttacgtaccgtaccaccaccctatctccataaatcaatagtgtccgtaaataattgtcaccccgtttgctaatcccctgtaaagttaacttactcccactcgaatgttgccgggggaccagaccccgccatgccgccagctggcaaccattagagaagtgtctggcatcccctaccgatgccagtgttgaattttctgttccggttctatcacctgacgatcaagcggtcatgctcccaatagttagattatccttgcaagatagtattcacgctcaatgaacgttccgatgattttgtcatgcaggatttctgatttagagtagcagatcgttttccgattcagcctttttattcgagtacgcagggtcagattcattctttcgatgcgttgggtaaatttctttcctctgaggtgagttctctcaggaaggcaatcataaacagcataattatcagtacaataatactggatttcaaacgatgccagaagcgccaacagtttttccagcgtttttttactgcgatcgccaaatacatgtgcgatgatttgcttctggtttggttcccacgcataccagagcccgcgttgattcttcttgttgccgacaaatgacccctgctcatcaatttcacagataatgtgaatctcacttcctgccagaggccgtgttgttacttgtctgggttcatgttttttaacgtgcgaagcacggtattgatcccgacgttcaaaacacgtgcagtgtctctgatcccgccgttatttatcgccatatcagtgatttgttctttcactccgggtttgcaggcttgataggtgtaattcagttggaaggttttacggcaggcataacagtgataacgcgggtgcccactgcttccttttccatgccctttgacctcctctgctttgtgacaataacgacaaaccacatcaactttagccatatctcaccagtaataaaaaatggaaagtttactacaataatctaactattgggagcatgacccgatcaagctccttcaggtgttcacccaactgctggaatagttgcctgaagatatctggcagactattactgacactctccagaatctcaggcagtcgtactccctgaacaataacgatcccaaactcgctcagtaaacccctaatggcattggcctgcgcagtacggtttgaccaatccctctcgcgcggtagctgttttttgagcaccgtttcactttgtgcatcaacgccgtggatctgaaagacatttttgccagatcgatacccactgttgtcatcttcatagtggacactcccgttattaaatggctgttttaatacacttccattttggcacactgatgccgcttgaatggggcatccatcccattatttctacggattttgaaaaagacagggttttgcgagtcagtcttaccaaatgatgacgaagattcagattatgtctctctatgcgttgtgtataacgcttgctgaccacatgcagttttcctgccagcgtttttaccctctccagccatcggtcatatagaccacaatgttgaaaggagacaataacgccatcaaaccgcatcaatgtcttctttgttcttgggccaaaaacgtgggcgatgacttttcacctaatcctgtcgtaggcataaaagagccaacgaggtttgttctttgacttcacgtatgaccactgcgcatccatttcgcaacaaataatcacttcgatgccgggagccatggcttcagtgatgtgtttgggcctgagctttttaagtgacgaaggacagtattaagaccaatcccataacacgcgctgtcgcccgacatcccactccattcatggccatatcaacgatttgctcatgtgtactgggacaacatgcggtataagtgaattccagttgccagaaatggcgacaggattggcaaaggtaacgttgatgaccggaacgagagcgcccattacgatggatccctttaactgcacagcaagatgggcaggtaacatcaatctttgccatctgaattttctccaaataggcagactatacataattcaataaattgatgtcatgaccttttaatagcggaaataatgcgggtgatacccaatggattttatatcaagtcatcagtacgatgatctgctctccatgaatggcatattcactttcccatcacatacaacaggaacaaatgatgaaaatcgatctgagcaatatggtgacagaaagccgtaaccctgccagtacccatattgatgagctatccacactcgatatgctgcgcgttatcaatgatgaagataaaaaagtggctctggccgttgaaaaaacgctgccccaaattacccgggtagtcgataaagtggccgaggcatttcgtcacggcggacgattgatatatagcggagccggaacctccgggcgtctgggcattctggatgcgagtgagtgccccccgacttatggtacaaagccggagtgggttgtcggtttaatcgccggcgggcatcaggcgattttgaaggcggtcgaaaatgcggaagataatcagcaatcaggcgcagaggatcttaaaggactacacttcaatgaaaaggatgtgctggtcgggatcgccgccagtggccggacgccttatgtgttgggcgcgatggaatatgcccgatcggtcggggcaactatagcctgcatcagttgcaatccgaacagcccgatgacgcaattggctgatatcgccattacgccggtggtggggcctgaaatcgtgacgggttcttcccgcatgaaggcaggaacggctcaaaagctagtgctgaatatgatcacaaccggtgccatgatccgcacgggtaaggtgtatggcaatttaatggtggatatagaagccaccaatgctaaattgatcgaacgtcagaagaatattgtcatggccgccactgaatgcagcagggaaacggcagaacaggctctgaatgcctgtgacggtcactgtaaaaccgcaatcgtaatgattttatcgggaacctgtgccgaagacgctaaaaggttactggcagaacaccaagggtttatccggcctgctatctcaaaatcctgatgatcatggtttctttggaggggtcataaatggctaaaatcagtcaggaaatgctggttgaaatactcagggcaatgggtggcgtgaataatatcgtgcattgtggcaattgcatgacccgcctgcgcttaacactgcatgatgattcactggtcgataaaactgccttaacgaaaatttccggggttttaggtgtcattgaaaatgacgaacagctccagattgtccttggccccggcaaagcacaaaccgccgcggatatgatgaacgggctattgagtactgccgatcattccaccgctgaacctcagcccgccggtttgaaagagattgcttcttccaataaaaagcagctcaaagaaaaacaaacccgttcagttcataagtttctggctaaattcgccaccatttttaccccgctgatccccggttttatcgccgttggcctgttattggggttcgctaccttactggaacagattttcattcagggagccggacatcccaatgccgcattgggggagatggtcggctatatgaaagttttcagcaaagggatgttcagtttcctgagtattctgattggttataatgcgcagaaagcctttggcggctccggcgtcaatggtgccattatcgcttccctgtttgtgctgggttataacgccagcgccaccagcggcttctattccggtatcagtgatttctttggcttcgccattgacccgcgcgggaatatcatcggggtgctgattgcctgtattctcggcgcttgggtggaaaaacagatccgcaaaattataccctctgatctggatatgatcctcacttccaccctcaccctgctcatcatgggtgccgtcgcgtttattgtcatcatgcctgtgggaagctacctgtttacagcgatgtcatggctgttcatgcatctgaacggtaatccattcggtgcggcaattctggcagggttattcttaattgcggtgatgtttggtgtacatcagggttttgttcccgtctattttacgttgatggatgtgcaaaactttaactcgctgttcccgattctggcgatggcgggagcagggcaggtcggatctgcgctggcgttgtatatgaaagcccaaaaaggttcgctgctacgcactcaaatcaaaggtgccatcattccgggttttctggggatcggagagcctctgatttacggtgtgacgctacctcgcgtcaaaccctttgtcacggcttgtctcggtggcgcaatcggtggcttttttatcggtctggttgcctggctgggagtccctgtcgggctgaattcggttttcggcccatcgggtctggtcgccctgcccctgatgacgtccgatagtggcatcttcacgggcatggcagtgtatggcgcaggtttaatcattgcttatatcagtggttttatactgacatttttctttggcagtaaaaatattgatttaagctgattcaacccatccaaatcagggggacacaagcagcggtcaaaatacccatagtgatgttgaaaataaaccaggcattgcggcttttcagcagggagccaatcagcgaacccagaacaatccacactgtaccggcgatcatgttggaaaccagcatcaccacacttattacgaccactgagtggttatataagtctccctgtaggctgtaactgccgacggcgcccaatcccatcatccacgccttagggttcagaaactgtaataaccagccttggtagcctttgatgggaacggccgccaaatttgccgtttccaaccgtttataatgtgccgtcgacgttttccacgccagccttaataaatacagactaccgagcactttcaacacggtgtgcatcgccggatacagtagcagcactgctcccacaccaaaggcagacagtagcaggattgtctgtatgccaagaaggatacccacccaaagcggtaacgagcgacggaaaccaaaattggcacccgatgaagtcagcagcatattattcgggccaggtgtaatcgcagagatcaataagaaggcgcttagtgagaatatcaggcttgcggtcatggggggttgttcctcttacccaaattgttaacatttcctttcgacgaaaatagcagtatgttattcactacacaagatgactaatcatgaaattaatcccttatgagtgagaatgtttcccccctgagcaaggccggtaatccccatttacacactcaggagcaaccacaatgatgatcccgtggcaacaactggcacccgaaaccctactcgatctgatcgaaagttttgtcttgcgggaaggcaccgattacggtgaagatgaaaaaacgctggagcaaaaagtacaggatgtaaaacgtcagcttgaacggggagaagtcctgctggtctggtctgaactgcatgagaccgtcaatatcatgcccaaagagatgtttcgcccttagcgccttcttcttatcaggctgttctgtttgccttattttgctctgtattgctgatgacgagaaagatagttccaacttttattgataaggagtctgttcttatgtctgccaaacaccctgtcattgccataacgggttctagcggagccggaacaacaacgaccagtgtggcgttccgcaagattttccaacaacttgaagttactgccgcactcatcgaaggggatagtttccaccgttacacccgtcctgaaatggatgccgagatccgtaaggcgaaggagcaaggcaggcatgtcagctattttgggccagaagccaatgatttcagcatgttggaaaagacattttgtaactatggtgaaacaggcactggccgctgccggagatatctccacacctatgatgaagctgtgccttacaatcaagtaccgggtacattcacgccgtgggaatcactgccatcaaacaccgatattctgttttatgaggggttgcatggcggcgttgttactccacagtataatgtcgccagctatgttgatttgctgattggtgtcgtccccatcgtcaaccttgagtggatacagaaacttatccgtgataccagcgaacgtggccattcaagagaggcggtcatggattccgtggtgcgttcgatggatgattatatccgctatattacgccacagttttcccgtactcatatcaatttccagcgtgttcccaccgttgatacctctaaccccttctccgccaaggctattccatctctggatgaaagttttatcgtgattcgtttccgtggcctgaaacaaattgatttcccttatttactgtcaatgcttcaggggtcatttatttccagtataaataccattgtcgttcccggcggaaaagtggggctggccatggagttaattatggctccgtgggttcagcaattactggaaggcaaaaaaatttcttgatttaaacgcaatttaatttttaattaaacaggtaacaaaaaataacgttgcctgttttacgcaaataagcatttcagtaacaataaaaacagattataaagagaaaattcagcaaggtaaaactcgtaaaagctgtacaatatttaccaaagtactcgccgattcttacacgataaagaagccatttagcagttcctgcctttatgttccttttccttttctctttggaaatattagcattattcggtttcccataagccatagagcaataaagacacgctcgaaatagatttcgggtaatctggcgcgctgaagcgatacaggaggagacagaaacgttttcctgtgttacaaacagagttacaagcgaagctggcaagatatataggttaagatcaaggcacccgtatttttgtatgattataatctatataaaattcccgcttgtcagtttttcagcaagttaatatgttaagctattgactttataaagccagccgggtgaggaaaagctgtttcctcacgtcataaaggcggaaataacaacagaggataaagcgaatggttctcggcaagccacaaacagaccctactcttgaatggtttttgtcacactgccatattcacaaatatccatccaagagcacgcttattcatcaaggcgagaaagcagaaacgctttactatattgttaaaggttcagttgctgttctaataaaagatgaagaaggtaaagaaatgattctctcttatttaaatcagggagatttcattggtgagcttggattgtttgaagaaggaaagctgcgtactgcatgggtacgagctaaaagtgcctgtgaagtcgctgaaatttcctacaagaaatttcgccagctcattcaggtcaaccctgatattctgatgcgtctatcctctcagatggcaaaacgcttacaaacaacttcagaaaaagtcggtaacctggcatttctggatgtcacaggccgtattgccaagacgttaatgaatctggccaaacagcctgatgcaatgacccatcctgatggtatgcaaataaaaattacacgtcaggaaattggccagattgtcgggtgttcccgcgaaacagttggccgcattctgaagatgttagaagatcaaaacctgatctctgctcatggcaaaaccattgtagtatatggaacccgctagttcctgaaattgctcttgaaactgagccagcgcaacccttatcctgcactggcttttttgttgcttcctttgtcttatctgtgcaatggcagcatcaagccccgttccgccgctttctgtaacacttcactggccttaccctgatattccgctggggcagacgtgatttccctcaccttatttttatatttgccatatcacagtgaaataatagtcaccaaatatgaataaaaagtcacataagggcaaataaaaaaacagccggtgaggaaaatgcgatggtatctggttaatatctgagaaaattattcaacaaatcatgtccctgttcactgagaatgctttcagggtgaaattgcacaccttccaatggcaaagtacggtgacgtattcccataatttcatctacattaccgttgtgctgactccatgcggtcacttcaaacgacgctggcagggtttcagctgcaatcaccagagaatgataacgggtaacagtcagtggacggttcaatcctttgaatactccttgttgattatggtggatcaagctgttttttccgtgcatcacctcgcgggctttgaccacactcgcaccaaaagcctgcccaatagcctgatgcccgaggcacacaccgaggattggcaacttgccggcaaaatgcgaaatggcctctagtgaaatccctgcttcatttggcgtacaaggccccggcgaaatcactaaatgtgtgggcgccaacttctcaatatcttcaagctgtaattcatcattacgcttaactaaaacatttgtccctaactcgcaaaaatattgatataaattgaatgtaaaagaatcgtagttatctattattaatagcataggagtatatcctactgatttttatagttttatatattgccctaccctagcgggcattgtgcattctgtatttcgataaaatcaggtaaagcagcatcaacagcagcgggacgctcatcataccacagacgtatttttaaaatagtaggatagcttaccagcaaacagcagcattcacctatgatgagagcttgatatgaaaagataaagcaggtgaagagggaagacggcactcaaaaagtgaatggcacaatacaaataccgtcttacgtcctaggcttcaaggcaggaaaaccctgttttcctattgaattaaggtgcaactttggcagaaaggatcacaatcggtttcacggggacattttgataagggccaacattttctgtcttgacctgagacattttatcaaccacatccataccttttacgactttaccaaagacagcataaccaaaatcacgctgaccgtggtcaaggaaggcgttatcggtgacattaatgaagaactggctggtggcactgtctttatctgcggtacgtgccatcgctatcgtgccacgcagattacgtaaaccattatctgcttcatttttgattggcgctttggtcaccttctgcttcatgtcttttgtgaagccccccccctgagccataaacccgggaatgatgcggtgaaaaatggtgttgttataaaacccttcattgacatactcaatgaaattttttgtggtgattggcgccttgttactatccagcgcaagctctatttcccctgctgatgttaccagcttcacatgagtttcggcagccaatgccggagctgctatcacactgatagcacatgcagccataagcgacacaaaaatacgtttaaacattaatggttcctttatttttgaggtcaataacaaaactcataacaacaaaacttattaagtgtaattccctatagaactaagttccaaagatttacctacatttacgagtaagcagctatttgttgagatgaattctatctgaatggctattatggtctcataacctgaattttgtttatgtggggaataacgttataaatggcgagaaatatagagtattcaaccaaagggtatacaatacagatatcgtgcaattagtagctacacctgtccacaagccgctgctctaggtataatcagcgcgctgttttcgtgtattcctcagggagataaccattttgaccatcaaaaactacaactatcacatgacccactttgtcacgagtgcacctgacatccgccacctgcctcaagatgtgggtattgaggtcgcgtttgccggtcgatcgaatgcgggtaaatccagcgccctgaatgcactgactaaacaaaagagccttgctcgcaccagtaaaaccccggggcgtactcagcttatcaacctgttcgaagtggaagaaggtattcggctggttgacttaccgggttatggctacgctgaagtgccagaagagatgaaacgcaaatggcagaacgcactgggagagtacctccagaaacgtgagtgtctgctggggttggtggttttgatggatatccgtcatccactgaaagatctggatatgcagatgatcgaatgggcagtcgtgatgcaagtacccgttatggttttgctgacgaaagcggataaattggcatccggcgcccgtaaaagccaattggcgaaagtccgtcaggagctggcttctctgggtggcgagattcaaattgaaaatttctctgtcctgaaaaaaatcggcatcgatcaacttgagcagaaacttgactactggttcaaccagcctgccattgaggtggagtgagcttcacctatcccctaaagccgtgcatcgcgcataaaaaaatgccccagtcaaaagaaatgactggggcagctaatattcagctaaatccgattacgtgaagtaaaaggtctgaaagatagaacatcttacctctgtaccctacgcgaacaactctaccctatttttttcaccagaaaaagatttttttgtaactaattttcatgtgataccgtgattcagccgcaattatttcgctaaatcgggtcattacatcattttttatgtagtttaattacatatttgtgagatctggatctaatctcaaacctaagctaaattcttgtcacaagccctttcgcggcattatgaggataatttcaggccgttaaataaacagtcattccatcaatatacttcaataaaaaattatccccataaaattctgcaccataacaaaaaagccactttttttgtggctcttttgtttactttgcagatttttgactgacaaagtggctgttttcatccgttaatcagtgagcctgatcccagttgatcccaattcccacatccacttttaacggcacatcaagctgcatacttttttccatcaactcactgactttctgctccgctgtcgccaactctgattcatgaacctcaaataccagttcatcgtgcacctgcataatcatgcgtacatttggctgctcactgacgatccaattatccaccgcgatcattgccagtttgatgatatccgccgccgttccctgcattggcgcgttaatcgcctcacgttcagaagccttgcggcgcatggcattgcgcgatttgatatccggcaggtaaaggcgacgcccttccaacgtttcaacaaaaccatactcagccgcctgctggcgtgtacgttccatataggccagtacccccggatagcgttcaaaatagagatccatatagcgttgagcttctccgcgcggaatacttaactggcgggataggccaaacgcactcatgccataaatcagaccaaaattgatcgctttcgcactgcggcgctgttcgctggtcactttttccagtggcacgccaaagacttcagccgccgtcgcactgtgaatatccttaccctgcgcaaacgcctccagcaagcccttatcctgtgacagatgcgccataatccgcaattctatctgcgaatagtccgccgccatgatgtgataaccttccggtgcaataaatgcctgacgaatacgtcgcccctcgtcattacggacaggaatgttttgcaggttaggatcacgggaagaaaggcgtccggtcgctgttacggcctgatgataagaggtatgaactcgtttggtgagagggttaaccatctgcggcagtttgtcggtataagtggatttcagttttgccagaccgcgatgttccagaatcacccgcggcagttcatggttatcggccagttcttccaacacttcttcattggtcgatggcgccccatttggcgtctttttcagtacaggcaggttcagcttttcaaagagaatgacctgtaactgttttggggaagccaaattgaactcttcacccgccagttcataagcggctttttccaattctcccagccgcgcagtgatttccgttgagtgttcagccagggtttgggcatcgatcagcacgccggttcgctctatgcgggaaagcactggcaccaatggcatttcgatgttctggaagatgcttttcagcgtcggcacactgtcgacctgtggatacatggcttggtgcagccgcaaagtcacatccgcatcttcagccgcatattttgccgcttcttccagcgggatttgattgaaggtaagctgctttttgcccttgcccgcgatttcttcaaaagtcgtggttttatatcccagatgacgatctgccaggctatccatgtcatgccgtccgctcacactgttcaggacatacgactccagcatcgtatcaaaaacaatgccattcaaagcaacgtcgtaacgtgccagcaccccacgatcaaatttcaggttctgaccaattttaggcaggtttgcatcttccagcaggggttttaatgccgccagaacttcatgcagatccagttgttctggtgcatcgaggtaatcatgccccaacggcagatatgccgcttcaacctctgattctcccaccgcaatagcaaaagacatgcccaccagattgaccgtcaacgtatcaaggccgtctgtctcagtatcaaaagagaaggctggagcctgtttcagcttcacaatccactcatcaagggatttccggtcaaggatggtttgataattttccgacgaaatattgacagcaaccggtgcactgccggcgggagctgagttagccgtagcacctgccgcagcgggtttttggctattaccttccagccaactgccattctgtacatcgctcaaccaacgtttgaattcatagcggctgaacagcgccagcagttcatcgctgtcaggggctgtaaccgcaagctccagacaggttttatccagctcaacatccgttttaatcgttgccaattgataagaaaggtaagccacctctttgtgctgctccattttcccactcagcgttttagcgccacggaagctgagtgtcgcgatctcatcaagtctggcatagatatcatccagactgccgataccctgcaataatcccagcgctgttttctcaccgacacccggtacgccgggaatattatcggaggagtctcccatcagagcgagaaaatcgatcatcaactcaggtggaacaccatatttctccgagaccccttccggccccagaatggtgttagtcatggtgttaatcagcgtgatatgaggcgtaaccaactgagccatatctttatcgcccgtactaatcagaacggaacgcccttctttttccgcctgcaatgccagtgtaccaatgacgtcatcagcttcgacgcccggcacaaccagaattggcagccccattgcctcaaccattttgtgcagtggctcaatctgcccacgtaaatcatccggcatcgggggacgatgagatttatattcagcaaataactcatcacggaacgttttgcccttggcatcaaacacgaccgccacatgactgggtttatactggatgattaagctgcgcagcatattcaggacaccatacatggcgcccgttggttctcccgcactattggtcagcggaggaaacgcatggtatgcacgataaaggtatgaagaaccatcaaccaaaatcaagggattgtctgctatctgtgccataaaattttcttcgtcgttctgtgggatgattaaagcgtagaatgccatactgtgtcgttatagacgaattttgcgataattttctcgtgctgacaggctttttctgacaaatattctgatgaatgaattgtggataactttgtgcacaaaaaattggcacataaaacagatttatgtttacccccctaaaaaatgagcaacaggaggtaaaaatcaatggattacgtggagtattaaagaaatattacaatgacttaaaaatcactgacttgtggatataaccggagtttatgttatgaaaggggcttttcagcaattattgtgccagctttatcatgactggcacaatacgcatatgattttatattaatactagcatttttgtttaatcacagccgtggcttccgacttatttttttgtcaccagataattcactacatcagaaaagcccttggcatactcagtcactgtcgctggctcaatacccccatttttaatctggtacttgccattcacataaacagcaggaacgccttgcagttgtaaatcgctggcggcctgacgctctttggctgccacagatttcacgataaagctgttcaatgccgcatcatactcttcacctgacacacccgctttgataaaagcattacggatatcggccttgctattgatggtttgggttttctggataccgtcaaacaaaattggggtgactttatcctcaattttcatgacgatggcaaccgcccacgcctctgtcaaatctttccccaaaggcccgataaaatcgacgtggtaacgctcatgagtgacacctgctggcaaattcttctcaacggtactaggaacatggtaaatattttcaaactggtagcagtgggggcaataaaaggagaaaaattctaaaacctgtggctgattggccactggattttttaattcaacgtattgtttatcttcataaaaaccagaagcactggcattaaatgccataaatactcccaccagtgctaaccaaaatgtcttcataatgttctccagtaaaattaatacatcggatttagctgtaaaggtgattcctgtaacagccgaatttgttcagaaaaaagactaacttggccatgccagaagtcgctgtcggccatccacggaaaggcttttggaaaagccggatcttgccagcgacgggcaacccaagccaaataatagaccattctcatcgcgcgaagtggttctatcagtgccaatgtttttggatcaaaatccgtaaactggctatatgactcaagcaggatatccaattggatcaagcgttcttgccgtgagccattgagcaacatccacaaatcctgaatcgccgggccattacgggcatcatcaagatccacgaaccatgcctcatcacgccacagaatattgccagcatggcaatcaccatgcagccgtaatatctgcccatcagaataccatgatccttccaccgtttgatttaactcatccaacgcagcaaagaaggcttttttatgtttagcagggattaatttacatgcagataaatagcggtatggctggtataaatattcatccaaaccaatagttggacgggtagaaaatattttctggcgaccaatttgatgcatttgccccagcaatcgcccaacatcttccaactgatcaaagttatcagattcatactggcgtccacccacactggggaaaatggcgaagaagaacccaccatgattcagtaccgtctggccggcaaacaccagaggcgccgcaactgacaaatctgcctgctgtaatgccagtgcaagatcatgctcttcttggatctgctgctggctccagcgctgcggacgataaaatttcacgacatagcgtttacgattttcatccataaactgatagacgcggttttcatagctattcagttcagttaagccagaatcaatatacaaacccgactgcaccaacgcatccatgattaagtccggtgtaatattctggaagttaaaagccatttgttccgtcacaaccctgctctctcttcattaatctttaataatgcctctcgcacgcagcaaagccgtcttaaaatcttcttcatttttaattccttataaatggctatacaaattagcaaggataatgacttagagaaagagttggtctgtcaataagcgtaaaggttatactctcttccatgaaagcattgttacatattggtttacaaaggttataagccaaataattaaatatttcattgccaaatatcaggtgagttaacatgacgcatccaaaaatgagtggcgcaattctggccggaggactatccacccgcatggggggggatgataaaggattactgcaattcgaaggcataccattataccaacacattgccacaagattgcagccgcaggtgcaagaactgctgattaacgccaaccgtaatcaggcgctttatcagcagagtggttatcccatcataccggatatcatcaccgatttttctgggccactggcaggtatgctggcggtattgaagaaggccattaatgaatgggtgatctttgtcccctgtgatgtgccagattttcccgatgaccttgtggaaaaactgtggcgttatcggcagcattcatgggcagtttatgtccatgattgccaacgtgcccatcccacactggctttaatgcaccgcagcctgatcccccgcttggaaagctatctggcactgggagagagaaagctggtgttttttatgcagatgattaaagcaaaagcggtttattttccctatctcggctccttcaccaatttaaatacaccggaagaataccagcattgggaatatttccaggagtcagcatgagcccgacgacattgccgttgctcggcatcactgcctatagtggaacaggtaaaacaacacttcttaagcagatcattccgctattgcgccagcagcatatccgcgtggggttgattaagcacactcaccataatatggatgtcgatcaaccgggcaaagacagttatgagctgcgtaaggcaggggcagcacaaacgttggtcgccagccagcagcgctgggcattgatgacagaaacaccagacttaccagagctggatctacactatctcgccagtcggttcgatgcagattccctggatctggttctggtcgaaggcttcaaggaagaggccattgcaaaaatagctctctatcgccacggcctgaacattgtctttgaccagatccttgatccccaagttattgctattgccagcaacaccccgctggcaacatcgcttcctcagcttaatatcaaccaaccacagcaagtaacagcgtttattgtggcgtggttgagggcaggcagcgctggcaagcatggctaaaaaccatcagaaccggcaggtaaggccaatattcaggccattctgttggaggtcatcccagaaaccctcgggaaaacgtttgatatcgctctccaacaattcgggcttttgccattcaaatcgattaaacccagctttttgaatagcgcgttcgtaatcttcatggctccatcgataaaacgtaaaaggacttggtggcgtagttaaaaattcggcttgataacggatgccatctttccatggttcttcgctcaggatattgatgccataaatatcacagttacttacggctaatcgataatcaggagaaactgtgtaagcaatgaacttaccagaaggcttgagattattggcaacagcctgaaacatcttttccagatcttcaatcgattccgaatagttaagcaaccaagccgcaatgacgatatcaaactgaccaaatgactccatattgcagacatttcgtacatgaaattccagatcatctccatattgtttcgattttgctctggcaagccctaccattgtttcggaaatatctacaccaaccgcttttgaagcgccatgatttcgtagctctcgaccaaagtaaccataaccacaagccaaatccagaaccgatttgccgcgtacatcgccaaccagattgagtatggtacgaacgtcgatttcacgttgaggcctattattcatgaagagttcataacgatctccaatagaattatagtctacatctttttttggcataattattagcctctaataaatggataattagaacagtccctgtttttcactttgtagttaggtggaaatttatttccttatgaacacatataatttacggttcttgcaatataaatcaggctgatgagaattgatttcagaaagtatcaatacgagtaggggtaagcaacgaaactttttggaaaacagcccacaaattatgttgcgggttgtacatattatgtggaattgttcagtttattagtgctatttaccttccggtattaaaccaataaaagaggcctttttccttggttcggttattaatgtttccagttacatataaaatagacttcttaatcttattaacacgaccccaaaaaccatcgaaaaatcctctgcattattggaggtatccatttcataaaatgaagaattggactgtatctttgattgttacagaaccgaaagtgctggtagtttcttcaaggggaatagatcggttaatagagagaggcttaaataaaaataattttcttggttggtcgatgtttttaggctctccggtttggaaaattacggcaacaaagatgaatcattatttaaatattgattacccttataaatatggtcaatatcggtcaaaaatagaaatgttggctaatttcccagaactaaaatgaatgatttaagttattcaatctatattgaacagcatcaataaaatgaaatgatattaaaatatgacaccaacaaattcgacagaagaattattactggatatcgctaacaaagataacctttcaaaagaaaataaaaaaatgcttatcaatgcgacggcttatccagaccaaaaaacaaattatgcggcaagaaaaccatgcgctgtatgcccacctccacaggcaatacccgaatttatagaaaatctaattagttctttagatatcaaccagccacaacaggtaacagcgtttattgtggcgtggttgaagggaagaaacgcaggaaaacatagctaaaggccaatagactattcctgatagttttgtaaccaaacataaaaagagcaaaccatcagaactgacaggtaaagcctatattcagattatttcgttggaaaatatcccaaaaaccatcgggataacgtttgaaatcattctctaacagcttaggtttttgccattcaactcgactgaatcctgccttttgaatagctcgttcataatcctcatggttccatcgatagaaaataaggaggcttggtggtgtcgttaaaaattccacgtgataataggcgccacctttgcatggttcttcactcagaatattgataccataaatatcgtagttaccctgattgaaacggaaagcgggtgaaaccgtataagcaactaacttacctgaaagtttgagatggctagcgacgacctgaaacattttttccaaatcgtcaatcgattcagcataattgaacaaccaagccgcaacaatgatatcaaacttgccaagtgattccatatggcagacatcttgcacatgaaattctatatcatcattatgctgttccgacttttctctggcatgctctatcattgcttcagaaatatccacaccaacgacttttgacgctccacgtttgcgtaactctcgaccgaaataaccatatccacaggccacatccagaaccgattttccactgacatcaccaaccatactgagtatggtacgaacgtctatttcacgttgaggtgtgtcttctatgaattgctcataacgttctccaatagcattataggctgcatgttttttcgacatgattattactcccctgataaacggataatgataatcgctccgattttctactgtgcagttgaaggggcttcatatctttatgaatggcatctaattttacttgatggtgccaatggcagataaagctaaaaattcaaaaaagtgcaaatatgagcagcattaagcaaccgcattttcggaaaacagcccacagattatgttgcgggctgtgcatatatcaatcatattataacgctatttcccttccggcatcaagccaataaacgttatttttttccttggctcggtcatcaacgcttccaatctctcgacacagcgcaagtaatgaggcgtttttttatgggcggccaccgcagtttcatcagcataggcttcataaacataaaagcgggtcggaatattttcatccctcagcacatcaaagcgtaagttgcccggctctttgaccgaaccaaggtgattatcacgaaaaacctcgataaattcgtcaatcttgtcggctttaacgttgattttgactaacgtgacttgcatattattcccccttagccttttcactcaggaacagttcataagcctgtgctggcttctcattgtgatgaaccaccgcctgaaccgctttcagcatggctaccggcgcttcggactggaagatattccgtcccatatcaacaccggacgcaccctgatcaatcgcctgatagcacatctccagtgcttctatctccggtaatttcttgccgcctgcaatcacaatcggcacaggacagcccgctgcgatccgttcaaaaccgctgtcaacataataggtcttgataatattcgcccctatttcagcggcaatacgggtcgccagtgagaaataacgctggtcacgtgccatatccttcccgacgcctgtcacggccattgtcggcatgccatagcgcattccctgatccaccagcttaatgatgttcttgatggattgatgttcatgctcagaaccaatataaacttgcgccgccacggcgcacacattcagccgaagcgcatcctccatcgccacagccaccgcttcattggacaactcagtcaaaatcgaattagcgccggatgcacgcagtaccacaggtttattggttgcaggtggaacctgactgcgcagaataccgcgggtacacatcagtacatcagtgtgctcaaacagcggggcgatattgatatcaatacgctccaatcccgtggtcggcccctgaaaataaccgtgatcaaacgccagcatcaccgttttattggtcgctggattgaaaatccgcgccaaacgcgactgcattccccaatccagcgcaccactgcctttcaattcaaacagagtgttcttttgtggtgtatcaataccaaaatctttaccgtctttgatgtcatctaaatctgccatttctctctccagaaggtgtcagcccataaattagaaatcgtattggttgatgttttcgctggtaaaaatcacacgctccggcatcacaacaatgccgttgcctttcgcttcgtagcggtatccctgtacgctgttgggtgaaatctccagtttgccgatatcaggaatatctaactgatcccctacattcagatcgccttttttcagcatttcatcagcaacgtgaatggctatcttgccctgcttgacgacatcccacagaccgaactgtttaactgtgccgcttgcaacgtaagggcgcatcacattcggggtactgaacccgacgatcgcgacattcctgcgtttcaggttctccgcagcctgcgccgcagcaggcaaagcattggcatccggagcgataatcgcatccaaatctccccatgcttttaaaatgccttccgccgtttgcaaagatttggtggcatcgttatagccaaattgggtggttacaatttcccagttgggatgctccgccgcaatcttggctttcgcttctttcacccattggttttgatccgtcaccgtcgggctggaatagaaaaacgccactttggcttggtcttttttgacctgactggcagccatctccaccagcattccgcccaactgtttcggtgtgccttgatcgatatagatagaacgacattcaggtgccgtatctgaatcccatgtcagtactttgacaccgcgttgcatagctcgtttcagagccggacacaggccatccggtgataccgccgataccacaatcgcgttatagccttgattgacgaaattattgatgagctgaacctgccccgcgacactcggttcggtcgggccatcgtaagtgacgtcaacgcccagagccttacctgtctctaccgcaccttgcccgccactggtgaagaagccgacaccgaccagcttcggaataaacgcaattttctcagccgcctgtacccaggagacacataccagacttaatgcactggccagaacccattttttcagtgttggtgctttcatgcctatctccatctctgttatcgttcaggggtattttgtggcgaagcagaagcccgctggcgttgccaccagtcacgaatttgatggcgatgcagagaaaccgagcgcccgaccaccgccgcaatcagcagtgcaccggacagcgcgctggatatctggttcggaatgcccgccatctgcaatccctgctgcaaatagcccaccagcaggatagccagcgcagtgcccacaatggagccagagccgccataaatattggcaccgcccagaaccacggcagtgatagtaggcatcaggaatgaacttcccaaatcagaacgggctgaaccgaaataagacaccagaatgatcgccgccagcgcggaagccaaacccgtcagggcatacagcaagtacagagttctattcacggggatcgccccataacgggcggcacggctattctgcccaatcagaaacacataacggccacggtgggtacggtgcataaacagccagaacatcagaacgcaaaagatgaagatcaccaaaggaacaggcaggccgaacagcgtcaggttggcaaaatcggtaaaggccgcaggaaagccaccaatgccttcatagcctgtcgcgcccgatagcccggacagcaacagcgcactgccaccaaacaggtacatcgttccaagcgtgatcaccaatggattcacgccggtatagaaaatcagcgtggcattgatcaggccacacagtacgccaacgatcagcgtcagagggatcgcagcgatcatcggcagccccgcctgatacatgatccccaaagcaatcgcacacaggccgatcaccgcgccaaaagagatatcaatcccgccactgacgatcaccatcgtcaacggcagggcaacaatgccaatgcagataaaatcactggtactaaacaacaacacgttaatatccagcatccgtggatttaccatgccaaacagcagaatttccattaccaacagcgccgcaagggcagtttcccagccgtaacgctgcaaagcattcatcatggcttctcctgtttttttgccgggctttttatcggctccagaaaacgggcgtaacgttgctggcgtaaattcttttcaacggcactgcgcaaacgtccgtcaaagaccagcacagccaacaaaaccagaccggcaataaaatcattccaccatgccggcaaccttagcagcaccaacacactgtcgatttgggtcaggaaataagccccgaaaatcgccccaaccacggttcccattccgcccaacagactaatgccccccaatacacaagcggcgatcgctttcatttccagcccgctacccgtttgattcgggataaaaccaatctgagccacaaaaacaatgcctgccagtgcagccatcacgccgttcgcagcaaaaaccgtgatgcagataatattgacaggaacgccaagctgacgagcaccctgctggttatcacccgtagcatagaagcctcggccaaaatcgcttttcttcaacatccacgtcatcgccagaaccagcaatatcaacaaccagccaatcggtgagataccgaaccagtccggtctggcaagcgctttcacatcagccggcaaaccttcgatccatttaccgcccgtcagcaacagcatcaggcctcggtataagccaagggttcccaaggtagcgacaatagccggaattttcagccataccaccagcaccccgttgattaatcccgccaccatgccgaccaacagcgtcatcagacatgccatcggcagcggtaatccgccattaagtgacatgcccaacaccaccgcgcataagcccgttgttgaaccgactgacacatcaatactgcgcgtgagcatcacccacgttgcccccagcgccaataacatcaagatctgcgcattaccaaaaatcatgcccatcgtctgcacgctgaaagcctgccgatcaagactgcccaacagcagaaataatcccagaatggcgatcaatgccgtaacttcgcggttgttctggataaacttcaacatgacgcctcctcaccaaaagcaagatgcataatcgcatccacactcatactggctttatccagatgcccgcagatccctccctgatgcatcaccagcgttcgatctgccaattgcacgatctcatcaagatcagacgagatcaggagaatagccacctgctggctggcgatactgcggataagctggtagatatcactgcgcgccgcgacatcaacaccgcgtgtcggctcatcaataatcagaacggcaggcttggcttccagacatttggcgatcagaattttttgttgattcccgcccgacaaggtgcgtacaggctgattgatatgactgaagcgaatattgagcgcccgacggtaacgttcaagcacggcggcatcataggcggggcgtgtccagaaagtacggcggctgtgcgtcagtgaaccaatattccaactgagcggtgcatcgagaaacagaccagacgcctgccgatcctccggcaggtaaaccagcccagatcgcaaccgggcgaccgtatcccgttgattgatcacttgctgccgaaaacggatctctccctgcacaatcggacgtaatccatataatgtttccgccagctccgttcgcccggcgcctaccactcctgccaggccaacgatctcccccgcactcagattcagagaaatatcacgaaacccttcgccacccagcgaagatacttcaaggacaggttcggcctgattgatggcaaaagcactgctgctaacttccagacacagcttctgcgatccggttaacgcgcctgttttcgcctccggcgtaatggcctgaataatcgcttctgtggaaaacgccaccgttgccccactgagcgcaatgccaccatcgcgcatcacactgacataatcagcaatctgacggatttccggtaatttgtgggaaataaagatgatcccaacttgttgctgctgcaactcacgaacccgctcaaataatcgctccgtttctgccggcgtcagcgatgccgtgggttcatcaaggatcaaaatacgggaataacgcatcagcccgcgcataatttccactaactgctgatccgccacattcaggctgccagcaggggcattcagatccatcgaacaattcaactgagccagtaattgctgcatccggcttttgctgacctgatgtttaggcaggcggaataaaatattttcctgaacagaaagattgggaaataacaaaggttcttgtggcaccagatagatgcccaattgatgcgccttagtgggtgtcagatgactgacagaacggccatccagcatcagcgttcccgcatccggctgctcaatgccagcaatgattttcatcagcgtcgatttgcctgccccattgccgccgagcaaggcatgaacctgcccccgagtcagtatgaaatcaatatgtttcaataccgccagaccggaaaattgcttactgactccacgaaccgccaaaagagggacactgccagaatcattttgggaaggcatattggtggtattgttctgtgacattacagcacctcatggcgttacagactttcgttttgcggacacggacattgaacatttattaatttaaaatacttttgttcacaactctaattcataatctgaagtttttacaatatttctatcacattttgtgaaaaaattagatctccattaaaatatgttcaaatttttgcgatcgccctctagcacatcagaggctttcatgcttaattctttgccagtggataaacaagttgttatgccgatcaaaccaaccaagaagcaatcagtatcagaaagaagcgtgttatccgaggaactttcttattcagataataaccattcaggtcatggctattcaggaaaccgcatgagtgaagaagaactactggctcgcatagcctggttttactatcacgatggtctgactcaaggagacatcggtgaattgctcggcctcagccgcctcaaagtctcccgcctgctggagaaggggcggcagtcgggcgtgatccgcgtgcagatcaattcacgctatgaagggtgtctggaattggaagatacgctgcaaaaacgctttaatctcaagcaggttcgtgtactgccggctcttgacggaataaacctcaacacccgtcttggcgtcggcgctgcccacctgctgatggcactgattgagcctagtcagctactggctatcggatttggcgaaaccccgatgtgtactttacagcacctgagcgggtttatttcatcccaacaaatccggctggtgacgttatctggcggcgtcggcccttatatgacggggattggtcagctcgatgcagactgccctgtcagtatcattcctgcaccgctgcgggcgtcaactcaccaagtcgccgcgacgttccgcgaagaacgcagcgtgcgggatgtgatcctggctgcctgtgccgcagatatcgccgtggtaggaatcggagcgatcaaccagcgacagcaggcgaccatcatgcgttccggctatatcagcgacggagaacaattgatgtttggtcgcaaaggcgcgattggggatatcctcggttatttcttcaatgcagaaggtgagctggtcggcaatatcgatatccatcaggaactgatcagtatctccctaccagagctgaaaacgatcccgaatgtgatcggtgtggcggggggtatcgaaaaagccgacgccatcgttgccgcactgaaagggggctatattagctcgctggtaaccgaagaacagaccgcaagagctatgctgacgtaatcgactaacactgcttacccatcccctgtgccctatcgaacaaaaagataacgacagacgaggatagcatcatgaatcaacgcgctcacgctcacccatcagggaagtatctgatggcgcttgatgcaggaactggcagtatccgtgcagtaatatttgatctcgaaggaaatcaggtcgccgttggacagactgagtggatacaccagcctgtaccgaatgtcgcaggttcaatggaattcgatctaaaaaacaactggcaactggcgtgtcaatgtatccgccaggcactgcaaaaggcagaactgcctgccagtgcgattcagggcgttgccgcctgctcaatgcgggaaggcatcgttctgtataatcgcagtggcgatcccatctgggcctgtgccaacgtcgatgcccgctctggtcatgaagtcagcgagctgaaggagctttacgacaatacctttgagtatgatgtttaccgttactccggccagactctggcactgggcgcaatgccccgtctgctgtggcttgcgcatcatcgcgcggatatctatcggcaggccagtacactcactatgatcagcgactggctggcttatatgctcagtggcgagctggcggttgatccctccaacgcaggcacaacggggatgctggacttagtcagccgcaactggcgcccgagcctgctggaaatggccggactacgttccgatatcctttcccccgtcaaagaaaccggcaccctgctcggttacatcaccggaaaagcagcggcagaatgcggcctgaacagcggcacacccgtcattatgggcggcggcgatgtccagctcggctgtctcggcattggtgtcgtcaaacccgcgcagaccgccgtactcggtggcactttctggcagcaggtcgtcaacctgccagcaccgatcaccgatcccaacatgaacatccgcatcaacccgcatgtcattcccggcatggcacaggcggaatccatcagctttttcaccggcctgaccatgcgctggttccgcgatgccttctgcgcggaagaaaaactgatggcggaacggctgggtgttgatgcttacagcctgctggaagacatggcggcacgagttcccgctggagcttatggcatcatgccgattttctcggacgtcatgcgctttaaatcgtggtatcacgctgccccttccttcctcaacctgtcgattgatccggaaaaatgcaacaaagcgacgctatttagagcactggaggaaaacgcggccatcgtctcggcctgtaatcttgatttgattgctgatttttccggtgttaagccagactcactggtctttgccggcggtggttccaagggcaaactctggtgccagatcctcgccgacgtgacaggattacccgtgcgggttcctgtagttaaggaagcaaccgcgttgggctgtgcaattgcggcgggcgtgggggtttcattgtatgactcactgcctgaaaccggggaaaaactggtgcgctgggagcgggaatatcagccggatttgacacattgggagatttaccaaaaaacgaaaaaaaattggcaggcagtgtacacagaccaacttcatctggtggatgacgggctgacgacatcgctgtggaaagcgccggggttgtgaatatgttccttcatatacaaattaaatattcttcttagtcccattaacataaccagaaacgccagtatattaaaccggacaaaattaacacaaaaaggaaatagtatgtaaaatatcatacatttgatacttaaaggaaataaacagggtttaatctctgctgactgttcagcaccagattcaatcggcaatctttatcaatgtgtgagtgaatactatgtctgatgctgatcaacaaattgaacacatgaccaaaaagccctctattcctatagagggcttttactatataacctcagcttcgtttaagaatagcgatatcagtatcccgtaaattcaagctcggttttttaggctggaatgtataagcaattagacccgcagcgatttccagcagaaaaccgagctgactgcgatgccttgaatgctctatctgagaaatatttttgagctggtcgatgaccgtttctatcaagaatcgccttcttaacatcaatctatcccaaagagataacgcttttgccttcatgttactacggacatgagtgattaacgtgaccccttccgcttccaactcatcgcataaagcctgtgataaataccctttatcaccctataaacatcccgttaacccttttaccatcgctttgacagggtgacgatcatccttatttcctgtggttaacttcacggccaaaagttcaccgcaatcattgataaccagatgaagtttaaagccataaaaccaacctgtactcgtttttcctcgttgtgcaaccccctcaaatacacgatggcggggaatacgaaggttgtgacaaacagcaattttggtgggatcaataaaagcgatcccttgggttttagccttgcgtgaagaaagaaaagcgcatagaggaataagtgcccttttcttcaaagtgagcattcgggtatagctgaccaatccgggaaaatcggccttaagatgttgttttacatatttaatataaaacgttttaaaatcacgataatggctcatatgaaataaaatgaggatcatcatgacttcactgagagaaagggaagcttcgcggtgccgtttgagtaatccgttttcaatgagttgttgatgccagagggggataaatgtttggcaaaagtcatcgacgcagcagtaaaattcttctaaattaaccatgcctggggatctccacgattttgttttctttagcaaaaactttgatcgtgcctcaggcactttagttcccttcttaagcaaatctcaggttatatagttttatatgtgatcttttattgatatcaaataaactattcttcacctacaaaatagatatcaaatgagcattctaatcccaaatcggacattattttcatttgctcgggccataatgtgggacctccgtgccatgcaatagaacgccaaacacaatcaattctcattgttactttatctgtattttgtaattgctttaatccttcagaagatttagatattttatttaaaagccaatctaaatgatctctaatatcttttgaatttacataattttctgaagataaaagccaaccagctatttttatttctcttgttcgccctgaactacttgtaatttttgtacctactatattttttttagtaggttctaactgtaataaagaacttacttcatccggatgaatatattcaggataaatcattaacttagcataacactcatcacaagtaggataatcaggatttacgggagtttctctagatttaatagtcattttatataatcacctaatcaggacttttagcgaacgtgaatagtctgtttggaagctctatttattgaatatgaccgtaaatctaataggttatgagtctgacaactcataaccttaagtgaatttcaacgatgacataaaaaagaaataaaattatctcatcgtcacaaattcttccgctgccgtcggatggatcgccacagtattatcaaaatccttcttcgttgcgcccattttcagcgcaaccgcaaaaccttgcaggatttcatccataccaaagccgataccgtgaataccaacaatcttctcacccgctcccgtacaaactaatttcatccgacatggctggcgatgttgtgtcacggcagtatacatcgcagtaaatgacgaagtataaaccttaacctgatcatcaccatactgttcctttgcctgcggttctgtcaaacctaccgtaccgattggcgggtgactgaataccaccgttggcacattggtgtaatccagatgctcttccggcttgttattaaacagacgctccgacaagcgacgacctgccgcaattgccaccggcgtcaattccactgcccccgtgttatcgcctaccgcatatacgcctttgacattggtattctgatatttatcgactgggatataacctttctcattcaactcaacaccagtgactgccagattcagattatctgtcatcggctcgcgaccaatcgcccagatcagcgtatcaaccgtctgctctctgccatcctgcaattgcagcgtcaagctaccatcagcatgtttaatcacggcttttaatatcgcttctgtatgcagtgtcggtccttcatttttgatgacttccagcaaggtctcgacaatcagcggatcgaaagaacgcagcggcgcatgtttgcgcacaaacagatgcgtttcactgcccagcgccttcaaaacaccagcaatttccacagcgatgtaacccgcgcctaccacagcaacacgctttggcatttcatccagttcaaagaaaccatcagaatcaataccatattccgctcccggaatcgctggacgtaccggacgcccacccgtagcaatcaggatatggtcagcggtgattttttctccattgacctcgactgtatgcgcatcaacaaaacgggcaaacccctgaatgacatcgaccttattattgcccagcacacgctcataggactgatgaatacgatcaatgtaagccgtacgactggcaatcagtgtcttccagtcaaaacgatttaccgtggtatcaaaaccataatcaggaccatattgatgaatagattccgcaatctgggcggcatgccacatcactttctttggtacacagcccacattcacacatgttccgcctagcgctttcgcttcaatcagcgcgcacttctgcccatacatggcagcacggttcatggaggcaataccaccactgccaccaccaattgcaatataatcgtaatgtttactcatcttaggtcacttccgtctaatcaattaacttacaagtacaagctaaagttcaacctggcgtctattatgacaaaaagttatcaccgactgtggatggttctggctttcattactataggccacaactatttggtgataatgccgttttggacggacgtctattcaggcaccacccatgccacagaggtatgccctgttccttcaggaaccaatacttgatgcagccatggcaatactgctttcatctgctgctccagcttccacggcggattaatgacgatcatgccggacgccgtcataccacgctgatcactgtcaggacgtaccccaagctcgatctgtaaaacattgcgaatgcccgttgcttccagatccttgagcatacgtttaattttctgacgcagtacaaccggataccacagcgcgtaagtgccggtcgcaaagcgcttatatccttccaaaatacccttgacgacattctggtagtcagatttcaattcataaggggggtcaatcagcacaaacccgcggcgacttctgggcggtagttttgatttcagctgctgataaccatcttcccgcaggaggcgcacacgttcatcacgggaaaattcactgcgtaacaaaggaaaatcactgggatgcaattcactcaagttaagctcgtcatattcccgcaataaatggcgggcaatcagcggagaacctgggtaataacgcagaacaccatgcggattcagcgcctttaccgcgcccatatacgccgtcaattcctcgggaatatcatcacgctgccagatacgggcaataccttccagatactcccctgtacgctcggcatgttccccgctcaactgataacggcctgcgcctgcatgggtatccaaatacaggaaaggtttctcttttcccttcattgactcaatgatcaggctttgcacagtgtgcttcagcacatccgcgtggttgccggcatggaaactgtgacgataacttagcattaaacttatttcctattgatttttaatggattttaattcaagaaaagacagattattcattttattaccccagatattaccccacgcttcattgcactaatacaaaaacataataaagcatagtaacaaagtaatggatgaatatttattttggaagagatgaaaaccgaaccaaaggaagacactgtgtggggtaatcgttaccccacggagatattttttaactaaatttccgctaattagaaacttttcgggtagttcgtttgataagttgaccgttactatcaaaatagcggctaggccagatttctgagggatgtatttcgaggtaattagcgataatccattcacctttcggccaaggccgactaagtgtattcgctaatgtcgatgaactgagtcccgattcacgggagacagccgctaaggttgtaccacgtttacgtaatgcagcaataatatcagcttgatgccagtcatttctaacgttattcattcctgctaccccttccattaattgatcattgatggtggcgatccagacagggtttgcagactgggtaactataaccagcgaggccgaagcctcccctgcctgaaccaccattgaaagggtgacaacagacgcactggtagaaacttcctaccagtgtatatagttacacaaggctgcaaaaccttgaccattggattttgccaatggcggggccactttaactgattggtttatcggactcaataagtgaatcagtataaacgcttaactttttgcgttatatgctgtccagatgagatctgatacccttgctactctgagttcacgcaaatatgacagtcagctcagtgcccagactgtgtaaaaacccttgatcaccttttggtctaagtacgatgtacttatgatcaatgggtcttagctaccgatccaatttcaaagccaagtccagtatcatcagattggtaagcataatcatggagattctggcatgtctcaccatattactggtcaatcaaggcatcaatccacgctctttccagaactcatggacgactttgttagcgaagataacccagtgcgagttattgatgtctttgttgaacatctcgatttactcgacttaggttttgaaagcgtgaatcccaagtcaactggccgtcctagatatcaccctgccacgatgctcaagctctacatttacggttatttaaatcgaattcaatcatcgcgacggctggagaaggaatgcaaccgcaatgtcgagttaatgtggctgcttgaacgtttatctcccgacttcaaaacgattgcaaacttcagaaaggataatggtaagggaattaaaaacgtttgccgtcaattcgtcgagttatgccgacaactcaacatgtttgaagatgccgtgttcgctattgatggtagtaaattcaaagccgtcaataataaatccaaaaattacacccccagtaaagtgcagtttcatatcgagcgagttgaaaaaagtatcgagaaatatttaagccagatggatgccaaagatgagaacgaaaaagagtctgatctgattgtcgcagcatcgaaattagcctggctaaaacagcgcttagttgagctaaaagcactcgaaaaacaagttaatgagcatccggacaaacagatatcacagacggatcctgatgcccgcttgatgaaaacacaccacatggaaagacaagtctgctacaacgtgcaaacggcggtcgatacaaagcaccatctcatcgtttgccacgacatcgtcatgacaacagaccgaggtcaactgacattagttgccgggcaagtccaaaaggttttggggaaggaatcgattaccgtgttagccgacaaaggctacttcagtcgaaatgatatcaaagacgcggatgatcaaggcatcacggcgaatgtgccacaaattgacacgtcaggttcggagagcaaaggcatttttaacaagtctctcttcaagtacgacaacgacagtgatgtatacatttgtccggcgggtcaaagtttacaaaagcgaatgagagtagtggagaaaggtgtagaactggatgtttactttaacaatttagcgtgcaataaatgtccaatccgatctcaatgcacaaaatcaaagaaagagccccgtcgcataagacgatggatacatgaatcgattattgatgacatgcaaaaacggttggacgagcatccggaattcccggtgataaggaaacagagtgttgagcatccgtttggcacgataaaaatgtggatgggagcgactcactttttgactaaacgcctcaaaaatgtgagcactgaaatcagcctcagtgttcttgcttacaacctgaaacgtatgatgaccatactgggaactgtcggtttgatggcagccatcagtctgagctgagtgataaagtcagcttagtttcaccaaaaatctgccccaaacgctcaaggcacactgcttttaaatgacttcatattacaagccaccaatctgcatcagaacattgtgaatgtgatgagcgctaatcggatgcttaaatgcaacccaaatcgatgtttgttggatgaaatcacggtttttacacagtctgtgccagaagcggacatcgcggacgacaccgtttgttaatcgatatcgattttaaaaaagcaatgcctcgctgggcataaaaggtggctcgctgacctgacatattgcgttgttagcgaaccgctgaaccttactccctcgcatcttgtaaagcgctttttcacatgttgtgcgatgttaaccaatgagcaaagctattagttagagtcaacattgtttcttcggagatatattttaaaaggtagattgttaacgaaacaaaataccatctttaagagcgtcatatttgatcatttttaaaagctaaatcctctattattccttctatatccattaaccgattaccagcatcaatatcatcaatatcatcaatatcatcatcctctgggttaccttcgtaataatcttcatcttcgacaggaatcccttgtgctttatcattcgtgtttcttgcaagtctatcaagtttaaaaaagttaatgctatagcatcctttagggctattgtttttaacactataagacacaagaatattcgttccttcctgaagggtgatgtataaaatatgatcaacaaaaatatcagtgtttgggtgtatgaatttatagttttctgttgcgaagggatcatgattgttttcgaaacatggattgataaacgcaacacttctccctttcatcttcatattacatcttttacatgaggcggctaagttatccaaagtaaacataaaatcaacgtatttatgcttgggtaatatatgctctatatcaatcacataattgaattcatcaaacatatttctcaagcagtaacagcaaaaatgcttttgccttttttttaaatgttctttaagtctggacttcaaatctttaacactgtcatccttccatgctgcatatcctttcttaatgcattctgcaattataacttcatcctccggcgaaagtgtaaaattagtcatttgaatcaccatgtacttttttcaaaagattaattacatcgttaaggaaatcatattgtttttcatcaaatgctacattcttcattctggaaattgcttggaatgcatcatcaaaggaaattcttttttcggcaacgccacggacgatttcattgcaataatatgaaagatatctattttttggcgtcaagatcccaaaaagctcataatacacttgctctatgttattatttttttgcttatgattagtatcgaaaatcaccccattttcaataccatacaaagaaaaatcagcgctataaaaatcgttctccattgtaatgaaaggggagtgagttgcaataataactttgacatcatcattgtatccaagaaaaccaatcagaaattctatatattttctttgcaattttgggtgaaggctattttcaggctcatcaatcaatataactttaggtaagttcgttttcctttcatctaaaaatttacgtaaaaaaaggccaaaagaaagcatgtacaactccccagaactagaattttcaataggaaaaattttattattttttttaacgaaaattctgctggtgaatagttgattgaaactatgcaaacctaaatcagtcctaacttcttgttcatatttcatgtgatctttaattgattgattttctctttcattaccattgtaggtaagataataatcatgacttttttcaatatatgaaccgtgtttttctacaattccacgacttaattgttgcttataagattgaaatcttttgtattgttcctttccataagtagaataaacaagctcataatcatacctttcttttttttgaatcctgtatagaggttctcttctgactaaaatctcatctgaatacccaatcaatttgcatatacttagtaaacctcttagtgaattgttcgtgattaatttaataaaataattatttatgttccttgataatatatcttgagtttgaccatatctcgatcttaaaccgtaatagtgatgactgtttttcctaattaatgggaatgggttaattattgaatttgatactactgctatgtgttcacgatgaaagttttcattaaaatagttaagtagatatcttgttttgccttgtccattctcacctaatataatttttattttagccatgttggtaccttttgtaatccatttggatgatgacatttacctaaattttttcatatgcatatgaaattatgcattgacctattagatattaatggaatcaagattgaaatgaaatactaatttatcacgaaagtaaaaccttaagttatatgaagcatggattactaatacaattcatatagtaactataatcattatttgagtataagtatgaacgcatacatccgataatagagaattttacgtatcgaggtttagtaatgaagtcggctagttaaacgtgtacatttatggtcagcaggcattttatatagggcgcgtatggttgatgccgccctagccggatacactttataggatattaaccaacagatatgtcataaagggatacgcgaggtgcatcattgcgggatgctttgcagaagactagcaaattaatatcaactgcctccatatgtgatgtcggcttttcgctcatagctgactgtcagatagagtaacgactaatccaaataaaggtgtgatatctagccttcctagcgtttgatttcattaattcctattctgcacaggcattaaaaatcaattatttatctaaattccatcaaaattagccagtctctgtttctgtccatcactgaggctgaatgcaaactctttatgctcactctgccatgtgccaaaactcatcaggaacgcgattgcggggtcgattttgttcgccgatttcttcttgttcggtttgatattggcgttcgcgtcggtctccatcaccacattggacattgcccatgccagcaccggatcgccattgtgacgaatgaccttgcggttaacaaacacctcggccgatttcgccacagggctaaagcgcatataggtttgcgggaacggctcaacatccagccccgcgccctgtaattgtgttcgtaggtgggtagcgttccatatgtcgaagccgaccagcctgatatcaaagtgctgactgtctttgagaatatcatctcggatacggtcataatcaatacagtcgcctgctgtagtgcatatccagcccatttgtgcccattgccgatacaccgcacgattcttattggcgggattctgtaactgggcttctggtaagtaatggcgggtcagtagtaacagttcattatccacaggaaaggtgtaacacacactggtgatatcgcccgttgacgataaatccagtccggcgtagcactccagtcctttcaggtcgctttcattataatcagtctgacaggctttccaagcgccctcacccatccacggcgtttccccctgacaccagatgttaaagcgtttggttaacatttccgtccattgtgagggaataccgcgggctttctgtatcgtgtcatgcaaagcgtcactgtctaccgagacattgagattggggttagcctttatccaaagcgcttcatcatcaatctcgttctcgccgtccagctcgtaaatcaaggcaaacagtgattcgttctgctcttcgccgtccagtatctggcagcaataatcataatgctgtttacaggcggagattacgttactgcccgctgtggtaatggcaaacaggacaccttcgggacgtgcgcccatgcctaattcaagggcagagtagacggcgttatcggggtgcaaatgatactcatccacaatagcaagagaggggtttgtgccctcaatcgtggaagctttggctgccagtggttttaacaggctattggttttcgaataggtcagtttatgttgctggatggatacccgctttttcagcggctttgataacaaactcatctggcgggcatcatcaaacacgatacgtgcctgatcacgactgacggcggcggtgtaaatatcctgctggcctgactccatcaccaagaaccaattagccaatatcgcggcaacggtggatttcgcatttttgcgtggcacctgaatataagcgctacggtactttctgcggccagtagcctttaccttgaagccaaacaggttagcaaaagcgaattgctgccacggctcaaggattatcggtttaccgcgtaaatggcctttgacgtgcggacagagacgggagaaggcaataaagcgcgccacaacctcggtatcaaacgtataacgtgggttattcaggtcattatagtagtgtttcacggcctgtttcagtcgcttacaggccgaaattttaccgttttggatattaaaagcgtactgctcccatgcgttcataggcgatctaattcgtcctcttcctcggtttccaccggatttttacgccgtgatacggggtcaaaacccagtaaggacgacatttttatcatgatcttttccgcgtcggccttagcgctcaaggacgggttacggctttcactgccctgactgttcacgatgctaaagccccgaatatcaaggtctgccaccgcttttcggtaaatggcatagttgacgcaatacagttctaagttgttccagtcggcggcgttcagatcttcccgttcgcctaagatttttgccttggatttccactgactggcggcaatgtcattaagatatgtcgggggtttgggtgccctggccataattttctgtctcccttgtgagtttattttcaaaaaaagtgccgtgcgtaaaaatttgaggagggggtcggttccgctgagaagcgcgtttgtcatttttgatacccccacccactatttcatttgttattattctgcgactaaccaaccgcgatgttttgccgcttctgcttcccgttcctgatagataccctgtttgcgtttcgctttggtgatagggtctgtctgtacggtcttgcggttatggcagggctggcataacgattgatgattgaattcaggccagaacaacacatcagcttcaccctgtatcgggataatgtgatccacaatcgttgcagaggcatagatatcttgctgtaggcagtggacacacaacggattggctttcaggtattgcagccgatagcgtccccatcggttactgtagcctcgttgggttcgggttccccgttgtttgtcctgctgccgtcgggcttcccgttggtgttgttcacagcggcctgacttcacccgttcacggcaattcggataactacagcgccttaaaggttgccacggcatctaatacactcccacatcacgatagacagaccacaatgatttaatggtgaaaggcacctctttaagctctgcatccactgccatctcccgattctcatacagcaaaccgatataaagcagacagcccaccttaatagcaggggtaaaagccaatccgttatcaaaccgcttgccaatatgttgctggcagacttccagcgcggcttcggcatagcccattaacaaggcatcatcaagcgtgtcgctttcatccagccggcaatgctgtttgatttcatttaaagggatttcaaccattagaaaacaccgcctttacaaagcaactctaagcgggtgtatttcgcatcagggataaccgccacaatgtcaaaagcagttcctctggtgttagccccgttatagagaatgatattggcggtggtcacgtcatcacggtaacgcatccagatacgcacagtggcctcagagaacacggcaccggatgccaaacgctcacgcccgctaatcgccctcacttctgcccagacggtggcggcatccacccacttgtcaataacctgccctgacggggcgcgtgactgctcggatttctggatagtcacccgatgcctcaatctgcctgccctcattccttgccctccggttgtttcttgatttctaccgtttgcttccatgcctgactaaattcatccccccctgcacggggagagagtccctcacgttcacgggcttcattcgggcacatcacccccgacttaatcgccgtctcatagctttgaaagcgttctttcggattggcgcgaagcaagtcggcggtatcaaattccacttgataacgaatcccccgtttcggggatgccattagcaaggccgatttgatttgctgttcaaagttggcgagccacggacgcatggtaatggtcagaaaggcgcgggacgcttcactaaagttactgtaggtactgttcgagtactcttgcagaaagatcgggctgacgttgaacatacgggcgatatcgtcaatcgtgaagcgacgggaggccagccattccgcatcttgattactcatccccaattgctggtattccatcccgccttcaaggatcggcgttttccctgcattgcgagcgcccttgtaacgttcaagggcttccagtgccttattgcccttgatgccatccagccagtcagcggctttaatcacacccgctgccatcatgccctctttcataatgctggctccgtggcgttgttgtgccagccccaagcccaaggtttcgcggcaaatggtgacgggcgaacgtccaagaaaaccgtcttcggtggcatagcgcagatgcaagatttcttcctgtaaataggtttttaccttcccgctataaggttcggtgatggtgtacacgaaccggtgatccgataatcgttgagggacaaccgctgatggtgggtaagggtgcaacgattgtggctgaccatcccgtccccagacaatcaccgcataagcattgccatttaataagcaatgacgcatcagggttcgcttaaactgaaatggggtctggcagtcattcggacactcattcagcaaatagtcgacaggatgatcactgagccattcgcgggattctttgccgtgctggtgctgaacccgatagagatagcaaggcatggtcgccactgcttcactgatcaccgtaacggcattcattaccgcaggtaagccctccgccgtagacggtgaaacatgctcgcccgatttggtgttagacgcgcccgccagaaaaagaaactcatcaatgctcatgctgcgggtttccgtgtcttttcgcttaaaaggccacataatcacacctcggacagttgcagccagtaatggcgcaaatcaacatgattaggcttgacagcattcagggaacgtctggcaatctccaccccgctttcagggtaggcgggtaagctggtgacagtgatttcccgcagttctgcttctaaaacggttctgatatacggctcttgaccaatatcccactgatcttttagtgccctgaacccaaaggacataccggaaatatcaccccgctcaaccaaggtaagtacatcacgccccaactgcgtatcaggcggggttaactcgaagcgtagtccggtggtatcttcgctaagccgcaacgtacccgatgtggtacgacctaacaggttcatgtgatcatgttcataaagcgcccgaacatcggtattgtttgtcagactgttcgtaaacgcattcggggcgaattgttcaacaaattcatcccataaaacgtgggatcggctgttccacttcaccacgtagccgatgagctttttctcactggcagaaagggaagcggtacggatttcaaaatcgttattcattttatggactcccagacagtcaaggggctttcgcccctctcgcttatttcgtggcacttttcacttccagcaccttgattgcgttggagtccaccagaccgccgcccagatatttatcggtgtgtaccttataaaatcccggctcggtgatattgtcggggcgggtgcggatgcctgtttcatggtcaacaatgaaataaccgcgtttgaagtcacccagaccgatcacaccatcgggcataaattcgagataatggacaggtaagcccagcagcatatcgggatcacccgcttgtaagcgttcccgccagatataatctccattgccgtttttcagtttttgcacttgggcggcggtattggagttcatcacccagacggagtttttgcggtacttattcttaagtagaaacttaaggtcaatcaggttatcggcctcaagcgtggtagcttccagtttttgcaacgtgccaaaatcacgcaccttgtcgcttttcgtgtcgcggggataagccagaaagcctttggcttttttgctgccgtcaccgctgacaagatccgtttcttcggtatccacgaacgtatcggcaatctctgaggtcagccagcctaagatatccacatcgctaaaatcgatgatctcttgcgtggtcttggggtaagcgtagacagggaacagcttaatgctgacttcttccatctttggtgtggttgtctcgctgcgtgccttaccttcttcgccgtgtgccaccgccgcaccaccgaccgaaactaattgcttatattcgttgctgcgtgtggttttaatcgtacagatttgacgcatgactgactcaccggtaagttgctgcatgatctgtttgttcagttcggagataacggtatagccgccctctgacggaacgcccgtggataaggtgcgggtttctccggtcagaatataatggcggaattcatcattgctgaggttatcgcgggttggttgggttttacctgcctgactacgctcatcatcggcaagggtttcataacgggcaatttccgcattcagggaatcggactggctgcgcagttcgtcaaactgtttggcttcatcattggttagtgagcgtttttcatctccagctttagtgagaagggaacgcatttgatttgttaggatagatttttgctggcgtaattcgagtagttttttcatggtgtttttaatcaatttattttcaataaaagatatttaacaacataaaaaataataaaaaagccctcataagatgagggcgaaacatatgaaagcatgaatacaaaaaaattacattattttacttaatgcgtttcattatattctttaatgagtttttttattttactataactaaaatagtttggaattcccgagctaaaaaaagccaaaaataatataaatattataaagtaagaaaagaaaaataaagataatttaacaccaccatccacagcacctaaataagcaactatagacagtgatcctaatgctcctacaaataacagcaatattatttggaatactgttactatccataccctgactaaattagacagactgattttctccactagtcttgaatccttcacaggaaataaagaataagctctcttatataattccatagggatgtttttatttttatgaaagagaattaactttgcccaaatattttgagcatcaacgctaagattacattttaaataaaaggagtttataatcctaatttcttcattttttgccaatgcccttatatcttctgatattctctcgttatttgatatccttcgaagagactttatttttctgaacaaatttttctctggattgaaaagaacaaataccttatacagtaaggttgtatgtacatttacaatggtaaaaacaaaaagtaaaaacatgaaaatgaataataaaaaccctatccatccatgattaattattagctcctcacttttaactaaatccataatcaacccttattattaatttatgagttattcttaatcttttaatacctgaccaactttagataacatccccctcacaatgctgccatgaataagagatacaggtatcatatacactttcccaaaaaaattatgcgttatcacagatgcggtcacagtagctatacaaccgtctttatgattatcatcagagaaaatattcagagatatcagcaccgtcaaatgtatgtccttagacaatagacatatttcatcatcactgatacgtacaatcttaaaaaaatcgatatagcttccagcgtgaagttctttatttaaattctcatctgagaatccatgaattttttctacaccagcaagacttgatattttatctcttattgcaaaagacaggcgtaaccataatggtgttttttgtgtcatttgattataaacatcaagggcagtcattttgttttcaataaaaattttctgctgactataataacttagattatcttttttatctaaaagcaaaacaccgaatttatcacgatagtacatgtttcaccataatattatttactaaaaaatagtttccatagcactaatcaatattactaattaggtatgtcatatgatctgagcagccatcagtttgtatctttattatacttctatatccctatatcatcattcatatataactacatagattttcacgggataacgggatatatagatatttttgtatttatttcaaatggttatcctaccccattttatcccacttatcccgtagcacagaaatactatttttaactctttaatattcaattaattatagcctatcaaaaaaatctttttcgggataactaaattatcagaatacaacattatctatcttcacatcacattacgggatgaaatgggataatacgggataattcaaaaaaacataacttactgattatagataattaaatgttttttatcccgttaccccgttatcccaatgtttttcatcttacatgagcctcaatcttcatccttgaaaatcaaaaccacaaaccgcccctgagtgccattcactgaaatggttttactgataaagcgatctttctccattttaatcaacattccggcttcttccagagcctcaaagcctgatttcttctgtaatccctgcaagatttcttcttcaaatacactggggataatgtgatattccacctgtccatcaccacggcgattatgtaccagatagcccgcgagattgttgattctcatggcgttagcggtgtctatattcccattcagttttccataggtataaggctgaaaacgcgatagaccgtatttctggataaaatcacgggcacgggtgacaacctgatatttttcacggttcccgataccaaaatcttctaaccagtcatcaaaactttgctttatcgcagtgtggcaatcttccttgctccagcctgtgatatgtgtcgccagttctccggcggcatccagtaaagcaaaacgcacagcaacgcgttttacttgtgccgaggcttcttctggcaggctatccagccactctttttctttacaggtcacggtttctattgcccgttcctgattttcagacagccacaagatccacgcccgacccaccgccccacagtagcgttttgattcacgcttgattgcccttgcgtgtgcatctccgtcctcataaccattgaaaaactcagtgtcgacaaagggtacacttaacaacctgactaactgccctgcctttggcgtgatcccgccttttatcaggaaggtttctaaatcttcctcacccgtcgaaagggcggctatcttccagcgaataacggcacggtttccaccttcccgtttcccctgaatttttccaacgccgttaaacaaactgtaggcactgttagcgacttctttcggattggcgctttgcccaatttcatcaatgggtaaaaaaccatcatttcgggctgccgcttcattatttaagccgtgatgggtgccatgccacgatagtttaagttcttcgggatcaccgtataagctactggctgcctcaacggtggttgttttacctgctgaggactgagcgaataagtgcacgccaaaacagttaccacctgttagcgagttcagcggcgcagctaaccccaccagcacccccagcatcattgaacgattacctttcattaatgaagcaacgtgggttgtccagtcttcggctgtccccctgacgacataacctgcaatagctgatgtgccaccacaaaacgccacaggcatataaggctgaccgatgatttcaccatccggcatgacatatgccccacaatgccagcctgccgtctgtgtgacttcccacttgcggcggtctccgctgcgctgtaagtgatcggctaaaatcggtaataaactgtttttggttgtgatattaatcccccgtgaacgcagtcgcgcccagcccataggcataccaatttcacggcggggcatggcctcaaaggtatgtttgcctgtgccttcctgagataacttaataatgagataaccttctccgccatcactgccaataccgaccacttccatgtaatcactcagccatttttcaatttcaatgatttcaccgttctgttccttgggttcaacccaataaataccgttctttcgtgtatcaacatgtggctttaatggatcgcgttctttctctcgatgttcacctaaattaatcacaactgactttgacactgacacttttttcccaacctgatacaaaccttcactaaatgcttgctttgctgccttgatgccgtaacgctggcggtaatcatcccaatcggctttatcttccgttggcggcaacgtgacccatccatcaacagattgagcggctttttcagcggcaatcttgccaacgttcttttttagtttaccgtttttgtcccgttctccctgcacgtgacaatcattatctgcggcaaggataatttttgcgtctggccactgcgctctgaccagctcggcaactgtgagtaaattactttcatcaatcgcagccaataccacgccctcatgtaactgattgacagttagcgccgttgcatacccctcgctaatgatgaaagtatcgggcgttccggtgatctctgaaacgggaataaaactgcctttcttctgtgttccagagacaaggcgtttttcaccgttcggcttgatggtctgtccgcctgtgatcgtgccgtccagcgtctgaaccaccagcaataaagagccatctttcaataatcgctgattggggcattgcagcccctttttcaccagatattgagattcgccagtaatagctgtagcgagcattgttgtgatgcgttcagcaataggtttcactggtcggggctgttctttagcgggcttgggttcaggcaaaggaagtgccagcacacccgccacgagtttcgccgctgcaaagattgtgatccctttggttcgcgccaccaaatccagaccatcaccgtgattctgctcatcacactggcgacaatgccagtcaccgttattgttatcgtcaataaagtgaaagcgatcagtacctccacatatcgggcaagcgccgtgtttgccctttaagggaacatcaacgccacaggcgggcaacaagagttgccagtgagtgactgcggattgcttcactgcacggataacatctaacgggcggcttttctgattattatttccctgattcacgattactcgtcctcgccatgaaccaccgcataaagcgagtagtaagcttcctgattgatatcacaggccagagaaagcaaatcatgtaactcttctgaacaatgttggctggcctgctcaagaatgacttcgtataaagaagtgcataaacccgcacgaaacgcggcctgatctaatgagccggattgcctatgtatcacggaatttaataatttattcgcaagaggctgcggggcatgtttcaacagagcgcggtgaacttcctgattgatatcgcacgccagtgcaatcaggttatttaagttggtttcgcactcgtcgttcgcttttttgataatgaacgtgaaaagtgaagtgctcaaacctacgcgatacagtgcctgctttagtgagataggtttattgctcatggtgtgcctcctgacgtgatacgaagatcagcgagaacataccagccagccgctgagtgccggatgcaattaggaatgtaaattttaggcgagtttggttagactgtgtgtcagccatgatcgttacctcgattaacggtttggttagatgcctcgtcagtgttccaccactacggggcattgcttttttatgacgctcatctttataatggttcgcaccactgtttaataaattaacataatggttcgaaccgatgcaagatgaaaaaagcaaaaaaccatatgaacgaaataacagcacacgtcgaacaattcgctttgaagacgatctgcttgagcaaattgaagagatcgctgataaaggtaatttcagttcatgggttaaagatgcttgccgcgaaaaactcctgactttaggaataaagcctaaaatctgaaccaaccagtaataactgtgattgttaactaaccctcttaaagagggttgtttatcaaattgataattgcttaatctcaaagaatctctatagctatttaccatcacactacctattccccaaaatcaaactatttttagagtgagtttgaccgctgccaatcaaggcagtaattttttccatgatgttattagttagcaggtttacggctatatgggttatttacattgtctacagtgggcggattacgtacccagtgcagcagatcactgagcaaccaagcacaggaattgcggcctaatggcttacgggcagggaaacggccttcattttccagtttccatgctgacgttctggaaatagaggtaatgtgctggcgttccttttcacgtataagacgatcataaggttcgccatactcagaaaggattgagcggcgttcttcaggtgtaggagtactgtattgaatggtcatgttaccctcactgtttaattgtttttgtgagggtattttacttaaatgaaatcattacaaaagaaagcaacattgttgcgtgtctatcacaattatcctgcttatcatcaaatcaattaaaccctattattgaactgcctttaatataaccacattctcataattacccgccaatacatccagtctctcgcaccatttgtttaaagcatctagcttctctggtaggtattggctccggttataaaccgctagcacaccacctaaagtatgccctaacagcaattcaacaatgtgtggagcgattcccgcatcacttagcatggttgcaaatgtacgccttaagtcatgaagaacccatttttcattatgttttaatctttcccatactctgttcccagttgaactaacagccgtattttctttatattctcctaataaatattcagaatgtttattttgggattttaatctatgtatcttcgttaccatagcatcggggataggtcttactattttctctctcgttttactgttaatttcaggaacaatccataacctttgctctaaatcccactcattcattttagaacgacgaacttcgacagttctggcaccaaacacaattaataaataaaaaagatctgaataataaggaataaaaaaatcactatgtaccgctctaactacatcagataattctttttcagttaaaactttttttcgcttatttaattttacgcctatatcctgctttgtaataccttccaaaacatgggaaacagcaaaacgtctgattcggcaaaatttaagagcctgctgtgacatttgcaaaagcattcctgccacactgggagctacctttttcacttggtcaaaacgcctaagccaataacgggtatcacaatcagaaagagccatatctccaatataagggaacaggtgtttattaaaacgttctctgtatctattggcattcactaaattattatcaacatattcagttaaccaatattcgatagcatcctgaacagtgactggttttaatgtttcttctctatccagctttatcattcgttggggatctttgccatcggctaaccatgttcggcattgagtgcgcatctctctggctttagctaaagacagatcagggtatcgcccaagggtaagtaaatttgcttccgtgctccttccacctagtcgatacttataaatccaagttatagaacctgctttcgtgatgcgaatcatcaacccagcaccatcagatacttttctcaccttatcagcgcgagcacccagtaacgatttgagtttcttatctgataatcgatttattccagtagtcatttggctctctaactcaagatatttgttaccccaccgattaccccacagtgtgatgtaaaagtaagaaaacgtcaataaacactggaacaatatacagtataaaatataatctaaggaattgatatttaagataattaaatgcaaataagataacgtcagaacaccaaacttcattggtgacgataacttagcattcgatttttaaaccccagtacagaatattgataacttgtctgatgtcttatcagacaattgaggaggcattatagccccattcttgccaaaaaagataaaagcctccatttccctcctatcagttgtagcctcagttgaattttcaggatcaaatcaagatctgtgtataaaattttggataggtccctagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaaaataactccaggaatgattcatgatgtcgaaaactatgatcttatctgcattgatcgttttcagtatgaatgttgcctatgcaagccaagagaagacgggatgtgaaataaagaaaaaaacattgaagaaacaacttgaatacgcacaggcagatggagataaacgcctgattgcaggattgacgcgcactttagaaagtataaaggccacttgtgaactggaaaaacgcttaaaatatcaacagcacaacccagaaccgacaaaagacagacttaaaaaaatgcagaccaagaataaatagcagacctgcaccagaacacctatcaaccaatagctagggataactacaagcttcttcccctgacttgctgtgcattagaaggggagattttgtaataaactttatcgcccataaatggcttattttcaatttccaccgaaaggatcgagttatctctggaaatcgcataatagataaaattatttccttttacatcataaggataattaaaatcaggtttaagaaattttttctcgtaagactctgcatgggggtaatattcatccgaataaatcaccttctgatttttaacaaaaataattttataaaaaagactggctttccccgtaaatgccgcaccgatgatatattcaatatcctcacgacccatccctttattgatgatatacattttatcccaatcaaaagacgtgattttattcatatcgatcaaacaggtcgtattcttctgacaatgtttatcaacataaccaataagactcaacttactgttattgaaagataaaaatacaatggcaattcccaatattaacgcaaatacgataataatattcttgttggcgacatggacaaacatcattcccccttcataatcaaatttgatatgagaaaacggtttttggaattttacccttggcaatcaaatcattactattaaagctataacatcggtcttatcactattgctcatgttgtgatattaataaacccaatttaaaagagtccccctctgctttcaatcagcagcctgatcttttggagtttacaatatgccatgaggatatatcttgatttgtggataaattgccacatcacttacaagcaactgttttacaattgctatttgatcttttaagtgcagtttacaagataaaaaaattcaacctctctttattcttcctgcatttaaagaacgctatcatcggtgctctatacagcgaaaaagtatagtaattgtactagcaatttcttttgttacaaataggaaaatatggtaagcaaataataaatgaaataaatcaccgctaatgtgaaagggtgatagtttgagagggatcagaagacttaatttgttatgggagaaatgcgggataaatagaaaaaacggatagaaatactggctatttatacatgccagtatggtttttacgtatgttcttatctgaaaaaatggttatcttctggcgatgaacgttcatctttcatttgttgttcatttgtgggagaaacccagggcacgagcatacttttttaacagctattgaataagaagtaatgacatgatctaattaaccttatttctcttctaatcgctcccctatgaccctaattgaacatttatctgttgttaaagaaacgcgctctgatatcaatcgtcagtatgatatgattgatgtgatcttccttgtcgtcagcgccattatggcctgtctttcctacacaaatattttaacccgcccccttcgttattgaacttttacctcatagattgatcccaataaaaaacacgacttgaggtaatctttatgttttcaacctgcgccgaacaatgggcaagtgacacgtttcaacacgcggaattaggtgataaacgccgtaccaaccgcctggtgaaagtggcctgttcgttggctaaccatataggacaatcgctcgtgcaagctcttgactctcctgccgatgttgaagcggcctaccgactgacccgaaattccgccattgcgcctcaggccatcgccgaagccggatttaccgccaccgtcgctcacgctcaacgttatcattgcctgttagcgctggaagacacgacaaccctgtcattttcccatgcgtcggtcgccgatgaactcggttataccacctcgaagaaaaaatcccggggcatgcaggcacactcggtgttgttatttgcacctgaagaacaacaggtcgtggggttgatagagcaacagcgctggtgccgagatgtcagtgattatggcaaaagccgataacgcgacacacgcccttatgaagggaaagagagttataagtgggaacgggcctcacaaaccgccgacagccggttaggggagcagatggccaacgtgatttctgtctgtgaccgtgaagccgatatcatcgaatatctgcgttataaaacgagccaaaaacaacgtttcgttatccgttcgatgcaaagccggcgtattgaggaaagtcaggatagactttatggctttatcagccagttacagagtgctggagcacggttagttcaggtcagacagaaaggcgggcgtcaggcgcgtgtcgcggattgtgatatcagttatgccgaagtgacgttgaaaatccccgaaggaaaaagcggtgaagcggtgcggatattttatgtcggttgctacgaaaaaggtacggaggatgggctttgctggcatcttctgacctccgaacccgtcaacagtcaggaagaggcccataaaatattcagttattacgagcgccgctggctgatagaagaatttcacaaagcatggaaaacgggcgacacgcaggtagaagcgctgcgtatgcaaagcaaagataatctggagcgcatgatagtgctgctggcctttattgcggtacggatacaccagctccgttttatgggtctgaacaaagaagaggcagagaaagagagcggtgagacagtattaagccccctggcgtggaaattactgtggtcaaaacaagaaaaacggcgtccgccgaaaaaagccccgagtttgcattgggccttcatcaatctgggaaaactggccggctggtacgattccaaacgcatgggtcgagtcggatgggaacgactttgggaaggttggtttcggctgcaaaccctgatagacggctatttgctggctaaatcggttgatttggagatctgatcaagagacaggccgtgcccccgccgccgcccaataactggctggctttctgcagggccttgctggccgcccgttcaaccagtccctgcccgcccgacgtgatcgggccggcaatcccctgaaccggcagacgtggggtgttggcgccccctaatccccccaacatgcccgccgtcaggggtgacggtggactcatggtgtgtggtctgtttctcggtctgtttttcagccggattttcggtcgcctgacgcaaccggtcatagcggccgagcagggcgttaaagcggtcatcaatgcctttcagcagtaccggcggcaccgcttccccgctcgccacccgggcgttgagctggcgcagcagttcttccagcggcacttcgctgccgtggctgcgctggaggtcatagaccgcagttttcaggtacgagagcgtgaagctgccccgggtacgctcctgcaacaggattttgtcggccagctgctggagctggtcgcgggtggtatgccagctgcctttcagcgggatactctcgatacgggcggtcatcgcctgtgtccactggcgggtggcgctccgctgctcggccgaatccggccattgtttttccgcggtgtcagtcagcgtgcgggccgcgtcccacgtcgccagcaggggcgtctcggccagccggtccagctggcgctggtagcccgccagttcggactggtacagccacgccagccgggcgcccgcggggtgagccgtgatagccgtgagctgctggtgcagcggttggtagaacagcagcccgctgcccaccaggaccaacacgcccaataatgccccgaggccaaagccctgccacgcactccaaccccgcggcggctcaggaaactgcacccgtacccgcgggctgtccgcttccggcgggcggtcagggcgcggcggcgcggacggcggcggcatttccggctcggtgtcggactgggacaggtagaccagcggcggcatctgcaccggcgtctgagccggtttcgcggccggccgcggtttttccagttttttcgccgcgttctggaagaaccacagcaggttctccacccgcggcagccgtttcaggtcggactgctgcaaccggtcgataatcagctgcaacgcccgctccgcccggtaaatcatccgcaggtcgccggtgccgaaatccatctggcgcagctggctgccggtgcgggtgtggaaccattccagtaaatccgtgcgcaccgccggctgcggcggccacagggcgtcccactcactgactatcaccccggccagcagttcacagccttcggtaaagcccgccagcccgttcagctgcatccgcgccagcgtgtagtaaatcgccgtctgcaaatcgaccccgttacggcggaacagggtcagtgacagcgattccaccagcacccaattgacttccggctgggccgggtggctgattttgttgatttcgtcgcggataaccgcaaattccggcagattctgcgggctgccgcccgcccggatgattaaattctcagggtgttcgctcatgctctggctttccttaaaaaaccccccgcccggaggcaggggggatggttcttgctgaatactgactcacacccggcttcagtagagggtgtccggcagtctgaactggctgaacaggccgcccgcaaacgggttgtccgattcgtccatgtaaatgcggtaggttatctcgccgccgtccaccgcgaagcgcacgtcaaacgcccccggctgcacgttggtcagcttgccgctgttaatcagccgcagctgcgcccacgggccggtgaagctcaggctgcgcggggccgcgttactccggtccggcatcagggtcagccggctttccgtgcccgcccgcatcgagttcggccacaccaggtgcgccacgttgctgcgcccgtgcgcgtaatccaccagctggccgtcgaggttcagcaggccgcggcgtttgttgccggtcaggctcaccggctcgatggcaaacgccgtgcccagcccgttctgcggggtgaagaaggtggtgcggatacggtccgccaccgccagctgtttcagcacgtccggccggataagctcgcgcccgtcagtcccggtggtcaggttgttttccacgaacggtttcaggctctgcttatagaaggtatccagtgtcccgtccggccggaagaaacggtcaaactcactcagcggcacgtcttcggtggccgccgggttgaacggataccggccggccaggtaggtctggtactgcttgaccaccgtctcgttccattccacttccagcgaacggaccgcttccatcatcaccacccgccacgcctgctcggccaggtcaccgacccagcggttcagcggctccggcaggtttttcgccatctgctgcacttcaaatatcgcgtcgctgttgttctggtccagccgcagctgcaccgcctgcagcgccgccttgcccggcaccggcgagttctggatagccagcaggtaacggtgcagcgccatcagtttctggtaaacgctctgcagggcactgcccttgtcgccgtgctcaaccagtaccccggtttccggcgcaaagtcccggctgatgcggtttaacagccggtaatccgactgcgccagcagcgcctgtttttccttgtcactcagggcgccgcccaactccggcggccgggtgttgtcactgaggatttgcagcgcgcgcttgatcggctgttccccgctgatcacctgctcgatggcgctgatggcctgcggcagatcctcaaagtcccgcacttccaggttgttcatcgccgcccgccagtgggcggtgtagtccccgacgtacagttcggtgatctcacgctggatattcccctgatcggtgtcgctgtacttgttggttttcagcggcaggttcagcacccagctgtccatctcggtcagctccaccagctccttgtcctgccggacaaagtaatccgtcaggccgtggcgggtcaggaactgcgggatcaccagccggctgtcattgccggcaataaacacgctgtcaaaactcggcccaatttggtcacgcaggttaaccggggcggacagggtatcctgggccttgaggcgcaggttctggtaaacccgctggttgatggtcagcgcactcagctcctgctgggcctgtttcatcggcttaataaacggcgcaaagcgggcgagggcgtcctgattgtccctgtcgcgctgccccttccagtcggtatgggccagggcgtaatccaggtgggtcagcaactgcgcctgtaaatcccgctggccgtggaacgccttgctccagcgcgcgcgcatgtactgcccgaccaggccgttgttgcgcttgctgccgtcttccatcatgcgcatcacccgcaggatctcgagtttctcctcactgcccgccggtgcccggttcaggtcgtccagcagcccctgcatcagcgacggcaggaaacgctgctccagcagtttcaggtaggtgccttccacatacggcccgaccccgtccccctgatacagcgccatgtcggtcaggaaggattttttctcatggtagttaccgtacgccagggtcgcatcccggatcgggttcagcagcggcagctggaggtggccgtaacggtcatccccgtccggcggcggcacggacaggaagtttttcgcctgcgccagcacctcttccccggcctggtagtttttctggtagaagtaatgccagccgccccacatggccacgatcaccagggcgctgaccgtggagaaggtgtacagctggcgcaggcggcactgcatgacatggcaataaatgccgaacatgttgccattgtgaagaaattggcgggtattttcggtaaaaaagggaaattatggcgtgatttaacaggttctttgaaattggatgtatatccagtatttattttgcgagtggcttcgcaaaggtcaattttgatgatggaaagttgcgcagggtggcgataaggtaggcaatgaaatctgaacgcggctttatcgtgtctcaccacggtaaagccgctaaccgcaacaactaacaggaatagttattatggctaacacgcattctagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaatgcaggtacctgcatttacaaaatttcccagccagaacggtatcagaaagtcgtttaccgccccaaaggactcaaccgcaccactcctgccattaatttaagcggaaactggctcagtgaagccgggttttctgtcaatgatccgttaaaaatcagggtgatgccgggctgtttgatcatcaccgcccaaaatttccctgaactctggcattgcttaaaaagcctgaatgaaggtcaatgggatgatatcgctgttgccgactggctgcggcaatttcccggcaaactgaataaaacagggctgagaaaaaacacctaacaatctgttttatcaaaataaaataaacattccgaacacaaagaatgaacggctttccagcgattgatagcaatattttcattttgggaagcggttcgcatttatgtgaataaaaacaaccttaaatcaacaaggaacgtcgccatgagtcttcaactttcattacagatggcagaactgccggaatgcgtgatcacaggcagcgcattgaggcagattggctttaccaccgatgcactgtttcgaattgcgcaatttgccaatggcttgatcctctcactgattgagccagaaaccgagccggatctcgccgccctgctccacgaaaccgaatttgaaccacatcaggggattgactgggtacgcgacaatggcgaactttatttggcgggcgactggttgactgaaagtggtttgttggatcatcctgttaccgttgaaacggcgtatggcacgattgtaataagagccgaactaccgattttgctggcctgaaaaaatcaataaaaataaaccggaatgctgacatggaattccggtttattttatttttagattgtattataaaaatgttattgttgctctgccctttcaacaaaatcattcagcgagcgagaaaattccctgatactgtctgtttttagtttttctgtagatgtactatcaccatagccagatgtatttatatcgaaattgaatctttgaaacgtgacagagaaaataccgttaatccttccccctggactatactcatcgccttcataacgagcgtcaaaataatatcccgttttcttgtgaaaaccaataagacgatcaaaatattgacacaattcaatcgctattgaagagtcatcagaataataaggccggtcataagataaaataaaccagcccgactgtagttttaattcaggtaagttcacgtgtgataaaaaaatattattatttcctttcacttcttttgaaaatattgtacttactatcagaaattacgttcaattataagaatatggtttaataaatgttacacttattatatgaattcaggttgcatttattatgtgaatccgcgtatctttatatcaaaataaccactttctattaattataaaataagatgattcttaaatatattactacatttaaagaacatcaatctttattatgaatatgatatttatcattaaaataaactggaataacaaaataaattttaagtttattttacaggtggattattaaaacattattaactctcttctctttcaataaactcattaattatacaaataaattcaattaggcagtctatttttttgttttctgttaatacgaattccccatatcaaaaactatttttatagtaatttattttttcaacgttacagtaaaaacacctttaatgtctctatataaatcaccaaaaatatctccttcatagtaggcttaaaaataaaaccctgttttattttaataaccaatgaagcgttcaaaggaataactcaaatcaatagttaccggcccatcttaagaataatgtggctgattataaaacaaaccaatccggctggaattttacttcgggtaaaaatagtggtggaaatatcatattattttttcctgtcactattttataaacattggatttactatataaaaccgtgttcaataataaactttctatatcgtttagtgagtgttacgcttatcagtaaaaatccgcacgcattaattcattcaaaataacaattatataataaatgatagtttcttgacacattatcgatatattcagagagacctaatgcaaaaaatgtttttttatctacatgaaaaccaatattaactattagagacaatattttcacaaacatatcatcatcattttttaagtattcttttaacaagagaaaatcagttgggtgatattttaaaacaaagaaagaataattcataattatcatatgagagatgagtaactcacgagaggattgagaatcacgtacacaatctttaagcacattaaatattattgctttattagttcgataaatttctaaaaaacatttcccttcaacatattttacgttagtaacattaaaatcataggattcatttttaccccatataaaatcaatgcactaatgtaacattggatttataaaatcaagcatttcctgaaggtatttaggtagagaaaatgctctaatcatatcacaaaatcggtcaattaaatcatggatatgataagctactccgctttcggccgtatataataactcaccatttcttatggataatctcttgtaagccagatcccagacccacacctctgcaaataatcttcccaagaaaaaaatgcgtgttttatcgttacttttgtaatgagatgcttgatattgataatagaattttgataattcctttcgataaaaacacgcttccttgttaatatcaaaaataaaaaacattatatttattatcaaattgacattgtaataatctatatttgcaaatccaaaaatatttttatcttttataaattcgtctggaatatggttccaatattcaataggcatatattcgctgaaaagataatcccaagaagttaccttaagaaaatcaccatagcacccacgcttaaagcataattctctatttttactctcatctcttctcggcctttttctatcagatttataaagcaaaaattgattatcaaaaggcaaagtgctttcgttaaaaaatgattccgttttatatttgtaaattgacagcaaaacacgctccatctcttattattctagtacgtaatgacaaattttggagatacaatatttgtgaaaataaaaaacaaacctcataaattcgaatgaggtttgtttacaatatacactttaattatttatcgatcaaaaaatcgcttttctctactttttctaagtgttcttctaaatttaacccatcaaatgaatcttcccacacataaaaattaatatctattgccaatgataataatttaatgaaagttttttcactatcacttaagaaagattttaattgtagtatttcatcagggctatttttaagtataaaacaagaataattcataacaataacatgagagacaaataattcttgaaaagattgaccatcacgcacacaacctttaattgcattgaaaatttcttcttgattatttcggtaagtttctaaaaaataacttccatcaatgtattttaggttaacatcatcaaaattaaaatcgtagactccattcttacccaatataatatcaatacattcatgtaacattggattgataaaatccaacatatccaaaaggtgatctggtagtgaaaaaactcgaataatatcacatagccgatcaatcaactcatggatattatagtcagctccactttctgacttaaatattaaatttccattttttatggataacttatcataggcaagattccaaatccacatttcaccaaataatcttttcaggaagaaaagacgtatattattgtctccttcgtaatgtgataattgatattggcaataaaatttcgtcaattcctttctataaaaaggaacttccctatgaatatcaaaaatgaaaaacatattattaaggatcaagttaaccccagaataatccatatgaacaaaatcaggaattcctatgttttttataaattcatctgggatatgattccaatattcttcgggtatatattctctaaagagatactcccaaaatcttacctgaagatattctccattatattcttttttaaaaaataaattttcattattaatttgatcttcgtcatgagttctataacataaaaattgatcatctaaaggtggcattttttcgttaaaaaatgactctactttatatttgtaaattgaaaaaagcatggcttacctccccttttttttgcctttacattcaataatcggttttggttcactatatttttttgttttacctattcttgtttcatattgagcactgataatttccttgttgaagtctttcaatacgtttacgcctattccacgagcacctttctcgttacctttataaaacactttatctggagcacctgcttcaccatcatcgaatttccaaaagtctaaggctagattcctatttgacatatccaacatcctaaatcccttttccgttactgtatatgtcaccctgtgtatgttcttttgttcattagggttaaccgtcccatatccatgttgttcagcaggtacattaatccaacgagccacacgcggactgtcataatgcaacacaattttcccgcccgcctttttaatattttctaattcttctgggctaacgtgccgcacaattttatacgtctcctctttgactttaggtacttcaggggctggccttctcggatcttccttcggttttttcttcgccaagcccagcgggtcaataaacccggtcggattcggtacataaccgtaggtattttccccgccctgaatgcctatcggatcgggcgtcaggtaacagcccgccagcggcgagtaataccggaaccgattatagaagagcccgctttcttcatccagccattgtccggcaaatttcagccccggatcaaactcggcattttcacccgcagcgcccagtcgcaggccatacagtgaatacgccggctggcgccagacacggtgaccggccgtatcaaacaacgccagcggttcgcccgtcggggcacagaccgcatagtgcgtccggatgtcgccagcaatgagttcacggcggttttccgggttcggggtgaaaaactgcacctgctgcgccagtaactgccagccgtcaaacaccagatggcggaggctgtacaggcggtcgtggcggtattcacggatttccgccggcgtactgccatcccacaggtaggtagtccgcatgccggtctgtgcacagtctttctctatccgccgcccgaacgcatcgtagcggtaggcccactgctgcccgcccggggtcagcacatgggtcagctggttctggctgttccagcggaatttcgtcagttgcgggcggtggccttcctgccattgctgcatcgccgtcatccgccccgcatcatcatactcaaacagatgcgggcctacacgtctcagccggtgccctttctggtagagccattccccgtcaatctcattgaggccatcaaaacggcgggatgggtaaccggcggcatcgtactggtagtgttcccgcaagcggtcgccgtcactgaccgacgtgacctggccgttgccgttgactacataacgcagccattgccgctcatcattcgccgccaccagattgagcgccgcatcgtagcggtattctttatccagcccggccagggtgggctggggaatatctgccacttcatcggcggtaaaaatctcggtgttgcgcccggcacgctgcgcagtcagctgccccatcagggaatactcctggcgcagaataaaacccttgtttgactggcggtgccattcctgcccctcggcatcccgggagcgcgtcaggcattcctccccgccgaggatcagcacattcacttcccccgcgttattgaccgccgcctgcatgtgccattgttgcccgtcggtcaggactgtccggctgacactctggttctccgggtagtcacggcggatttccccgttctgctgaatttccctgaccagccgatcctgttcatcgtattcatacgtgataggggcgctgccaggcgcggccacggccagcagatgtcccagcacgtcataacggtaggtggtggtgccttccggcgtgtgcatcgccgtcatccgctgggcggcgtcatattcaaagcgggtcacctgccccagtgcatcccgcatttcaatgcagttgctgttgccatcataggcataatgccactgtgtccccgcgtaatcggtttcggtcacgacccggccatcggcatccagctgatagcggtaactttccccctgcgggttaaccacggccaccagttgcaggcagtcaacgtcatagcggtactgccagcgattcccttcgccatccacccgggctaccggcaggtcaaacgggccgtattcaatgtgccagaccaccccgcgggcgtcagtccattcggtcaggttaccctgacggtcatggcggaaacgctcaaggctgttattgggccggtcgcttaaggccacattatgatggcggtcatattcccaacgccagcgggccccgcccaccgtggttaactgctgaacgcgatcctgactgtcgtagccccattgcaggctgcgcttgtcttcatcaaacagcgacgttaaccggtgatggcggtcatattccagcgtccgcgtgctgccatcactctcctctacggtcgtcaccaacccaaattcattgcggatcagggtggttttatcgccgttcggggcaataaagcattccggcgccccgttatcgtcgtactgctgtgcccagcaacggccgcgtgggtcggtgacgctgatcagacggtcatggtcgtcatagtcatactgccaggtcagatccatcgcattggtaaacgcggtgaccagccccgtatcggccagatagtccagcgtgacaacctgcccttccggcgaaatttcccggcacaaattcccccatgcatcgtattcataacgggccacccggccgcacggggtttccagctgtgtcacctgctgctggtcattatggtgccaggtggtggtatgcccctgagggttactcgcccgggtgaggcccggttcataatcaaagtgaaccggatagtatcccccgctggccaccgtatcggtacaacgcccctgggcatcataggtgtaatccaccacggtctggctgccgtctgaccagcggctaatcaggccctgtgcgttatagtcataaaacagatgaaaatgctgacgactgtccgcctcggccagccagccgttgtcgtggtaacggtaatgcgtcatcacgtcattcagatcgctgtcggtacggcgaatttcttccagcagcccatcggcacggtacagaagcaccagcgccggaccatcgctgtgcgtcaccctgaccagctgatgctgttcgctgtaatggaacccgatgacattattgtaatgatcgcgcaaagcgcccaataaccaccgctggctcccgtcatttgccggcacgggcacgctgaaatgctggctgaccggattattgcgttcatgcaggagataccccgcctccgcccggctcagagtaaattcagggtgctccgggttcatgctgctccggtctgacggggtcaggataaagtagagcgaagccccttcggtggtacggatctcgacccggtcgccgatgacaatggcacggcctgaaaacgtatctgtccagttttcacccagcaatccccgctcgccgggtgaccagctgcgcataaacgtcaggggcagtgtttgtcccaactcaatctcggtatgctgggcaaacacggccccggtggtgacatcaatcgggtcagatttgaagaaacgcttggccgcttcccagtaacgtttcgcccctttcgtttcgtggaaggcacgcttggcacaaccgacccggttggaacagcctgtttttgcattgggaaccgactggcgtgctttcgctgcccccattcgggcaccattcattaccctgccgggagccgtcctgacattgccggcgatccgcttcacctcggctttcgtgtaggccgccgcttttttcgcccccgatttcgccccagccgccaacgcgctggccgccgctttcgggtcttttaccgcattttttgcccgctttccggctgcccgggcaccggctttagcgctggccagcaacgcattgccttctttccgcgcaagcttgagcagggcctgacggccttgttgggtcaacagcttacccgcgattttcagcccgccccgcgtggggggaaccaaaaattccaccgcgaccagcaccgcccgctccagcagagaaaattcttcctgcacttcaaggtagtcatgcttacccgagccgataaataccgtaccggcgccgcctttaatcgccgcgccacacaccagtttgtcatccacccgggcggcggcgtggccgttgataaacaccgtttcactgccctgggcgatcaggggtggggtcgggtgtttactgcatttcgctttgtccgcttctgcccgggccgcggctttgccctctatcttcacattcgatgaaccgctgtctaccgccccatccggtgaccccaggctgttcaccatattcgttactgaggcggtcacattactaatcacgcctcccagctcgtgtacagcatacgcacccagtgcaaaggctgctaccgaggccagcccgcccgtgccgatcaccaacgccgcaacggcaacggtggcagcaacggccgctgccgccactagagcacccgccaccacccccgccagcgcggccagaaagctggtgtgctggataggatcaccttcacgggccgctgcggggccgttcggcccctgaacccgccgccccgagtgcatggcacccacccgcgcggaacgtgtcacaatctcctgcattattcccatgactgacctcctgtcaggcggcatggaagctggtgatcacatccagcagcgcatggcgttgtccctcattaaacggctccggtgacgtcaggttaaacgccagtaactgactgccccggatttgcatcaccaccgtctggtgcatttccccctccgggctttgccactgataatccagccgccacgcgggttcaccactcagttcaatttgcagccgctgatgttcctgatagtccggcaggtgggtcacaaactgcgtcagggtttgggcataaaaagcttcggggtccgttcccagggggacggcgctgcggttaatcaccagattgaccccgctgtcatccggcaggacaaacacgtgcatcgattcatcacgccagttggccggaatagtcagggtgccttcgttcatctggtaagggtgtgcgctcatggtcgtttcctttttcactcgtttaagattgtcactgtattggtctgttcagcccgcgctcacgggcggttatcgggctgagatttttgttaccggccttgccgcgataacggtctgtttggttctttttcgcttagttcagggtgatctggctgccgttcacagaaacccccccgccattcaccgtaatgttggagccgccaaacgagataagaataccgtccgtcgtcatctgaatggtgccatcgccgaccgttaaggtgatggcatcctgcgcttcatacagttgcgtgcccggcacggtaccattcgcgttcgtcgtcaccgagaccgcattcgccgtggtgctgcgggcctggcagatgctctccgtcagattgccttccgtgactgtcttgaactcatcccctttctgaatggtcagggtacggttacccgcctcgactaccagactctgggcatctttcaccgtggtgtgcatgtccttctgcgcatgcagcgctaactgctcgctgcccttcgcatcctcaaacagcagttcgttatacccctcccccttgtgggtcttggagcggaacgccatctgggttttgctgcccggcagcgcccccggcgggatgttgctggcgtggtaagtgcgcccggtcacaatcggctggtccgggtcgccgtgcaggaaatccaccaccacttcctggccgatgcgcggtatcgccagcatgccccagccctggccggcccacggctggctcacccgtatccagcaggaactctggtcgtcgctttttccgtatctgtcccacgggaactgcagccggatacgcccgtactggtcacagaagatttcttcccccgccggcccgacgaccttggcaatctgcgggccgtcgatggtgggcttgggccgcggggccggccgccagtgctggttatggcggataaagctgaactggctgtgcagggtggtgccgctgtcgctgctggcggtttcccgcgcctgcggctggctgcccgtatggctggcgctgaccacctgccacggctggttgaggtccgcccgcgggtggttgtctagggtaaacagcttacccggctggacagcgatggcctgcccgctgccctgtcccgtcaccgcgtcgctgcgcagcgcttccagccggtagcgggtaaaggcttcgccgtgggcttcgtccttaaaccgccccgggtagtcgtagtgctcgtaataccgctgctgcagggtgtcttccttcatctgccggctgaactccgccggccacgccgggtttttgaaggtgtagtccttgagctgcacctgtgccgggcgcacctgggcgctgcaggtaaagctgcccaccgacggcacccccgtcgtgctgccttctcccggctggtacggcagcacaatgcccggcggcacggagccggcgtcatcggcaaacaccagcgtgttccgcccgctgccgcattcgaagaagtaaaagatgccctcttccgccgtcagccgttgcaggaaggtaaagtcgctttcctgatattgcacgcagaattcccgcgccgggtgcggatggcgcagactgaacaccacgtcgcggataccgtgctcttacaggagcatggtgaggatagcggcgatgtccagctgctggaagatacgcgagttctgccgcagggtggtgcgccacaagtccggatagatgctcatctggtaagtggtctggtgcagcccggtgttgccctgctcgaaacgggccaccatgccggtgatactgcgctgctccaccccctcctgcaaaatggtcagggtcgcgctgcggtcgagcaccgccggaaagtcaatggccgggtcggccgcccaataactggctggctttctgcagggccttgctggccgcatgctggccgcccgacgcgatgagcccagcaatcccctgcaccgacagtcggtgctggtcataatccaacagcagacggtaaccatcggagtgcgtgatctgggccagttgaggtattccctcatcatggaggtcgtcatagtggaacgtgatgcgattatcatggcggtcacggatacccgacagtgacaacacccgcactatccggcaacaataccaacgccagcaaaaccagctcagtgagattaagctgaggatgcgagaactgattggggaatacaaaacacataaaagagagagaaaagcagggattgagaagctacaggcagcgctagattatcatgggtatgcaccacggtagataaaacaaagctggaaaattccaagaatcttccagcttaaatggttttatttataaataatccactatattagtaaattattactgtaaataaactagtcaccttcaaacaaccctatatatttcaatccattatattgttctttatatggagggttaatgtgtaattctgaatcctgataccaaaaaatggcatttgcttcttttattcctaatctatcacatatgtcttttattgattgaaattcactttgatcaacagcagcatcaattaaaatttcatctatagagacactttcatcgcggcgtggaattattcctataaaatcctcatcataccactgaagaccaatatctttacaaaactggcaaagtttatagttaggatcatcaaaatttccttcaacagaataatctagctcaaaatatttcacatattcgtcttcagaggaaaaattatttccaatccataaatgcacactattttcagttgtcatcttccgcatttctcactgtatatcatatgattacgatggtgcctgaccattattttcttcgcaccaaatttaccagtagcttctttcagatctgcaattaatttattatgaaaatgcctacctgctctacttccatggtgtcctccatctggtacaggattacctttggcgtctgttacatttgtgaatgtaatcttatctgtatctacaacatatttttttagttcttctgctgtaaaacctaattcttttgctttagcagctaaagaaacaggaaacatctcatgttttcctccatttcctcttaaggcggaagaaacagatgctttattatctataacgtcttgaactgtggccttattaaaccactcatcaaacttaccaggtttccattcagcccatcccaaaggatcgatctgccccgtgggattatgaacataagcataagggttttcgccccccagcagcccaatggggtccggcgtcagatagcaactggcaacaggcgaataataccggaaccgattatagaccagcccgctttcttcatccagccactgaccggcgaatttcagccccggattcagttccgcattttcacccggtacgccaaggcgcaatccatacaggctctgcgctggctgacgccagacacggtgaccgccggcatcaaacagtgccagtggctcgcccgtcggcgcacacaccgcatactgggtctgaatctccccggccaacagttcatgccgattttccgggttcaacgtaaaaaactgcacctgttgcgccagcaactgccagccatcaaacaccaaatgacggatgctgtacagccggttgtgccggtactcccggatttcggctgggacatcaccgtcccacagatacgtcgtgcgcatccctgcctgcccgcacactttctccgtgcgccgcccgaacgcatcgtagcgatagtcccactgctggccgcccggtgtcagcaccccgataagctggttctggctgttccagcgaaacttggtcagttgcgggcggtgcccttcctgccagagctgcatggcggtcatccgccccgcgtcatcatactcaaacaaatgttgtccaagctggcgtaaccgatgccctttctggtacaaccgttccccgtctatctcattcaggccgtcaaagcggcgggaaggataacccgacgcatcatactgataatgctcccgcaggcggtcaccgtcactgaccgaggtaacttgcccattgccgttgaccacgtaacgcagccactgccgctcatcattcgccgccaccagattgagcgcggcgtcgtaacggtattccttgtccagacccgccagtgtgggctgcggaatatccgccacttcgtgcgccgaaaaaaactcggtattgcatccggcacgttgagcggtcagttgccccatcagggaatgcgcttgccgcaggataaagcctttatccgactggcggtgccattcgtatccgtcttcgtcccgttcaagattaagcgtgtgctcaccattgatgcgaagcagcttaagttcacccacgttgttgatttgtgtgctcgcctgccagcagcggccatccgaagtgtgaagcgttctttctgccgtcgcactgtccgggtagtcacgctggattaccccgtgtggctggacttctttgacgagtcggtcttgttcgtcgtagtcgaacgtcagaggttcactctcgggtgcggaaacttccagcaggcggccgaggatatcgtaacggtaagtcgtgctgccttccggcgtatgcatcgccgtcatccgaccagcggcatcgtattcatagtgggtggtattacccagtgtgtcgcgtttcttgatgcagttgccattaccatcgtaggcatagtgccactgcgtacccgcataatcggtttcagtaatgacccgcccgtccgcatccagcgtataacagtagctttcccccttcgggttaatcacggccaataattgcaggctgtcgaggtcatagcgatactgccagcggtggccttcaccgtctacacggcccacgggcaaatcaaacggcccgtattcaatgtgccattttacgccacgggcatccgtccattcggtcaggttgccgtgacggtcatgacgaaaacgctccagactgttattcgggcggtcacttaaagacacccggtgatgacggtcatactcccacaaccacagtgacccgccacccgaaatgagccgctgcaaccgatcatggctgtcataacccagtttcagactacggttttcttcatcaaacagtcgggtcagccgctggtgaccgtcatattcccacgtccgtttgcgcccctcgttgtcttcggcagcgataaccagcccaaattcattacgcgtcagggtagttttactgccatcgggtgccataaagcatgccggattaccgttatcatcatagctctgccaccacgcacggccgaacggatctgtcatgctaacaagacgatcggcatcatcgtagtgataacgccacgttgcccccatggcatccgtaaaaacagataccaatccagtattcgccagataatccagcgttaagatttgtccttccggcaggatttttcttcgcaggtttccccactcatcgtactcaaaacgggtgacattgccgcacggtgttgcctcctgtgtcaccagttgttggtcgttatggtgccaagtggtgatatggccttccgggttagttacccgagtgatacccggttcatagtcaaaaacccccggataatagcccccgctacccacggtatagatgcatcgctcctgttcatcatagcgataatccaccgcggtctgatcaccatctgaccagcggctaatcagcccctgcgcgttatactcatagaacagatgaaactgctgggtactgtttgcatccgccagccagccgttatcgtgataaccgtaccgggccatcacgtcattcaatcccgtgtcgatacggcggatttcagccagcaagccatcttcacggtagagcaacgccaattccgggccatcgctatgaatcaccttaaccagctgctgttcactgtaatggaaatctatcgtgttatcgtgacggtcacgtaacgcacccagtttccatgtctgatttccatcctcagcgggcatcgccacactgaaatgctggctgaccggattatctcgttcatataggatatatcccgtctctgcgcggcgcagggtaaactgcgggtgctccggattcgtactgctccggtcggtcggggtcaggataaagtagagtgaagccccctcggtagtacggatttccacccggtcaccgatgatcaccgcgcagcccgaaaaactgtctgtccagctttctcccagcagcccccgttctcccggcacccagctgcgcataaacagcagcggcagggtctgtcccagggcaatatccgtgcgctggtcaaacagcgcccccgtgacaacatcaatgggatctttcgagaagaaacgcttggtcgcttcccagtaacgtttagccccttgcgtttccccaaaggccgttttggcgcagtcccatcgatccgacagattctttttggcgttgttaagcccctccttggctttgcctgcccccattttcgcgccgttcatcaccttcatggcgctggctttcactttattcgcggcttttttagccacatcaccgactttcttcgcccccgccttcgcccccgatatgacggtattcgcgattttttgggcggccgccctggccttctgagcccccaatttggccgaggcaagcagggcattcccttcttttcgtgccagcctcagtaatgcctgacggccttgttgagacaacagcttacccgcgattttcagcccgccccgtgagggaggcatcaaaaactccaccgcgaccaacaccgcccgctccagcagagaaaattcttcctgtacttcaagatagtcatgtttacccgacccgataaagacggttcccgccccgcctttaatcgccgccccgcacaccagcttatcgtccacccgtgcggccgcagacccgttgataaacaccgtttcactgccctgcgccaccagaggcggagtgggatgtttactgcatgttgctttatccacttccgcccgggccgccgccttgccctcaatcttgacattcggcgaaccactgtctatcaccccatccggtgatcccagactgttcaccatattcgttactgaggtggtcacattactaatcacgcctcccagctcgtttacagcatacgcacccagtgcaaaggccgcgaccgaggccagcccgccggtgccgatcaccaaccctgcaacagcaacggtggcagccatggccgccaccgccaccaaagcacccgccgccacccccgccagcgcggccagaaaactggtgtgctggatggggtccccttcccgcgccgccgcagggcctctcggcccttgtgcaggggcaacccgttgccccgcgtgagttgcccctacccgggcaattcgcgcgacgatatcatcggtcaatcccatatcagcctcccgttatgcagcctgaaaactggtgaccaccgccagcagggcatcacgctgtccagcattaaagggctggggggaggtcagattaaaagccaacaattgacggccccggatttgtaagaccaccgtctggtgcatttccccttccgggctttgccagtggtaatccagccgccacgcaatttccccgctcagttcaatttgcaatcgttgatgctcctgataacccggcaaatgagtcacaaattgcgtcagcgtttgttcatagtaggcggcggcatccatccccatgggcaccggggtgcggttaatcaccaaattgaccccgctgtcatccggcaacacaaagacatgcatggattcatcacgccagtcggccggaatagtcagggtgccttcgttcatctggtaagggtgtgcgctcatggtgttttccttttcgctctttttaagattgtctgtttattcatctgcccagccaacgcgggaacgccgttggctggcttcatcgtgttatcggcttattcgccatggtattctgttttggttttcagccggttaattcaaggtaatcacgttcgaaccgttaatcgtgaccgtggttccctcaatgttgatttcaccggattgtttcagcgtaatactggccccggccgtgctgatgctgatatcgccctcaagggatttgagggtgattgttttcttcacactcagcaggctggtctcattcaccgtcacctcttgctctttattaatggcagtgacgtccttgcccacaatctctttatggcggtcttggcgcaccgttatcacctgcttgccgccaatcgtttcggtgtggttttgcgtcacccgggtggtgcggtcattgagtaccgtggtgttcatgtccttctgcgcatgcagcgctaactgctcactgcctttcgcatcctcaaacagcagctcgttatacccctcccccttgtgggttttggagcggaacgccatctgggttttgctgcccggcagcgcgcccggcgggatgttactggcgtggtaggtgcgcccggttacaatcggctggtccggatcgccgtgcaggaaatccaccaccacttcctggccgatgcgcggaatggccagcatgccccagccctggccggcccacggctggctcacccgtatccagcaggaactctggtcgtcgctttttccgtatctgtcccacgggaactgcagccggatgcgcccgtactggtcacagaagatttcttcccccgccggccccaccactttggcaatctgcgggccgtcgatggtgggcttgggccgcggagccggccgccagtgctggttgtggcggatgaagctgaactggctgtgcagggtggtaccgctgtcgctgctggcagtttcccgcgcctgcggctggctgcccgtatggctggcgctgaccacctgccacggctggttgaggtcggcgcgcgggtgattatccagggtaaacagcttacccggctggacagcaatggcctgcccgctgccctgtcccgtcaccgcgtcgctgcgcagcgcttccagccggtagcgggtaaaggcttcgccgtgggcttcgtccttaaaccgccccgggtagtcgtagtgctcgtaataccgctgctgcagggtgtcttccttcatctgccggctgaattctgccggccacgccgggtttttgaaggtgtagtccttgagctgcacctgtgccggccgcacctgggcgctgcaggtgaagctgcccaccgacggcacccccgtcgtgctgccttcccccggctggtacgggaccacaatgcccggcggcacggagccggcgtcatcggcaaacaccagcgtgttccgcccgctgccgcattcgaagaagtagaagatgccctcttccgccgtcagccgttgcaggaaggtaaagtcgctttcctgatattgcacgcagaattcccgcgccgggtgcggatgccgcaagctgaacaccacgtcgcggataccgtgctctttcaagagcgtggtgaggatagcggcgatgtccagctgctggaagatacgcgagttctgccgcagggtggtgcgccacaaatccggatagatactcatctggtaggtggtctggtgcaagccagtgttgccctgctcaaagcgggcgaccatgccggtgatactgcgctgctcaaccccctcctgcaaaatggtcagggtcgcgctgcggtcgagcaccgccggaaagtcaatcgccgggtcggcgctcgccagcccgaccgtcaggtgaaacggctgggaaaacccttcggtcagcgagaaatcggtgaccacaaaggtttccggcggcaggccgcccgcagtcagggtaaactgcagcccgctcggggccgtgccgcccccgccgcccaataactggctggctttctgcagggccttgctggctgcatgctggccgcccgccgcccgttcaaccagtccctgcccgcccgacgcaatggggccggcaatcccctgaaccggcagacgtggtgagctggcgccccctaatccccccgacgccaccggcccggcaatgccctgaatggacggcagacgtggggtaccggcaccgcctaatccccccaacacgcccgccgcctgttttgccatgttagcggcctgctgtccctgctggaccagcgcccgccctttcttcagtttcgctatattcttttttatcgacataacatgtctccctgattaatgcccgccgtcaggggtgacggtggactcatggtgtgtggtctgtttctcggtctgtttttcagccggattttcggtcgcctggcgcaaccggtcatagcggccgagcagggcgttaaagcggtcatcaatccctttcagcagtaccggcggcaccgcttccccgctcgccacccgggcgttgagctggcgcagcagttcttccagcggcacttcgctgccgtggctgcgctggaggtcatagaccgcagttttcaggtacgagagcgtgaagctgccccgggtacgctcctgcaacaggattttgtcggccagctgctggagctggtcgcgggtggtatgccagctgcctttcagcgggatactgtcgatacgggcggtcatcgcctgtgtccactgacgggtggcactccgctgctcggccgactccggccactgtttttccgcggtgtcagtcagcgtgcgggccgcgtcccacgtcgccagcaggggggtctcggccagtcggtccagctggccctgatagcccgccagtgcgggctcggtcagccacgccagccgggccccggccggggacgccgtgatagccgtgagctgttggtgcagcggttggtagaacagcagcccgctgcccaccaggaccaacacgcccaacaacgccccgaggccaaagccctgccacgcactccacccccgcggcggctcaggaaactgcacccgcacccgcggactgtccgcttccggcgggcggtcagggcgcggcggcgcggacggcggcggcatttccggctcggtgtcggactgggacaggtagaccagcggcggcatctgcaccggcgactgaactggtttcgcggccgggcgcggtttttccagttttttcgccgcgttctggaagaaccacagcaggttctccacccgcggcagccgtttcaggtcggactgctgcaaccggtcgataatcagctgcaacgcccgctccgcccggtaaatcatccgcaggtcgccggtgccgaaatccatctggcgcagctggctgccggtgcgggtgtggaaccattccagtaaatccgtgcgcacggccggctgcggcggccacagagcgtcccactcactgactatcaccccggccagcagttcacagccttcggtaaagcccgccagcccgttcagctgcatccgcgccagcgtgtagtaaatcgccgtctgcaaatcgaccccgttacggcggaacagggtcagcgacagcgattccaccagtacccaattgacttccggctgggccgggtggctgattttgttgatttcgtcgcggataaccgcaaattccggcagattctgcgggctgccgcctgcccggataatcaagttttcagggtgttcactcatgtctggctttccttaaaaaaacccccgcccggaggcaggggggatggttcttgctgaatactgactcacacccggcttcagtagagggtgtccggcagtctgaactggctgaacaggccgcccgcaaacgggttgtccgattcgtccacgtaaatgcggtaggttatctcgccgccgtccaccgcgaagcgcacgtcaaacgcccccggctgcacgttggtcagcttgccgctgttaatcagccgcagctgcgcccacgggccggtgaagctcaggctgcgcggcgccgcgttactccggtccggcatcagggtcagccggctttccgtgcccgcccgcatcgagtttggccacaccaggtgcgccacgttgctgcgcccgtgcgcgtaatccaccagctgaccgtcgaggttcagcaggccgcggcgtttgttgccggtcaggctcaccggctcgatggcaaacgccgtgcccagcccgttctgcggggtgaagaaggtggtgcggatacggtccgccaccgccagctgtttcagcacgtccggccggataagctctcgcccgtcagtcccggtggtcaggttgttttccacgaacggtttcaggctctgcttatagaaggtatccagtgtcccgtccggccggaagaaacggtcaaactcactcagcggcacgtcttcggtggccgccgggttgaacggataccggccggccaggtaggtctggtactgcttgaccaccgtctcattccattccacttccagcgaacgcaccgcttccatcatcaccacccgccatgcctgctcggccaggtcaccgacccagcggttcagcggctccggcaggtttttcgccatctgctgcacttcaaatatcgcgtcgctgttgttctggtccagccgcagctgcaccgcctgcagcgccgccttgcccggcaccggcgagttctggatagccagcaggtaacggtgcagcgccatcagtttctggtaaacgctctgcagggcactgcccttgtcgccgtgctcaagcagcaccccggtttccggcgcaaagtcccggctgatgcggtttaacagccggtaatccgactgcgccagcagcgcctgtttttccttgtcactcagggcgccgcccaactccggcggccgggtgttgtcactgaggatttgcagcgcgcgcttgatcggctgttccccgctgatcacctgctcgatggcgctgatggcctgcggcagatcttcaaagtcccgcacttccaggttgttcatcgccgcccgccagtgggcggtgtagtccccgacgtacagttcggtgatttcgcgctggatattcccctgatcggtgtcgctgtacttgttggttttcagcggcaggttcagcacccagctgtccatctcggtcagctccaccagctccttgtcctgccggacaaagtaatccgtcaggccgtggcgggtcaggaactgcgggatcaccagccggctgtcattgccggcaataaacacgctgtcaaaactcggcccaatttggtcacgcaggttaaccggggcggacagggtatcctgggccttgaggcgcaggttctggtaaacccgctggttgatggtcagcgcactcagctcctgctgggcctgtttcatcggcttaataaacggcgcaaagcgggcgagggcgtcctgattgtccctgtcgcgctgccccttccagtcggtatgggccagggcgtaatccaggtgggtcagcaactgcgcctgtaaatcccgctggccgtgaaacgccttgctccagcgtgcacgcatgtactgcccgaccaggccgttgttgcgcttgctgccgtcttccatcatgcgcatcacccgcaggatctcgagtttttcctcactgcccgccggcgcccggttcaggtcgtccagcagcccctgcatcagcgacggcaggaaacgctgctccagcagtttcaggtaggtgccttccacatacggcccgaccccgtccccctgatacagcgccatgtcggtcaggaaggattttttctcgtggtagttgccgtacgccagagtcgcgtcccggatcgggttcagcagcggcagctggaggtggccgtaacggtcatccccgtccggcggcggcacggacaggaagtttttcgcctgtgccagcacctcttccccggcctggtagtttttctggtagaagtaatgccagccgccccacatggccacgatcaccagggcgctgaccgtggagaaggtgtacagctggcggcggttgcggctgagccagagacggttttctgcggcgaggttcggctccgccagcagcacctcctcaaacagggcctgggtaaagtacggcagggtgtcgcccgccggccacgtcgggaacgcctgcgagccgaggtgatactgggctgacgcggactgggtgaacaggtcatccatctggccgacctgacgggcggaggtcaggtagacgccgcgcaacatcgggcggtggtgttcatcgttgtacaggatgtcttccagcatctgcgcgatatagctgtgcagcccctggacctgccgggtaaaactgaacagggcgctgcgctggccggcatcgacgccgttgagcatcatgtccggcatcgccccgttgaggttggccatccactgctgccagaactgttccagctcgctgcgccaggctttttcatcccggttattgaggctgaaggtcacgccgaggatttggtcacgctgccggcgatccagcgacgggtacatcgcttcgaagccgtgcagcaggtcgattttggtcatgaccagatagagcggcagctggctgtggaaggtcaggcggaggttttgcaggcgctggtggatttcccgcacgtagcgatcccgctgctcccggttgtcggtcagcaggcgcagggtatcgacggccagaataatgccgttaagcggctggcgctggcggttttccgtcagccagttcagcagggattcccacaggcggctgttgatctgcggtttgtcactgttgaccggcaccggctggtcaatcaggccgccctcgggatcgatgatgaccgctttttcgcccagccagcagcgcagcctcagcgaaatgtcgccatcctggcgcaggtattccggcgccgcgatgtcggacagtttatagccttccttgatcagcgtggttttgccgctctgttggctgccgatcatcatgtaccacggacgctggtacaggtagttatagctgtccagatggcgttgcagctgggctttccagtgatcgaggtaacgggcctggtgttcgatatcgacccgcaccggatcaacccctttcagctcgacgtccaggttgagtttttccagctggcgcaggcggcgccacgctttgatgccgatccagagcagcaccatcaggatgatgagggcggtcgccagccagcgcgccgccagactgtccagcggggtgtcgttgcgcagtttccattccggcccccacacccagaccgcgatcagcagtaggccggggataagtgccagagccagcgccatcgtggccttgagacgcggcagggatttaaattttgatagcgccggcaaggccgatttcaacggcgccaaggatgacaaagagggccatttcatgtgttaacgctcctgtgtgacgcagtatccttcgcaggcgaaggtattttttcagccagcagggtcagcaggctgggttcccattcagtgagtaacatgtgttgtcccgtgtgtaacaagttccggtaatgctgttgtgccagtgcggtcatgcccgcttcttcaagcagttgggcagtgaacaactgaccatagaattgatcccggggctccgtcagtagctgctggtgttcttccagcatcttcagggcggcttctagcccctgttgctggaagcagtgccagatggcttcctgatcggccgacacggctcccgggtttccgctggtgtcgggttccggtgtgagccagtccagggtgtcaggagaaataaacggactcaggtcggaaaaacttaaagttttcagtacaggaagccgggccaaaaacgcattcagttcgtcacgcatggcctgcgcaacgtggctgtagccccgttgttccgccgcctgtgcggcaatggcatggccatccagccaataaggggcgagggtcaggctctgctcaatttgcgccagcaatttgttatccgccgtcggcagtcgcgccagataatcggcggtgcgatccgctgacgccggtgccaacggcgttttgcccgtggcgttcgccatcggtgccgtggtaatggtgtgccagaccgcatgacggcgcaggctatagccgatcggggattcgggataccgttcacacagcaaatccgccacgatcatcagggtctgtttccacgctttatcactggaactgttgaccgccacgtcaggcatcggcgcttgttcaggggcgtgagacgacggagccgccgacgccgcctgaggggctgtgggtgcaggcggtgccggcgccgttcgggcctctggctggcggttatagcgggtacgcagttgatcgacgtctttcgcgaggtcgggttcattggcgtgccagcactgggccaggtgagccagggcaccttgtgcctcgtcgcgctggcttttgctggcctgctcggtgaagcccgcctgggccgattcaaaccgtttgatcacctgctgtgccagtcggcgcttcaatcccggtttgaccggccaggctttttcccagtaatttttgacgtactcggtcagcagctctatcgccaggatcagctcggcggggtgaccggcatgctgcaaagtccgcagcaggtgaaccatcagccggaagtccttgctgtgttcgctgaaaagttgcaaagcctgtcgctggagggcgtcaacctccagcgtgccatgtgacagcgagccgaatttgaccatctcgccgtcgatgaattcccaggcggggtcgctctcactcagtgccttgcccgtctgttcgtcggacaggggcgccaacagggcgccgaaccagtcgaattgtgttctgatgtccatgtcggttaccaacggcaggcgtcgcgtaagggtttcgcggcctgctccagctgagaaatattaaaggttatcgggctgccagtgcgggccgtgatggtcatctggtcgctgttcattaagcgcttgatttcctcaatgcccggcaagccgcggctggattcccataagtaaccgtgttcccgcaggaaccactcggttttgaattgggttttgtccgtggccacggtgaccgtaccggattccatcggtttaggcagtgccacctgcaaacgggtaatgcggtcaatgcaactcagcatcagaaccggacggggaggcggcaccccgaccgccggtgtggtcaggataacgggtgcctcaccattttctccctgcgttacgatgaagccagtggagtaatcggtgcgtttcatctcctgctccatcgcctgtcgccacacaagccccatgttttccatcgggatttgcagggcgttaaacttcaggttattcaccgtacggtcataacacgccagccggacaagcggggacggttcaaaacggcatttttgcatttcgtccacgtattcttctttgggtgcggccacttcctttggctcaaccaggttcgccaatttgggatcacctcccaatgacgcgagcaacgcgctgataattaatacaatattcataatctacacccgtatttagccagtttgtaaaccaacgagcgcggggcaatccccagactttgggcaatcagtcgggtgtcgttgccatactgacgctgacgttgaaccaacacggcgctttcaaattcttcgatggcctttggcagattatcgatgtggctgtaatccacggagatacggctcacacctgcgggtttcgatccactcagggaggcaagcagttcatccagttgtttttctttctgttgctgaacctgaaatacctggcggatttggcgtaactgcccacgcagctgttcgagttcctgcaattttttcaggcggtgctgcatgacatggcaatagaggccgaacatgttttcattgttgataaaatggctgacatgttcggcaaaaatggcaatcacgccgcaggcctgtccgttacagtcaaacaggggaatggcatacaacccgcagttatgcggcagttccgcaacaaacgtgcggaaaggcacatcgtcaatgcgcgcaccgtgattcagggaatcccataccgtcggggctcccttgcgcagaacctgtatcagcgggttattgacgtcatcaatatccacattcagccggcgtgagctggcttggtggagttccggcaggttgtagcattccagtctgttttcattggtgttaagcaagaaaactaacagggcatcaaaacgcgagctctggctcaccagcagaaagtggccaaccagttgttctatagtgtcatcatctaataacgctaacgcgcttttcagccgctgtttcattattctgcctcctcaacctcagcatggaactcgtgttctaccgcggttaagcaaatggcactgattgcggtacctgcggccattttctgcaacagcagtaatgaaacaggcggtaatagggcaccatcaatgatggattccagcatacgggcaccgttttccgcacgggtggcacgttgcaggatctcttccgatacgtcatcgctgatcgtaacttcggcgttaaagcgctgagacagcaggttatccagtcgagccagtttgctctgaatgatggttttcagcgtttcgtgacccagaggcaggtaagggatcacttccatacgtgccagcagggcgggtttgaaaaacgcggccaattcagggtagagcaggtcgttaagttgatctggctgctcggcatgatcaacgatagtttgatagccaaggttagaagtcaggaagaacacgacatttttacagtcgatgatgcgtccttcgccatcggccagttcgcctttgtcgaaggcctgatagaacaggttcagtacatcagggtgcgctttttcgacttcatccagcaacacaacggagtacggtttctggcgaatggcttcggtcagtacgccaccttccccataacctacgtagcccggaggagaaccaatcaggcgggaaacggtatgtttctcctgaaactcagacatgttgatggtggtgaggtattggcgacccccaaacatcagttcagcaatttgcaggacggtttcggttttaccgacaccacttggccccaccagcaagaaggcccccagaggacgccccggacgacgcaagtctgcacgagcggtcaacaggtgtttatgcaagttctggatcgcaacttcctgccctttgatgctttgtcccagatgggtaggcagttcggtcacgatagacagttcgctctgtgacagacggttcaatggaacgcccgtccactcagcgataaccgaggcaatctgggttttgtctacatggggagaaaccagcgtttgcttctgctgtagctctgccagttgtgcgttgagcagcgccagtttttcgatcagggattgttcgtcagcggcgacttctggctcgtcttgcgcaatagcttcctgctcttccgcgtcttcagccgtctcttcaaccgcattttcgatggttttatccatcgtttctgctgcaactgactcgtcgctatccgccaggagttgactgcgcaattcgatgatctgtgtcaccagctcctgctgttgccgccagtttttttccagcgtgacgagttcttcctggatctctacctgctggttttgcagttcttccagtctttccgcatgttcattcagacccatccgctgttctcttttcagaacatcgatttccatttgcatctggtgcaattcggtcgtcagtgaggagatctggcgtggcggcgatgtcaggttaatggcaacgcgagcacaggcggtatccagtacgtcaatcgctttgtccggcagttggcgcccagagagataacggtcactcaataccgcagaggctttcagtgcttcatcatcgatcagaacaccatgcgcctgttcataaatggctcgcagaccacgcatgatcacggtggcttcttccgcgcttggctcagaaactttcactaattggaagcgacgagacagtgctgcgtctttttcgaagtattttttgtactcgctccatgtggtcgctgcgatggtttttagttcaccacgcgccaatgcaggtttcagcaggttggagatatccagcccgcccgcttggttaccggcaccaatcaaagtgtgcgcttcatcgataaacaggatgatcggcttagatgattggctaatttcagccatgatgcctttgaagcgtttttcaaactcacctttaaccgctgcccctgcttgcaatgcccccagatccagtgtcatcagttcgctgttgcgcaatttatccggtacacggtcattgatgatgcgcagcgccagaccttcaattagggcacttttacccacccccgcttcacccacgacgatcgggttatttttgcgacgacggcagagaatgtcgatcatcagatcgatttcgttatcacggcacagcacaggatcgagtttgtcctgacgcgcctgttcagtcatgttctgggtaaaacgcgccagcaggctgtcgctgtttgccggatgtacgccctgcccatttttatcgtcgccgctgaaaggctgttcggcagagccattcgtccattcagcaaagttctgacgcagcaattcacggttgatacccgccagcatgcgcgcgggctgtggagtcagataacgcattggactgaacagcagagcaatcagcatgacgccaccgcgtaattcagtatgctgcatctccgtggaagccagcagccagctatcctgtaaccattccaccagcatcggtgagaagttcggataggtttgtacaatcgcctgatgatgaggcatcatctgatcgagttgttctttcagcagatctttatcgatgtctgctttattgaggatcaggcgcacatcactgaggggtgtgtcgatcatctgaaacaacagttgtgcaacagtaatttcaggctgctgctggctgacacaggatgccgccgccgcttccagtgcatggcgggtcatcgggtttaaacggtttacaagagtgggcagatcaatctgaatcatgacgacttcctatctcaataagttacttagctgctttaatatgtcttgggtttgatcaccgaggcggatggcatagaaactgtaaatagcagccagcaaacctacacttatccaaaacaggtgcttgatggtccaacgtctgctcaggcgataacgctcatcacgctcgttgatatcgacatatagcgtggtcggcggagcttctccacgcagtgagtgaagctgttgctgcaagcgacggaacaggcgatcaaagtcatcgcttttctgggtgctgactttgtaacgtccgcgataacccaggcagaggcagagataaatgaactccagcaggtgctggtagcgctgtgcctcccccatcaggcgttcgagcaatacaaagactttttcgccgccccaggtttcattgtggaagtgaaccagcaacgattgcttcaaccagccattctgactgttccagccgtgccccaacgcggtttcatcaatgaaggtgcatagtacgtaacggaatgaaacaatcgctccgggttcataacctttggtttgcagaaactgctcaatggctcgaatgtcagtaacaacctgttggtaaagcttatctggcagtgcctgatcactcatatcctgcaaacgcagaaccatccccagtaagggggtggccgcatcgatcatcgggttgaggctttcaccacgcaacggtagctgatactggcgctgaaacgttttcagcgtctcagacttttccagtgacggactgccaacattgatatcactcatgattattccttaccgcccctgatagcccagagctgcatatctaagtcagggaaatcccctgatacgtggaatgcgatggaattcccctgctggatctctttccatgccggactcttctgatccagacggaagtaggtgtatccagagtgatacggcaactgacggggagccgcggacaatgcaatcagtggcacacccggtaactgaacgctgaccagatcgcggattttttccatcgaggtgactttggtttgctgcacgaactgacgacgtaactgctcctgtggcgtacttgcgctgatagccagtacgaattcggctttgcgcagcagatcgttgtcgtggagcgtcgccacgcggataccaccttcgttctgtttcaggacaattgacgttgcacgcggtgtcagaaccacgttcagtgcatcacgaatggcgtgcatcgcgtcctggaaggtatccgtcaggttattgtggtcatacgccagcacattccccggcaagcgactcgcatcggtgaaggttctcagctcaccgcaggtctggagcagttgggtatataaatgcagcgggtgcaggacggtctgttttgcgtaatggttgaacagaggttgcacgcggttcaacaactgaagcatcatgaactccgcaacatccgcaacgccctgctgacccggcgaaccaatgcgtttggccagtgttcttgagcgttcagtcaacaggccgtcgatttccaccataaaacgtcttaacttgtcagcgacaaagatagacagacaggtcgggataaattcgctatccagaacgatagtgccatccttctgtttttctttgatgcggcacagcgggatagccgtgtaagcactcatgtcttcggagccttgcatcagaaccggcgtcaattgcgcaaggttcagggcaaaggaatcgccgcccttagtatgcaggtcacggacatcgctcggcagttcccgataacgtactgcgctttgaatttccgcttctttgtcagcaatttcccgaatggtatcgctggacattggcaatgctagatagatgtctttgcttttcaggtcattgacgctttcgatgtccagcggttttggcagcagatcttggctgggcgcagagaatatcgtgccatcctgcatgatgccgctggcttcggtaatgccgatgcgccctaaattgagcagatcctgattgatgctcagagagctgaaaccgtgaccataagcggccaacaccgatacgaggctatgagccagataatcattgtgtttttgttgttgttgaaaatgttgtggcttgatgaacaatccttcgtgccaaatcacccgatttttgcctggcatgactactcctcctcttttctaagttcgacgtcgttatttctgacatgcaccaagatgttgtaatggcggccgatgtcttttactcggatgatctttttccattcagattgatttgcatctgcatagtgaacgatgacaccgatgtaacggttattcttttccaatatcagcgttgacaggggtttgtattgccccggcaatagcgtgtaatcctgatgatcgatataatttttccccagtgccttttcgagtttgtcgctttcaagctgatcataatcagcagccaaaaaacgcgaatcttcactgagataaaccagattcatttcaacaggagccgcttcaccactttcattggggttgatgttcggttcggccaataacgtaatgttggcaacagaagcctgttcatccggttttcctactggtgtggaagggtcccagatcacttgaccgactttctttgtcgcgttccatgcaccgctacagccattcagcaacatcgctgacaacaataaaatccctacagcccatacacgatgactagcggaatgtttcattgctggagtcctctaagccctgacgcagtgcgcggtcataagcctgctcatacacctcacggaatagcttttcaaacccctgctggcggctggaagctaattcacggtaatagttggtgtacatttcccacgcccaagccgcgtctttgttcctgacttcgttgctgcgacggtaatgtgagaagcgacggagcaattgatcaggggagaaggcttccagcatggtgtccaatgctgccgaaatggcttcccgattggcctgataatgcaattgcaggttatgcagactttccgagacggcagcgggtgcagacaagtgaaccgggcttttctgatccgagaacatcacctgcatggtggtgtcataatccatattcaggcgcagtgggttatcttcgatggggcgaagttgtttatcacgcagcccatgctgttcacgctggagagccaataacccttcaatggcggctttcatggttttgcccatctcttgcagaaaatcgttagcctgctggctatcatgcagaggtaactgtgcatctaacccacgcataagaggggtaatggcaacatgatcaacatccatatctgcgtactgccgatcggaagtgatacccggtaaatcaaggaactcctgatccataacactgcctcggttatcagaaatagggttagcaaacgggggggtttggaaatgatccggcggcaaaagctgctcagtatcattggcttcaacctgctgcttcagcgtggtcaggctttcgctatcgagtaccctgagcgggtcatcgctgaaactatgctggatcgtcggagcaatgctgttatcgtcggcaaacacggctttttgtgctactgcgccttccatcatggcatccagcgggttgctgtaactggacaccaaggattcaggtgataccgtcgaaggatcaacacgatctgcatcagaaaaactgatgtggatcttaatggacagattacctgcctttatctgatccccctgctgcaaacggatcagacttgactgagacgttaatgcggcattgttgatctgcacaggttctgcgagtacttgcagacagaatgcaccatcccgccactgaacggagaattgtgatggatgaatatttccctgctgatcctgaacagaccacaggtgactttcactgctaccgaccgtaccaccctgtgccgaaaacaggcaactggcggatctgccactttccagttgctcactgttgagaacccgcaatgaaagcgttggttgttgtttttccatagtcgttattccataactgaaattgtgacaaagggtttcttttccggttcgccgagaaaactagtccaccccagatggttattctgctgcgcccccaataccatgccactgacctgattttctgccagaccaaggcgcagttcccatgcaaattgactgcgcatgacgaaagaaataaacatcaccaatggggcataattctttccatccggcaggaatgacaggaaccgatcacgggtcagattattgatgctgagaaggaacttcccgctgtaatcgccgacccatgaaccaatggtgaaattctgccccagcatggacagtttagagtcaccgattacctgtcctttcctttcgcttcccaagcggttctgctgatcaaggggaatggtgacctttctgaattgccagccgtgcagggtgacatcctgtaaatcaaaacagtgggaaaccaaactgcatatcacttccggcgagcggccggggcttgccagcagccctgcataggccagcattttgctgtgattaatgttcagcatccggcggttgacatcgctccccagacccacaagggaaaacatgcgctgagaaaagtgatcgtctccccccttcttaaagcagacgtaatagcgatatttccgccagatctgatgcagaagcgtgattaagcgatggttaaacaggttgagaaaatccgtcagtcggttttcgttctgcgcttcttcccaagccagcgaatcgagataataacctggcatcggggactgactgccgtgtagccccataaaggagacttccagctcaaaataaccccgtctggcctgcgagagtgagatcacgtcacgagtcggaaatgccagactggcactggctctgaaacgaacagactcacgatcaggacgatctgtctctcctgttttttcccacgctaccgccagctgattgagcagctcaaccaactgataaaagttgtactgtgagatgtccaatgccaagggtgtggcaggatcttgctcagtgattacatcaatgagtgttgacctatctgtactggccattcataacactcctgattatctaaattgattaccttcaacatatgaaaagcgttgacgctggcatacagtgagaaaaaccgtgacaaaatcgtactgaacagataaagctcgccttctgaactgaatgcctgttgccggatatacagtgtggagcgcaggccgcgaacgggctgcccacggaacaggcgatctgtcggctctgtctcaatcttttcaatggcatcgagccgtttctgcgatgaccgtttggactgtcggttatggatgctggggaaatcataggtacgcagtacctgcttcagcgcgtccttatccagcaatgacatatagttcagcgacatgtttgacagcagcgaccagtgcagaccgccatccagcagaggatagagtggtactgacgggcgcgtgatattgcggaatgtcgcaaatgtcgggctgccgatggatgggtaattaatgtcgccaacacgcagctgcaacggcaattcacggttagtacacgtcaaactgatagaaacattttcttttagtttgagtctgagcagatccgattcatctccccgtacaaatgagatgaaatgttccagcccccggcggaaaggtgattctttcacccgaaggcggtaataacgcattgagcgttcatcttcgtcatcaatctggtgattgaaactttcgaacggtgtatagacgcgctcgccgatacgtgcccgactgcgttcgccattttcacccgccaaccagctttcaacgccatcgacggaaaaaatatcgtagttatcggggaggctataactggcctttaatggatattcagtctggctgccattgagttcaatggcttcactgtccatcggaaacaggttgatggctggtgtacagtgcagacggaaagtatcatgccgaatcttggcttctggtggtaatgcctgagaaaaatgtaaattcagtttgaaatctttggtcttgagatcttcaggcaacgttgggaaacccttcacatcaaaaaacaggaagctctccgcaaagcagaaatattcctgcaaaatgcgatatcccatgtaagcgtttttggggtacggcagcagggcatcttcccgttcaaacccaaccggcacaaaatcaaaatccggtagtgggattaccttatcgccaaccaccagttctgcttttctgaagtaataacagagccagaagtaaagctgagaagtggtatagtcatcaccgctcaggtaaaaacgcagtttgtccagttccagttcatgcaagttcagttcagttttcgacgcaaaattcaggccgatgatgccttgctcattactgttattgacggaaatgtcttggatggagagagggaaaagccagacatcacgacacagcgtaaaagtacagcggctttgttcgtctcttttaccacccgatttttcgttcgaataaatatcatcatgagttgacagcgtgttactcataatctgtgtgccacgcttgaccggtgtcgctttcgttacgacgctctcatcgggcgtgtactcgatgatagtcatactgggagtcggacgcaggtaattaggccaaagcatattgagcaggccgtgagtcagttcggggaactgatcatcaatctttgcccgtagattgccagtcaggaatgcaaaaccttcaagcaaacgctcaacgtcggggtcagaaccttgttcagacagaaatgcggcaagatgaggacgctcaactgcggcttctttccccagttgtcgcagatagttcaactcatctctgaaatatttttcaaatgacatttattgagttcgctccaggcaatagcgccggttgttatccaactgaatgctgaattccacaatatcgttgatatcatccaacaagatttcagcgctgatgtgaaagctcaacagcaacggatctgaatcatcgttgatggcgctgacggaaaccgctgatattctgggctcataatttctgatgcactcttctatcgcccactcgatgctttgcttaaaatccaccgatgtcgccgtcgcgtcattgagatcaatgacacccagatcaatagcactctgacaggcaccaggacgagaattcagcacttccttcagatgcttctttatagaatcaagcaatgaacgcatccttgactgacgggaagagccggagcccttcccttgaatgcgctcgaacagactggcagagctgcccctattccaactgtacagcgcagccataattattccttatccaaacgtccaaccagtgacagttcgaagcttgcacccatgtatttaaagtgtgggcgaacttgcatagccacctgataccaacctggatcgccttcaacatccagtaccttgatttcagctgcacgcagcggacgacggctacgaacatcagttggcggattttcctgatcagcaatgtactgtttcagccacatattcagttcacgctccagatcctgacgctctttccaagagccgatctgttcacgctgcaacactttgatgtagtgagccagacggttgatgatgaacatgtatggaagctgcgtacccaacttgtagttggtttccgcaatcttaccctcacgggtattcgggaaaacttttggcttctgaactgagtttgcagagaagaatgcggcgttatcgctgcctttacgcatggtcagtgtaataaagccttcttctgccagttcgaattcacgacggtcagtgatcagaacttcagttgggattttagcctgcacctgacccattgcttcatacagatgcacaggcagatcgctcaccgtaccgccgctctgtggaccgatgatgtttggacaccagcgatatttagcaaagctgtctgtcaggcaactcgccatcagataagccgtgttaccccacaggaagtgctcgtggtcacggctgacattttcctgatagttgaagtttttgattggattttcaacgctggaataaggcagacgcaacaggaaacggggtgctgtcagacccagatagcgagaatcttcagattcgcgcaatgcacgccatttagtatgtgaagggccttcgaagacggacttcagatctttgatggctggcaggtcggtaaagctgttaacaccaaagaactcaggtgaaacagaagaaaggaatggtgagtgagccattgcaccgacagcactgacgtattgcatcagtttgatgtcaggtgaggagttggtgaatgcatagttaccgatgacggcagcaacaggttcaccaccgaactgaccgtaacctgtagagtagacgtgtttgtagaaaccagactgaatgatttcaggcgaaaattcaaaatcttccagcatttcatctttagtagcatgaatgatgttgattttgatgttttcacggaaatcagtgcgatccactagaattttcagtgaacgccatgaggattccagctcctgaaacggcttcgcgtgcatgatttcatccatctgctcactcagctttttatcaagctcaacgatcattttatcaacgacgagtttgttgatcggttcttcgttggcgcctgtgtccaggatactgctgataaacgcggcgataccttgttttgcgatatagtagccgtcattttctggtgtgatccttgcctgagacataatttcatcaagcagggaggtcgttgcgccagaagcaagagcggtgctgttttcttcgtgctgagccatttaaaaattcctttaaccagttattttttattgacgatttcaagttctttcaggagttgctcacgaacggattcatcatccagcagcgactgcaagcgagtacgaaatgcaggaatatttcccaaagggccttttagtgcaaccaatgcctcacgcagttccaggagtttattcaactcaggcactttttttgcgatattatccggtgaaaaatcactcagtgatttaatttccagattcacaggcatgtcttcttcatttttttcatcaaggcgattagggacgttaaaagtcaggttgatgttcgcctcattcattacagcattgaagttgctcttattgactgaaactgtttgccgttcttcaattggcgtgtcttccttctttcctttcaagtcaccgacaaccagaagattcagaggtaattcgacttctgcggtctggtcacccgtattcggaacatacttaatattaattctttctttcggagctacgctacctggactattcttactcatattttaatcctttggctaatacaaccatgaactgtctaacaacccattattggtgagagaattattctaattttacccatataacaaatacaaaatatctccctaaaaaaaataggctaagaaaaacaatcgtatttgtcaggcacggatggattttatatcttcttatatataaacactcagaaatatcctatccaatcgtggaggtaacatcgatatgaaaaatcgtcaagcccgagtttgacattttatttttttgatgtaaagcctaaacacaaattgataactccctctattccagcttttaatattcctatgtcaatctgtaggaaattataagcgctttttcctcctaaaaatagacaaatatttggttttacgctctgcatgagtatgcaggccaattacctatcaattgtataaaaggtaatatttttcatttttattagaataaaatacaaccaatgattcatgaatcataattaccatcaataacaatatttattttatttagattaattattcgacattacaatccgaattaatcgcattttttgatccagttaacatttttcaaatgatcatgaaaaatatttcattaaaaaataaaaaatagataaatatcaatctattacatttaattaaaaaaccaagattatttattaaccagctaaataggtttgttttttataaaaactcagctataaatttcacaacggcaatgattataaaatttttatttgtcattgaattagagcttgccttgcaatttgcaaattactttgcattacacgatttccgctttattattcgctccgagtgttcggcagcgatagttttatttaattagagaatgaaacaatcacgcacggaatgagcacttaaacttatatattggtaaaattttataggatattcatatgccaactccatgttatatttccatcaatgggaaaactcagggcaatattactgctggtgcattcactgctgaatcagtaggtaatatcttcgttcaaggtcacgaagatgaaatgctggttcaagaatttgaccacattgttactgtcccaactgatccgcagtcaggtcagccttctggtcagcgtgcacataagccattccgcttcaccgttgcattgaataaagctgttcctctgctttacaacgcactggcttctggcgaaatgttacctactgttgaattgaaatggtaccgtacttcaatcgaaggtaaacaagagcatttcttcacgaccaaacttgaagatgcaactattgttgacattgattgcaaaatgccacactgccaagatccatcaaaagcagaattcacccaattaattcgtgtatctctttcttatcgtaagattaattgggaacacactacagcgggcacttctggttctgatgactggcgcgcgccaattgttgcttaatatcttataaattaaatattaagtaataatccttcagccaatgaataatattcattggctgaataaattaaagccttattatttacaccatcaattccttttaattcttctttttctttttcatatttgtttctttgattttttctaaatgtcagatttttatatagtgattatttttatgctgaacagagatgcataagtacatgattacgtacgtaaccaatctgactgatgctaccgtgttgatattgccttacggcagcactcacttttgcatgacgatttattgaacaaatcgcaccaaaaccgcatataaaattctggcctcaaatttttctaaaatccacgctgaattcattgaacacggtgatatgtcaactccttcccctaacctgtaatcaaagtgacataagtgaaatttttaaattaaaaatacagagtaataaaagaactttgttgttttatcgctatcctactgaaattttaattaagcacgaattacatttgacttaacccttaacaataagataggacataaccaaaacgagtcataataaatcattaagataaatatataactacaaaccataagtttgggcaaaatacacacattaatcagagcaaaataaaatattttctatgctttaatatttaattaacaaaccatatttaaacctaatctaacactgtacgttttcggatcaaccattgtcatttgggtattcccatgattaaaaagacggcaatttttatcttattatgtaccgcccttcaggtaaaagcgtcacctgaagaactcaatgtcatattaccgacagatgagacaagaaggactttacaggacagttcaagggaaatagaccagttaattgagcaacgccgtcaccaaggattaatcaatcgttccggtgccctttcgcctcagactgtctctccagtactggtagaagcaccagcatgtctggatatccgcagcgtttatctccaaggcattacgctgctgactctgacagatctgaatacactcagcgcattgcctgacaactgtattaccagcaatgacatcaataaactgtcagcagaaatcactaacctctatattgccaagggctatattacggcgcgggtgcaatttattcctcccagccatcatggggaattgggaattaatgttgtcgaaggttttatcgaggccatcgaaggtggtaatcgctggatcaatagccagatgctatttcctcatctgacgaataaaccactgaatcttgatcagcttgaccaaggactggatcaggcgaatcgtctgcaatcaaataaaacaacgctcgatatcttacccggtacggtcagtggcggctcggtcatcaggctaagtaaccaacattccaccccgtggaaaatatccgcgacaaccgataactacgggcaaaaaagcacaggaaaatggataagccgactgaatgccagcatcgacagcccattggggttgtccgactttatcagtctcagcggcatcagtaccgtcgataaccccgacacccaatataatcgggctgctactctgttctattcacttccttacggtgctgcgactttcagcggttttaccagctattcccgatataccagccatccaaagctacaaaataatgtgcacaaactgcatgggaattcacagcagtcgggtatgcgtatggattgggtattccaccgcaatcaatcgcaaatctcgacgctgaatacccagcttgtttacaagaatttcaacaactatttcgatagcgccaaactcagtcacagcagtcaaacattaactgtgttttcactgggaataagccacttacaaatcattgcgaatggccttatcacttttgatacgggcattgaacagggaacaccatggttcagtgctcaaacctcaacagacaacttgaataagcaatttaccaaaggaaagttatccgtaaatttacagcagcgcttcaggctatttgatatgtcctaccggctcaataaccaattttatacccagtacagcccaaacggactgcccggtgttgagtggctcaatatcaccgaccgcaatgcagtacgaggattcagtaaaaatacgttatccggtgataacggctggtatctgagaaataccttatcccactcaataccgatactcaaaggttcgcttgacctgcgggcgggagtggatgtcggacgggttaaaggctatcggagtcaggatggctggcaaagtagtgctggattaagtactggcttgacattgcgctatcagcgcctgcttgccgatgtcgagttcagtcgaggcaaattattatcccatcaaaacagagacaaggatgagtccatgcaactgttaacacgcgtttcttacactttttaatttttgtagcaattaacattttttaaccgtagtcaacttagggtttcactctcagggggctgcacatggcaataaaagaaagtcaataaaggtaataatatgcaagagaaaaaattcaagttatctcctacgggaaaacttgccgtatccatggcaattattctggcaacctgttcagccagttttgccaacggcattacgcccggaggcgatgcaggacatcgtcctgatgtcatcctggcggatacaggggctacggtagtcaatatcgtggcaccttctgactcagggctatcacataaccaatatgaggatttcaacgtcaatcagatgggggcggtattaaataactcattgatcgagggatcatcagaattagccggccatttatctgctaacagcaatctgaatgggcaggcagccagtgtgattttaaatgaagtcatcagccgtaacccttcattcttgctcggccaacaagaaattttcgggatagccgccgattatgtgctggcaaaccccaatggtatcacctgcaacggttgcggttttatcaataccaatcaggcctctctggtcgtcggtaatccgttagttgaaaatggcgtcctgcaagggttcaatacttttaacaaccaaaatgcgctgagtatcaaaaacaatggcttgtcacatactgacgttctgaactttattgcccccaaaattgatagtcatggtcgggaaatcaccgctaaaacgatcaatatcacgacaggtaataaccagatttcagccgatggaaaaattctggcatcacaacaagcggacgttggtgtgctcgacagctattacctcggcagtatgcaggcaggacgtattcgtctgctgaataccgcagaaggaagcggcgtcaatctgcaaggcaaggtgacggccagtgacagtattgatattaagtcttacggggatgtgaagttgcaggccgctaatctgaaaggcggggatatcacattgcaaggcaacaatgtcctgtctcaaggacgcctcaatcaatcctcatcagacaaagacggcagtgacaaccaccaagacagtttcagcggtctttatgtccaacagaagcaaatcagcgagtccattgcccgtacccaattggaaggcaagaatattacgctggtggccaagcagaataatcgcgttatggcaaccgatattgtaggggataatgtcgagctggccggtgctgatctaaaactgggtgggcagcaactccaccagttgacccgcgacaccaaaaataaatggatattatcctggcagtacgatgtgaccaaagagagtgacaaataccatcatgaaggtaataccatcaaggcgcatgaaaatgtccacctgacggccagcgaaggtaatgcagaagtgcttggcagtaaaatcagcgctggcaataaactgtccgtatccgcccagaaagatgtgaaactggcaggtctgctggaatcagaagtgactgccgagaaaggctataagaagaaccacactgttggtttgcagaccggaaactggaacaaaaaccataccgcccagagaagcatcggcagtgaattgaatgcagggggagatttaggcatcaatgccggagcaaatgctgaaattatcggttctcaggtccattctggcaaaaacctgattgtttctgccgatcagcaggcgaaaatcacggttcaatctcttgttgataatcaaagccttgccaagagtaagaaatactggggtggcattgcgggcggcagtaacaaagataacctcaataaagaagaaactcatcatacctctgatatcaacgcaaacggacatttgctgctgtcggggatgaatggtgtcactattaccggcagtaaagtgaaagcacaacagggagcttatgttgaagcaaatgatgggcaattaatcattgataacgcggttaacaactcctataagaaagtggatgaaagaaccggtacaatatttaacattaccaaaaattcgaaccaagaacacaatacacagcagaccacgtccaacagtcagctggtttccgataccgatctgaaattactcagcaataaagatatcaatatcattggtagtctggtgaaaagtgcgggtgagctggaagtgaatacatcaggcaacatcaatgtactggcttatggtgagcagaatagccatcatcaggaaaaaaccgatctaaactggcaatattacgcccgtgaagcagaagacaaacagtaccgtgtcggtatcggccttgagcacacgcgtgatagtcagaaaaccgatgtcacaacgcagcgtccatcagaattgaacggtggcaaccttaccgtaaatgcaagcgaaaatgtcactgtcactggctccaaattagtgacgacacaaggtgatgccaaagttacagggaacaatatcaacttcctgaccggagaaaacaggacatcaaccgagaattcacaggtaaaaggccgtggcggtctgtttttgaccggtggtatggataggctcggtggcggtattgaagggggttacgccagtaatggccaatcccaaaaccaaaccactgcagtggtatcaaaaactcaagtcaccggcaatcttgaattgaatgcgatgggagagttaaaacagcaaggcactcagcatcaggtcaatggtgcttaccaggccaatgccggtagcagcaaaaacctggcgacagaaaatacggaatcaaactccaccaatcagttgcgggtggacggtgaaatcagtggttcagccgattacagtgcaacgactcgtccggcagaaaaaacagccaaagcggtcagtgagaagaaattggatacttccattgccaaaattggcttaccgaatgccggccttgagttagcggccaaaggccgcagccattataccggcaatagccagtcaaacgcagtcgtcacttcaatccaggcgggtaacgtcaaagtcaccactaacggtgatgcttacgatcaaggaacccaatatcaggccaataaaggcgacgtgtcactgacagccggcagtcataccagtgaagccgcctacaatcgtaaagatagccattcttctgacaccacaggcaacgcccgcctgcgcgtttacacctcaactggcagtgatatttccgttaatggcaaaggtgatggcagctatcaggcaacctccaacagcagtgctaacgccgtgaccagcggagtacaggcacaaaacggtattgatatccaagtgaccagagacgcccgttaccaaggcactaccatgaatgcgggcagtggcagtacaaacatcaatgcgaaagaaaatatccagttcgatcaagccaccaaccgcaacgagcaaaaccgtacaggccacaatggagaaatttctctgaccgtgggaaccaacccagatggtaaaaatttcagtgccagcgctggcggtggttataacactgaccagcagaacagcacgacggctcaaaccagtaccctcacaggtgaacagggtgtaaacctgaatgcaggcaataatctggcactgaagggttctgatgtctctggtaagcaagtcgatttaactgcacaacgtgggaaaattgaactgacttccgcccaggacaccgtcaacaacaatggctggaatgttggtctcaagggcaaaggggggatgtccagcaaggcccgtaacaatgaaagcgggggtagcgcaggaagtagcaatgcggcaactgacaattccactgacagtagtgaggctggcaacaaaatcatcgatagcaaatataacattggtggtgaagtgaaattcggtgtcaatcgtctggatacaatgacataccataacggccatgtgtccggcggtaacgtcacgctgaccagcggtggcgatacttcactcaaaggcaccaatattacggccgatcatgtgacaggcaatgtaggtggcaatttcaatgttgaaagcctcaaagacagcactcatagcctgaatgtcggcctggatgctggcttgggttacagcaaaacggtcaaaggagacgataaagctacacttcctgtaccgactgccgatagcagttcatcagaagcagcacctgaaaccacagcagcggatgataaaaaagaggtgccgggactaaaagaccagttgactgccgccttcaaaggttacagcggtaaactgaaaggcaattacgatacgctggacagagaagccattggtgagcagtccaccctgaccggtactcacggcgttaatctggatgtcgcaggaaaaacctatttagtcggcggtaaaattgacagtgcacaagggacggtatcaatgaatacccagcagattggacatcagtctgtgactggatacgataagggtagaaatctcggtgttaatctaccagattccatcgtaggccttaccggtgctgcacaaaaaaacattttttccggaaaaattcctttcgtaaaaaatgagagccacgatacagaaattcctgctacccacagtgggatcaaaggccatcaattaaattaatcagcgtttctttgatttttcctcagtacggtatgccatgcggctaccgtacttctatttcttaatcatttatatatcctttatttatccttgagttctgcccatttaatcactctcttacccactgccacagacctatccgtatctgttgccttttccgttttgcctgttactctttttctacataccgattcagcgcatagagttaacattgtgagtaacatcaggcaagaccagatttaaggggatgtaatgctaagtgatattgaaaagaaggaacgctctaacacggaaaaagacaacacaccgttgcagaaagggctggatggcagtaagaaagcgctttccatgacaattcgcattagtaactatatccgacgcattccctttattgcccatttaatccgaactctccaacgcttcaatgatcggatggggagtcagttcggtgccgccattacctatttttcatttctatctctgatcccaatattgatgctctcttttgccaccgcgggttttgtgttggcatccaatcctgatctgctgacaaggttaatcaatggcattgccaatagcatcagtgacccgtcattggccaatacgctgaaaaacagtgttgataccgcagtgaatcaaagaacgacggttggattgacgggtctggcaatcgcactctattcaggagtgaactgggtaggcaacttacgcgaagccatcctcgcccaatcccgtgatgtctgggaacgtcatcatacagaaaaagaaaaaatctactctcagtatatccgcgattttttctccctattcggtctgctgttcgcattggtgataacgctttcgctgacctctatcgccggatctgctcaggcaaccctcgttcatgcccttggattagaaggtattgaatggctgcgccctgcatggacactgataggcatgaccatttccatttctgccaattatttgttatttctgtggatactgtggatcttgccccggcatcaacctgagcggaaagcgctgtttcagggaacattaatggccgctgttgggtttgaaatcattaaatacattatgacgatcatgctgccaagacttgccagttcgccttctggcgccgccttcggctcggtcattggtttgatggcatttttctatttctttgcccgtctgacactgttttgtgctgcatggatcgccaccgcagagaagcaatcagaataaatccaaacacacccaaaaaggagtcatgtatgccatttgtaaacatcagaatcacccgcgaaggcgcgactgccgagcagaagaagcaattgattgaaggtgcaacccagctgctggtggatgtactgggtaaaaacccggcgacgacgtttgtcattattgatgaagttgaaacggataactggggcattggcggcaaaagtgtaaccgaagtcagggctacggcgaaaaagtagccgatgattgacggatagtttatccatgtaaagggcgaatttgatcgcccttttttggaaaattttactcatttggtactaagtcatgtttaaaccacaatcgaggtttcatgaaggtaacgccataacgcatttccctctttaaattcaatgatgacaacagaccaacgtgcttgttttatgtcattcatgcaatgtgtttccctgtattggcataccaccgtatcgccagtattaacaagtgtcttaattgaatcaatttcaatctttagaccgggtttgttaccgatattctgatgaaacagctcactgacctgaacaaaaaaagcagtatgtccacgagttgtaatcatgctgaattcagggctgaagcaagaaagcagtttttccagagacgcagcacctttttgctgatcattggtaaatacgtcttctatccattggtgaagttccatgatgcttcgatgcgcaattaattctctggcgttgttcatacagtctcccgactcttagccagttggcgcaattttaacaggggcaataaacctgaaattgctgcaataataaacgtgatagagtaagccgttgccggagtggttttatgctgcaatacattaaaaatcatggcaaaaatagtggcgccaatactaaaacatatctggcgattgagattccagatcgtgctggcacgggataaatcttctccttcaaaatccagcatcgccgtagtttgcgcggtatttgcgcctatccccccaccgattcccatcaaaaggtatgccataatcagaagaggctgatcctgaggggtatttacagtagcgagtatggcaattcctgcggcatgtaaaacgagaccggcaaagaacaaacgtaccgaccccaactggttatatattcgaccacagactaatatcgcacagaaggaaccggctgcataaaaaagcatcagtaatccggctttctccgcagaccaattcagttcttgttgtagatagaagatattgagcaggttcactccggtaaatacaccgggtacagcgtaatagacccatattgaaaaacgcatctggatgttggtcagaatgtttaaatcgagtaccggattattgatgcggcggtaatggcgaacataaagtaaagcaaacaaaattcctgtgataaccaatatgtaaggcacgaatttaatgcttgcttcagcatagagcgacaaaccaagcaaaagagaagccagcgacaaacttaccaaaaataggccgctcaaatcaggtttaggagccgttgttttttccgttttaatccagaaaaatgacaatagtgctgcgataagactaaaaggaatattgctgaaaaacacccaatgccaagagaaatgatctacgattatcccccccactcccggagagactgcgggggcgattaatgcgaccgccataataatcattgaaatctttgctctttcgtgttttttaaacagactcaaagtcagggcctgcccgacaggaatcaacaatcctccaccgagaccctgtacaaaacggaatagtgctaggctgagaaaatgcgtcgccatacccgcaaaaaacgcggctattgaaaaaatcaacatggatgcagtcatgatttggcgggtgccaaaccgacttgccaaccagttacttataggaataataagcgttaatcccaatatgtaactattcgcaacccaggttaccgttgattccgaaactgacaaattacgtgcgatatctggtaaagctatagctgacataaaaatgttgatgcagtctataaaaaaaccaaccagaaaaattattgcaatacgataacgataagtcattatgccctccactgcggagtttaggctttcttgacccgttaaaactatgaatataaattgaacattccgtttagctgtaattaaccatgatgaataaccaattaaaccggattcaaacctttatcgctgtagtggattgtggatcattcacacgggcagcagaacggctgttgatcagcaaagcaatgaccagtatccacgttaagcggctggaagagtcattaaacgtaccgttattgattcgtaattccagaggagttgcgctgacggaagcaggtcagcttctttacaatgaatttagtgaaatctttattaatattcagtccagcttagataatgtggctgaacagtatctttcactttctggcaccctacgtatcacatcaacaatcgagttcggtgatcggtttcttcttcctctgattggcgagttctgtaagatacatccacaacttaatatcagctataacgctggctctgctcttaatgaccttatttcagacaggctggatttagccattaggttgggggtattgcgagattcttctcttaaaagtcgtaaaattgctgactataaaatttatctggtggcatcacctgactggcttgaaaaaaataaactggaatcagtcaatgatctcaggggcgttgattggattgccaacagtaatttgcaaacaccgacccactgggaattaagtcaccccgccttaccgtcaattgatatacgtgctaaagccagattcaacaccaactcttcgacatcaataaaaacaatggctattgcagggttcggtgtgactgtcttaccggaatggatgataaaaaccgagctgaaatcaggcaatctagtgcgactttttcctgagtattcactgccaaaacagcctgtaacaatcgtattcccaaatgggcacaaaattcagcgcaaatgcagagtgtttattgattatctggtagagaagatcaagttatgatgtttagctatctcgccgtaaaccctcgcccaattcgggagagagttttacggcgaaagtgagaagcactttaatcaggggttgcctgactctcaatataggcttttaaagtttcgaggattgcgtcgcaatcagcatcacaaggtcaaataacaaccaagctgttgtaaaaacctgaagctactccgctccttttttgatgtcagcagcttgcttggtatcaacggcgggtgcttccggcacaggccccggccgcataatctggttaaaaccgtttctgagctgattcacattaacggccgtttcatcttttggctgcaccagaataaaggagatgtcctgagacaacatctctttcagttttttgttcaaaagctgtggtgtcagagaagataaaaacgtctgtcttaagcgctggaattgctccggtgcaatatctatcacattattctgctgtgaaatcaggcgctggttaatcaatagatcggtatttgtacgggcatagaccgcaaagagctgttgcaattgaagccgtttctgagcatacagttcatcaaattgctcttgtggcagaccattttcacgcaatgatgccagctcagaagccagataaagtgtggattctgtcagcttgtccgaagaagtatccatattcaaaaaacagtttgcccgctggtacaatatgcgacaatccagatctaacttcatgtcagcctgctcttcttcccgtcccaattgcaggtagcgataaagcgcttcacgagccaaatcgtttaaccaatactgaagcagggtctgcgaatcattaatcggttgccagttcaggttccagactaaagacagccgatcttgttgagctttatcactgactacgccaagcgtttctgatttcagcggcaacaacgtcgcaacagctaccggtgtctgccgttttccttttaatggcgaaaacgcctgattaatgcgctctgacagtacccggctgtcaacatgaccagcaacatacagcgtcatcgcatctggcgtgtaccattgccgataaaatgcttcaacttttttgacatctacaggcactgatacgctcgcacccggatcatgatcgagcaatgtcgagccttgcagccgcatccgccacacaggatctcgtatatctgcaggtaaagtcgcgacggaatgatcggtcgctttcatggcctgtgccaaagtctctggcgtaaaaaccgcaccacccgcaatatccgacagccacaccagtgcatctttcagtaaatcagggcggttatttggcaggctgaggctataaagcgtgaaatcatatgaaacaatggcaggaggaaggggatttttgctatcaatcgcgttgcgccacagattttccagtttttgcgatgacaaatctttgctgctgaacaatacgactttgggaatgaggtaggtgtagccttgttgttgcattttctctgccagtgaaccggttttcacgattaaacgcagttgtatcctgtcattgggacgctgtggagtttgcagggcttgccaactgaacccattttcaagtttaccttgttgccaagccggatcaggctgtaaggtctctgcctgtgctaaataagacgtagccagaatggcgccaccaataagatacccgattttcttgccctgcattctcacttacccctacctatttagttttatccttgttatccctggcttcacctgccacagtttaactattcatgccaaaccattaatacccagatagattatctctactaatcaacaaggcttcattttaatcgcagtttctgcttatcaatctgacgattatagcctttaaccagtaaccctaattcatcatcctgatggtttttgggacaaggtatgggcgcagtcggctgttcttcattcagtgcacgcgcaacatcgcgcagtggatggatgataatgcgattcacgcaccagcttatcgccaccgtaagaataagtgcgagtagtaaataggtggtcaacattaatgcaagtgtattcaaggcaaatcggtacactcggttagaatcgacctgcaagatcaggtatccctgtgacgcttcggtttgcgaggtaataccatagatatgcaaagggatctgtacctcaacgggaataccaaaaacctgctttgccaattcgggtatagggcgataagtcgcgaaatccaagctcatcacccgggcattatccggtgataccacatcagcccgccccagcatgcctgatgtttttaacccaatcaacagcgttttcgctttattgagatctgaattcagcagcgcttctgccagaggaacttgaatctgtgcagccgcattattgagctggctgatataatcatctttccgctgctgtaacaggtgtgataactggatagtaatgaaaatggcaatagttatcaaagcgactcctgtcactgcggccatttgtttaatggttaatgaacgtttgacacgcaatttcatcttatccaaaccaatacctgcaaaaaatacgggctatcacaccttaataatgtgactgagtatacttgatttttctagcggtcgtcttattttgatgagttcaaaacagaagaatgaccgcaacatgacgtttatatttaataacgtttgcattatccatatcatatccacgttatatcacggtcaaagacgattatctggctgaattttcgtcctgttcaactgcaaaacaggcgaccaattgctcgtcatattgccttagcttaggctggaattgcgtacaatgaccaaatgcgcgacggcaacgggcggcaaaggcgcaacccggaggcggattcatcgggcttggcaattcccctgtcagcttgatgcgctcacgacgcagtgccggattcaggcgaggtgtcgcagacagcaacgcctgtgtataagggtgacgaggattattgaaaatctggtctttactgcctttttcaacacaacgccccaaatacatcaccatgacttcatcagcgatatgttcaaccaccgagagatcatgagaaataaacacataagacaatcccagatcctgctgtaaatccatcatcaggttcaagacctgcgcccgcaccgaaacatccagcgcagaaaccggttcatcggcaatcaacacatccggatttaacgtcaatccacgggcgatggcaatgcgctgacgctggccgccggagaacatgtgcggataacgctgataatattcaggttttaatcccactttttccatcatctgcaacacttgttccttgcgttccgctgcggtgagcgacgtgttgatcagcaacggttcttccagtatctgccccacttttttgcgcgggttcaaagaggcataagggttttggaagacgatctggattttctggcgccgcagtttttctgcctgtttatctggcaccaataaatcctgtccctgataataaagctcaccctccgtcggtttttcaatcatggtcagcaggcggccaagtgtggatttgccacagccagattctcctaccaccgccagcgtcttgcctttttccagctcaaatgaaacaccatccagcgccttaaccatacgctcaggcgcaaacatccctgtcttcaccggataatatttctttaactcggtggctttgagtaaagggacagtggccttttcctgttcacgcctgttttgattacgaatgttttgctcactcatactgtcggcctcccctcatcatccagcggcatatgacatttaacctgactttccccaaccgttttcaatgctggctctacctgacggcaatgttcattcgcatagggacagcggggattgagcaggcaccctgtcggacggtcatatttgcccggaaccacgccgggcaacgacgccagacgggatttatccgtcgaaaattccggcagtgcctgtaataatgcctgtgtataaggatgacggggcgcacggaagatttcagttgccttgcccgcttccactacctgcccgccatacatcacgatgatatgatgagccgcttccgccactaacgctaagtcatgcgtgatcaagaccagcgccatgttttcctgctgttgcaactccagcagcaattcgatgatttgtgcctgaatggtcacatccagtgccgtcgtaggttcatcggcaatcagcagcttaggacgacaggcaatcgccatagcgatcatgacgcgctggctcatcccaccagacaattggtgtggatagacatccagacgggaagccggatcaggaatacccaccagcgtcaacaaatcaaccgcccgctggtaacgggttttgcggctacccccctgatgtactttaagcgcttctataatctgaaaccccacggtatagcacgggtttaagctggtcatcggatcttggaagatcatagccacttccgcaccgaccaactggcgacgctctttctcagaaatttttgtcagatcacggccatcgaattccagtttttctgccatgaccctgcccggataatcaaccagccccataattgccagtgaactgacggacttacctgagccggattctccaacaaccccgacaacctgtccctgctcaacactgtagctgatacggtcaacagcgcggaatggcgcatcttcttcaccaaagtgcaccgataattgatctacattcaacaatgccatttcaatacccctactgcttgagcttaggatcgagtgcgtcacgcagcccatcccccatcaggttaaatgccaatacggtcagcaggatagccagccccggaaaggtcactacccaccacgcgctttgggcaaactgcaagacatcggccagcatggttccccattctggtgtgggtggctgcgcccccatgcccaaaaaccccaaggcagccatgtcgagaatggcatttgaaaaacccaatgatgcctgcacaatcaagggagcaagacagtttggcaggatattgatgaacatctgacgtatggctcctgcaccagccacttgtgaagccattacataatctcggttcacttcaaccagtaccgccgcccttgtcagacgaatatagtgaggcaaggcgacgaaagtcagtgccagtgaagcattgacaatcgacggaccaaaaatggcaaccagtaccaatgccaatagtaagcttggcaatgccagcatgatatcgacaatacgcatgatgatcgtatcgacaagaccgccgaaataacctgccaatacccccaatatgatgcccatcaccagcgacatcaccacaaccaggcaacccaccagcaaagagaggcgtgcgccatacatcagacgggataaaatgtcgcgccctacatcgtcagtaccaaggataaactgccagcttcctccgtcctgccatatcggtggaaccaacagcgagtcacggaactgctctgccgggccgtggggtgccaacacattcgccaatagcgccaccagcagcatcaggacaatataggcaaagccaacgaccgcgcccttgttacgcttaaagtaatgccaaaactcctgtatcggcgtcatcaatttcggcgcaccagataccgctggctcagtggtttgagtcatcatgtgctccttatttcttatgacggatacgtgggttgacgatgccatacagcaaatcaaccacaaggttgaccagaataatcatggtcgccactagcaatactcccccctgcaccaccggataatcacgacgctgaagggcatcgatcaaccagcgtcccagccccggccatgaaaaaatggtttctgtcagaatggcacctgccagcatgatccccacttgcaggccgatgacagtgacgactggcagcaaggcattacgcagagcatggacaataatgacacgcatacggctcaagccttttgcgcgggcggtacggatatagtcttcccccaacacttccagcattgcggaacgggtcatgcgcacaatcacagccagtgggatcgtccccagcacaaccgcaggcaggatcatatgcattacagcatcgataaaattgccctcttcaccccagaacagagtatcaattagcatgaatcccgtcagcgggtaactatcatcaagaaatacgctgtcgcttattcggccggaaacaggagtcaaattccattgaacggataccagcatgatgagcatgatcccccaccagaaaatcggcatggaatagcccgtcagtgatatcccgacagccgtatgatcaaaaacagatccacgcttgaccgctgccagtacgccaaccggaataccaacagagatcgcaagtaacatggcgcagacccctaactctaatgtcgctttgaatcggggcacaaactcgtcccacacaggaatgcggcttttcagggagatccccaaatcaccatgaaatataccattaatataatgaagatattgctcccagagaggtttatccaaccccatagcagccatcaattcggcatgacgctcagcagaaacaccgcgttctcccgccataatcagcaccggatcgccggggatcatgtgtacaaaagcgaaagtcagcagtgtaataccaataaacgtggggattaccattcccaaacgtcggaggataaattgcagcatatcctgagttctctttttaattaccagttacagctctcaggctgtttggtgtaatacaagggtcaacttgcccatcaaagaagcgaaaccatccccacagaaaaatctgggggatggttaatcacaacaaatcaagagcaggattagtcaagagtcacgttgtaaaagatgtgtttaccaagtggatcaaccaaatagcctttcacttccttacggattggttcataaaccgtggagtgggcaatgatcaatgcgggtacttgctcatgcattacaacctgtgcctgcttgtaaagcgctgtacgtttagccgtgtcagccgtttcacgggctggcttgataacgtcctcaaatggcttgtaacaccatttcgaatagttggaacctttctctttggccgcacaactaaacagagtgccgaaaaagttatctggatcaccgttatcacccgtccatcccatcatcaccgtctgcggttcaccatctttggcgcgtttcaggtattcgccccactcataactgacgatcttggctttgatgccaattttcgcccagtcagcctgaatcatttcggccatacgacgggcattcgggttatacggacgctgcactggcattgcccacagatcagtttcaaaaccattcggaaagccagcttctttcagcagttccttagccttggcgggatcataggcataatccttgatgtcatcgtcatagctccacatggtcggtgggatcaggtttttcgctttctgcccagctccctgatagaccgcatcgatgatggcatctttgttcaccgccatcgccagcgcctgacgaaccttaaggttatccatcggttttttatcgacgttgaaagagagataacccacgttcaggccagcctgctccttcagaacaatatttttgtcctgcttcatacgggaaatgtcggcaggatttggatacggcatgacctgacactcgtttttctgcaattttgcataacgtacagaggcatcaggcgtaatggagaacaccaggcgatcaattttcgccgggccttcccagtaatccttgaatgctttatagagaatgcgggagtctttctggtattgctgcaattggaatgggcctgtgccaatcggattcaggtcaactttctccggtgcccccgccttcatcatcacatcagcgtactctttggacagaaccgaggcaaaatccatcgcaagatcggcaatgaaaggcgcttcaggacgggataacacaaaacggatggtgtaatcatcaactttttctattttgctgatgatgttatccagatccatgccaataaagtattcgtagctgccacctgaaactttgtggtatggatgatttttatctttctgacgcataaaagtaaaaatcacatcatcagcgttgaaatcgcgagttggcttgaattccttattgctatgccatttcacgcccttgcgcaaatagaaagtataggttttgccatcatcactcacatcccagcgctcagccaaactgggaatgacatttgtcgtacctgccttgaaatccaccaaacggttgtagatctgtctggaagtcgcatcataagttgtgccggaagtgaataactgtggattgaagccttctggagaaccctcagagcaataaaccagtgtctttgcctgaacacttgctgttactgctaacgcaacgaggccaatgcccagtttcagtaaactgaactttttcttactggagattgtcattacttaaactccgtttgtgatgtttatcgtgtcttggccaagtccagcgtttccacctaaatgatgccgtcccgacctgcgttattgttgttcgtttatcaattaaccaattgttatgcctgacgtcaacataatcacatataacactagcaacattagaaaaacataaaatcaaaaaataattaacacttacggtgtaaaaatatgacaatcggcacatcaaacagataaaatcactaaaaatagtggatatataaagaattaatttctattggtgataatttgaaatttgtgactgaatacttaaaaaatgaacaatccgccttataaaaaagacggggcaatataagatgcgggtacgggtagaaaagaagaaatgttttaaatttagccaattaatataaaaataatcgtgttactcattaaagcaatactttattgagtaaagttaatttatgaataaagagaaaaataatgaattatcgaatcggggagattcagttcctgagcgaattgccggcggtttcagagataaaatccagatagatgaacaattttatcaaaccgaccgtgatataacgtcgatgtttaatgaatagagatcaaggagtgagttaacgccgagtttttatttagcacatacgaaaaaaccctgctcaaagagcagggtttctgaatgctggtcggcgagagaggattcgaacctccgacccactggtcccaaaccagttgcgctaccaagctgcgctactcgccgaaaacgaagcgcatcttactgccatcgctgtaaaccgt

SEQ ID NO: 16867 - DNA, 46436 bp, Xenorhabdus bovienii
  unsure (1)..(46436): unsure at all n locations
ctcttgcggtcggcaacggagagttacctgtggcaaagtatcgcacggttactactaaataaaaaataaataaggggcaaagagatgctaaccacttacccccaactttgcccaagaacgtgccttgaacatgctgcgtcagaactggaagcaacaccgtactttcatggtgtacagtccaacgggatcaggtaagacaggtttagcggcgttcatcactgacggttacatttctcgtgaaatgcgtgtcatgttctgtgtgccttatacaatcctcgtagaccagacggcggcaaagtttacagagtatggcttgcctgagcgcgaaatcagttacgtctggcgtgaccatccaaactatgacccaacccgactgattcagattgcctcagccaataccattatccgccgtgagtttcccgacaatatcgatttactgattatcgatgaggcgcacttacgccataagcggatgctggaaattatccgtgacagtgactttccggtgatcgggttatcgggcacaccctttgccccgttccttggtcactactacgaaaaactgattaagccgaccacgatgaaagagctgattcaacgtggggatctgagcaagtatgaattctatgcgccaaccaagcccgacttaagcggcgtaaaaagcaatcaaagtgctgaatacggcagtgattacaaagaggcggagattgctgaaatcatgtgcggctctgatctggtcggggatattgtcagcaactggctggcgaatggtaataaccagccaaccatttgtttctgcgtgacggtcagccatgccaactttgtgaccgtggagtttaatcgtgcagggatcaacgccgatatcattacggccgagactccccatgaagaacgccagattatgattcatcgcttcgagcagggtgcgaccaagattttagtgaacgtgggatgtcttttggctgggttcgatagcgatgtccgctgcattatctacgcaagacccacaaagtctgaaattcgatgggctcaggcacggttcaccgccttggctatcccgatgatatcgaatacaacgaactgcccagcaagaatgacggcatgaaaacccgtgacagttaccgggagcaggagaaacgggagaagttaccgaaagagtgttcctcctgccactacatgaagccagcgggggtctatgtctgcccgaagtgtggctttaagccgctgacaggtgaggatgtcgaggtggataccagccgcaatatccagaaactcagcaagaaagagcgcgtctacacgcaggccgaaaagcagagtttttactcgcagttgaagtactaccagaaccagcgcgcctcacagggtaagaccatcagtaacggctgggtatcaaatacctttaaagacaagttcggcgcttatccgcgtggattgcatgacaccccacaagagctaacgcccgaagtaaacaatttcatcaagcacaaacaaattgccttcgcgaagtcccgcaaaaaagcggaacaggtgcaaccgtccagcaacgagcagcaggaaatgcgccttgaggttgctcaccaaaaagtgcgcgatattcgtgaagcattaggcagaccatcacatcagggaggcacactgtgaacagaatcaaaacgaccgaggctgtgattggccactggcctgaaatcttcgcctattacaaattacccccggtgacaggtaagaatcactttaaagggaagtgcccgatatgcgaacggaaaggcaaattccgcattgacgatatgatcctgaaacaggcctgttcacatggataaaaagaaatagcaatagagtgaagattggcgatatagcaggctctgttaatgataatggatacatagatatcaggatacatggatggctgatgagggcgcacaggttagcttggttaacctatttctggaacagactgacaggtgaacaaagatgagcagaggcattcgtaataacaatcccggcaacattgaccacaactcagcgaataagtgcagggtcaattgccccacgacccgaagattgaatctcggttctgtcggtttgaatcaccagagtatggtattcgggcactgatgaagctgttgtgcaattaccataaaaaaggctatcagaccgtcgcgaagatgatagaccgatgggcaccaaatgtggaaaacaacacttcggcttatatcaagggtgtggccaaggcactaggtgtcgatcctcatcaggtgattagtgtcgataaagtgacgttgattgtgttggccaagtcgatcattcagcacgagaacggcaagcaaccgtattcaaatgaagtattcgaaaaagcatttaacttactctgaatcctgagcctcgcaatcgcggggcttctttttatctgcgtactgacgtgcgcgaaatccaatcatgagcttatagaaatagagcctgagagatatcgctaggtggcgacctttcatgaggcgatatttctacgtcagcaggctcttatttctataggaatacgcaatatgcacacaatcacagtccccttttatgatgatgaactttatgtcgtggaatacaacaatgaaccgaagtattgtcacggcatcaacatatcctgcaacaccgcggttggtcgcatgtccagttgcgtcagggggatgccctcaatttgggcacactcgcgcctgacgcttacgatactgttgtcattaactcggtggttcagtatctggataaagtgcttgcccagttactgccggcgattgccgcaggaggaacaattttgctgggggatatccgcaacttagatttgttaacggcacatgtgacggcgatagaacaaagccatctgggcgaacagcgtatttccgtgggaacgatggcaaaccgtattcagcgacgtttgcaacaagaagaagagttcctgctcagtccaacttattttgcccaattatctgcccgttatccggagattggccgagtggatattctggttaagcggggcgtcggtgacaatgaaatgctatgttatcgttatgaggtcatcttacataaacgagataaaaatgcagcgtcatgtcacgatcaactcataacttggtttgatttcaatgccattgaagaggtgagcagtctgttgcaagcggggacatacgatacctttggtatttcaggcattcccaacacccgtgttaaagatgacgttgaattggcagaagggctacgccattggccagccaaccaaatactctttccaccagaatatgccggaaaattttctccccaggcagaaaaacaggttcaagcatttgaatccctgtttcaatatgcggagcagtgcggttatcaatgtggcgtgacgtggtcacaacagcaacttgacctgctggatgttattttcagccgccactcattgcctcctgtacaggcccgtcatgaatataaccaaacccatttagccaattatccgcaaatctctgccattgggggtgaactttcagagttactggaaacggccctgaaaaaaacaattacctgaatatatggttcccagtatttatatcccaatggagcgcatgccactctcattgaacaataaaatagataaaaaagcgctgcctgttccaaatgacaatgatttgcaccatcaaacttatgtcgcaccaagagatgaaattgagaaaaaactctgtcagttgtggcaaaaccatctgaaaatcaaccaagttggtatttatgataatttcttctcactcggtggtcattcgctcttggcagtgaaaataacgacttccataaaaaatgatttaagtaacaattttagtatgaatcaaatgtttacaaatccaactattgcacagattgccagtgtgattcgtagcgctcaaggccatgacatatctacactattgccaatacagaatgtattcgacggaagaataccgatttcttattaccaaaagatgttctggtctctgatcaaagaggaagcattggacgatgcctttaatgtccccatttccttgttgatagagggggaactaaatcaaagtgcattggaaaaaagtttgcacgttattttagaacggcatgaaagtttacgattaagattttatgaagaagatgagcaggttttcataaaacctaataacaacatgagaataaatttacaaattatcgattcgttgccaaaaggaatagaaaaagaacaaattaccattgaaattaacaaactctgggaagaggagttaaggataccttttgatgtttacaatggcccattattcaagacatttttgctacctgtatcaaaaacacgccatgttttattaattaatattcatcatattattttcgatggatggtctatcaatatttttataaatgagtttaagaaattgtatacggcttactcacaggagcaagatgttattcttccggcagttgcaatgcaatattctgattgtgtttatgatttacaggagcgtcataaaactgagaaatatcaaaatcaactaaaattctggcaacaacaatttgctgatcttgatatgaatgaacgtatttttccagtggctttcagcaaacatctaaccactaagtatcaatttaaagttatcagtatcaatacacctaaatcactggataatgctgtttcgcgatattgtgaaatccataagatcacgccttacatgctatatatggctttattccacgcttgtctttttatgtattctggtgaatcacaacatatagccacatcaccacaagctgatcgttctcatattgacagccatcaaacaataggactgtttttgaatgacctgatagtaaaatcaactatcagcaaagagatgagccttcatgacatcattcagcaaatcagtaattttatttataaagcgctagaaaattcagatgtccatatggcagcggtgattgacagtataggggaaaaggcgagggataatatatttaatattctatttaactatatggatgcccataatttttataactatgcagatagtcccgatagcggaaaaatatcgctgccaaatctcgatatggaattgataaaagttgatccgactccttttcagtcacttgggataaatttcataaatataccacaaaatattatgtgtgaattaagctataacccagagctgtatactgaagaaacagccaataatcttgtgaggtattatgaaagattgctggaagcctttgtatctggtcaagataaagagaatatcagttatttttatgactaaattcatttaagaaataatcagttaatgaatgaagagtcaggcctcatggatgaggccaattatcgttaatcgctgtcaatttactgacgtggccaacaaagcggcaacttgaaagacgaaggatatagaaaataatttttatgacttcattattaatcaggtagttcaggcggctaaagcctgaactaccctgcaaatcacggaacgatagcaaacgaacgcactggaaagcctgacacgtttttaggtttagccacgatattgagaatcactgcaccacgcacagggacttgatccaggttagccaacagctctatttggtaggtatcttgtgctaatacataatattcaccaattaaagcattattctgcctgaaatctttggctgagtcggtatcgaaggtttcatggccgatggctttgatatgacgttcttcaaataaaaatttcagggcatccaatccccagcccggtgtttggttattaccttgatcatctttattatccatcttttcctgagatggccaacgtttactccagtcggttctgagggcaataaaagtatctgcttcaatcattccatgttcggcttcaaattgaagaatgtcatctttggaaagcgagaagttaggattgtgttttgctctttctgattggtcaataacgattaagggtaaaaccagttcttttaattccaattcatcaagagaacgggcatcagagacaaaatggcagggagcatcaaggtgagtgccatattgacctgggaatgtcaattgttggacaaaaaatccatttttataattaaaaatagttttaaattcggcgggttgaaacatgaaaaaatggggtgaacattcatcaaaactatgcgttagatctatccattttttcgatttcaacaaagtcagtgcttgcaagatgtcgtgtgtcataacaacctcattttttattgtatatccttcatttctcaatttactactttgttggctgcaatttgaaatttacggggtatcgtcttttggataactatttggagttatatcaaaataagtgggttctgttaatgaacattcagccgctgatataattgacgaggtaataagcgtcatgggaggtacttgattatcgataaaaggaatgattatttttgtcgtttggctatataactgtccccattctgaaaatgttatcggtaactcttcttttttcagtttatgcctggcgattaaagttgataccgcccggtgtttatcgagtcggttatttttttcaaccgctttttctattactttataggctacccacgattcttttttagcacaataatccagatcttcgtctactaatgaaaaacccattcgggggatgaataacatcgcaaagacgatgactttattgatattattcccctgcataatttcctctttaagcaaagataaaatatgatgattttatcttctatcaatgaggtaaaaaagccgttatgaacattatttagttaattttttgttaaataattttgtataagttttcttgattgtttgaaaattatgaataaaataaagtgcctaattagattaaccaaaaaagcgatggtgactaaatgacaccacctgaagtgaaaacaaataaatgacaccaccatttagtgttatttttaataaaagcacatggcgtcgttgttgtatttattttggctctgtagtcgttaactccatttcatagtcgctgacagggaactgcccataagtatcatgtaatagttgcttgcagctttcttgtttaatcaggtcgctaagttcatctaatcgtttttgcaacaatcgcttcgtttctttctcattatccaagacagtttgtaaaatttgggttaatttttgctgtaatgaaagtggggcgtctgagttttctgataatagggtaaccacttcaactgccttcagataagtgatttccatatcaacaagttcatcccactgttcatttttagctaaatcaagcatttgctcacttaaactaaggatccgctggtaagctgacaaaagatccagatcatttttcattaaacaatatcctgactggcgttgtaatgaggacctatttgccgccaagaatctgaaatctcggtaagtaaatcaatcacttcggtaatggccttctcatcattgcgtaaattagcatggagtaaacgacgattcatataatcatataaagcaaacagattctgagcaatctctccgcctttttcgaaatctaatccctctttgagaccattatcaatgatattgattgccttggaaatagctaaacctttctctgggatattgccctgttgcatcagaataattgcacgacgtagggcgctaagcgccccattgaacaatatctgaatcaactgatagggagaggcattcataatttcgctctcaagatctacctgagcgtataactggcttgccgaacgttgatacataatgtccttttattatcttaaaagctggaatagggatgaacttgtgctcttcaatgaattaacaagtttatccagttctgtaaattgacgtttatagcgttctattgttgcatcaatatttttattggtctgttccacttgtctttcaagtgtttttagacgcttgttgatgccttcggtcgctgtggcgatagtcccttcgtgactatccagcgtttgctttaatatattataagtttgggttgcgaaaccggttttttcaccatcacccatgaagaaagccttaacgttggcaggtttctctttcaggtttttttccagtttttcgttgctgatttccagagtgccgtctaatttttgtttgatacccaatttattcagggtagcaatatcagcaacatcctgtggtgagaagatctggtgtctcaattggctttgaatactttttaaggtgccgtcaccgagcagggcgccattgtctttggaagcggattcacctttggctacaggcttgaatttggtcagtgattcgaaagtcgtctgtaccccattataggcctcaacccactttttaatcgcttctttcgttggctcaatatcacgggaaactaccagtgtttcgggtttggacatcttcccgtcttcacttttttcggagagttttttcagatttagggtaatgccttctggtgcatcttttatttcattggtctgacgttcaatatcaatgccgttgacctttaattttgcatttgcggcttctactgtttgcttcattgcaccagagccacttttaggggtactttcgctaccagacgtgtaatcagacgtataattcagcaaattacccagtttgtcatcaccttcaactttaattgtcatgacggactgtattcctgcttttttcgacgtcaggatcaggtagtttttattctcgcctttatcgtctttattatcggttgctttgatgatgctggcattaacgttgccttcctgtttattgatcgcatcacggatttcaatcagagacgtttcatcatctttcagggaaatgcgtagcggcttttcttcacctggctgggtgatgacaatggtacgggttttcccttcgcccagtatatctccttgcggggatttcacattggaaaccgcagtggattgtagggactgtgccttagcaagctgattgatttcaataatgtagttacccggactagccttggaatccgtagttggggtaaatgttttatggtcttcgctgactttggtggtattgagcttatcgaattttttcagttcttcggatgcgcttttaagtttctctaaactgccttttaatgtgccaaaaccggttaatttggctttatagctggtttgctgctgtgctaatggttctaaacgttttctttctgctgcctgaagtttatccagtatagaacctaaatccatcccggatccggctcctaatgaagaaatgctagccatgttgactcctttattagtaaagcatcactgggtatgttatcggattaatttgcgaaaagtttactgacaaaatgatttttttgatggacggaataattgatgagaacaggcgctgtttgggttatcggcgaataaagagaaaaaaaaagaaaaagtttttcaagaaaaattaaaggttctttttaaggagccgataaaactgttggcggtgatgaacaccgtgggcgaaaaagctcaaactaattatatcgacttgattttaaaaaggaactctactatggcatcagttattaataccaactattcatctctgctggctcagaacaacctgaccaagtctcaaggcactttaggtacggctattgagcgtctgtcctctggtttacgtattaacagcgcgaaggatgacgctgctggtcaagcgatcgctaaccgttttactgcgaacgttaaaggtctgactcaggcttcccgtaacgcaaacgacggtatctctattgcccaaactaccgaaggttctctgaacgaaatcaacaacaacctgcaacgtattcgtgaactggctgttcaggcccaaaacggcactaactctgaaagtgaccggaaatccattcaggaagaagtcactaagcgtctggatgaaatcgatcgtatttctgcacaaactcagtttaatggtgtaaaagtattaagcaaagatactactctgaacattcaggttggtgctaacgatggtgaaaaaatcgctatcgacctgcaaagaattgataaggaaacattaaagctgggtgattttagcgttgaattacaacgaactgatgcggaaaaaaaggaaattacagcagctgaaggtaaagtaaaaacggctgaagaggccgcgaaaaaagcaacaggtgctgcaaaaactgcggcagaagcaacgcttaaaacagagcaagcagctcttgaaaaagcaaaagaaacaggggcactaccagcagatacattggttaaattagatggcgctttgtctaaagttgacagcctgcgcagctccctaggtgcagttcaaaaccgtctggaatccactgttaacaacctgaacaacacggttaacaacctgagtgcagcgaagagtcgtatcgaagacgctgactacgcaactgaagtttccaacatgagccgtggccagatcctgcaacaggcaggtacttctgttctggctcaggctaaccaggttccacaatctgttctgtctctgctgcgttaatttttattttccagttgagagtttatgcaggacaccccgcataaataacctctataaaataaggatcggcttgccgatccttattttttaacctttgtcagggacagactgaaacttgcaatgcatttgggcggacgacaaaaaaatttcgcataggtgaaaaagaagcgcttttacttcattgttcaaacgattgtaccgattaggtgattggataatggtagccagtctcttatccaaaggtgtctgttgttgtgagcgatttgtataccgccgaaggcgtgatggacaaaaatagcctctggaagcgctatgtaccactagttcgccatgaagcattgaggctacaggtgaggctgcctgccagcgtggagcttgacgacctgcttcaggctggtggcataggtttactgaatgcggtggaacgttttgattccttgcagggaaccgcgtttaccacctatgcggtacagcgcatcagaggtgcaatgttggatgagttgaggagccgtgattgggctccgcgtagtgtgcggcgtaatgcacgtgaagtcacgcagaccatccgtaaacttgagcaagagttaggccgcccagctagtgagcaggaagttgctaaagaattaaagattaatctgatagaatatcggcaaatactgttagacacaaataacagtcaactgttttcttatgacgagtggcacgaaattcatggtgaaagctgtgaaccagtgattgaggaagagcatgagacaaatcctctccaacaattgctggaaggtgatcttcgtcagcgggttatcgatgttattgaatcgctgcctgaacgggaaaaaatggttctgacgctgtactatcaggaagaactgaatcttaaagagattggcgcggtacttaatgtgggtgaatcccgcgtgagtcagctccacagccaggcaataaaacggctgagggcgcgtttgaatccagaaaagtaactttttgcttatttgttttttgttaagttaagactacacacagggctttatctcttatgtctgttacaacacaaaagaaacggcctctcagccgttatatcaaggactataaacatagtcagactcattgtttgcactgtcataaaacccttgaccgtatttctctcgtttttaacggtcaggtaatcaacaaggaagctatctctgagatgactgaattagttgatgacaaaacatgggatgagttacagggtaaatttgtggcgctgtgccgcttctgtagcgaaatttattgcaatagccaaactgattatttcgacattatgtcatttaaacagtatctgtttgagcaaacagagatgagccatagcactgtgcgcgaatatgtggttcgtttgcggcgattggatgaattactaacatcaagcaattacccagcacaagagtttacgccggaaaaaattcaggaaaaactcagtgagaaattgtctcagtctgctttcagtaattacaatatcgcgctgcgtaaatatgagcaatatctgagctggcaacagaacgggcattgattaattacgcagagatataacgttatcagactgcacgattctagaggggaatgcgataataacgcattcccccctatattttaattatatatttattagttatatatttataaccaaatcatcctatccaattgtcattaaactggcattaccccctgcggcggcagtattaatacttaatgagcgttcatgcaatagacgttccagtagcaggtttgtttcaccacgggcaaaaccctgtaccgaaacaatcggcccttggcgttgagcgatgataccgcagacatgacgcagctggtcgcaatcaccgtgataaataacggcttccatctcagtctcttcattctgccaatcattgatcagacgaatggagtggcgaacctcatccggtaactgacgcagcaattgctgatgtaactcgtccttctcccagatggcctgacagccgacagacaacacggcagacaattgtaccaacgtatcttgctcattatcggccagacacaaagtttcaccgcgtggtaagagggtataagtgttgcgttcccctgtcggccccggcagtaagcgaatggtcccgccctgagtcaacaggctgtattcctgaattactttgctcagagcttcgttattttgtgccgtcgcccattcagccaatttgttgaaaggagagcgcagggcgacacgcacgttggcatcaagctgatattcctcatcctgacgctccagcgtctggctggcagcattgactggacgctgtgataacagacgatacagataaagcggcccgccggcttttggcccggttcctgacagaccttcgccaccaaatggttgtacgccgacgacagcaccgaccatattgcggttgacatacaagttgcccactttggctttggccgtgacttgcgcgatggtttcatcaatgcgcgtatgaatacccaacgttaatccgtaaccggaagcgttgatttgttccagcagcttatccagctcattgcggttaaaacgcactacatgcagcacagggccgaaaatttctttcttcaattcatcgaaactttccagctcaatcagcgtgggtttgacaaacgtgccttgtgaagattcctgactgtcggcttcattttcatgtaccgcttgataaaccgccctgcctttggtgcgcatggtctggatatggcgctcaatgccagcctgcgcttcggcatcaatcactgggccgatatccgttgataagtgttcaggattcgccatccggcactcggccatggcccctttcagcatagtaagggttctttctgccacatcttcttgtacgcacagaatacgcagagcggaacaacgctgacccgcactgtcaaaggccgacgcgaccacatcggtgacaacttgttccgtcagtgccgaggaatcgacaatcatggcattcaggccgcccgtctctgcgatcagtggcgttgggcgcccctgtgcatcaagacggccggcaatattgcgctgcaacaggttggcaacttcagtggagcctgtaaacatcacgccacgcacacgctcatcaccaaccaacaaagccccgacagtttccccttgacccggcagcaattgcagcacatcacgcgggatacctgcctgatgcagcattttgactgcaacagcagcaattaacggcgtctgttccgcgggttttgccaagacactattacctgccgccaatgctgcggcgatctggccagtgaaaatcgccattgggaagttccacggactgatacagactactggccccaatgggcgatgggtatcattggcgaaatcctgccgaacttgatccgcgtaataatagagaaaatcaacagcttcacgcacttcagcgatggcattgttgaaggttttaccggattcacgaaccagaataccgagcagagattgcaggttattttccatcaattctgccgctcgtactaaaatcgcggcgcgctctgagggaggagttgcaaaccaaatagtgcctgcgtcggtggcaacgtccagagcgtggctgacttcttgctcagtagcctcacggacatagcccacgatatcggaaggccgagcaggattattgacgggtttagctgtcggcaattcgccggtatgcgcataatcaccacccagcagcggcacgctgttccatgtttccatcgaagaactcagtaatgcactggagagtgaagccaaacggtgttcattcgacagatccagccccgaggaattgacgcggttcttgccgtataaatcatgtggtagtggaattttcggatgtggcagaccaatttgtccttcagattgtgcgagttcctgaactaccgtcaccggatcagcaacaagttcatcaagaggcagggaagtatctgcaatgcgattaacgaacgaagtatttgcgccattttccaacagacggcgaaccaagtaagccaatagtgtttcatgtgtcccgactggcgcataaatgcgacatgggcggttaagtttgccatcggcaattttaccgacaacctgctcatacagtggttcacccatgccgtgcagacactggaactcatattgtcccggatagtaattttgcccagccagatggtaaaccgcagatagagtatgcgcgttgtgggtagcaaactgtggatagatcagattggggacggaaagcagtttacgggcgcaggcgaggtaagaaacgtcggtatacactttgcgggtatacaccggatagccttccagaccatcgatctgggcgcgtttgatttcactatcccaataagcccctttcaccagacggatcatcaagcgatggcggctgcgctgcgccagatcgataatgctgtcaatcacaaaaggacagcgcttctggtaagtctgaataacaaaaccgataccgttccagccttccagttttggttcaaaacacaatttttccagcaaatcgagggaaatttccagacgatccgcttcttcggcatcgatattgataccgatgtcatattgacgagcctgtaaagtcagagaaagcaggcgcggataaagttcatccatgacgcgctcatattgggctcggctataacgtggatgcaaggctgatagcttgatggagatgcccggcccttcataaataccgcggccgtttgatgctttgccaatggcgtggatcgcctgttgataagaaaccatatatgcctgcgcatcttcttctgtcagcgcagcttcacccagcatgtcataggaataacggaagcctttctcttccagcttgcgggcgttagcaagggcttgggcgatggtttcacctgtgacaaattgttctcccatcaggcgcattgccatatcaacacccttgcgcaccaatggttcaccgctcttgctgataatacggttcaaggatttggataatttggcttcattatgggtagataccaacttgcccgtgaacagcaggccccaagtcgcggcattgacgaacatagatgcgctttggccaagatgagaatgccagttaccgttgctgattttgtcacggatcagcgcatcacgggtcgctttgtcgggaatacgcagcagggcttcggcaaggcacatcaacgcaacgccttcctgtgaagaaagggagaattcttgcagtaacccttgcactaaaccggagcggccaatgccatgtttttgctggcgtagtttttcagcgatggagtaagcgagtttgtgggtcgctttggcttgttcttctgataattgagcgcgttgcagcagcatgggaactgcctgcgtttcgggcaggcgatacgctgaagtaattgcagaacgtttcaccgattggggcaaaatatgctcggcaaaatctaaaaatggttgataaggcgcctcaatctgtgattcttcttcggaaatcttttcttctttgttatcctgaaacactgatatttctgggatcttttcctcattttccaggcgttcaagataattaaaaatggcttgcttaatcagccagtgtggtgtgcgttcaattcgttgtgcagcagattttatacgattacgcgttgcttcatcgagcttcacgcccatagtggtactacccattctcactccttaataggtaagacttaaccaagttacataacaatatctgtcatgttgcaactttgtgcaaccatgttaaaagcggccgttctaaatttgtgaaactaatcttgttttgattacttgtctggtaaatatcatgacttgttagtatttatttgattgatatttaatggtttttattgttgtaattgtggaggtgtaactgattctttaatgaaaggtacaacttctgaagtgataaatgtgacttagcgagcgtttctaataaaaaacatcgttaattagttgttaaaaatgtttgagctaatctaggatagaaagtgattttaaaataattacaaacataaattatacataccgaaattaatgccactttaggtgaaatgatcttcaggtacaacctggtaggcaaatgccttgtactgcaaatatattgcactgaaaacatatcatgttgaacaagggtggctttaagtacagataacattatttacgcaaataacacgatttgcagaaacactatggagaagaacctgcatgacagtaaattcaccaatgctaataactttcattgtctacatttccgcgatgctggtgataggcttcatagcttatcgttccaccaaaaattttgatgactatatattgggtgggcggcgattgggcagtgtggtaacagcattatctgctggcgcttctgatatgagtggctggttattgatgggattgccgggcttaatttttctatcaggcatttcaggtagttggatcgcactcggctgtttgatgggcgcttatttgaactggcgctgggttgccggtcgattgcgcgtgcatactgaagcgaataacaacgcgttaaccttaccggattatttcacccaccgttttgaagacagcagtaaaatcctgcgtatcatctcagcgctggttatcctgattttctttaccatttattgtgcatcaggtgtcgttgctggtggtctgttatttgagagcacttttggtatgagttatgaaaaagcaatatggcttggagcgctggcgactattggctataccttcctcggtggttttttggcagtaagctggacggataccgttcaggcaaccctgatgatttttgccctgattttggtgcccgtactaattttgctcaatgttggtgggtttgagaatgctatcgcggttattgaagcaaaacatacctcttatctggatatgttcaacgggttaaatgttatcgccattatctcgttattgggatggggatttggttatttcggccagcctcacatccttgcgcgttttatggctgcggattctcaccaaaccattcacaaagcccgtcgtatcagtatgacgtggatgtttctgtgccttgctggaaccgtagctgttggtttctttggcattgcctattttgagctgtatccagagcaggcggctcccgtattacaaaagaacgaacgtatctttatcgagttaggtactctgctgttcaatccgtggattaccggtatcttgctgtcggcagtattggcggcagtgatgagtactttgagctgccagttattggtttgttctagtgcgttgacggaagatctctataaagcctttgtgcgcactaaagccagtcagaatgagttggtatgggttggccgtttgatggtgttgctggtggctgctattgcgattgtcattgcaactaatccgaacaataaagtgctggctctggcaagtaatgcatgggctgggtttggtgcggcatttggccctgtagtcctgatttcggtactttggaaacgcatgacgcgcaatggtgcattgatcggtatgctggtgggagcgattacggtattggtatggatgcagtacaagtggttcgggctgtatgaaattattccaggttttatctttgcttctattgccattattggtgttagcctgttagggaaagcgccaagtcaggcaactcaacagcgttttgatgaggcggaagcccattatagaactaaataaaaaaaatagactgtgataaaaagcctctgattgttcaggggctctttaatttagctgcttagttccatctcagtactccattaacggtgaagcaataaagaatcaaaaatattttgagtgatttcatcagagggagagcgatatgaagattaagaatattatatctggaatgatcttagcagtattattttttaagttcataacccgttttggcagagcagcgaataacttggggtattccttaatggggtgcggaatgacggatataagaaagtaaccagagtatttttcctgatttaaatttatccggtagtggtataaatagataataaagattattgattttttctttttatttcataaagtgataattactaaccgtcattccgcacctcattcctgatttaaaaatcatgtgatttgccgcacgctttgttgatttactcctcaaatcagattgacggcaatcttcggttttgatctattacttctatttaccggaagcccaacatgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgagaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaaggcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattaggctgcgtcccttaattagataaccgcctgtaaaagagtcgaatacagcctaatttcaccctggacaaatagtttcgagcggttttttcgtaacgggttgcgatacgccgatttcctttaagaaaaccgaaacaacgttcgacaacattacggtcacgataagcctgctcatcaaattgtgtgcgaccatcagtactgcctttttcattgattttatacggaataatgctctttatccgcaacttacgcagataaccgcggagttttccgcccgaatagcctttatctgccagcaccgctttgccgcgccgtttcatgaaaccatttttgcgctgtataccaatgccgtcgagcaaagggatggcggatcgactttcgtgggcttgccccgccgtcaaaagcaggttgaggggaaaaccccgtctgtcggttgccagatggattttggtgccataaccaccgcgtgagcgacccagcgcatgatcgtcagcgatatcgggaggggttttttcgcgcctgcggcatctttactcgcgcgaatattgctgccatccaggcaaatttcagcccagtcaatcaagcctttttcatccagaatggacagtaaccggttaaatatcttgttgataatgcccgattttgacccgcggttaaatcggttatagaccgttttccaaggaccatagcgttcaggtaaatcacgccacggtgccccagagcacaagacccagaacatcccattcatcactcggcggtgttcaacatgtggacgtcctgcccgctctgaatggaccggaggtaaacaaggttctatcactatccatgcgtcatcaggaatgtcgtagcgtgccatcatctttttcccgtattgaaaacaagttagatgataatactatcaatttacattaagggacacagcctagtactttcgagtttcaggaacaccgtatggtgacgggaatacaggtgtatcaaaatgaactgctgaaaatattggggcaaccctatgaatcattttattcctgaaagtggtgcggaatgtcggttactaattgtttcatctatgcatttaatcaatagctctgcatccggtatgcggccttatttttcaataacataccttttagtgcaatttatagatatcttgcaaaataatgatcagagcaggaaaaatctaggattaagtaaccatttatactatttccctgaggtatcctaaaaaaactaaggagctacgaaattaacgtaactccttgataaatctggtgggtcgtgggaggctcgaactcccgaccaattgattaagagtttacctatctattaataactaattgattttaattgataaattagcattcacacaatcaaaaagtgccacatagtgacatatcgatgacacgctggtgacacagtagtacgccacaaaaatgacacgcactcccaatttcaataatgaggtaggggaggggcatcaagcccctgtcattacttcggcggctccggccatttgacatcgggggcggtagtgcaatccacccgattgagcagcacccggtatttacgccaagcggttaatgcggatttctcggcatcggtggcgatattcaaatcaacggcgtcctgtaatggcgctattttatctcgcgcctcagtcatcagattctgtttttgatattccgcctcagaaatctgccattgttttaatttaggtttatctgcaacccatttttccccatcccaattatacgcctgttttggttcgggtgattttgggatacagatgtagtctccattatcaataataaattgataggcggtgagattgtcaaattgctcctgagtgactgttactgcataaacggcatctgccaaccctttggctgcaaccgcgtctaacaaatatgtccaatctggattttttctgttcacatacactattggcatgattacacctcgatatatcgaaaaccaatgcgacaggtattacccccatcgcgccattcagccccacaaataacaatgtttttcagattactgatggtggataacgcggcggtaatcgatggcagcgtcccattcagacaagccgcgctgagataaatacatcatccattcatcggtgcgtttacctagggcgttaaatcactccatcggcggttttccggctgtgcggtctacggttactccccatccgcgcaggatatcggggaacatttctaattcacctgttttcgcatcgttagcgaatattttataatcaggtttattgatgattgacattgataatcctcgtaaatttaccatccccaaaaccaaatgagcgtgtatcactcgcccagccaaacggacggtcactgttaacaacaacgaactggtatttaacgccgacaggtctactcaaaatatcgagtttcagaatggcgtgtaatcgaaatggggtcaggtaatcagcagggacaatcacattcatggtcatgtcatagttatcgatgacaaatgaatattcccctaataggtgttttagtgaatgagtaattccctcaatagtgggtttctgaaagttcttgatgatttttgctctgataaagaacctgaaatcggaatcatccagtttgacggatttttgcagcgagtcgccgtatcgataaaacagaccgtcgttaaatcccaacgccccgctgatacccagccagccgaaatagtcttttggtacaaatgacttcattgtccggccaataccaatgtgtcggcctatcaaatccagtccgtagccaactgatttatcgatgttgagtatttcgggaagctgcaataccgtctcaaatattgttttggtctcagaaagcaaaagcccaacggtttgctgggctttgggttttcctctgtaaagcagtacctacaatgaatgccccgcccgtgtggggagtccctacccaaagtgatttttggggcgtggttagcagagtctaaggatagacacagagtcgctgtaaagtttgcgcatatcttttagtgacgcgcaaatttcaaacagcccctcagttcattaactacgccccaaaacttactaattgagggtaatcaaatggaaagtatcactattctacctaaaggcggtcggttgagttccaaaatgtgccgctatctggaacgtggcgatctagtgactcatcactgtttagaagaacacattcgccagtccgaagtaaaagcgcttgaaaatatcatcgatgaggcattcggggtagaaaccgaaccacgcaaagtgctggtactcaagcgtaagccacaaaatgatggcgttaatgtaatagccaatctgattgttcaggctaaggggctttctaatgagtcacaagaagacagcttcaataactgctgcttaccacatgtagctctttactcaaccaagcaaagagctagcaatcggatactggagtcaggcggggttacggcgagagggtgatattcactttcttgtttttttcagataatcaattaatagcggtgggatataaattacagcaaagacaatagggattgagaaaataatatcagttacaaagttcggcaaaaagtccggggcatgttcacggaaccacaatttgagtgaattaggataaaacacaattaccggaatgtagccccattttacccagacattattcttaatcttttcacgaaaccagccgacaacctttctccgaaaatttctatccatagattaaattttattctcattattgtagggaatttattctaaccgattttgttgctggggagtagcagaaccacctcgcctgatgtggttaaaagcaggcacatcaaatcaacaacagtaacagcgagggtgtgaagatggcattagaccacggaattttaaatattccactccataaacgttcaaatatcgacagggacattgataaatggaaagcggaacagaccaaggaaaagagcaagcggctggatgaaattaactatcaacgcgaacaggaacggaaagaagctgagcggttatttaaattggttgatagaaagctgatgtgggcggaggctacccgcctagcatgaataacgataaaaggggcttttcgagaatttcacttttatcagttctttgatttgaatgataaaaagctccaaactccagcgagaacgcaggtagccaaattgttgtggtgaatgttggaccaaaaaagacagcaaagggaacagtgacgttaaattccatgttgcgggtctgccagcgggtaggcttttgagcccttctaatccatataacgtcaaccagtttatccaacgattgaccgaagagcgcgctgcacaaagggttctggcgacataagagacggacatcccctgatggagcatcaacagggccatcagtctgcgtgcataatttttatctcgggttgtttggataatttttttcatctggcgacgttcatttcgggatatgggtgctatgatcggcataactcagtccggttagtgatttgttttgatttggcgattaatcagatcgcgaaaatcggactgagttcccttcaagtgatctattattttgaaattttatttaggctatcaatagattgaaatgtcagcatcttgcttttcaattgaaatccttctgttaatacctcggctgtctatgtcacaatgatagcttaaacacagcctgagggaattaagtccatgctccatgctgtgagaataaatgggatacaattatggaagaaaaaatacaatctacccacacacctgaaactgaaggctcgcatctacagagaagtctcaccaatcgacatatacagcttatcgcaattggtggcgctatagggactggcctgtttatgggatcaggcaagaccatctcccttgcggggccatcgatcatctttgtatatatgatcatcggatttatgctgttttttgttatgcgcgcaatgggcgagttattactctccaatttgcactataagtcgttcagtgattttgcggcggacttgttagggccgtgggccggtttttttgtgggctggacttactggttttgctgggtcattactggcgttgctgatgttgtcgcgattacctcttatgtcagttattggacgcctgactttcctgagtgggcaacttcgctcttgtgcgtttttatattgctgacattgaatctcgcgacggtaaaattgtttggagagctggaattctggtttgccatgatcaaaatcgttgcgattgttgctctgattgtcataggcggtattttgattggcacccattttcaatctcctgcgggacacactgctgcattatccaatgtctggaatgatggtggcatgttcccaatggggctgagtgggttttttgccggattccagattgcgatatttgcttttgtcggtattgaattggtgggaaccgccgccgcagaaaccaaagatccgatgaaatccctgccaaaagcaattaatgccattccaatccggattatcacattctatgtgctggctctgattgtgattatgtcagtcacgccatggcgctcaattgttgcggataaaagtccgtttgtggagctgtttgttctgattgggttaccggctgcggccagcattgtgaattttgtggtgctgacttctgcggcatcttcggcaaacagtggggttttttctactagccggatgttatttggtttggcgaaagaaggggatgcaccgaagcagtttagtcgtttatctcgccgttcggttcctgcatcgggattgatctttacctgcttatgcctctcttgcggcgtcattctgatttattttattcctgatgtgatgcgggtctttacactggtgacaaccgtttctgctactctgttcatgtttatttggagcatgattttgtgttcctacctggtttatcggaaacgccgccctgcgttgcataaggcatcgatttataaaatgccttttggcatcgttatgtcatggctgtgtttggctttctttgcctttgtactggtattactgtccttgcagccagatactcgacaggcattaatcgccacaccagtctggttcattattttagtgatcgggtttcaaattgtgaaaaaacgcagaactcgcctttatcgctgagtaaggatcaatcctaattaatcaatggcccgaattcagggccatttttttacctacggcgtgatattgccgagcggctgggccgccatgattgttccctgatggaacctaagttgccatgtaccggatacagataattgccaaatagatgaacgaagcgctttattgaatggatggtctgatttatttatttcgtaggattgataggtaatcagtgcaatattttcatccagccatttgatgttaaaatcttgcgaaaatattggcgagaccattttaaattctgtcgttaattcatcgattacgatttttttagaataaacataacccgattttgcgatttctagaaaatcatcatgcaagatagtgttcagccaatcgatattttttcttttttctttatgcaagctgatttcgagatttttgagtaattcaaaaatagctgaatttttctgatgcatatacggctcctagaatagacaggtatgtaaaaataatcttgacgatacttttgttattatttaaataaatttcaaacattctatttacatttatttttttatcaggtagttataaaagggtcaagttgaaaaagaggttcatatggaaattataattagggccgctgagtcagaagatgccgagcactttcagaggatttatagccatccagaagtttattccaatacattacaacttccgtgcccttcacgtgaaatgtggcaggaacgtcttaaacaaaataaaattcagggaaccatcaattttgttgctgaaatagatggtgaggtggtgggcacggtgagtttatttactttcgctaacccaagacgcaggcaggtggtgggtatcggtattggtgttgacgcagcttattccggccaaggcgtagggtcaaagatgatggcattcgcgattgattatgcttttaattggctggctgcggttagaattgagttggaagtttttaccgataatgaaaaagcaatagccctatacaccaaatttggctttgaaaaggaaggcgttttacgtaaggcttccctaaaaaatggccaatattgtgatgttatggccatgtctataataaaaaattaattattatgacactgaatgatttatggtgtttaagtaggtagaggaaaagcgttcctttggtcgcttttccttcttccttatatttttgcctgattacatttaatcaggcaatatcacagaattaattccagtttgtcctgaaagcttcccctgattttgaaaaacaatttccgctaaaaaatcagcaaccttacgtattctgggagagtgtgccaaatcggcctgaatcacaagccagatggattgatctattcccaaatcatgagaaatgcattgaagttcagtatattgaacaatgaaatgcggtagtaccgccaaccctagccccgcttttacggcagccaattgtgcgttcagtgaagttgtagccacagataacggtcggcctttgaggtttttctcagtccataggaatgaaggaaggtacgagtaggtgtctgcccaaccaataaaacgagccttttcatattcacccctcagtatgtcaggtgaacaagttgccaaataatctttgctgccataaagcccaaatcctaattttcccaattgacggacggtaacatgccctcgttcaggcctgacgatacgaagtgccagatccgcatcccgacgatgtagatctacggtatgaatatccgttgtgatttccaatgtgaggtcgggatagtttttctgtaaggttggtaaattcggtattactaagtcactcgcgaatgtttctgtggtggcgagtcggactttccctgaaattgcaatccgggtatcggcttcaagcagaaaggagttggcggctatttccatcgctttggctttttccagcagttcttttccgtcttctgtgagccgatagccagcctgatggcggagaaatagaggcatcccaaaggtcgcttcaagtcgttcaatttttcgtgagaccgttgcaataccgatttttagaacatctgccgctcgacttaatgtgcctgtccgtgctatcgccagaagtacacggatatcatcccaaaccaatgattgctctgttttatttttcatttttggaaaattgatttctatttttgtctaaatattccgaatttgaaatatgccacaatgatctcgataaaagcaatccaatctaacgtgtgcagaattaaaaataaggtcattactatgcgaaatacaccacagtcagctgttgttttaacgttatttgcaacatttttttggagctcaaattttcaagtgacaaaatttgcgctagagagcttgcctccgtggacggcctcagttgaacgctttgtttttgctgtcttcccgatttttatttttatggcattaaaaagtggcattcatggcaaagtgctgaggaaaaacctgctggcatttatttgtcttggggcaattggtgtggctggattcaacggagcgttatttgttggccttcaaagctccagccctatcacggctgcactcatcatggcaacgacacctatttctgccaatatcttggaagccatcatgaatcgtcgttttcctgaacttatccgtgtgttaggaatgggtattagcttactgggtgttgttttggtgatcactaatggtcaattggtgggcggtatggttcatatggcatcgggagatgcaatcatttttgcgggtagtctcggctgggccatttatacggtgggaacccgtaaattcattaccaatgctacgccacttgagataaccagttggacgatgctttttggtgtggtgatattagcgatgatcgctttttttgttgaatcaccgatttcttcaatgcgatcaggaacgtttgagagtcatttagcgagcgcttatatggggattgcgggttcatttttagcttatcttttttggaacataggagttgcgcttagaggagcagggaagacagcgatattctttaactttgtgcctatttttgccctgataatacagctaatgataggaaattcgccaagtttgccacaacttgttggcattatgctgactattgtgggagtgctcttagggcaaggtattatcacggcgtggttcacatccaaaggcattttggaaaaacattaaggggaaaagtaggcaggattttctgcctttttttgtcaataggattaataaagaccacgatggtattgttaattagatatttttaatctaatgtaaataatgaataatgaataatgaataatgaataatgaataatgaataatgaataatgaataatgaataatgaataatgaataatgaataatgaataatgaataatgaataatgaattgttagcgcattaaatataatttatttcattaaaacaatttaatataaattaagagtgagattttgctagttgtcatatatttaaaaaatggattttctgtattaataatttaatcaggctcccaacagggagcctgtgaaacataaaattagacttctcgaataatgtagttcaaatacacaataatatcactcaggttggcaatcagatcatgctgtgtttcatcttttcctgcatggaaaatattcagtgtcaattcacccgatgttacgtctcggccttcaaatggcaggaaacggctgtcgttgaaatccgtgacaaaccggccatcatcatttgtaccatgtgatagtgtggctatttctgaatccatcaccagtgttgcctcaatatcttgataagggccaagtagagttggtaaggtgacagcaacacgtttaattcggcgtttattctcgctgctcatattgtaggaattttccagaccgagttggttcaaatcaagcgtggcctgaaaaatacggtcatgacttcaaagcgttaatttgatattcttgtactttttaatggggtatcatcatgactgttacgatagaagtgacttgtcgatattgcgatcaagctgaacctgtacgcaaacacggaacaggtaaggccggcttccctcgctactattgcaaagactgccaaagaacctttcaactcaactatcgttataacggccataaaccgggtatgaaagaaaaaattgtggatatggcaatgaatggctctggcgtgagagacacaggccgtgtgttaggtctcggtatcaatacggtgatgcggacattaaaaaactctcgccaaaacaagtaacatcgcgacagaccgcttatgacgatgtcacacttatctgtgaattggatgagcaagggtcttttgtaggcaataaaaaaacaacgtcattggctttggtatgcttttgatacgaaaaggaaacaagtcatcgctcatgtctttggcccccgaacggatgcaacctgccgaaaattactcaacttattggcgccttttaatattcgtttcatcacgaccgataactggggaagttataccagagaagtggcgccggaaaagcatctaataggcaaaatttttacccaacgtatagagcggcataatctcaatctgcgaattcatatcaagaggttggcgagaagaacaatttgttactcacgttcaatggaaatccacgaaaaactcattggcgcatatattgaaaaacatcattacaaccctttggagtcatgaccaaaaataccgttggtgagtgacagggtgacgccaccggaagtggagactccctcgccgttaagtaccttattgatattttcattcagtgtgcctgtgccaaacagtgaatccagatactgtgcgagtggcttccagccctatgccaccacgtgtaagtcagatattatccagtttctgcaattcggtacttaaaccttctcctgccagtagaccctgccacagatcattccagatcggaacctgaaacaggctatcactttctttttcacccagctcttgtactaacgcagcttttgcctgaagacatattggtagtgtgacatcgtacatttgatagtaaagcgcagacaggcggccggccatccagttatatagtgcttgtccggtaaaacgggtggtttgtagatcgtaaacggcctgagtatcaggggttacgcatgaaattttagccggctaaaatttcatgtgtaacccctggcgttagccccagcaatgacagcgcatacagcgatcactaagatatcaataaaacggtgtttgacctttccctgacaacgtgggtctggaaaatcagaaaagacatccactaattctttcattagcgtccctctaaaaatgaaagaattatccactaaatattttcatgcgtaacccctggcctgagtatgagcctgttccatttctgccagtgtgatttgcttctgcgccatgttgagttgttcttgcaggccttgtatctgggcatccaattgggtcagttcattatcggcgatatcacgttgcagcgcccactcctcctgacggcgttgataactggctgtgatttcagaaattcccgcactttgatcttgaatactcgcaccgacttgtgttgcctgacccgcaccgagtagtggtgctccccactcagatcaaccgttagccaagccgaaaacgtttggtacggcattggcgataccacccgcagttaataagccagttgccacgccattagtgatcatggctgtactacgcagtgtcaggccagcaatttccgctgcagagaggccgccattaactaggtcgctatagtgtttctgcctcaatgcagcaccattccggctggcttgcaaagccgtcaggctatgttgtagccctttcaggttggtttgctgaatatcatgttgttgtttcaggatcgcctgttgctgcgtttgcaataacagcgtcattttttcattgtcttgacgctctaatgtggtttgcagattgctagcgaactgcgtcaataaacttacggcgttacgagcgcgttcaattaataaaggataacgccagccttgggttttgtgttcatcaatgagcgaaccattacctgtaccatcaccacccgcttgctggcgttgtagtgttttgggatcgacaggcgtggcatacagtggcagattcagaggctggccatccagacttaagttatggcgcaggttatatagcctgatatccaacttatcccagtaagtcagcagaacgtcgttgtaaggcggcaagaaatcaccatcgccgatattggtggcatcgccagaattcagccacgtcgagaatgtcatggcttctggtgtgctcagtagcgtcggtttgctggttttgttggcttcttcattcagggtcggatttgaccagctattcgtgatatggatatctggtctggttcccagcagttgcagtgcctgaatataatacatcttggcttcgaccagtgtatcccgttcaagctggcggtaggcagcgttaccacgggcaatcagcaggtcaagagtatgcaggaatatcgctagcttatagtgcatcggatctgccgtggcgatcacatcgggatcggtggtggcaggctgtgtcgtatcccattccttgtcgatctgtaatggcatgatattccagtagcgtggtgcattatcatccataatgggatcgccatcgtcattacgataaccagcgctacgaaaaatgtatttgtaccaagtatccgcatcgctgaaatgctgttccgtctgcattcgtaccgctaccaagaatggaatatggaaaaagatttcccacagatatatgccgtaaggaccactgaaattattcaccggattggaacccccgaactgtttttggacatcataattaaacagtgagtccagactggtatccagtttgttatttaaatccacatagtcggggggatagagagcaatggctgaaccagaaggtggcgtgaattgcttgccatcgggggagaatttgccataggttgtgaaagtaatctcattaattaaaatggtaaaattacaatagtggtcattgttataacttgttccatggcacatacgtaattttgtatttacatagtcttttgattttagatgtttacttccaatgttattcaatacagttattactgtacctgagtcataacaaagagcaacgccataactcggttgagagccagaagatggattactaaaaattaatgtttctccatcattggaaatagttaattcagcatcagatgagtattgtgatgcagggcgggattttactttgcttaaaaattaatctttaggagcttgtacgtaaaatatgatgtgatttcttggataaaatggtgaaaattttacgtagagatacgttttttggctataaaagaatcgatcttaaagtggaatcccgccctgtattgtgatgcgactcggttttggcttgatgagtcagttgcacctactctgttgtagccagtgaacgaaatatcaagaattttattctttgatgtccaattatagtcgcttttcatcacccaggtatgtttataaacataatctactttatcttcccttgatattgtataccaacgtatatgtagcttattattttgccagtaaggctctacatgtcctgaataaggggtactaatacccgcattaatggctttccactctgtccattggttaggtaatgttaatttccgccagtagaatttatagggttcatactctgtccgcccaataaagaaaatcgttttgtaattttccctgtgaaatgccttgttccaattcagtaaatatctcggttttattcaggcgcaatgttggatcgatataatcaccggcatagaattttaagcgttctttacctgcccatgtactgtaacgatgattgaaactgtcccagttatataagaactgttcgtcggcgaaatactgttttgcggaacttgccagagtgccatcataaccttccatcgcccggtggataaacagttgcaggctgccaatcgcttctgacagtaaggaagtggaaaccaaatcgctgattttggtatccagcagcaggtattcatacagatcatcagccgtctggatactgtcttttagatcggtgggaatttgggtggcgatataatgggccaccaatgcatcacggcgttgttcttttaatatttgagaaaataaagagtcagacataataaagagtcagacataatcaattccttctttatccggttactgacggccagtcattgccgcgcttaagttttgggcgactgatgccagtagagcagtgttttcggcagcaggatcggctttcatcattttcatcaggtcactcagagtcttactgcccacattcaggctttgcccgacgcgcagccaagtcagaagctgccagagcgcggtaaaactttttggccagttattgtcgccaaacagcagaatattgacctgttcgactgtgcctttatccatttcatgcaatcgggcgatcagggttgcggcatggccgattgtcattgtgggatcattgagttgttcgaaacagcgcatggcctcatcgtgaggaaccgtaacttgagtttgccactgtttaaaacgggatagcgtgagcagtaaagacagattgggagcagaggcgctggtttggttgtctatcaggcgctcaggaaaatctgtcagcagttgcagatcctgctcagtcagactcagccatttgacaaccagcaccaattgactcaatcgctgagtggctattacaaggttggtatcagattgtaaatcgtccaatgtggtggtgttggtactgaacaatgtttgaatggcattccagtaatcagatagtgtgaagggcaacgtatcgtcggccgtgattttttccagccagaccgtcacaatattcatcacattacttttgatactaaaacccgcactcagtgcccgcaggattttttgttgcagggcaggatcaagggatttcagcgaatttgacgggttgttattaacactgacatagacattttgcaggaaattgaacatatctgcggccgcggttccgttccactgtgtgcttaccatgccttgcagataaaccaaattcagccgggttgaagccatccaatcgataacttcttgagtacggcgcaggatcttcagtggttgcagcgatttggcctgacccaactgcttcaacagaatatcggttccgcctgccatcaagcgccacaaaatttcggcctgagcaaacgtcaggccaaatagacgaggaatggctccgaagcgatacaattgactggcagtatattcatccacggtaaagtggccagcgtcatcaaaacagtaactcccgatgcggaaaaactcatcactggtaacgcccagggccttacagcataaagtagataattcgtcttgttcatccaaggtgtattttacttcttcacccagggcaatgacctgattaccgtcagcggctgagcggaatgttttctcatagaggctggctgtctggcgaggggcataaggattgactgcgcaaatgaaggtgacgaaagtatcgacatcaaggcctgagcgctgtctcaagctgatatattccgccagcgcttcaagtaccggtttatccaatacgattttgccatagtgttcgggaacactgcggctggcattggcaatcaaccaatccagttcgtcaaaggagagtccggtttcggcagctaggcgcaccagcttttcggcccggcctgacagttcaacaacggtactgtcactgaaattcagttttttgccatcggtttgtacccacagatattggctgtcagcatctactgccagtgtgttgttcaggtaggttgccccataaacattgacacgggtagggtctgtttcaccaaaacggaaataacggctacccgcatgagcgcttgccccgttttgactgaaggtactctgtgccgttaactccatgagttgattaaaggtgatttgagttttttcgcagaatgtttcgatggagtttagcgtgtcagccagagatgaagttaaaggcgatacatcctgcagtctgctgccaaggccgtaatgattggagatatcctctgctgtcggtgccggatcggtcatgagttgatagctgacaggcgttagtgacaacgtttcacgtgcgggtggtgaaggtatgtcattaatggcagggggaacgacatcatcaggcaccgttggtgttcctgtgttgtctttgctgaattgcagcagtaaagcatcggttttttctccattaatgaccaacgcatttttccaatttgtttggccggaaggtcccacagcgatatagcctttgtgtgttttcagataaaactgagtcttatctttgtcattttgttccagcgtgacaggtagatggaattggcttaagggttgtgtgctatttgatttattggcgacttgagcgaaatcgccgtcctgattcggattagttgggctattacctcgtaaaaaacagccattcagaattttgccatcacccgtttttgtcccgtcagggatccccaaatagtagcactgacctgccatcgaccaagtgagtttcaacggagcaatggcggctgcggctgcgttatctggattacctgcaatcagttgcacaccttcaaccgtttctccgttggtgtagtgcgacaggtaaatcatcggctggttttggaactctattgccttaacatagaaaatttctccatcaaaaaactgatctttcttgacttcagcggcaaaaaatttaggcgaattatcgggtatctccgtagaggattgttctgtgacagcctgcgccgtgacatctgccagagtattccagaccccatttagagttcgagcctgcgctgacagggcggcattgatctgtgagagatcatcatcatagggcagtgtcatcgggtaaaacgtggtggacagttgattgatgtcctgactgcctttttgcaggatatcaagcagaacatcgagcgaggtgatttcctgattcatggtggtttcgctcagagccagactttgcagatccgggcgacgctgatcaatatgcaggctggaagatgacgtatgcagatctctggcaactttatagagtgcggttgcgtaacgtccgggagaaaacagggattgaatggacgctgcgtcagcatattggctggctcggttcatgatatcgctgaaatctccatctctcccaatgctatcaaccaaggttttttccaggatgggtgcgtttgattgtgtattgagtttgcccattcttttaatgacaggctcatgacgcaattgccatgaccgatagagcgattttagattttctgcccgctggcgggcttgaaggtatatcgcttgggcttcattgacgggtagggaagggatggattgaacaaaagcagcacggctgattgagacaatttcaaagatatttttatagccggcatcaagtagtggccgctctaataaaccggataaagatgatgctttattctgcataataatcaccattctatagctgaaaattaaaaagtatccaaattattttaaatttagaaaaagagaggaaagataacttgaatgattcaaatgtggtatttgtcaatcgaaataatatattatgatttattaatacccatttctattatcatatactctgttcaaagtatgaatttaaacgttttggcttgttatgttgaagattaaaataaagtgtcatcaatataaaaattaagggatacactttttgatagtaaggataatatctcatcatattgattttgatgtttgctactgcgagattattcatcaggctgaataaatacagccctggtatttcagggctgtaagtcaaatttaattatgagtttcgatgttatttatttttattgaaataatcaatctctaataataacggatgtttaccctttgttaacaacgagttgacggcaacatcagataatttaaaggtagcatatttggacttagaccattcaaagtcttcataaaccatgggggtgatttgacctttatcatttgtcataaatacaccaagggcttttacattaatcggttcttttgttctatgtattgtcacagagaaattaaatttcagtgagcttaaatcttttttcgctttgttaatacggtcaattagcgcatctgttaatttcaattcagcaatgattttctgctttttatttgaataaatatagacatcggtattttgttgattaataggctcttgtgcactgccgacatcaatcggaatagtgaaatgagcgaaggaatcaaaatcttttcgataacattccacaaattcggcatttttaaaaatagttgggatcttttgtttggtctcgatcaaactcttagactcttgacgggaatcgccggaagttgagcaagaatatcgctgaggtttacttctgtatctaaaccgactttacaaccagttaatgccagcacggataaagcaattacagataatttacgcattccttacctcaaattatttttttaaaattggcaataaaggaaactatatttttacgcttatatcgtcaattattcaggtcacaaaattcattatattacataaaatattcttggtgctttcatgattggatgcaatataggataattttaattattgattacatttgtaaattaattaataaaatgtttttatttaaatgaatgctctatcttgatttttatttttacctttaaaaattagattattacctattcaatatattaataacaaaagtaaatatattaaaatttttgtatataaaaggaaaattttggtactattcgccgcacatttgatgattttttctttcatggattataaatgaataaaatttgtacgttattattatctgctgtgatgctgtgcagtggttgtgccaccatcgttggtgaaaaaaatcaacttattgaagtcaatagtcagccttcaggcgccgaattttcaatcaaagatgaaactggcaaggtggttgcgcatggaaatacaccccaaaatgtcatgcttgaaaaatcgaatggtcgttattttggtaaaaagaactatcagataacttttgcgaaagaacattttaaatctgccactttgccgctggtagcaagacctaacggatggtatatcgggggcaattttgtatttggtggcttgattggctggttgattgtagatcccctgaatggtggtatgtatacgctgaacccaaaaatagccaatgccgtattgtctgaagccaaataagatttaaatagaaaaccctatcgaatattgatggggttttctatatgaattaagaccttgaattaattaaaagacacagcagaacgcatcatatcaacataacgctgctgatcttgatacatctgtaaatagacttggtattttgcctgatggaacgggaacatttctttctctgggctgatcacatttccttcccgtaccattgactgggctgctgcggtaatatcagtaaacgctccgcaggcgactgcgcctaacatggctgcaccgagattaaccgcatcctcttcctctgccagatgaatttcctgccccgttgcattggcatattcccgcagccacaatgcatttttggttgcaccgccacatatcaccagacgatctatttgatgccctgccttaatcaaagtatcaatgatatggcgtgtgccataagcgatagattgtaacgttgccagataatatcgcgccaagccttctcgctcctgttccagagtcaacccgctaatcatgcctttagcgttgggatttgcccgtggtgagcgatttccgtgatggtcagccaaaatatgcagttgggctgttgggtatttttcgcgtagctccagttgggcaacggcatcattgagtagttggtaataatgaagcccagctgctttggcttcagcctccagcacgggccaggcttcatgctggcggatcgaccactcaaccagtgctccggcagcgctttgtccaccttcattaagccaataatcaggcagcatcgccccaaagtaaggcccccatacaccacgaaccatgacaggctctgggctgacaatcatatggcaatttgaggttccgctgatcattgccagactgccattcggttttgcgccaatcagcgctagcccgccagcatgggcatcaataatgccactggcaacaataacatcgccgtgtaagcctaatgcactggccgactgctcagtaagatggccagcttgttggcctaactcgagaataattgtcggtatcttgtctgttagatcttccagcccaatacgttgaagaaattctttgctgaactgtttttgatgagccagataattccacttgcaagtgagagtgcaaatactgccaacatcggcatctgtcgctttccatactagaaaatcagctaaatcaaaaaagcgccacgctgcttgataacgctgtggaaagtggtttttcaaccataaaatcttgggtaattccatttcgacactgatttcacccccgacataacgtagggtggggtcatccgtgagatttatgcggatggtttcctcgattgcacggtgatccatccacatgatgatatcgcgctctggactgccgtcttctgcaacagataacggctctccttccgcactgaccgcaactaatgaacaggtggcatcaaaaccgatggatttaacatgagtgggatcgatccctgcgtgagaaacagcctccttgactgtagtgccgatatttgaccagatatctgccgatgactgttcgacaaaatctgcttttgggtgaaattgttggatagagcggacagaaaatgctaatcgcttgcctttctgatcaaaaatggcggcacgtacactggcggagccgacatcaataccaatgaaatattgttgttccatacgataccttattgttttatttatatgatgttactcacaaaaatacctaaattattgttgatgcattgcaatacactctaacagtgtaggttgttttttagtcggtaaaattttaactaaagttttgtgacaatgcacaaataaaaaagataatttgctttttttctttcaggaaatgaacaagatttgtcattgttttgatcaaaaatcatatggtgccatatggataaaaaaattatagaaatattacaatatgagttaaaagcagcaacaggaaaggagtttcatcgaataatgacagaaattagtgtgccattgcatgagaaaactggcatagatgttattagttatggtaagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaattcattacacaactctgattcatattatctgattcgtgcttttggtgatcttgatgaaatgaataatattttgactgctttttatagcagcgatgattggatcaatggccccaaaatagagattatcgagaaaattaataaaagcatgaagtcgataataacgcttcctaaggtatcgattgatgcattacgtcggagtggttacatcgttggtgggaaaaatttctgctgcgagcatagcactttcagggaaatacagtagcagaatgatggttatctctgatataaaattttgtcccataagtttatttcaaacagagaggtggaatgatgaatcaaggtcgttgcctgtgtggtgcggtagggataacaacctatcaaaatattgagaatatcaatgcatgtcactgcaaaacgtgccaaaaatggaatggaggcccgtttttatctgtagactgtaagaatgatctgcaaatagaaggtgctgaaaacatttcaacgtattcctcttcagcgtgggcagaacgggctttttgtaataaatgtggaacacaccttttctaccatttacttcagcctagtatctattatgtgccggttgccctgtttgaaaatagtcattcgagtaaattatctaatcaagtttatgtggacagtaaacctgcgtattacaattttgttgaaaaaacaccgatgttaaataaacaggatattcttaatttatttaaataatggttttaatatgagggaaattattccctcatattttttgatataaatatatgtctaagaataatatattttaattctatttaataataatttaatataggaacgatagtaaatatggtttattgaatttattaatctgatttttactttatttatatgtgacaattttctttctgtttaggattaatatccgtataatcgcttttttatcaaaaagatcttgatatctatcgacaaaagatgttgccactatttcagtggatattatgttagtggagacgttgtttgattaatgttttgttagttgatgatcacgaactggttcgcattggtgtgaaaggcatactcgaggatgtaaaaggaattaaggttgcaggagaagccggtagcggagaagatgcggtcagatggtgcagatcaaacagtacggatgttgttattatggatatgggaatgccgggaataggtggccttgaggcagccaaaaaaatcattcgctattcgcctgatacgcgagtaattatgctgactatccatactgaaagctctttgccagcgaaagtgatgcaggccggagtcagaggatatttgagtaaggcagcaacacctcaagacatgattaatgctattcggacggtttatgcaggtcagcgttatatctctcctgatattgcacagcagatggcgctcgaccagttatccccaccaaaagagaacccactggctgaactctcagagagggagttacagataatgacgatgatcactcagggccgaaaagttaatgagatttccacattgcttaaccttagcccaaaaacagtaaatagctatcgctatagaatgttcagtaaactaaatatcaagggtgatgtagaattgacccatatggcgatacgttgtgggttgcttgacgcacagaatatggtaaaccatagcggatgacagtgtgatgggtggtaaatcgtggcagagcaatttgattcaacggtatttttaaaaacagtgactagccagccgggagtctatcgaatgtatgacaccactggctcggtgatttatgtcggtaaggctaaggatctgaaaaaacggctatccagttattttcggacacaagttggcagccgcaagacagaatcactggtaaaaaatatcgtccaaatagatgtcacggttacgcatacagagacggaagcgctcctgctcgaacataactacatcaaactttatcagcctcgctacaatgttttactgcgggatgataaatcctacccttacattttcttgagcggagatacccatccgcgtctgaccctgcaccgtggtgccaaacatgcgaaaggcgagtatttcggaccatttcctaactcccatgctgtgcgtgataccttagctctcttgcagaaactttttccgattcgccaatgtgaagacagcgtataccgcaatcgttcaaggccctgtctgcaatatcagattggtcgctgtcttgctccttgtgtcaacggttttgtaacggatgaagaataccagcagcaggttgaatatgtcagcctgttcctatctggcaaagatcagcaggtactgacagagctggttggcagaatggaagaagcaagtaaacaactgcaatttgaagatgcggcttgctaccgtgaccagattcaagccgtgaggcaggtcactgaacggcaatttgtttctggagaaggggatgatctggatgttatcagtgttgcttttgatacgggaatggcatgcctgcatgttttgtttatccgtcagggaaaaatcctgggcagccgcagttactatcctaaaattcccgctgataccaaattggatgaagtagtacaaacttttctcggccaattctaccttcaaggcagccagaacaggacattgccgacggagatcctgctggatttctcgttgcctgaaaaagaacttttggaagcatctctttctgaattatcgggcaggaaagtgcatatccaacctcgtccaagaggtgacagggcgcgttatctcaaattggcacgtaccaatgcagcaacagcattaaccacgaaactatcccagcaatcgactatccatcagcggttggcatcacttgctgaatttgctggcattaaaaaaattcatagaatggaatgtttcgatatcagccatacgatgggagaacagaccgttgcatcctgtgtcgtttttgatggaaatggccctgtgcgctctgaataccgtcgctacaacattgtaggaataacaccgggagacgattatgcagcgatgaatcaagttttacgtcgccgatatggcaaagccattgagcagaccaaaattcctgacatcatctttattgatggaggtaaagggcaattagcgcaagcgctggaggttttcggctcgctggatgttgaatggaataaaaactatcctaagctaattggcgttgcgaaaggcagtgatcgcaaagcgggtctggaaactctgtttttcgaggcagaaggcgggggaatgacacttcctcctgattcaccggcattgcacgttatccagcatattcgtgatgaatctcacaatcatgccatcacaggacatcgccagcgtcgggaaaaagtgaaaaagaccagcacattggaatcgatagaaggtatagggccaaaacgtagacaaatgttgttaaaatacatgggtggattacagcctttacgcaacgcaagtgtagaggagatcgcaaaagtgccttctatttcgtattcgctagcagaaaaaatctataatgcgttgaaacactaagattattgatgcaccatactgataaactttacatggccagatagttacgaagcattatgcaattaaatattccaacatggcttactctattccgtattgccttaatcccattctttgttttggcattttacctgccattccagtggtcaccgatgctgtgnnnnnnnnnnnnnnnnnnnnnnnnnnnnnnnnnnnnnnn

SEQ ID NO: 16868 - DNA, 79387 bp, Xenorhabdus bovienii
aacgatttcgtaatgacgcattagcattgctccttacggattattagcctcctgtcagggtcagccgtggcccatggaggcaaggaacgtattgaatacggctgaaaaatcgacgcgtaactatacctgcacaataaaaaaaactcaaggtacgggtaaaagaaaaaacgcgtttattcttatttccaatgatgtcccaatgaaacgcatcatgcaggacaaaaaattactgggcgcttctctgacgcataatttcaaacaagcaaaccccagtcgcaaccgacacgttcagagaagaaacagaacccgccattgggatactgatcaattcatcacaatgttcacgtgtcaggcggcgcattccttccccttctgcacccatcaccaaagccatcgggccagtaagcttgctctgatacagcgaatgggtagcttcacccgcagttcccacaatccagatattgctttcttgcagcaaacgcaaggtacgggcaagattggtcacccgaatgagcggtacgttttctgctgcaccacaagcgacttttttggcggttgcattcagttgtgcggagcggtcacgaggaataatgactacatcaacgccagcagcatccgcagtacgcagacaagccccaagattatggggatcagtaacgccatccagtaccagcaaaaaaggacgatccaactgcgatagaaaatccggtaaatcgctttcctgatactggcgcccaggtttaattttggcaatgatcccttggtgtaccgcgctttctgtctgagtatccagccattgacgattagccagttgaactgcaataccaatatcttccaattcccgtaacaatggggttaagcgacgatcttcacgtcccttcaatacataaacttccatgaatcgctgaggatcgcgatccagcaaggctttaacggcatgaataccgtagataatttcactcatgactggttgatacctaactcactgatatcttaaatgatacctgaaaaatggagggcagcagaagccgccctgattctctgtatttgtcagctattttcctgcgtttttttcacgcgtttcgctttcaattttgcagtaatctttttggttttgtctgacgttttcttcttgcttgctttaggcttttccgcttttttctttttacgggaggcgttgtctggctcaaaattggctgattttttatgatcacgcccttttttgctactgttacgctctggtgtacctcttttcgacttatctcgcgcggtcttaccttgattacgcgcctttcgggtcgaagaaagcaaggcgaaatcaatattgcgttcatccatgtgaaccgcttcgacacggatctctacttcatcaccaagccgataagtctggccagaagattcaccaatcagacgctggccgacattatcatatctgtagtaatcattatccagtgttgaaacatgtaccaagccgtcaataaacagctcattcaacctgacaaagaaaccgaaacccgtcacgctagtaatcaagccagtgaaaacattgcccacttgatcctgcataaaatcgcatttcagccagtctgccacgtctcttgttgcttcatccgcacggcgctcagtcatggagcaatggttgcccaattgcagcatgtgatccatatcgttatgccagccgccggttggtgtccagtgctgttcaacggcaccattctcttgctcttgcgccaataaatatttgatcgctcggtgcaatgccaagtcaggataacggcggattggcgacgtaaagtgcgcgtaagaacgcagagccaggccaaagtggccacggttttccggatcataaatcgcctgtttcatggagcgcagcaacatggtttgcagtaattcatgatccggccgttcagccacatctttcatcaattgagcgtagtctttcggttcaggtttcattccacccaataagctcaaacccagttcgttgaagactgagcgcagatttaaaatactttcttctctgggccgatcatggactcggtataacgctggctcattatttttctcaacaaagcgtgccgccgcaatattggccagaatcatgcactcttcgatcagtttatgggcatcgttgcgcgtaacgggttcaatacgctcaatgcggcgttctgcgttaaagataaatttcgcttcttcagactcaaacgaaatggctccacgctgttcccgcgcctgctccagtgcctgataaagctcatgcagatactcgatatgcgtcaccagcggctggtaatgttcacgcagctcttgatcgccctgcaatattttccataccttggtgtaagtcaaacgggcatgagagttcatcacagcttcatagaacttataggaagacagcttgccttgggcagaaatggtcatttcacacaccatgcacaagcgatcgacttctgggttcagagaacacagcccattcgacagaatttccggcaacatcggtacgacttgagatgggaaatagactgagttaccacggctacgcgcttctgtatccagaggtgtttgcggacgaacataatagctgacatccgcaatcgctacccataaacgccagccgccgccacgttttctttcacaataaaccgcatcatcaaagtcacgggcatcttcaccatcaatcgtgaccagtggcagttcacgcaggtcaacacggccttttttcgccgattccggtacattttcatcgagatcgaccacctgtttttctaccattggtggccagctatgtggaatttcatgggtacgaagcgcaatttcaaccgccatgttcgtacccatcgtttcaccgagcacttcaacgatcttgccgatagctttagttcggcgggtcggacgactcgtcaattcaacgacgacgacattgcccattcttgcaccgcaaatttcttcttttgggatcaagatatcgaaacttagccgactgtcatcagggacaacaaatcccatacccgcatcgacaaaatatcgcccgacaatctgactgttctttggctccagtactcgaacgatacgcacttcaacgcgacctttacggtctggttgcaaaggctgtgccaatatgacatcgccatgaattgccattttcatttgttctgctggcagataaaaatcttctttgtggccttccgcacgcaggaaaccgtaaccatcacgatgtccaatcaccgtacctttcaacaaatccagtctttccggcaacgcataacattgacgacgagtgaaaatcaactgtccatcacgctccattgcccgcaggcgacgtcgaaacgcttcctgtgcatctgcactggttaactgaagttcttttgctaattcctgacgacttaccggagtggtgtgtttagaaaggatatccaagatgtattcacggcttgggataggagattcgtatttttcagcttctcgttcctgaaaaggatcttttgacatcgtaattcctctgttgtcatcagcaagctgttgctccccgtgcttcactctcgcttcacttagccagaagcaactgataaaggggacgattgtctttgaccatatcggccaaagtatgtttacccaactcttgcaaaaaattttctaccgcttgattcaacactaattttaagcgacatgcaggcgtgatatagcaagcactacagttaaccaatggaagcggttccagtgaacggactacatcgccaattttgatctcgctggcaggcttacccagactaatgccgccattttttcccctgacagcattaactagacctaaattactgagctggttaattatcttcaccatatgattacgtgaaacaccataaacttcagttacttcggtaatgctagtcatctgaccttcaggcagagaagccatataaatcagggcgcgcaagccataatcggtaaaactggttaactgcacactcacctctgggcgactggatataacagcggttatttagaaccaagaaataaaatatatgtttattggtttatcattatctgttcacattatgtgggcattttaaaaattaagcaaaacgagctgcgttttataacctctcgcccaaaagcctatccccaaaaagtaaaaaccgggcataagacccggttatacatacttaaaagattaaactatcaatcaagcatcaaatggatcacgcaggatcatggtttcagcacgatctgggccagtagaaataatatcaacaggaacgccagtcagttcttcaacacgcttgatgtagctcagtgctgcttctggcagcaggctgtgatctttcacgccgaaagtgctttcatcccaaccaggcagagtttcatacactgcttcaagaccttcccagttttctgctgccaatggcgtagtgtcaatcaagctaccatcaggcatacgataaccaatacagattttcacttctttcagaccatcaagcacatccagtttggtcatgcaaaaaccagacagggagttgatttggatcgcacgacgaatggcaacgatatccagccagccggtacgacggctacggccagttgtcgcaccaaattcctgccctttctgacgcaggtactcgccggtttcatcaaacagttcagttgggaatggacctgcaccaacacgggtagagtaggctttgataatacccagaacatagtcaacgtagcgtggacccagaccagaacctgttgcaacgccacctgctgtggtattagaagaagtcacataaggataggtaccgtggtcgatatccaacagcgtaccctgtgcaccttcgaacatcaccagttcacctttctgagttgctttatagagcaggtcagaaacgtcaactaccatgtttgtcaggatatccgcaacagccagaatatcatccagtgttttctgataatcaacagcaggctcgttgtagtagttaaccagttggaagttgtgatactcgatgatttctttcagtttgaccgcgaaagtttctttatcaaacaaatcgcctacacgcaggccacggcgtgctactttatcttcgtatgcaggcccgataccacggccagttgtaccaatcgccttggcaccacgcgctttctcgcgggcattgtccagtgcaacatgataaggcaggatcaacgggcaggcttcagaaataagcaggcgttcacgtacaggaaccccacgtgattcaagcgcattcatttctttcatcaaagcatctggtgctaaaacgaccccatttgcgataatgctaatgacattttcacgcaagatcccggatgggattaagtggagaacggttttttcaccgttgatgactagtgtatggcccgcgttgtggcccccctgataacgaaccacgtacttagctcgttcagtcagcaagtcgacgattttacccttgccctcgtcaccccattgggtgcccaatacgacaacgttcttacccatttcaaaagttcactcggttgcttaaaaatggattctaccatctcatttagcacctttcagtattttttctcacttctgttatttcgtttcgtcatattaacgggctgttaagtaagcattcgtaatgatgctagtaacaaaaaagccactgcaagttttcttacagtggcttaggcagcggtcattcattccgccgcgttagatttctttttgttcattaaggcaattcgcctatctgagcggctcagtcattggtattactgtgctgcttaactggcgctttcatataacggaagaaatcgctatctgggctgagtaccatgatgttattgccatcattcttgaagctcttctcataagcacgcaggctacggatgaacgcatagaattcaggatctttgttgaacgcatcagcaaacagcttggccgcttccgcatcaccttctccacgcaggataagtgcctcgctattcgacttagctttaatttcagttgctgttttatctgctactgcacggatcttttcagcttcttccagaccttgtgagcgcaggagacgtgcttcagcttcacgatctgcacgcatacgctgataaattgcttctgaaatttcctgtggcaagttgatctgtttgatacgcacatccacaacctcaatgcccagctcggccatactgttctggttcagaacgggctgtttgcctttcgtttcctgccctacactagccgcagccgaagcaaccggattgtccgctgtttctgccgtatcaccatcacttgtccctaagttcaaagaattacgcacatcggtagttaaacgaccacgggaatccgtcacaataccacgcacatccaaacgaccgatttcagaacgcagacggtcactgaatttacgctttagcagcagttcagcctgagcaatttctccattacctgtcgccagataatagcggctgaaatctttaatgcgccatttcaggtaagaatcaacaatcaggtctttattttcacgcgtcaggaaacggtcagctttgatatccatagtctggatacgggcatcaagtgttttgactgtctcaataaatggaattttaaaatgcagaccaggctgataaaccagtggtttattttccgcatcacgcgcaaccttaccaaaacgcagtacaataccgcgctgaccttcgtacacgatgaatatcgacgtatacagcacaaccaatataacggcaatagcaaagacgaatgacttacgcatgattatggtctcccttgtcttagcgtctcaccacgcaggctactgggattgccatagctagaatgattattactggagttgttataacctgtttgtccttgttcaggtgcaaaatgtgtagagccgctcttctctggcgctactttggcatctgatgactgcgttttcggtacttcagcttgtttacgaaaaacctgatccaatggcagtaccagcatgttattgctcttttcgtttgcaatgaccttacgggtattactcagaacatactccatcgtttcaatgtaaagacgctcacgggtaatttccggtgcagctttatactccggcagaattttggcaaaacttgccacttcaccctgagcattcaataccacactgactttataggctctggcatcttcaatcatgcgttgagcatcacccttagccataggcaaaacagcatttttgtaggattcagcttcacgaatggttttttgctcttcctcacgcgctgcgataacatcatcaaatgccacttgcacctcttctggtggacgggcagtctggaagttaacatcaagcagcgtgatccccatgttgtatggacgaatggtttcttccagtactttctgggtatcgttacgcacgatggtacgatctgccgtcaggattttttccatggtgtatttgcctacaacaccacgcactgcgctgtcagtcgcttggctcaggctgttgtccgggctggtgacattgaaaagataagccgcagggtcggtcacacgatactgtacgttcatttcagcacgcactacgttttcatccgatgtcagcatgacacccgatgtcgccagttcgcgaacagattcgacgttaacggctcggactcgatcgataaacgtcattttccagttcaagccaggctgcacaatatggctgaatttacccaatcggataacaacgccacgttctgtttctttgatagtataaaacccacttacaacccagatagcaacggcagcagcaacggcaagaccaataatacggccaccaaatttagggccctgctcagaaccatttccacctttttttccaccgaaaccaccgagtttttcactcagcttacggaatagatcgtcgagatcagttgccccacggtttcgaccacctttattgttgccgccggagttgccgccattattattgctgcttccccacgggtcgcggtcctgtccgttattaccgggctgattccacgccatgttttagctccactttttagtttttcactggtttttcagaggtgactgctctccaccctaacggatgaggcttcccacttcacaggccattgcctgtccctgacaggtctgacagcggcctctgtggtcagaaacgacaaatttcgtcgttttagtaagcaaccaatatttttgggtgatgtttttgacagtactgattctgtcactgcaattctggcacagtcattccatcaccgccatcccattacagctactacatgactataagcgccttgaaatggctgacaaaatgataccttgtttgtcttcctgagccaatcaatcagacaacatagtcaagtaaattcaattcttgtttacatagtcggcgccaatcaaccatcggcatcctgacttcaataccaatttggccactgtcttctatccattcacgctcaatggcctgaagctggtaaaaacgactgcgcaaacgccccgcatcaggcggcaaatgcaattcatagtgtgcaatttcacctgaaagatattcggtcaacacctgaaataacagcgggataccttctccagtctgtgcggataaccagatccttatcgggcggttttcctcatcgcgatcaatacgtggaacaaaatcttccaacatgtcgattttattcatcaccaacaaggaagggatctcattggcttcaatttcttccaggacactgtttactgcaacaatgttttcgtccagacggctgcctgccgcatccacaacatgcagcagcaatcttgcctgccgggtttcctgcaaagtagctttaaacgccgcaaccaaatcatggggtaagtggcgaataaaacccacggtatccgccaaaacaactgtaccgacatcattcacgtctatccgacgcaaagtgggatcgagggtagcaaaaagttgatcggcagtatacacctcagccgaagttatccggttgaataaacttgattttcccgcattggtataaccaacaagagaaacagtgggaatatcagctttattacgtgcctgacgcccctgctcgcgctgtttttcaactttgccgagacgccccaaaatctgcttgattttgtcacgcagcaggcggcggtcagtttctagctgagtttcccctgggccacgcaaaccgatcccccctttctgacgttcaaggtgagtccagcctcgaaccagacgggtagataaatgacgtaattgtgccaactcgacttgcaacttaccttcgtgcgttcttgcccgttgggcaaaaatatccaagatcacacccgtgcgatcaacgacacgacattggcaaagacgttcaagattacgttcctgagcagggcttagtgtatggttgaacaagaccacatctgcaccgctgttcttgacagcctcagcaatttcctctgctttaccttctccgacaaaatatttcggattcggtgcctttctgcttcccgtcacaatctgcacaggagaaacacctgcggaagtcaccaatgattcaaattcactgagattttccgtatctttttcctgtgagaaaaaaacatgcaccagaacggctaattctccgccttcataacgatcaaacaacggtgcaacccctcaggctaagtagaaatccataggaaaaaacataggtaaagtctccctacctatgtttttatttacgtcaggcacggacactgatttattcagcgccatcactttccggttgtgctgctgggttagcgccagcatgataatttccaacgccagtcgtcacgttcggattattgccgtggtgagacacaggacgggaaggcacaacagttgaaatggcatgtttataaaccatctgactgaccgtgtttttcagtaaaataacaaattggtcaaaagattcaatctgaccctgtaacttgatgccgttgaccaaataaatagaaaccgggaccctttcacgccgtaacgcgttcaggaatggatcttgcaaagattgccccttagccattctatattttccttattttgttgttcttaactaagaacctgttggttcgaaaaagtaactactcaaaaataacgctttgtactgatcaattgtacacaatcaatgaatttatgtactaataacctgcatcactgtattcagtgcctgttcaggttggtcactgtccaaccaagtcacattgtcccaacttctgagccacgtgatctggcgcttcgctagctggcgtgtcgcacatatgccacgataaaccatctcatcatgagagatttcgcctgaaaggtaagaccacatttgacgataaccaacacaacgaatggaaggtaaatctgtatgcaaatcactacgagcataaagcgcttttacttcatcttcaaaccctgatttgatcatttgttcaaaacgtgcggcgatgcgctgatgcaaaatttcacggcttgcaggtgcgatcgcaaattgatgaacacgataaggcaatatttctccagacgtttcagtcaatgcagttagagttttacccgaaattcgaaaaacttccagtgcacgagtgagacgttgtggatcatttgggtgaattcttgctgctgcaacggggtcaatttcctgcaattgccgatgcaaggcttcccacccatgttcggccgcctgttgctcgatctgcgcccggatatcaggattagaagagggtaagggcgataatccttccagcaatgctttgaaatatagcatggttccgccagctaggaggggaattctcccggcagccatgatatcagccatttctttcagagcatcacggcgaaaatcagcagcggaataaatttcagcaggatcgagaatgtcaaccagacgatgaggtgcctgtgcctgctctgctgcggtaggtttcgcagtgccaatattcatttcacgataaatcaacgcagaatcaacgctgattaattcaacaggaagatgctgacgcaaggcgatcgataacgccgtttttcctgaagctgtcggccccatgatgaaaatggctgtcggcagatgttgagtttttaaatcactcatgattgagaagtgccaccactgcttgtaaatcaattaactgtaataagcccccaggcggggattccaccaattgagggcaaagacgctcgacatcagctaaaagctggacagcttgcgcaacgttccacgtttcatgttcgctcccaacgtgacgggagagccaaatcgctacctgttcagcacagaccgagggttgttccactagatagttcaacagctccggcaggagtttcggcaggttctgttgacgcagtggcaacgataccgcatgaatagttacttttccatgtgcgactgtagattcaataccgaaagtcttcaatagctcactattctgctttaaagcgtcgatttctgcctgactgagagaaagtttcagcggtatcagtagcggctgcgatttaagccctagctcccctggcgtcaactgcacctgtttcagccagcgctcagcaactggcaaagacagtagcccaatccccaacggggactcaatcaaggcataactggcagcatggatgctcaatactttgccaaaactgtaactattgttttttccctgcaaaagtgctgcataaacaggaactggagcggctttttccctcacggagacagccttttcaggaaacagcagccgtttctcctctggtgcaaattgcatcattttttggtacaactcgccctgtttcttctggtaattttccccatgatgaagttgccgcgtgtcattgccagaatgcgggcgatcaagctgaggctgttctttatcatgccccccagacgaaaccaagggagaagtcgcggcacgagaaggcggtgacgccttcggtgatgtcgtattttgctggagaaaatggttctctcccgcagaaggacggttttccggcacccaactggcagccggctcctcacagccaagcgctagttcagctcccttctcccgctgtttcaataccgctgccacaccctgataaataaaatcatgcaccagacgtgcctgatggaagcgtacctcatgcttcgctggatgcacattgacatcaacctgatgcggatcgatctccagatacaatacataagcaggctgcttctctccctgaagcaaatcttgataagcttggcggatagcatgattaatcagccgatcccgcatcatacgtccattgacataacaatactgaatatcgctcccggcagtatcattcatgggatcagcaacccatcctttaatggacaaggagtcatgctgccatgacaacgcaagagcctgttgcacaaacgccattccacaaatggccgccaaacgccgctcatgctgagattcttctttcgctggacgatactgacgaaccaatttgccgttgtgatgcaggttgatcgccacatccaaccgtgccagagctatcctgcgcaccacttcatcaagatgcccgaactcggttttttctgttctcaggaatttgcgacgtgctggcgtgttataaaacaggtccaatacttcaaccgtcgtaccgacgggatgagctgcgggttttacggtgacttccatatcacggccttcggcgtaagcctgccacgcttctgtttggctttcagtacgggaagtcagagtcaatcgtgaaaccgagctgatactggccagtgcttccccacggaatcccatactgacaatcgcctccaaatcatcaagcgaagcgattttactggtggcatgacgtgccagtgccaatgtcagatcttgctggtcgatcccacagccgttatcacgaatgcggattaattttgcaccaccgcgctcaatctcaatatcaatgcgggtagcgccggcatcaaggctgttttccaccaattctttcaccaccgatgcagggcgctcaaccacttcaccagcagcaatctgatttgctaattgtgggggtaaaatcctgatagccatattcaaccttctttacggtttagtattacattggagaagtctgcaacgggttagcctgaaaatagtggcgcagcccaaagtgaatagcttgtgccaatctcgcctgataatcattagaccccagcagcttctcttcggataaatgactgataaaacccgtttccactaagatggaaggaatatcaggtgaacgtaacacaccaaggcttgcatgttctggcgtgcgcttatgcaaagatccaatgctagttaactgactcaatacttgaacagcaacgtcatagcccactctctgggaatgaccaaactgcaaatctaacacagcctgactcaatagaggattaacaccattggatagaacatctcccgcaccgcccaacaattccgattgtttctcgtgctgctccagccaattccccaattcactgtttgcgcgacggttggatagtacccaaacagaagcccctctggcgctgcgattaggtgctgcatccgcatgaatagacaccagcatattggctttgtgcttacgggcgacctcagaacgtccagcaactgagataaaataatcgccatccctcgtcaaaacaggcttgaacatgggatcattgcgtaaaagtacttccagcttgcgtgcaacgctgatggtcacgtttttttccttcaagcccccttgcccgatggcgcctgggtctgtcccaccatgccctgcgtcaatggcaatcacaatcgggtattttccctgtgctgccttagctgcctgctttttcactccctgcccatgatgagccggagtaggctttgtttcctgcttcggtgactgaacattattagctagtaattgcttactttcatgtaatgaagtatttcccttaagcatcgaggtgctattcgctgtactcttagccgctgcactattagcttgcaacgtaaaaaccacctgatattcactggcggatcctttcactgaagaagtcgcggtagcctgatgtgccaattccaatacaaaccgcttatgctgtgcatcaggggactgactggttcgaatcactttcaccagatcctggcctgataaacgcattggcagtcctatgacatgaccagactgacgaatatccaccaccaaccgctcaggagcatgcagggggaaaaaccgataatcaggatgcccgcctgtgaattccaacgttacggtagcttcagatgggctattattcacatgaatattcgacaacgtagccgctgtcgccgtcatcatgatcagttgactcaacatgacaaacaatgcacaggacatcacccaatgggcttgccatttttttatcactttcacaaagaaagcattcatcatggtcgggtattccttcataaggacttcagattatccagcagattttcaccatattcagataacgccacaaaacgcgcgtgccgcccttcactgtcatagctcaaatgcagctcaatatcggcatcaggtaaaaaccctgcgccctgttgaggccattccaccagacaaatagcatcctgatggaaataatcacgaatgcccataaattccaattcttcaggatcagccagacggtaaagatcaaagtgatagacaggccgcggttgcaaagcataaggttcaaccagtgtataagtcggactcttcacatgtccctgatggccgagcgcctgtaggaagccacgactgaatgtcgtttttccggcacccagatcgccatataaataaataacatagcctcgatcgccggctgccgccactgcattgcccaatgcaaccgtggtattttcatttggaagtaataaaacgagttctttcatcgaaaagtatctattttatttattgaattaaagcctaatgagatttaggtttatcagttaaatagtttaaccaataaccataacataactcagccattatcatttaacatcttctgctccgccgtactgccacgtaccgcactttttgtattcaatccgctgtgtgctaaactacgtcccctttgcagcagtaatttgatattcaatggcaacccctctcgatctgaatcttctggcagcaaacatcaaacaatggggcctttcccttggctttcaacaagtcggtatctgtgacaccgatttatccacagaagaacccaaactacaggaatggcttgataagcaataccacggcgaaatggattggatggctcgtcacggtatgatgcgcgcccgtccccatgaactactgcctgacaccttgcgggtcatcagcgtgcgcatgaattacctgccaaccaaagccgcttttgccagtacactgaataatcctgaattgggttatgtcagccgctattcgttaggcagagactaccacaagctattgcgtcaacgactcaaaaaactcggtgagcagattcaagactattgtagtgctcatgaatatcagggaactctgaattttcggccttttgtcgattctgccccgatcatggagcgccccttggcggccaaggctggtctcggctgggttggtaaacactcacttatattgaatcgggaatcaggttcgtggtttttcctcggcgagttgttgattaaccttccccttcccatagatgccccgcaagaggagcaatgcgggcgttgcgttgcctgtatgacgacctgcccaacaggtgccattgttgaaccttatatcattgatgcacggcgctgtatttcttatctgaccattgaattggatggcgttatccctgaagagttgcgcccgttaatgggcaaccggatttatggttgtgacgattgtcagcttatttgcccatggaatcgtttttcacaattaacggatgaagtagatttcagccctcgtgcagccctgcacacaccaaaattacttgatttattcagttggagcgaagaaaagtttctacgcattacagaaggatcggcaatccgccgtattggttatttacgctggctacgcaatatttccgttgctttgggtaatgccctttatcaggatgatatcgtgctggcactggaaaaaagaatcggtttaagtgaggtactggatgaacatatccactgggccatcgatcagcaaataactcgccgcaatgccaatacgattgaagttcaaacatcacagcagaagcgattaattcgggcaatcaccaaaggtctacccagagatgcttaataatcaaccagtcgaatttactgtcaaaaaaccagtctatttccttgtgaataaaataaaaatgccttgttgatcaacagacaaaaagagtttaaatatcaatcaatatctttttaaatggagctaattacgttaacttatcaataagttaaatatgatttattattttaaatgatgggtcaaaaaacacagatacggaaataccgactgtggataactctgtgtagcaaatagagcgtcatcagacaaatcaatatggcagtaaggttaaatactgtggataaaaaacagtaattgtatttcagtggaaaatctcagaaataagcagtaaaaccagaatccactctcacattctagacgctggtggagaaattttcctctgcctattcaaaaatgaggcggcattatggacttgttaaatctggatagcaagtgctttatcgacaatttatttatggtggtgatagatagtacggagcgagcagttaagggcaaataacgctaacatccagcaaaaagtgccaacatctccccgctagcactctccccttacctactgcgacaataggataaaaatcaaactagagcgcttttatcttttcaaccaattccttcgatgatttccaatcatattttgtataaagacgctctagcgcaaagtaagaagcaccggtataaaacatctcatattgcaaatgccttgaagcaaattctgaccccactgcatcccataccagtttcatcagcctgactctttcaataggggaagcaacagatgaatattgtgttttctcaataatgcgtaaaatttcatcattctccaaatcagcttcacttgatggcagcatcaaaacacctccacccgcgagtttccttatcgtctccaatacttttggatatatttcctgtgcaataacctgacacgcataaagctgtgttcgatcaggaatataaaacccgttatcgactctggggttatggatcaaactattaaacaacccttcaatattcatcgcataacacgcaagtttagcaagagactctcttaccgtgggatattcgcaaacaccgtttgtttctgccattgtctgagctagccccgccagaaaatgcaatttcaccgcataacgagcctgactttgagtatccatcagcacttccgcagcagtttccttaaattgccgacggcacatctctatatcctcaaaaataaatacccgttcccaaggcactaagacatcatcaaaatagataattgagtcattttcatcgaaccgatacgacagcggataatctttgggatttacgcctaattcataagaacgccttgaaataatcttgatacctttcgcattaagtggcatggcaaaagaaaccgcataccgttcatcaatcccaggtttaagtggattatgcacaccaatcagaatttcatcagccagtggtgctcccgtagcgagcatttttgcacctctgacaataattcccttggcattcttttccaccacacccagagtgtgataaatattcttggtatgttctcctggagcctttgagcgatctccctgagggttaaccagtgcgtaagttaaatagaggtttttctcactcacataggtaaaataattccgtagagcatcagcccgctcttgcgaataatcttcaaatacctcgatatgagtcatcatcccagtaagcaccgacgacacgttatcggggcttcttccgagccagccaacactctgtgtagccagttcatattcagcccgaccacgtgcaatcaatttttcaggtgtagaaggcaattgccagtatagactaattcgattacccgcttctgtcataaacatcattctgtcggcatgttcgatctgataatcatacagattcgcaaccgacctgatcgtatttctgaatgcaggatgatccacatgatttgtgactacctctccattaataaaaatagctcgcccatcacgtaagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaaatcatcaatatatctttctccggttcttatcatcttttttactctcctatcactgatcacgacttttaaaagtcaagaaaagaaatctttctattcagtacagagcgcttaatatacaaagataattattcctccattatcaggaagtgaatcaccgatcttaatatgtgagagaaacctctttcattaacattgcccgattttcgtatttccgacaccattctatgtaccggaaaataccgagatatgttcctgtggattaactataaaagcgatatcaaattccagcattatcatattaacccgacattccgcaccactttcaggaataaaatgattcatagggttgccccaatattttcagcagttcattttgatacacctgtattcccgtcaccatacggtgttcctgaaactcgaaagtactaatcccttcgaaggtcaaaaacacccaacgcgccgtgggagattgggtgggtttacctttcatatcgggatagaacggggcattttgcttcagtccggtgcggattttatgctccagtgcagcataaaccattaaactgcatgtcattatcattaataacgcttcgatgcgttctggctttttcaaataaatcgctgaagtcagaaactccggacttttcaggaaacggaaaccccgctcgactttttgttgcgctttgtaattagccagcagagtttccatattcagcgccttatcgtccatttcattcgtcgccagaatgaacatgccgactttgaggcgggcataagccactttccccagttggctgtagaccgaggcagaaagctgataatgaacactatcgggatgttgacctttagccgggcggcctcgccccttatgcacctcgattttttgaactttgggggcctcaatgccgataaactggcattctgcttcgaagtcacacaatgcctgcaaagcatcttcaccacagggaaacgactttttgctgagtttttcgaactgtttcagttctttttccgtcgaaatccgcgtatttttcctgaaagtctgatgttcacactgcatcgccgcttcactgttgaccagtaaccagcgctgtggaacgcccccgtagcaagattcaatccaatgaccggcataaccttctgtaaccggttgtaactggtcggtattaaccgtcagcaggtgctgtttcgcctctttaatggttaacggaacccgggtaataaatttttgattttgttgatgaagtgaggccagtgtctcttgggtataaagcgcggcatcggcaatcagataacggctgttttgggccgctttcaggcagccaatgtgatgtttcgtcgtctctgcaaacgctttggtgtcgttggtgtttccgctcatcgcctgcatgtatacggggatccccgcctgattttcacagataagttgcagcacaacctgattcaggtcaggacggtgatcacgactgtaaccacgcaccaaaacgaggcgttttgtctcgtcatcatcggggagtttgtactcaccatccacgtgaaaactcgtgatatcaaggtgaacggaatcggattttaatgccaatttatcaataacccgctcagcgataacctgataaatttcagagacaccgcagtcaaacaaagcgtccagcgtgcggccgagcacatcatcattgaggtgttcagccataattcccaccccaatcaggcgttcaacgggtttgtgcttaaaaaaatcagggcacatatggagcgttcggctgtggaaacccaacccattgaggatcatcgctaaaagagcctcgccatgagaaaccgtatgctctgcatatttaggcaaaatagcatcaatcatgcggggtaaaccgatctcatggcaaaaagcggcgacaaggccgaggtgatcgagacgtttgatggcaggttcagagagagacatgttgggcttccggtaaatagaagtaatagatcaaaaccgaagattgccgtcaatctgatttgaggagtaaatcaacaaagcgtgcggcaaatcacatgatttttaaatcaggaatgaggtgcggaatgacggattaactaataatatccagattaatttaatcaacaatagttagaatttcgcatggggcttattaaatataatgaattaaaaatataaatctttatttatttccaaggatttcttttttatcttaatttatatatcccagaatatttatttcattaatataaagttctgataacttcccctgaaaaatatttaaccgtcactttgacacactagaattaaaagctatttggacttttctcaaagtcataaaacaaaccataacagccaataacgttattcccatcaaggtgtatgtcaagacactgaaagcaccgctataaacagccagcaactgatgatcagataagttggcaaacagccctctggcattttcaaagttgcctgtcgccagcccaatggcggcacacagcaggccaggccaagacaagaaagatcgacatctctgaatgcgaacgccatgaggcctcgtgtaaagccgatgatcgtttcttttatcggtctataagcctttcccatatgccttacacgggccgcattgatccagaaatatcctacatccagcaacatagggctaagatagcaccgctataacgctcacggagtgacaacttcgacaggttctccccttttttcaatatcctctgctgctttcaggcatagatcttctcgaaagcgtgcactcactatctgaatacccactggtatcgtttccccggaaggagtggaaatcaaatttgtccggagattgacacaagggagccctgtaacagggagcgtaagcattggcatttgactattccagacccgcataaatgaagtttcacattcaagatccagattgttagagaatggcaattctgctgaagtcggtaaaaggatcaccgcaaacttttcagagagaaactgttgccattcacacgcaatcgtatgaagtcgactcaatgccgaagagtaattgaccagagacacggaatgcgcaaattcacggtacatgttcaagaagttcagcgcaccgggatctccgtcttcctgtaccgctaagagttgaccctcataatcttcacccaaccatagggtcagttgaatatccgaagctgaacggagagagggaatatcctccaactcgacgactgtccagcctgcatcacgcagttttcctgctgcatcataaagcgcgtccgcgacgtctggctgggtatccaatccatttggccgcacgcagaacgctgcacatttcggggcatcgtaacccaccatgggcgctggtacccaccaaggatcgcggatatcctctctagcaatgacatccatcgctagacgcaagtcattgacagttctggcaacaggcccagtgacagccattaactgcacccctatcggcactttttcaggatcagtcggattgaatctcgccactcgcccgaaagaaggacgcaaaccgtgaaccccgcaggcatacgctggataccggatagaacctgccaagtcggtccctatcgcaattgcaccaagacctgcagcaactgctgctgcggcaccaccagaggatcccccaggtgttaaagaaggattatgcggatttctcgttgatccatatagccgattttcggtgaaccaacgatagctaaaagcagctgtattcgtacgccctataagtaatgccccagatttcagcaagtgatcgacaaccgcactgttggagggagggaactcatgttctctggcccggactccgtctgtcgttgcaaacccgatttgatctatgctcgcttttatggttacagggacacctgcgagagttcccacactctcaccttttgcaagtgcaatatcgagctcttcagcacgtcttataatctcttccggccgatattcaacaaccgcattaatatgagggttgacaccgtcaagtcttgcaatcaccgcagtagcaacttctctgacagaaacatccttttgatgcacaagcttggaaatttcagtcgctgatagaatggaaagatcttctctagacatcaccataccctatattgatattggagataagcccgtatccttgtagaacgaggttacatgtttcacggcaacgtataggcgatgacataatcaccccgatccttgtctgaacgctgcgcgccacctgcggtcacaacaacgaactgttttctcgtttttttcccaatgtatgtgattggagctgcttgactcccgactggcaatcggctgcgccaaagttcgctaccgctacgactgtcgatagctcgaagataatagtccatcgaacctgagaaaaacgtgacccctctcttagtcacaagaggccctcccatggttggtaatccaatcggtaaatgcaacctattgtggccagtcctcagtgggcgcggaactatccgcgatcaaagcaataggtcaagatactatatgacaagaatggagccacggctgggattccattgtgattgtacaatttcggcgctgattaacggtaaccattgactcagttcaaaagttttcatgattacgtcaacagttggtatttcagcgtattaacagtcgttaatgcgcaggatcagcttttatatttgaaaatatgagcacagctagcgccagaatggcaaccactccagcaagtgttgtattagtcagaagtccgtatttatcgacaacttggcttccaaggaacgatcctgacgcaatgccaatattaaatatcgcgatgtaaagagaggtcgcaacttcaattgactttgatgcagcaatcatcatccatgtcatcaacgaaaccgaaactccgccatacgcaacgccccacaagagagtaatgaggctaccacctgtgatagatcctcccaaaggagaaaaaaggagaacggcagcagttatgccaattgcgataaacacgagagtccagcgaagttgcttcgtagcggcgctgccagcaagaaaattccccgctattccagcaaggccgtaggcaaacaaaagtggactaatccagctattatcgaacttagagacggtccggagcagtggtcgtacatatgtgtacgccataaaatgaccagcgaccagaaaaaacgtgaccaaaaggccgactaaaacttttcggttcgcaagcacctcagcaaactgtcctattgttacagagttattcaccggaagtgatggtaatgattttatgaggaggattagcaccagcatcgctaaaatagccattgctagaaatgctgcacgccacccaaaagcgtcaccaataaatgcccctagtggtactccgaatacagacgccgcagcaactcccccaaaaataatcgatgtcgccagaccaacagaacctggtgacaccaagcgccccgccagaccaccagcgatagcccaaattccccccatgcagaatccgacaatgacgcgtgccgccaacaaccagttcatgctggttgcggttgccgatgcaatgtttgccataataaggaggataataaacctgagcttcgcttaagggaagggaactaaagtgcctgaggcacgatcaacgtttttgctaaagaaaacaaaatagtggagaccctcaggcatgtctaatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatattttacagccgattttcccggattagtcagctatactcgtatcctcaccctgaagaaaagggcgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccacaggaaaccaggatgatcgtcagccagtcagagcgctgacaaaaggactaacaggatgtttgtatggtgataaggggtatttatcccaggctttatgcgatgagttagaagcggaaggcatcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgaaatcgctatctttaaacgaagctgaggttaataaggaaacagaggatcgttctgcggtttatgcccccagaggcgagaacagcgagcggagcaaataacgcagcgagcagcgccggcaacgaaatcattaatccagcagtgccgacagttgagttaagcgtatccgcaattggattcaagagaccgacaggtaacatctcggttgtaacgacggaaaacgttgacaaacctattgcagtcacagccaaccacggtctcataacatttcctgtttgctcctctaccggatgggatctgttcattgaatttcctcagttgaagactcttttttgaatagactgttgcggatgatcaggaaacagaccgatcgagggcaacaacgccactgaactgcaacattgtaactgtatccaatcagatgataaactacactataagaacaacattggggaaaattcgtggctaatataatacaaatgcctttcgatcatttatccgacattttagtgtttgtaagagtcgctgatgcccacagtttcacaatggctgccgagaaactcgggatatcgcggtcggctgctgggaagtgcattacccggctggaaaaatgcctgactaccaggcttattcaccgaaccacaagaagcgttagccttaccgaggaagggcaggtgttttatgagcatgctatacgcatcttggccgaagtcgacgaagcgggaaacgtgataaacaagcggaaccaaacaccaaaaggacgccttcgtatcgatcttcctgtggcattcggtcgcttacatgttttgccaattctccgcaatttcctagagaggtggcctgaagttgacgcggaagtcacgttttcggacgagtacagtgaccttgttcgtgatgggatcgatttgaccattcgcattggcggtaacgatgatagccggctcgttcgcaaggttctcgctcctcaccgactcattacatgtgcatccccccactatttagaaacttacggtattcctgaagtgccagatgacctgttgcaccatgacacgttagtgttctcacatcgaggtatgccagttccgtggcactacgaagtgaataaccaacaccgcgattaccctgccaaaggaaggatgcgtttcaacaatacagaagcgttgcgagatgcagccttagcagggtgcggcttatgtcaagttggtgccttcctggtcggcgaacaagtagcagccggcacccttgtccccgtattagatcgattttgccgaactgagccgccaatatgtgccgtttaccccacaaaacggcacctgtctccaaaggtgaaagggtttattgccgcaattgaagattgttggcacgggcaagctgtatgggaacccacttgacaaatttttgtcgaccatttcagttttgaaaaacttaattcttaagaacccgtctatgaacatcgcatagctgctaatcttagaagggtcaatcgctattagatttcaatgaaatttgttaagacggaaaatatgggctagaccatttttttcagagaggtgtaaatatcagtagaagtttaaagtttatagataagatattggagcgggaaacgagactcgaactcgcgaccccaaccttggcaaggttgtgctctaccaactgagctattcccgcgtcgctgatggctgttatttagcctgaagtgcctgaatgcttatgattaataatactatttttaatctgcatgtccggaataggcgctattatggacttgctcagagaagatgacaagtcctttgcatgcactcttatgccaaacgttcaaaaaacattcgccaatgagagtatacatccattttagaaacatttgtgattctaaaaattaacactaaatatacaactaacctctaataagatttgtgcttgtcggaataattctagggcaatagattagagatagttttggtcgtatcttagacaataatgctcctcaaaaagggccaagtgtatgactcgacattatccatctaaatttgtcacaggtactgatgcccttgctgagcttttactcgctcaggctgaactggataaaagccataatctcaacactgcggggtttgtttctggatatcgcggctcccccttagcccgtttagatcaggcattatggcagcatggtaaagagcttgctcaagccaatattcgctttcaacctgccatcaacgaagatctcgccgccactgcacttatcggtactcaaaaagtcgaatccgaccctgatcggaatgttatcggcgtctttggcatgtggtacggcaaagggcctggagtggatcgctctggcgatgcgctcaggcatggcaacgcctatggctcctcaccacacggcggggtacttgtactcctcggtgatgaccacggttgtgtctcctcctccatgtcccatcaatctgatctcgctttaatggcttggagtatgccgattttgcatccagcatctgtttctgactatcacgatgtaggattatggggctgggcggcatcacgcgcgagtggggcgtgggtcgggtttaaagcaatcagtgaagttgtggaaagtagtgctatcagagaaagcaaaccctttcctgagtatgaaacacctgaaatcgattctgggccagatgggctgcattggcgctggcctgatcttcccggcccacagattgagaaacgcttggcctataaacttaaagccgttgaagccttcgccagagctaatccgatcgatcaactccttgccccgtgcgcccatccgcgtgccctgctggtcactgttggcaaagctcatcgagatgtgctggaagccttacgtgccggaggcttaacgccttcccaactcgccaaacaaggggtggcttttgtccatgtccgcttagtctatcctctgtcgccgcttctcagcgatcttgcttcacaggtcactgatatttttgttattgaggagaagaacgctgttgtcgagatactgctggcacgccatctggttaattcacagaaaaatattaagctgataggcaaacacaaccatcttggccagcaacttttacccgcagacattgagttacgcccttcattgattactcctctgctttctggatggctacacaaactcgatttgtttctctcagttcctctggaatgggcaaccaaaacaacaccacacgatctcacgcttcccaaacgcacgccttatttctgcgcagggtgtccccatagcacttcaacccgtttacctgacggcagccaagcccatattggtattgggtgtcatgtcatggcggcttggatggatcgcaatacgggatttggttttgtccaaatgggaggggaaggtgccgactgggtcggacactcaccttttatcaaccgtccccatgtctttcagaatttaggcgatgggacctatttccattccggccatttatccattcgccaatcagtagccgcaggcaatcgaattacttataaattgctatttaatcaggctgtggcaatgactggaggacagccactagatggcaatcttaccatatcgcagattgcggccttaatgctggctgaaggggtcaaaaaagtcgctatcgttacagataatattgataaatatcaggataaaaacctgctacccgctaaggtgacgctctatcaacgtgattacctcgaagaggtgcagaaacgctttcgagaaatcgcgggggtaaccgtaattatctacgatcaggcctgtgccacagaactgcgccgcaagagaaagcgaggtctggagccgaaagcgacacgacgcgccgtgattaacgagttggtctgtgagggatgtggtgactgtcaggtacaatcaaattgcctcgcagtgatcccggtcaaaacccctttggggactaaacgcaagatcgatcagcacgtctgcaactccgatctatcctgtctgaaagggttttgccccagctttgtcaccgtcgaaaatgccaatccacgccatgatctcagtaaaataatcccgcaaggcgatctagacaaattactccgtgaattaccccagccaacaccgatcattagcgataacccttatgaaatcctgctcgtcggcgtaggtggtacaggtatcgtcacagcagggaatttactggcgattgcggccgaagcggataattattccgtcagtctgctcaattttacgggctttgcacaaaaaggcggtgaagcaatcacccatgtccgattatgccatgatatgaataagctacatcaagtcagaattgaccgtgggcgcgctaatctcgttatcgcggctgatttagtggccacaacgggacaaaattcactgacagtgatgtcaaaaaatgcaacgaaatgcgtcctcaatacccatgaaacgcaaatcggcactatgcttcgggctcccaccctgaatctggatcatcccaagatgatgacgactcttcaccaacactgccaaacattaaattccattgatgccgaaataatggcggctgatctggtcggtgacagaaaccaaacaaatatcgtattaatcggttatgcatggcagctcggcaagattccaatcacgctttctgctatcgaccataccattcaggcactgggcaatgccacagacagtgcacgacgcgctttccatatcggccgcattgctgctgtacagccagatatcctgaatgagcgcctgcacatcaagccgcaaaaaagcattaagacgctggatgatctcattatgcatcgatatcaatttttggttgattaccagaatgaaagatatgcacagcgttatctcagtcgcgttgctcagattcaactggtcacgcaacaaattgatgcagaagaaattgtcaaatcggtctctgaaaacttatttaaactaatggcttataaggatgaatatgaagtcgcgcgactctacgccaaaagcgactttttcgagaatctccgctcacagtttgataatacggataacattcgctttcacctcagcctgccccttttcaatcgcaaagacccacgtacaggcgagagaggaaaaaaagaatatggcacatggatcatccctatcctccgcgttcttgccgcatgtaagccacttcgtggaaccatgttcgatattttcggctatcaggaagaacgcaaacaggaaagaaatttactgctcgaatatgagcgattacttgattttctgatagaaaaactgaaccgcgataatttagcgatctgtcagcaactcgcggagctgcccgatcaagtccgtggcttcggtcatgttaagcaaaaagcgataaaaaacatgatggagcgtaaggaggcattactggaagagctataaaaaacagagtgatagcacagataaaaaatatttcgggtacgatgaggttaagcggttcccatattattaatgaatgaacggctgcgaaaacatagaagccactgttggcaagttttcatgcagccgtttagcttaacccagataatgcgtcattatcagtatgctttttttgacatgacatcaccctgttaattgaaggatatttctaccacattcattgcgcttgaatagcgagatcgtcaaatagcagcgaatcctgaagccgtttacgcatggactttttggatgtaagcaacatgccaacgtctcgctccaaacaagggaaaaagcggtcatgctgttcaatatcactcaaagatcgcgaggtgttgacgattgcgcgagcacgaggttgccgaatagcttcatatcggcgtagcgcagcactatagtcctcagtatttttaagcacataccccagcaccgcagcatcttctatagatattccagcaccttgaccgagactggttagcatcggatgagcggcatcaccgagaagagtcactcgtccctttgtccaattttcagggaaggttctatctttggcgtcaacagtgattatggattcactgtcagttgagttaatgatgtcttgaacaagatccggccaacccgcataaaactcagctacatccctattcgtacctttccattttttggcgtcatcattcgacatattcgcggttccccaccaatacacccagccatcaccgatatctacaatccccatacgctttcctctcccccaataatgggcaacatagccgggtgtaattttgggatgggagtatttaactaaggcgagccagcaaatataaccggcttcctggataatagattctgttccgatcgcatcacgaattgcagaataaaacccatcagccccgacaataatgtctcccgatgaaacggtgccatcctcaaaattgatatggacggcatcactcgtttcgttatagccagtgacgcgcttaccaaaactaatatcagcatcgccaagctgatccaacaacgccctctggagattttcccttgatatgcaaatactcggtgcgccttgctcatcagagattttttgaacagggagacgcttcaagagcaatcctgagctatgtcgaatctcaaagtctcgaacttcagcaccataattcttcaacccgaggtcgatatcaagcagcttcttcatcgccgaactggcgtttgacattaccgacagacccgatccggtcgctcgtaaactgtccgtcttctcaaagagacgcacagaccaaccaatttttttcaatgcgatcgcgcatgacaacccaccgataccagtaccgacgatgagcgcagaaggttttctagacattagcatccacccctttcactttattaatctcagtaataattgccgacaccattggcccaacgaaaggctcttccatgatagtcagatgatcaccatccacttcaatcaagttaactcgaccagacgtcttgccaccccagccattcagaggatcatgatattcactacgtatggtattgtgcatctcttgcaatatctgaggaagaggctgccttgcgcgaataagcgtcacatcgagattcgggcattgtgcgttgtattcagccgcggcttgccaattagcattatatacctcgaaaaggcgctgcatgactgcttttgtgctgccttccgggatcgctcctatctgggttgcatgatcagttatatattcgaatttctcttgcaaactttcaatataggaaggaacaacctgaacaggtaacgaagatcccttcgatgtccacagcaattcccagaagaaccaactgagcaaagcatcatcgctagcctgaccttttgcctgtgagctcagagccatcgtatcaagaatcagaacattagagaccgtttctcctgatcggattaactgattcgccatttcgaaggcgataaatccaccataggaccagccaccaatcacataaggacccgtcggctgaattctcttgatcgcatcgatgtaaaaagcagcctgctcttcaatagtcgttattggtgacgaacccgcatcaacacccgatgcttgaagagcataaagtggctgatcagatggcaggtgtggaagcattcgcagatatgacaggatatttcctcccataggatgtacgaggaagagtggcctgcggttacctgcttcgcgcagtgggacaagtggatcaaacttgaactgaccaccaccatcttgaataagcatggcaagcttcgcaatggttggcgcgctgacaaatgccgaaagcggtacgttaatgccatacagtttttcgacaagaaccactatgcgcattgcagtcaaagaagtcgcaccgcaatcaaaaatactctgctcaggggctatttcggggatcttcagtagctctgcggtcagctcgcaaagccggctttcatactcgccttctgggccacgataatttttttctgatacaagctgtatatccagtttccggagcatcgcatcatcacgcttgccactcggtgtcttgggaagctcatttatccatgtgatgtgtgtcggcaccatatatgcgggtaattcagctccgataaactgccgaagttcctccaacgcaatacgatcttccttacccaccaggtaggcgatcaagtatgaatccagatcgtcacgaggccgagcgacaaccgctacttcaacactttcccggcggttttcaaagaattcgaggatttttaactcgatttcagagagttctactctatagccacgaactttgaccagtgtatccttgcgaccaaggctgataatctcgccgcatgctgaacggatgccaatatcccccgtccggtaaaacatcccacctggcacgtcggcgtgtgcaataaactttttcttggtttcctctggcgaacggtaatatcccgatgccaaagcttctccgaacacacagatttcgccaggaaccccatcgggaacgacatttgaactctcgtcaaggatcacaatgccgacacccgtgatcgggataccaatcggcggaagtgctggaaactggctgggatcactgctcatagtgtaacttgtcaccacatgagtctcggttggaccatactggttttccaatatgccgccgggtagattatcgacaagcgtccgtatctctttggtgacacgcaactgctctccagacgagacaatcacccgcagtttcttcggaaagaatcccagcataactgccgtctcagcgagttgctgcaaagcgatgtacggaaggaatatccgctcaacgcctttatgatcgagatgcctgaccaaagctaccggatctcgacgttccatctcgctaatcagatgcaatgtggcacctgatgaaagggtggagagtatttcctggaaagaaacatcgaaactcaaaggcgaaaactggagtgtagaggtaaccttggcgccactccttattttattttgccagccaacaagattgctcaatcccctatgcagcatagtcacgcctttaggcgtacccgttgagccggaagtaaatagaatgtaggccgcatcagtcgaatctatcgcagcatcgtctctttcagcgaccgcctcaattgagtcatactcaaggaaaagtactcgctcacttgcgggtagctctgtaacagaacgatcggttacaaccactgccggatttgctattttcaatatcaactcgattcggctggctgggtatgataaatcgatcggaagacaaatagcgcctatcctcagaatagccacgacagttgcaatttgttcaaacgaccgtggtagtgcaattccaaccacatcctgcttattgacaccacgttcactcagcaaaaaggcaatccttgtcgccgcatcccataactgctgatagctccactcgctgtcaccatacgtgatggcaactgcatccggatcacgttgaacgctatttcggatcgtggctggaagtgaaataaatgccttatccgaaattctttccacaaggcacccaacttcagtaatcgggcgactgagggatacgggcatttctggttgataggctattcgctctaacgcacgattaaagagcctggaaaaaactgccccttgttctctggcataaacgcttccattgatatccatgcgaacactcgtacgtttgccatcaacatcgcgcattacgtttaccagaatatcgaaatttgtttcctccttcggatcaaaggctacgatttcaatatctgtcttctcagaaatatcctgcaatatatgaaagtgtacatagttaaatgcggtctggagagaaaacaattcattgtcagcttggatttggcttaagggaaaacaccgatgtttatgacttcttttttcatttcggtacaacccttcgacaacctgaagccaattcaaactctttatatcaacccttaaaggaagtgtgttcaaaaatagccccaggatacgctccgagtgcttaatttccggccgtgtatgtgtcactacacccgtgacgatgtcctctttaccactcattaacgcaatggcggtgcaatgagcggcaagataaagatgctttatagggactcgaatagttcttgccagctgattaagtgcggcatcaagtacaggatctattaggaaacgataagaaaaaatacgcttcactggagcagttgaatatccagccaagcctattggcaatgtattcgtcgcgccagagaggtattctttccagtaactcctgggctcactcgcttcaaggacttctatttcgttttggacaaaaactgatggatttgggagttcgtcttcagggtaaccgagattggcaccatcattcccctgagaataggacaaaagaagctcacgtatcaggtttgcaacgcttcctccgtcaagaatcgcatggtggaagctgaaaactaagtcgatgtagtttgattcactattagcaaatatcgctacgtggaaaaggggtcccgatgcgaacgaataattataccgtgaccacttatccatatgagcaagaactgtatgctcatactcaaccacatcaggcgtttcaattgataaaacatcatcaattagaatctccggtctgattagctgaaggggtagatgatagtcactaaggttaaaaactgtgcgtaatgcggggtgcctacgagccaatccttgcaaagcagacctgaacgcgacttcattccacgccaacttcagggtatatcggaatacatctttgtaagttctcgcgccctccatctctcgactatggaaaagcaagccaagttgcagctgagatacgggataagcatcatcgtatgctgaactcagcctcttttgatcgatttcacttatgagagcaaaaggaggaagtgcttctttcgggctactgagaacacgtgacacactttcgaggacatttcccaagctacgcactgtcgtatactgcgccagatcggataagccaacgccatacccgtgactttccagttctgatctcactttcaacatcaagatggaatcgccaccaagcgcatagaagtcgtcatctgcactaatgtttgaccgaccgagtactttctcccatatcttggcaacaatcgtttcggattcatcaagttttactgtctgcggagatgttttatttccactgacctctctgagagcactgacgcgatcaaattttccattaggtgtaagaggaatgcaccccagtcggacaaatcttgcgggaaccataaaggaaggaagctgtttcccaagttttgcgcgaatatcacgctcatttaagtctcgtcggcctacatagactgcaaccaggtgttttccccgagcatcatcttcaacgataacctccgcgttcagcacctctggcaggttaagcaaggcgttcttgatttcaccaagctctatgcgattgccgcgtatcttcacttggccatccatccttccgaggtaaaggatggatccatcttcagcccaagccgcgagatcacccgttcggtaccagcgactgcaactgtcattctgatcgataataaaacgttctgccgtcagctcgggacgattcaaataacctcgcgctaattgcacaccgccaatctgtagttctccagatatacctataggctgcctgaccccatgcaatgaggctattctcactgaggtattgttgatcggaaaaccgattggtactgcgttgatatccgaatcctgttccagatttaattcatagtaggttacgtcaaccgttgcctccgtcgggccatataaattaattagccttggcggacagatatcgtgactgaaaatcttcctgtatttattcacgacagcgggtgttaacgcttcaccacttgtaaataggcatttcagactgctaaccgataaaagagactgtctatcatcattcaaagtttgcacatacggttcaaacattgacggcacaaaatgcgctaccgttaccccgtgtgtagaaattgtctggatcaattccctgggatcccgttgtgcgccttgttttaggagtgcgacagaagctcctgtcatcgcccaccaaaaaagctcccacacagaaacgtcaaatgatatcgacgttttctggaggatcacatcgtcactggttaacggatgtatttcctgcatccactctaaacgattaaccactgagtgatgctcgacgatgacccctttgggacgaccagtagaacctgacgtatagatcacatacgcgggttcattaggctgggccttgcttttgtatttataatgagaaggtaattcagttggcaaagcgtccagatcaaaccaacgaggatcatcagatttcataacgtggggcagattagaaatgactaacttggcgttgctgtcgttgagcatatattgaatacgatcttcgggatagtcgctatcaatgggtaaataggctgccccagttttgaggacgccaaatattgcggccaacatctctggcgatcgctcgactgataccgccacgatatccccctgaccgattccccgttcttctaacgcagcggcaatggtggatgaccatgcatttaattgagaataagaaagcgatgtgccagtgtgatctcgaagagcgatattttcaggaaattgttcggctttagcctcaaagagcgaaacaacggtttcattcacgctgtatggcttagttggcccattttcatactgtcgcagctgctccgtttgcttaaatgtcagcaagtttacttccgacacacgcttatcaacattattaccaaaattatcgataagatgaatgaatgtatctaagaatgcattcgctgattcctcagtatcaaatactgagctattcaaacacacatctccccaaacatctgcattattgccataagtgtacagatgaattgctatcgcatcctgggtatgtatgtgcgcgatattctgggttttttcttcaaatccagcaattgccccccattctggataacgcagataggacattgttacatcaaaaagttgacgagaggaacttgccagagcagaaataataccccctaacggaaccgattctttgtctttcagaaagacgataaaatctttgatctgcgagtaaattgctctgagtgtattttgaggtaatacctcgactttcacgggaagaatattagctcggtgactgactgacgtaatttctgtatcggttctgttaagaaacggcactccaatgaaaaatttctcgcttccgtatgcatttgacagcagaactgccagagccgttgaaacagccaaaaaaggagtaaaaccattttcaataccatgagcgacttcgtgcgctgatatcttgaatggtctgatatagctgggggatgtcgaaagagtcgctccagattttgggaataatacgggatcggtatcagcgattttcacgacgacgtcgtcgattgcctcatcaagtttactgccttccagggttggatattttgtcgcgtaacgtttcacccctttgagctgttcatttagacctaaatgattatccgcataagcaccgagtattttcttggacaacagattcagaccccaaccgtcggcaacgatgtggtgggcacgtatcatcaatatagttgcctgatctgtttggcctatcgcaatatcgagcaagggtggaacagaaagatcccaaatcttacgaggccactccttgaagaatgaggcaaagtcgtcttcattcttgaattcatataactcggcacaaaccacaacgggagctttcctcagaactagatgcccctcttgctcgtgaaaagacttgtgggaagcttgctccgactccagaacttgttcagcaaccctcttgagattcacgagatcgatagatctgggtaacaattcactaagagccactgtgaactgatggcagtgcggatcatgtagctcctcaacccataaatccctttcgtacgaagtcggttctgcaatactcatagcttgaactccatttagactaatgacattagctctacgaataacgacacaaaccgagtatttctgggctgaagctgtccccttgattcaaccaagccaaaccgctccatctcggctcttaatattcgaaaaaattatttcagatgacataatatgttatcgaacgcacaatatgtcactcaatgacatattgtgtcaaatgacattttgctaatagtatcactagtcaactattacataagtgtccttttatgcaataatggaggttcaaacacagatcacttattccagacaggaggaaacaggcgcgtgacagatagagaaaaagttggccgccgtgagcggaagaagcttatgctgagggatgccctaattaagacatcttacgaactttttgctattaagggatttgatgaaactcgagtagaagatatcactgaaaaagttgacgtttctacccgcaccttttttcgatatttttcctcaaaggaagatgttgtccttgactaccaagaggcagaacacaaagactttattgccgcactcatccgccgtccacctcatgaacccgcgttatcagcattacggcatacagctgtcgaaattatgaaaagatgcgaaggaggttcttatggctttaatacgaactgtttcatgacccttcaagacttgataaggaaccatcctttaattcgggcaaaaaatcttcagcgcggagaggatcggaaaccccctatcatttcgttaatcgctcaacgtatgggaaccgaccctaaaatagatattagaccaggcgtcttagccggcgttttagattatgcacattgggctacatatgacgtttggaagcggaaaaaacactcttctatgctttactctgatgttcttgatgaagtatttctaattatcgagaatggtctcaactttccagcaaacaatcagccagatatctagtgaccttaccctagataaccgaaaagttcgggtaaacgcaggcagggggttattaacgaccggctaaaaagcacaggatgcgagtggattttggtcattatcactggaacgaaaaaaggacctttcggtccttttttctgtgacttgcagaatttcataaaaatctacagtcctgaatttggagcgggaaacgagactcgaactcgcgaccccaaccttggcaaggttgtgctctaccaactgagctattcccgcattgctgatgactactgtcagccttaatttctagatacgaacatcctataaccatttgatttaaaggaatttttctatatttacgtaccaagatgggcgctattatggacttgtttggagaagatggcaagccctttgcacacaacccaataccaaacgttcaaaatacattctaactgacgtgacatggacattttacacccgttgttgccctcatttttctgccgcatagcagggtcaatatgtcactctctgctaaccattgacgaaagattaaagtcataataacctatcattcaatcattacattgaatggcagcatatcgctctatcttcggatggacaccgctcatgacagcaaccgcattcctgccgtttgcaatcgctctcatcgcaacaggacggatagcaacgcctctagtgggccgtatcggtgcagcacgagtgacaagtactggcccgatggtcaatagcgtccatgtatcggtcatcaacagcggcctggcattgccgatggattcccactaattttttttcggattaacaaacactggacgaattcttttcaaaggatcgcagacttgcgtggaggtttacataataagaattggagcgggaaacgagactcgaactcgcgaccccgaccttggcaaggtcgtgctctaccaactgagctattcccgcttacatatcgatgcgtggtacttttggcgtagtactttcggtatgccgtactgttgaaattcttcatcggtacggggagcgcattatacgaaaaatcattgccctgacaagccccccaacacaaaaaatcgcgttcttttctctgattgatgattaaatcagcaaacaatccgtttcatcatcaatccagagattaattatcgtacaccccttacaccaaacacacttttttatttctggataaagtgctcgcggtagtacaccaactcagcaattgattcccgaatatcgtccaatgcctgatgagtattttttttgctgaaccccgacaacatttcaggcttccagcggcgagccaattctttaagcgtactgacatccagatagcggtaatgaaaatatttctccaactctggcatataacggaacagaaaacggcgatcttgacccacactgttcccgcaaataggagattttcccgcaggaacccactgctccagaaaagcaatcgtcgctttttctgcttccacatcaccaaactgactttgtttcacacgctcaaccagcccacttgcagtatgcgttcgcacgttccagtcatccatcaatgccagttgttcatcaggctgatacaccgcaataactggcccttccgcaaggatgttcagttccgaatcggtgacaatagtcgcgatttcgattatgcgatcgcgctctggatccaaaccggtcatctctaaatctatccagataagattgttctcattttttgacatgatatatcctagtttccttcaaaacagatagtctgtatcagtggtgtatcataacgtttttgatcactcacagcgataatcagcaaaatagatgaaataagtgaggttcggtggctaagaataaactctccaaagggcagcaacgccgtgttcaggccaatcaccagcgcaggctgaagcagccgctcgacagggctgccaataaaccagaaatggatgacagcctgtttggtgagccacaggaagggctggttatcagccgattcgggcagcatgcagatattgaagccgtagatgcttccatacagcgctgcaatattcgcaggacaattcgctcactggtcacgggtgatcgcgtcgtatggcgacccacattacagctccaaactgatgtcaaggtcaatgggatcgtggaagctgtgcatgaacgcacctccgtccttactcgccctgattactacgatggcattaaacccattgcagccaatatcaaccaaatcatgattgtttccgctatcttgcctgaactttcgctgaatattatcgatcgttatctggttgcgtgtgaaacacttaatattgagcctctgatcgtgctcaataaaatcgatctgttggatgccgaaagtcgtgcatgggtcaacagtgtcatggacatttaccgccacattggctatcgcgtactggaagtttccagccataccggagaaggcgtatccgagctggtctcccagctggtggataaaatcagcatctttgcggggcaatctggggttggaaaatccagcttgctgaataccctgctgccagacgatgaaaaagatattctggtcaatgaagtatcggataactccggcctgggtcaacatacaaccacaaccgcacgcctgtatcacttcccacagggaggcgatgtgatcgactcccctggcgtccgtgaatttggattatggcatttaacgccagaacaggtaacacaaggtttcattgaattccgtgaatacattggcgaatgcaaattccgtgattgcaaacatcagactgatcccggatgtgccttgaatgcagcactggagcaaggagcaattgcagaagagcgtttcgaaaattaccatcgaattctagaaagcatggcgcaggttaaaccacgaagaaatttcacggatgtccaaaaataagacaataattaacgatacgttaccctgacattcaaaataatggcgggtacaatagtagacttttgcccaatttgcctatcaaaaatccaagaggttgatgtgctggataatattaaaattaaattgcaatatttactgccaaaacaatgtattactaatttggcaggctggttcgccaataaaaaggcgggctggttgacacagcttgcaattcaatctttcgccaaagtctataaggtagatatgaatgaagccaaaaattcttcattcacagcttactcgacattcaatgaattttttgtccgcccattaaaagaaggcattcgtcccatcgtcaatgaagctcaccagttggcgctgccagcagacggaaccatcagccagctcgggataatccgtgacgatcaaattattcaggccaaaggtcactactataccgtagaagctctgctggccggccagcatcaacttgctgaacaattccgcaatggccatttcgtcacaacttacttatcacccaaagattatcaccgtgtccatatgccgtgtgacggcgtactgaaagagatgatctatgttccaggcgaactgttctcagtcaatccattgaccgcagcaaatgtccctaatctgtttgcacgtaatgagcgggtcatctgcctgtttgatacagctttcgggccaatggtacagattctggttggtgcaactattgtcggcagtatcgaaaccgtctggagcgactgtgtcacaccaccgcgtgaaggcatcatcaagcgttgggcttacccagcagcaggtcaggaaggcgcgatttctctcaagaaaggagaagaaatggggcgtttcaaactgggttcaacggtgattaacctgtttgcgcccaatcagattcaatttgccaataatttatacagcggctcacaaaccctgatgggtgatctgttggcgcaggctgtcacagcaaatgaagagcaggcagcaaatgcagatgatgaatctatgaacaaagatatcatcagctaattttcaccaccaaggagccccttattgtgcgcctgattatcagtttacttttcagcctgtttcttgcgaatccggctttcgcttcgatagcacagttggatgaaacccaactgaaacaagagctaaaacaggttggaggcagtaaaaatccacaggatgctgaaatcgcacaggcacttcaaggggcaataaactggcttaacgatgctaagtccaccaatgaacgcagccagacataccaacagactattgatgattttcccaagatcatcaaagaattgcgtcaaaaaactcttactgaaagtgatattgtcccctcaattccggccaatcagtctatcggtgagttagagcagcagactctccagaccagtagccagttgttggagcaagagcgccaactacaacaggaacaggataagatccgggaaatcagtgattcaatgaacctgctgccccaacagcaggttgaagcgagacgactgctggctgaggcaacttcccgcctccaatccttgggtacgcctccgacacccctgaccgaagcccaattgaaacttgttcaggccgaagtcagtgcccgcaaagcggccaccaatgaactggagatgtcacaactttctgctaataatcggcaggaaatcgcccgcatgcgggcagatttatttaaaaaacgttatcaacgtctggatctcaaactccagcaattacgcaaccaattaaacattcaacgccagcagaaagcagaatcggcccttgaacataccgaaatgctggcggagcaggcgggtggaaaactacctcagtttttgctggatgagctccatcaaaaccgccaactgtcacaactgctcagtcaacaaacccaacgcatggaagccattggctcacaacaacgcaaagccgctaatgatattctgcaagtacgccgaacactcaataccatccgtgaacaagcggaatggctgagtgattcaaccgcactcggtgaagcattaagaactcaattaacccgcatccctgatgtgccgaaatcccagcaacttgaccgaaatattgtggaattacgggtcgaaagactgaaatatgaggaaatgcaggagcgctcccagcaggaaaatgatcaagcattgccttcgcctcaaaacctgacatcagggcaaaagcaggtctatgaatctcttatccgtaccagaaaagagttattgaactccctgctctcaggttatgacaatgaaatattggaactcacaaaactcaaagtcgcaaccaaccagttaaatgatgctttaaaagagataaaggatgctacccatcgatacctgttctgggtcacggatgtcaatcctatttcactagactatccgttgcttgtcgttcaggatctgacacggctgctctctctggatacgttatctcagctaggggtcgcaattcacgttatgctgaccacgaaagataccctgctctatttactgggtacgctattgctggtgattttcagtatcagctcacatcgtcaatatcatgcgttccttgagcgctccagcaaccgcattggcaaagtcacacaagatcatttctcgcttaccctgcgtaccgttttctggtctattgtcgctgcattgcccctgccgatactttggtcagccattggttatgggctgcaaaatgcatggcagtacccgatggccaccgcgattgggctcggtgtcagtgagacaacgccagtcctgtgggttttcatgctcagtgcgtcatttgccaatccgaatggtctgttcatctcccacttccgctggcctgaagaacgcataaaacgggcaatgcggttttatcgtctgtctattttcttggttgtgcctctcatgatggcgttgatcacgttcaataattacagtgatcgcgaatttgccgcgacactcggcaggctgtgcttcctgatgctgtgcgtttccctgagcctggtgaccagcagcttaaaacgcgccggagtaccgctgtacatggacaaacacggctcaggcgaaaatatcatcaattctgttctgtggtggatactgctctctgccccgatcttggccgcgcttgcgtctatactcggctatctgcagactgcacaggcgctgctgggacgtttagaaacgtctgtcgccatctggttctccctgctggttatctaccatattattcgccgttggatgctgatccagcggcgaaaactcgcctttgagcgagcaaaacaacgccgagcagagatcctagctcaacgcgctaaaagcgaagaagagacggccaatactaatagcagcgtggaaggctccattgaagttgaagaaccggtgatcgatctggatgcaatcagcgcccagtctttggggctggtacgctcgatcctgacgatgattgcgttggtttcactgattctgctgtggtcagaattacattctgccttctctttcctggagaatatccggttgtgggacgtcagcacgacggtcaacggggtcaataccatccagccaattaccatggggtcagttctgattgcgatcttagttatcgtcatcaccacgcagcttgtccgcaacctacccgcgctgctggaacttgccctgttgcagcatctggaactgacaccgggcacaggttacgccatcacgacactaaccaaatatggccttacgttgattggtgggattgtaggtttctcgctggttggcattgaatggtcgaagcttcaatggctgattgctgcaatgggtgtgggtctgggttttgggttacaggaaatttttgccaatattatctctggcctgattattttgttcgaaaaacccatccggattggcgataccgtcactatccgtaatttgactggcagcatcacaaagatcaatacgcgggcaacaacgctgtcagactgggacagaaaagaaattattgttcccaacaaggcatttattaccgagcaattcatcaactggtcactgtctgacacgatcacccgtatcgtcttaacgatcccggtgccggctgaaactgattccgcagaagcgactgacatattaatgaccgcatccagacggtcaccattaattattgataacccgatgccagaagtgtatctagttgatttacaaaacggtattcaaatttacgaactgcgcgcttacgcagcggagatggggcatcgtatgcccgcccgccatgaagtgcatcaatatattttgcaggagttccacaaacacggcattaccctaccattcccgccatttcaggcacgtgttgatatcttcggacaagaaatccgcagtgccacaaccaatatttcgggccgcaatccaccgcgtaaaccgggagaactataagctcaattcgagatgatgaggcgtataccttttcagataagtggattactggctttaaatggcgtttcgatcttgggaaacgccattacagacattgccatcccttggctgattctagaaatatcaggcagtccactgctggtcgcagccgtgatgtctgccaaaatagtgccgttgatattatccattttctttagcgcacaactggtagataaatacggagccttccatatttcagtcttatctgatttggtgaacttcctgagcgtcttactgatccccgtattttatacaatggatatcatgcacttttacctgttggccactttgcttatattctcgacaattttggattctccgggacgtttagcaaaagacgtaatgctggcgaaagagattaaacagaataaaagtgaacatgagttgatcaatggaatcaacagtaccattgaaaatatttgtgaccttactgggcctgtattgggttcattgattattgccctgttcggtacaatcaacgccctatacttcgatgcggtcagttttttagtggttgcgctggggctgattattctgaagaaacattttgtcaccattatcaatgaagttactgaggttccttccctgccacaccactatttccttgaagcactcaaatacgttaagtcagaaaaggaactgttttctattcttatcctgagttcggtggtcaattttgtcatcgctccattcctgatcgtttatttaccttatgtgaataaggtcgagtttaattccgtcgtcagccttggtgtttccatgacctgctttggcttaggcacaacgttctcttccttgttgtatggtatttatggtaagcatttttccagcaaccaaatcattctctctggctatagcctgctggtattgtctctggtctctctcaatctgttcaatgggcaatatattctttttgcccagctatttgctatcggttgctgcattggtttttctgctccagttgaaatcactttgatccagcgccaagtgccagagaatctgtttagccggataatgacgctgttttcttctacgcgctttcttgccgtacctgttgggtacgtttgttttggtactctgctgggatccagccttgctaaacaaacaccgctgctcatggcagcaatggtattgggtggtttatggatttatctggttatgcgtaggagagcgaaatgaagacaactctttttcaaattgacaaactattacaacgccatgtgtctttgcccttataccgccaaatatatcagcgttttattcaagcgattaatcagggcatattgcgacctgaacaacgtgttccgtctattcgtgcgttatccagtgaactgcaagtttcacgcagtacagtggaatctgcctatgcgctattactgaacgaaggctatctagaggccagagggcaggccggtactattgtgtccccaaggcttgcagacagggtattacagccccctgaaacacttatatcatcgtctatcgatgtgactagtatatctttattcgattccgcttcatccattcatccctcaccttatcaactagggctaccagcgttggatctctttccccgcaaattatggaacaccctcaccgtcaaacaactgcgtttgcaaagccgatatatgtcttacccgcaacctgagggctatttgccgttacgagaagcccttgcggcttatcttcaattatcacgtggggtgagctgctccccacagcaaatttttatcaccgctggctatcgcggcgctcttaacctaattgctcacaccctgatacaaccacgggatcaagtttggctcgaagatccctgctttcctcccagtcaacattttctatctcaaataggcgctgaaattattcctgtgccagtcgatcaagagggcatgaatatttcggtggctcaagaactcgccccaaatgcacgatttgctctggttacaccagcacatcaaagcccattaggcgttacgctgtcaatggcacgaaggcagatgcttttagcgtgggcagaacagaataatgcctttgtcatcgaagatgattatgacagtgaatatcaatatgatggacgccctcaccctgcactggccagtttgggatctaacaatgttttgtatatcggcacattcagtaaagttctgacgccaacactccggcttgcctatctcgtcgttcctccccatctgttaacgagatttaatgctgtatgccacactcggcaagatggctgtcctttattacagcaggccgtcgtcacggatttcatgcagggaggtcatttcgcccgtcatttacgtaaaatgcgcactgcctatgcacagcgacgccagatagtcattgagagtttgaatcaagtttttgatagccgcctgaggttcgatattcccgcaggtggcctgcatttgctggcaagacttgcgcattatgaagatgatgtagcactggctcaactcgccagagagcatgggcttggcattaccgccttgtccgcacgaagattgagctcagattgtggcaagggattactgtttagttttgccaatgaaaccacccccgaaaatgctttgaaacatgctcaattactgcaaaaatgcctgcctactacatcaagaaccagtaattaaacgatcactgacgcataccgattgcaaggcgattcattccattcattaatgcaatcgcgaaggtcagatcagtgatttctttatccgtaaaatggtctttcagcggtaaataggcatagtcatccgcatgtgttgtaacaacatgagtaagggattcagcccattccagagccaccttttcacgcagggtaaactgaccgctgacacgccaccctgccagttcagacaaacggcgttcagtttcctgattttcccgcaaagattgactgtgtttgttcaaacagaaagcacagccactgatttgggaaatacgcaaatagaccaattcaatcagtgctagacccaatggactttcttccagctcttgctttattgtacggaaaccctgtaacagctctggtgataaatcataataggcaaggcgcaaactactcatgaataaaactccttatctcatatctttgtgaatatggtaaacgatataacaatccatcaattcggataagggacaagatgagtgtttttagccatgacaagttatttagcttagataaaaagcagataaacaatcactcatattcagagcaataatatgtcgaattcataggatagtgattatttataaagataaaaaccgccgatcataatttttgatcggcgattttatgagtatgcaaaaccaacttctcaattagtgatacacttttagatattaaagcattcctttaggatctgctccaaaatcgttatctcctttagatccttccaagcagaagaataccaataacgcgatgcttaaaatcggaacaaaagccagtaaaaaccaccaaccggagcgattggtatcatggagacgacggatcatcactgcaagtgaaggaataaaaatcactattgcataaatccccaataacccaacacctaaagtttcactgattgcagaccctaaaacacaaagaactataatggcaatgtagttaaacagagtaaatatccaatactctttacgacgtgcacgccctgagaaattagcgtaattctttaaaacattaagataccagttcataatatcacttatttgaattatataaaaaagcagacaaactataaaagatgacggattttataccaaattatattttaaagtctataatccaccaatcaaaataagagtatttggttgtttatgacagtatcataaggaaatgaattcagaaattctcccaaataccaaaccaggaacactatatacatagatacctctggcacatatcaaagttatacattaagttatcagaggaatacaccaaaataattcattattaatatgcacttgacaacaattcatttagcatacttattattaatttggttatttctgtaaaaaacaaaatcattacaagcaaagataatcctcaatatttacagccaaagctcccactttcatttttaaaaacaaactgatttttctgtatgtccatgggaataattcctttcatccctattatgacaatcaatgtcatacaacctccctttcatgaatgatgctttccacgtccccatcagtacttatgccactcactttattagtcaattttatgattgttcaagcccgcaaccacaggattctcctatctgcaattcaaactcaaattcgcgctcctgcgcttttccattccatgtcctcaagatttcgatagcagtctgtgccattttatctattggctgacgtactgctgtcaaagaaggaacattaaacagtgattgctgtgtggcattgaaacaaaccaaagcgatgtcatcaggaacagtaagcctatgttcagccaatgcacgcagacagccgaatgcctgtaattcattggaagcaaacagcgcgcgaggacgttttccctttaacatgcgcagtgtcgcttcataaccaccctggcgggtatactcggtagaaaaaatccactcttcgcgcacggttaaatttgcctgttccaaggcatcactccagccggaaagtcgatcctgtgtattgagcataattcgaggcccacaaataatagcgatatcacggtaaccatgctgaatcagatgttgcgtaaccttgaaggcggcaagccgttcattgacacgaattgcactgacattcagatctgcattaacccagtccaacataacgcatggagttccactggcctgaatcaagtcaatataaggatgacgatcaacactggtatataacagaccatcaatttgacgattcaataagttattgatcaattctttttcacgcgtccgattgtcccctgaatcacccggcagtaatacctgtccatgtttgaacgcctcctgttgcaacgcataagcaactgaagagagaaaagggttggagatgtccggcagaataagcccgtatgactgtgtcgtaccagaaaccaatgccttggcaatattgtttggtcgatatcctatttttttaatggccgccaatacacgctgacgcgtcgcttcagcaacaggccgtggcccaccattaatcacataactgacaaccgctactgaggttccggcctctttggcgacatcactgcgagtcactcgtttcagatgtgaattcatgattcttatttagtccccagagaaatagagattgggaataatcaaaagaaataaaatatcatgccttggcatataaaaaagcgtttgaacacttcaattcatgttaatccatatcaaaaacatgagtggattaaatagcatcttcaagcaaattcagatccctgccacgtgtttccggtgcaaagaaagtggtgagaaacccaatccccgccatcaatataaaataacatgcaataggccgccaatgacccgcaaaggataacagcgctgatgccatcagtggcgcaatacctcccgataaaatggcacccagctcttttgcaaatgccattttggtatagcggttagccacaccaaagagttcgacaccccatgcagcctgaacaccaaatattcccagagaggccaatcccattcccacaacaatagttggaatgataatgataggttctcggctatccagcagaataaaagcagggaaggcatacatcattaatagcaggcagaaccagcgataggtaatgcgacggccaaagcgatcagataagtaccccgccagcggaatgatcaggaaacctagaaccgaagcaatgaagacagctatcgtggggactgatttatccaccatcagcacttttgccacataaccgatgataaaaccctgagccagataggaagggccattttcgccaacccgcaaacctaccatgatccagaatgcttttgtccgcttccagaagcgacaacgttcacagtcagcttgatacgcttttccttcagacagggtctgtaagcgctgtgctttcaattccgcttgatggcgttcaaatacaggcgtttcattcatgtgacggcggataaatagcgcaactatcgcaatcaagaaactgaacaggaatggtatacgccatccccaatcgagtaaacgctctttatccattgtcaataccagcagccaaaccagcgaggccagcaatgttccgctattggagccgagggcaatgatggaagaaatcaaaccacgtttttccggaggggcaaactcccccaaaatgacagcaccaccagacagcgccgcacctgcccccaaaccctgcatgaaccgtaaaataaccaaacagacgggagccaaaacaccaatttgagcataacttggaattagtccaatcaaagttgttgagatccccatcaacataaccgtcatcatcatgacgatttttcgtcctttgcgatcccccaaccatccaaacacaagagcgccaataggacgggcaacaaatcccactgaataagccgcaaaactggcaagtaaagcggctgttggtgtcgcatcaggaaagaagacatcaccaaaaataataccagccgctaaaccataaagtgcgaaatcggcatattccattgttgtacctaaccagcaggaaaaaatggcacgcctaaaatcttttcgcccttcttctgttgtcaggcatacctctgatgcatgctgcacatacgttcccgcaataattgcactttcagacggcataccaatatattccctgagtgttggaacagtaagtgaatgattccaacatgataagtcgaaaaactttatcgttattaattaacgttttttatatcaaaactatctactcgcgtagaatactaaaaaagaaagttagataatttaatttgcttcacgaatattagtgaaaaattagattttgtaattaataaaatttaaatatgccataatgaaaattatttaatatctgtatttaatgttatttacattaaatattcattaatacatgaaactataaactctaaaaacaatattattatttattataaaaatcattaagatacatatattttagtatttaaaatcatcagagaataagaaaataattcaaactattatatttagaataataataactattaaaaataatatcagaacaaatatttatcatttataaaaaataaaacaaaatacttatataataataaaaaataaataatgtaattaatcattgtaatgtaataaaaatatcatttccaaaaatggctagaaaaaaaacagcaccccatcaggtgctgctctcaatcaacattccgaaccattaccatcagacttgatacatgctccgcaaataatatgaaacggcatcatcagcattagcgccaatcacttccatttccggcaaaatgtctttcaggcgttggtgtgcgccctgcataatgcagcctttacccgccacagacaacatttcctgatcattcatgccatcaccaaagacaatgcagtcactcaattgatatccgatggcctgacagacttgttccagcgcatggcctttagatacaccacccgccatcacttccagacaatttctcagtgaaaagctgacattaacgctatctccccaacgcgctttaatcgtttcttccaactgttccaaatagtcatgatcttcactgacgtaatagaccttgcacacgccatccgtggggaagttatcacgcggaaaaatctgatactgaaaaacagattcctgaaaaaactcattctgttcaggactttcacggttaatgaaccaatcatcattacggtaataattggtgagggtattagggttatcgaactccattaagcacaaatcaagagcaatatcaggcgccaggttatggctgaataccaattttccctgagtattatgcaccctcgccccgttagaggtaatcatataagcatcaatgcccaaaccatcgcggatctgccctacatcaatatgatgacggcctgtcgcaaaaataaagtgaatccctttattcgtcagtaaattcagcgtttctttggtatacggcgttaatttgtggtcaggagacaataatgtgccatccaagtctgaagcaacaacatgatacatggttataattcctaagctaaatcagtgctggtcaaaaaaatcacaaattgcattgagagcctgcgcccgtaatgcatctttttcgaacaggatttcgtgatgtgccccttggatgaccagaggttttttttctgcttttcctgttctggctttttgtcgagattcacaaaatgccagtaactcccgattattaacgaccttatcttcacttgcttttaaaacaatgagcggagtctgaattacccctgcattttcaatcagttcgtctcccatttgcatactttcacgcatccaatggtaagtcggccctccgaggcgcaattcaggataatcggcataatagcgtaaatagcgctgataacgtgcataactgtgagttaacaggttgataagatagggcaacggacgccactgccccgttgataccgcgtaactgttacgccttttaggataaggttcagcctgattgaccagaaaatttgccaaccagcgaggcatcggtaagttgatgccaaacatcggcgcacacagagctaccgcccgaaaatcgggttcttgacgtacgagttcttgccgtaatagaaaacggctgaggatcgcggctcccattgagtgagccaacgcataacaacggtgggactgacgcggggtaatttccaattcaacaaatttggccaaatcatccacatagtgatcaaatttttcaacgtggcctttttggggatcatcaagcattcgccctgaacgcccctgcccacggtgatcaataataaaaatgtcgtagcccaagtggtaaaaatcgtaggctatttcaggatatttcacataactttcactgcggcccggcaggatcaacagcgttttatcgtgatggagagaacggaaggagacataacgaatggggatatcatcaacgcccataaattcccgttcgtctctggttttccagaaatccagtaatagtccattcgtaaacgcagagaactgaggttcgcggtttaaccagcttgctttcaatatctcaggcgccattcatcatcctcggttaatatcctttggttattctgacccttcgaaatgatcacggatgagcgccatgaaaacatcgccaaaacgctccagtttacgctgcccaacaccattgatcagcagaagttcattaggtgttatcggacattgttctgccatttcaatcagcgtaacgtcattgaaaaccacaaaaggcggaatgttattttcatccgcgatggatttacgcaatttgcgcaatttggcaaataatttgcgatcataattgccactgtatgatttgttttgctgattccggcttttcaggctttgaatgcgtggcacagcaagttgtaaagacgcttctccccgcaaaacaggccgcgccgcctctgtgagctgcaacgcagaataattggcaatattttggctaatcaatcccagatgaatgagctgacgcaggatgctcatccaatgttcctgactctgttctttaccgataccgtaaatgggcagtctgtcatggccaaaatcacgaatgcgttggttatttgcaccgcgcaatacttctacaatatagccaataccaaaacgttgtccaacacggtaaatgcaggaaagcgctttttgcgcatccaccagaccatcgtaacgttttggtggatcaagacaaatatcgcagttgccgcatgatgtctgctggctttcaccaaaatagttgagtagtaccagccgacggcaagtctgggcttccgcaaatgcgcccatggcattcaatttgtgccgttcaatatcctgttgctcacctgctggtttttcttccagacaacgacgcagccatgccatatccgccggatcgtaaaacagtatcgcttcagccggtaggccgtctctccccgccctgccagtttcctgataataggattcgatattgcgcggaatatcgaaatgcaccacaaaacgcacgttaggtttgttgatccccataccaaaagcgacggttgccacaacgacctgcaaatcgtcacgctggaaagcgtcctgcacccatgcccgttgattgttatccagcccagcatggtaaggtgcaacactcagcccccgcttttgcaggcgttcagcagtttcttccactttggttcgactgttgcagtaaatgatcccactttttccctgctgaccacgcacaaatgaccatagctgatcgagaggtttatatttctcaaccaatgtgtaacggatgttgggacgatcaaaactgctgaggtggataagcggatcgtgcagttccagcaggcgagtaatgtcctgacgggttgttttgtccgccgttgctgtcagtgcaataaatggaagttcaggaaagcgtcggcgaaattgccccagcgcgcgatattctggccggaagtcatgcccccattgagaaatacagtgtgcttcatcaacagccagcagcacagggtgccaatcatgcagttgatcgagaaaattatccgtcaccagccgctcaggtgcgatatagagaagcttgatgcttccttgacggcagcgttgaacgatatcaatctgctgctcacggttttgggttgaattcaaacattccgcttctacgccgttcgccctcaattgatcaacctgatctttcatcagcgagatcaatggcgaaaccaccaacgtcagcccattgttgatcagggcagggatctggtaacacagcgacttaccgccaccggttggcatgactaccagacaatcacgcccatcgagaacagcatcaataacctgctgctgtccgggacgaaattgctgatatccgaatgtttttcgtaatacttgttcagccagcgatgccgtgctgatggcttctgcggtagacacgccttccctcaatcatttaaaaaaacaggcagtaaaaaatacagacgcgattcaggcgcctgtacatattatgctatctcactgttgaaacaatgacagcatatcattcagcatggtgccgatgccaaaacggatcttcccgaaatcatcatcgatcatggattctccatatccactgaatagctgcgtataaaaacggctatcccaaaacaaaaaagtcacctgtttattctacacactgaatggtaattttctgtagtaagttttccttcaataaattgttttccgaggtgcttcgcaaactggtaagatgagttataaaagcataaacttaacaaattattaaccataaggttctgttcaatatcagcttattgactttttaacatcaggaaatccgacatggaaacaatacagcgatcaacccagccattaacacaggaagaagcccgtaagattattggtgagttatttgtttatcacatgccattcaaccaattgctggggttcgaattactccgctttgatcacgactatgcagagcttcgattccgcaatcaagataagctggtcggcaacatggcccagaaaatcctgcacggtggcgtgattgcctcaatattggatgttgccggtggcctgatttgcgcaggcaacgctctgactgcaatggaaaccatcacgatagcagagatggaaaaacgcctgccgaccatcggtactattgatttgcgtattgattacctgcgtccgggacgcggtgaagtgttcaccgccagcagcaatatcgtccgtagtggcaacaaagtgtcagtggccagagttgaactgcacaatgagcggcaggtgcatatcgccagcgcaatggcaacgtatttggttgggtgatactttattgactcccaaaagccaaaataagggaatgtgccataaaaacacattccttttttacaggataagtacgccaatcattggattatgagtgagcccaagtcgttcactcttcctaaattccattcaacatatcactttatttacctagacaatttcgcagctcaattcagcagaataaatattcctgtccgtctccgataaataatggattccaatattacccgataacagacaaacatccctatttccaaacccacctttttttatatagaaaccccgatgttgaagtatgtataaagtctccatcgggagaaatatttattggtgcaggagaagatactacaggaggtgatcttgagcctgatgactcagaatatatatccgggaagaagataatttaattataaaaaatagccagttacattgattgtataagattagaacaaactaatttctagataagttacgtttagtccatcaaccacgaaagttcattttttaatccactcctgaacacacaagctttgagatgaaaaatgagttaggttgtataaatatagtgaattatgttattaacaaatacaaattaagcataaaacgcggtcatgtattaaatagttagttgttatgataatcttccggtatttcgtggtggaacatggctaaagtagatgttgattgtcgttattgtcacaaatcagaagatgtcaaaggacatggaaaaggtcatagaggttatccccgctaccgctgctatgcctgcagtaaagtctttcagttggcatactcctatcaagcctgcaaaccgggagtcaaagagcagattattgatatggcgatgaataacagcggcatccgtgacacggcccgcgtattgaaggtggcaacagctactgtgatgaaaacgcttaaaaactcaacccccggaacgtgacgacgcttcctcttgacggggataacatacatcttatctgtgaagtggatgagcagtggtcgtttgtgggcagtaagaaaaatcagcgctggctctggtatgcctgggagccgcgtatgaaacggatagtggcacatacttttggtgatcgcagcagaaaaacatgggaaaaactgctggcactcttgtcaccctttaatatccggttttactgtacggatgattatgccgtttatgattgccttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgaacgtgaaaactatatttagcgagccttctaactatttaatacacgacctaaaacgccattaaaatgagtggcaaaattttattcatccctcacggcattaaccccttgtaaatcattcatcccagtgacacattgtatgagtgctaacgattcacaagctcttctgattttcttttacattcagggatattatgactgaccaacagactgccaaaggcgttctatatgccttaggcgcttatcttatttgggggctggctcccatctacttcaagaccatacaacaggtaccgcccgatgaaattgtgtcgcaccgtgttatatggtctgtgttctttatggtgctactgctaacactgacacgccactggcgtaaagtgtgggtcgttgcccgtcaaccgaaaaaactgctgctgttaggcatcaccgcttttacgattgccagtaactggctcgtctatatctgggcggttaataatggacatctgctggaagcgagcctcgggtattttatcaatccattggttaacgtactgttcggcatgatatttcttggcgagcgtttccgccggatgcaatggatcgcggtagggctggccttcaccggcgtattgattcagttatggcaatttggctctatccccgtggttggactgtacttggccatgacatttgccgtttatgggttgatccgtaaaaaattgggcgttgattcccaaaccggcatgatgattgaaactgtctgggtatttccggtcgcgatgatctatcttttctgttttaccagcagcccaaccagtaatatgctagataacacgctatcactgaacatgttgttgattgccgcaggtatcattaccactgtaccgctgctgtttttcaccgcagccgctgctcatctgcgtttatccacactgggatttttccagtatcttggcccaacgctgatgtttttgctggcaacgctggtttatggcgaacagattggtccggagcgcctgatcacgtttggttttatctgggctgcattgatcctgtttacgctggatgctctgtacacccagcaccgcttgcgcaagtaaccgaattatccctccgcccaccagtgggcggggattattacagccagtttttccgcttgaaataaagataaggtgctagccccgctgcaatcatcacaccaatagccgcagggtaaccgaatgtccagtgcaattccggcataaattcgaagttcataccgtagctggaagccaccagcgttggaggcaggaatacgacggaaacaaccgagaagattttgataatgcggctctgttcgatattgatgaaacccatagccgcctgcatcagaaagttgactttctggaacagagattcgttatgcggtaacagagattcgatatctcgcaggatttcacgggcctgttcaagctgattagcgggcaggcgggcgcgacgcacgaggaagttaagagcacgctggctatccatcaaacacagacggactttccagccgatatcttcctgctcggcaaggtttgaaagcgctgagtcaaattcatccccctgtttgccttccatgataactcgactcagggattccagtacgctgtagatattttcaatcacatctgccaactgttcgatcttagtttcgaacaaatccaacagtagctcataggcattcccgtcaaccatagtctggttgcgggcgcgcattcggtataatcgaaatgcaggaagttcacgctctcgcaatgtgtagagacgactgtcacggatggtaaatgccactgtcgagttaccagcatgatcttcggcgtcttcaaagtagaagaatgaatggacgtgcagaccatcttcatcttcaaaaaaacgtgccgatgcctcaatatcatccaattcagtgcgggttgccagtacttgccccagttcattctgaacacggagacgatcttcatctcccagaccgactaaatctacccacatggagtcagataactgatcaccgttttcaagctcaagacggagcaggcgattattctctaatttaaatgcgttcagcatgtaccataagtctccttatactccctacgtttatcgtaaggcgcgaatgttacgcttagacgaaaaagcctgtcaacattcgaccggattattattggcctgtttcaagcctggcataagcggcaaccagccacttgataccttcaccttgaaacgcgatttgcaggcggcaatgttctccactgccttctatattgataactgtcccttcaccaaatttcggatgacgtacacgctgaccaagtgcgtaaccactgtcgtcggcactgataggtgttcccagctgcttatggctgaccggacgtgatacggttgcccgcaggcgaacttcagcaacacattccgtcggcaattccccgacaaaacgagacgggcgatgatacactgacttgccatataaacgacgggtttcggcataggtcagtgtcagtttttgcatcgcccttgtcacgcccacgtaggccaaacgacgttcttcttccaatcgcccgccttcgtcaagagacatttggctggggaacattccctcttccatgccgacgatgaaaacttgcggaaattccagccctttcgcagagtgcaaggtcatcaactgtacggcatcctgataaacatccgcctgcccttcccccgcttcgagtgccgcatgggacagaaaggcctgcaatggcatcaagttttcatcttcatccttataactgaactggcgggtcgcagtaaccagttcttcaaggttttcgatacgcgcctgtgctttttcgcctttttcctgctgatacatcgcccacaggccggagtcacggataatgcggtcggtctgtacgtgcagcggcatctcctgcgtttccgtttccaacgcgtcaatcaattcaatgaaacgctgcaatgcggatgcagcacgccccgccaacactttttgctgaagcaacagcagacagctttcccatagcgttttctgctgatcacgcgccacttgacgcacaacatcgagcgttctatctccgataccccgcgtcggcgtgttgaccacgcgctcgaaggcggaatcatcataacggttcgatactaaacgtaggtaagacaaagcatccttgatttcctgacgttcgaagaagcgctggccgccataaatgcggtaaggcatggagacctgcaataacgcctcttccagtacgcgggactgggcattgctgcgatacaggatcgcacactctttcagtgcgccaccgttgtccaaccaatgtttgatacggctgacgacataacgcgactcatccagctcattgaaagcacagtaaagtgcaatcggctcgccttccccgccttctgtccacagactcttacccaatcggtcgctgttatgagcgatcagggcgttagccgctttgaggatattactggtggagcgataattctgttccaggcgaatggtttctgcgccgggaaaatccctgagaaaacgctggatattttccacctgcgccccacgccagccgtaaatcgactggtcatcatcgccgacaatcatcaccttgccgctatcccctgccagcaggcggatccaagcgtattgaatactgttggtgtcctgaaattcatccaccataagattagtgaagcgctcacgataatgttgcaggatctgcggtttgttcagccacaattcatgagcacgcagcagtaattcagcaaaatccaccaatccggcgcggtcacacgcttcctgataggcttggtaaattttcagccatgtcgcttctaccggattgccgtagctttcgatatgctgagggcgcaatccttcatcttttttaccgttgatgtaccacatgccctgacgggctggccactgtttgtcatccagattcatcgccttgatgatacgcttgatcagtcggtgttgatcttcactatcgaggatctggaaatcctgcggcagattggcgtcaaggtgatggaaacgcagcaggcgatgagccagactatggaatgttcctatccacattcccccttggctggtgccaatcaggttttcaatccgatggcgcatttcagccgctgccttattggtaaaagtcaccgccatgatggaaaaaggtgacgcattttcaactgacagtaaccaggcgatccggtgaaccagcacgcgcgttttgccactgccagccccggccagcaccagcatattggtacgcgatgccgtaacagcttcgcgttgtttatcattcaggctttcgagcagataagaaacgtccataattaccatcaattgagaacagtcacttttgtcactgtttttttatacagattacaatctgaaattatatcagtgcgatcaaagaagccaaatcagaaatctcaacatgtggaacccggcgcccctcaggctcctgcatcagatttttattttcgaggttaatccagcaggcctgcatgccactgcacagagcaccttccacatcagttttcagattgtcgccaacatgcaggatctggcttattggcaggttcaaccgttcagccgccagatgatacatatctgggtaaggtttggctcgcccgtccacacccgctttgagaacaaactcaaaataaggctcaagtccgcacgcagcaagttcggcattcccattagtgatcgccaccaacggcatttttttcgccagtacagataaagtattataggtggattccggcacgatgatctgattacgccaataagtaaagcaggccataagttcatccgcaccacgcagggtttcctcacgattgaaaccgtggtggctgaacatcagttctactgactggcggcgccaagatgtcacgtcatggtaaatttcaggctccgactcaagaaccgcctgacggtacacatacagatcttctctctcaaaatgattgaacttgacatcgtaccgcctgataaaacacaacacttctttttcggttttatcgattacaggatgattatcgtaaagcgtatcatccagatcgaatgtcatcgcagcaaacggcgcgagaggccgataaaaacgcattatgattttcctcgtttggctctggggtgggccacatcatagactttggccagatgctggaaatccagatgggtatagatctgggtcgtcgataagttctcatgacccagtaactcctgcactgcacggagatcaccactggattccagaatatgcgtggcaaaagagtggcgtagtttatggggatggatatggctgttgaccccttggcgaacgccccactgttcaaatcgtttttgtacgttacgggcagagatccgttttccgcttttggtagaaatgaaaacggcattatcttccggctcaaaccattcccgcatttcaagccagcgctggagccattcccgtgctgtacgacccacgggtactttacgttctttactgcccttgccatgcacccagacttcaccactttccaactccagatgccgacaatccagaccaaccagttctgacaaacgcaaacctgcaccatacatcacttccatcatcgcccggtcacgaacggacaatggatcattcaggttgatattgagtaactggttgacttcgtccacatccatatttttgggcaaatggcgctttttacgcggtgcactaacggctttggcaggattggcatccagttttccctgtattaccatccaatcaaggaaagtacgcagggaagaaagacgcagggccaggctggcagactgcaaccccgcccgacggctacgggaggcaaacattctgactttagccggatcaagtgcctgccactcatgtatccccatatccagtgaaatcgacgccagaaccaccaaatgacgacggtagttagtgatcgtcaataggcttaaacgacgctcaacccgcagataatgcaaaaaggtttctactggttcaagcagcaagtcaatcggctgagtcatactcgttctacccagcgggacaataatcccggtagcaatttcgccagatgatcaagtagatcggttcccacaccttcatgatagtgctgtttatcacggctgttgaaaatcaccatgcccagctccccctgtgaacccaaaagggagatagcgactgaacctacatagcgagcctgtggtatcagcagtaaaatttctgggccatacagtgtgccaagataatggttactgtcaccaaatcgctgaatgcggacaggctcaaaaaaattacgcgagatagccagttccggcgaattcagcggcgcaccaagacgccatttatcactgaataaccgaacatagctattactcaacccaagggttttcgaccatgaactcaagcgggaaagaaagtcctgcaaacttttggcagcggagagatcagcgagtaattgcagcagacgacaaaacagtatttcattctgtttcgcctgctccaccaaatgtatcagatcgtcttccagatgacagatgcgctttctctggcgatccatgtgccattccatcagggagacacattcacgcaccggatgaggaactcgtatcttatcgaccctattggcattgcggacaaaaaacttaggattattcagcaaataatccactaccgcctgatcattcaaccaattttccaagtgcagtggatcgtcatttttacccattttccaatgccccatatttcaataatgactcagataaaactgaatcaatcacaaatgaatcgtaccttcataaacgtgagttgcaggccccgtcatatagagcggcttgcccggcccgtcccaacagatttgcagagccccccccggcaaatcaacgcgaaccttgctatccagcaggtcttgctggataccgacggcgacagctgcacatgcaccgctgccacaagcccgtgtctctcctgcaccacgctcaaagacacgcaatcgaatatgaccacgatgcatgatctgcatgaaaccaatattcgcccgctcagggaaacggtcatgattttccaatactggccccaaaatctccacttctgcggtgtcgacatcttcaacctgtatcacacaatgaggatttcccatcgacacaacaccgcagagcacggtgcgctcaatagcacggataatataggttttctccgccttattggcacgaaaaggaacatgctgtggttcaaagtccggttctcccatattgacacagacctgatcatcattggtgatgctcagtaccatacggcttgcttgcgtactgaccttaatatcacgcttattggtcaaccctttcaagcgaacaaaacgggcaaagcagcgcgccccgttgccacactgggcaacttcactgccatcagcattaaaaatgcgatagtgaaagtctaagtcaggatcatagggagcttcaacgaccagtagttgatcaaagcctacgccagtacgtcgatcggccaaacggcagattaattctggcgaaaaataaacattttgggtcaccgcatcaacgaccataaaatcattgccaagaccatgcattttggagaactgcatatactactccaacatatactgctccaagagaaaccacataaatcggctctatttttgttgagtatccgattgtgtattgtgttctagctgtgctttattcgcctgatctgctggagcctgttgtgtcacagttggctctgccggcgggaaataaagaggacctttcaagccacaaccagaaaccgcaagtagtgttatgatagccagtgaccaacggaattgttttttcatcataataattaatgcctgtaattcatgcgccaatactctctataatcgcagttagaccctgaaaagcaaataggaaatgaacatgaacgatagcgaatttcatcaattggccgatcaattgatgcagcgtattgaagagcaactggataactacgatggcgatgccgatattgactgtgaaacaaacggcggcgtaatgacgctgactttcgaaaacggcagcaaaatcattatcaatcgccaagaaccctttcatcaaatctggttggcaaccaaaagtggtggctaccactttggttgtcaggaaaacagatggatttgtgaccgcagtggtaacgattttctatctatgctggaacaggcgatcacagaacagagcggcgaatcatttcagttttagcatttttttgctactacgcaacccatctactgcttatgccgtattaaaatacggcatttttattaccgtccataaaccgaatcgccataaagccaatcgcaataatataaaatataaaatatcacaaataatataataaataattaatgtaaatctgaaatatagatattaacgaaaaatattattaatgaattataatataaaaataattcaattaaataacaatatttaattataagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtttggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttagtaaaatacagtgtaaatctatatttaattaattcaacaagtaataaaatacgcttggaatataatagatgatatgccgaaaattcacgtattttgcaaattattcgctttatatcaatagggatacaacgaatgacaaggatcgtgtgacctacacgagtcatccagatgtacatcaatactgcacgcgatatcattatgttccgtattatccggtggaaacacaccatctctaaatggagcgacatgggtacgctcacctttcctgatgatttgataaaactgcggtaagttgaagttgatgaaactggagccataagtaaaacgatcatgcgatgaagaataaaaacggctgacgtcacgtaccaattcttctttactgccctcacaatgggaataaatttctacccgatttgactcatcaagaatataaatattgaatccctgacttctttcaatatcttcgaagaaaaattgaataatcccttcacaggcaaatccatcgatcacgggaggtaagtgtttttctttaggatcaatcttaacgggcagaccatgcaatttagtattcgaaatcgcgccatagaattccatcgcattttctaatttctgtaccgaaacgtttaaccgttcaaaaaataaaccccacgtctggcctgaaatgcgcaacgccttaaaacgattgggatcctgacgattactacacagacgcaactctatacattctgaaactaactgctggacgcgagttcggatcaatccacgcaaatgctcgctatagcagaatacgtcaacctcagcgggtggtgccgcatcctgatgcattttgcccagtatggttttcaacgcttccagcatggattgttcaccactgaaatgcaatgtcctcacttcattccacgagttacggtaaagcaggtcgatactccccaccaaacattgctgcaattcaccaaaactgaaaacatccagcttcctgaaatcaaaatgcacgatccgattggaaaagtccgtagtgggatctttttccaaattaacaataatcgccagatggcgaatctcgcaggggctatataacgcttttggcgtcggtgcaggcaggcggattggaaaatgggtagcgatatcgctcaccaaatcacacaagttattccagtcacattgcgacttcccgtgatgaatatggatacgagatcctttcgtcagcaggccgttaaaataagtccacgccaccaatttatttaaatagcggttatattccagtggctggtggccgatgatcgtttctatcgtgggcgcgtgattgtaaagataccagccgctacgatttacacgcccaggcggaacatagatgaatgtcagatcctgttctgtcagatccggtgaaatttgtggattcaccagagtgactttaccgggcaaggcttcaaatgctgcatacaatttacgggtcagtacgccaatatcctgtgggctggcactcacacttaaattgttacgccgggcaaagcggatcaaattgcgataactcatcatcatggtatccagtaattcattatgagcatcacgcactagcccgattttccatgaattacggttatccagcattgccaatttgctggcatcccaaccccattcatgcgccagctgcgacatgacctgatggcgccatcctgtacagcctttatcctcgtggcttcccagcatcttttcgcaaactttcaggtaaaaacaacggcgcgccagatccagacgcgtgaaatcgttcgttgcggtgagataacgggttacacgctcaagcatcatgctataagaatcaaggccgaaggaaacaatagaaccatcatggaaatgctgtttcatctccattgacagcaattttccgttcggatattcccatgaataggcctccagcagcagacttttcaaaactgctttataaggagagtcaacactcttgtagagctgccacaggcttgccccaaaatattcttctgctgacagttcgttcaacccgcccagatccagccactcgtttggcgtcaaaacaccttgggcataaagagaaagcacatattcgtcatactgcccctcttcttccacaggaaccatcatccacaacaagcgcttacctgccatacagaccgcagtgcgataaaattcatccagcagaaggatatgctgggttgttccgcagtcttccccgttcaggctgccacaggcattatgacgaaagcgattttcatcaaccagaaaaaatgtcacttcaatacccagcgactccgcccactgttctatcagagtgcatttctgttccagtaacgctttttcactatgatccagccaggattgatgacagacccagatgtccaagtcagaggaacagctttgccctatagaagaggtgctgcccatcgagtaaatacccgtaatcggcagctcaccgttgggagtgtgtgacaaaataccagtagactggcctgccagatcattaatccaaaattgctgagattcatcagacgtgaagaagcaaacgccatgaggaacgttgcttttgatatagcctggcatcattgggtgatgataatgcaataataccggaattaaattataaacctgcttaaaaacgggactcattgagctggtcgcacgctctaacttaagctggttaattgcatccagtcgctgcttcaacgtttcaatatagagatacaagagtttcgcctgattgagttccagtgcctaaagtagcccccgtttccgataaagcatcgtattgcaagatgacttttaaaaatttttacaaaattattgtcggaaacgtgatcaatttaacaccttgcggtcgaagcgtaaagtacgcactaccacctttccgccttctccgcaacagtcaatgatcaactaactcattgtaaaatattacattaatcacaaaatagacataataatatgttttttgaaaaagggattatagttgattattttatatataggttatgtaaagcattgtaatgccagaaggtttacataagtgcttaaactaataatatttttaattagtaaatacctctccttcggttttttccatcaggataaatttcaaatagtaatctgcttttaaatcaatctgtttgtttattttctctatttaaataaaatattattttaatatttaaaattatttttatctcacaacctgtatatctataatctattcaggttttttttggcttttacctaactggaaaaaaacgtattgaaatgttaaaactgactctattttctcgcgatttagcggctcaaaagcccctaaataccgttattaatacgattacccaatataattatcaatgacaatgaaaatcattcgtatcgcgacccgccaaagcccactggctatgtggcaagctcaatatgtccaaaagcaactggaacagtttcatccagaactgaaagtggaactggttcccatggtgacacgcggggatgtgatcctcgatactccactggcaaaggtgggtggtaaggggttatttgtgaaagagctggagttggcactgctcgaaaatcgggctgatattgccgtccactccatgaaagatgtccctgtgggatttcctgacggcttggggttggtcacaatttgtgaacggggtgatccaagggatgcctttgtttcagtaaaatacgcctcgcttaatgagctgcccattggcagtgtcgtcggtacatccagtttacgccgccaatgccagcttcgtcagttacgtcctgatttggtggtccgtgacctgcgtggcaatgtaggtacccgtctgggcaagcttgataacggcgattatgatgccattatccttgcagctgcgggtctgaaaagattagggctggaagatcgcattcgcataccgttggcaccggagttactgctgcccgcagtcggtcagggtgcaatcggtattgagtgccgccttgatgataagcaaacccgtgagttactggctcccttaaaccatataggaacagaaatctgcgttctggctgaacgcgccatgaatacccaccttgagggaggctgtcaggtgccaattggcagctatgctatctggcagggaaacactatctggctgcgcgcgcttgtcggagctcccgatggcagcatgactgtacgtggtgaaaaaaccgtatcaccagaagaggcctgtcgagcaggtgtggaattggcggaagaattattggagaaaggcgcacgccagattctggctgatgtctaccagaggaactctcctgaatgagcatcttgatcacccgcccaaatcccgcaggagagcagttagtcaagcgactgagggctataggaaaaatggcattcagtgcaccactcattgcgatttatccgggcggcgatttgccgttgctgtcacagaaactccaacggctgtcggcgggtaatttagtcttcctgttatcaaaaaacgccgttcactatgccaatgaacagcttatgcaagaaggtctatcatggcctgataagctatcctattatggtatcggcaaatcaacttccctgatgttttatcaaaaaaccgggttggagatcctctggcctgaacaaggtgaaataagtgaagatctactgcaactccccattttgcagcaggtgaatgataaaaagattttattgctccggggcaatggaggtcgtgaagttatcgcttcaacattgagaagccggggaggggaagtcgattattgtgagtgttattcacgccaacctatcaaatatcatgtcgctgatttcagtcgccattggcaacaatatggtataaaaaccctcgttgttaccagtggcgaaatgctacaactgttatatagcttagtcactgatggtgatggcaaaacgtggttattgagttgcgacttgattgtggtaagcgaacgccttgccaatattgcccaaacactgggctggcaggcaataaaaatagccaagagtgcagataatgacgccttaatgcaggcactagaataaaccaatatgggatgtccattatgacggaacaaaagcaatccactgatgcggttgagccaaaataccctcagcagcctgaaacggctccccataaacccaaacgttatggatgggtgggaaatacactctcaattgccattacgctggcgatcggtgcaggtgccatttacctttaccattatggcaagcaacaaaatgcagtattaacagccgaaaaccttgctcttcagcagcaggttgcctctctcgcacaacaacagtctagcgacaaacaagattttgctacccagtttcggaagttagagagcgacttgcaacaggccaaactgcaaaataaacaaacagacagccgcatgttggagcttcagacccgcttatcaaagatttcaaatacggatctcgaaaactggcacttggcacaagcaaattatctcgtgaagatggctggccgcaaaatatgggccgaacaagatacgactaccgcaatcgcactgctgaaaaatgccgaccaaagccttgccgagatggatgatcccagcctgctacacatccgccaagccatcatggaagatatcaatacgctctctaaaattaatcagcttgatttagatggcattattcttactctgaatcgcttatcaaatcagatcgataatttacggctggaagataatggagaacaagaagcgccaatggatgaagacgatggaggaatcagtgcttcactctctgactggcgtaaaaacctgagtaagagctgggacagctttatggagaatttcattactatcaaacgtcgtgacagctccgtagtaccattattggctccgaaccaagacgtttacctgcgtgaaaacatccgctccaaactactggtggcagcccaagcggttccccgtcaccagaatgaagtctataaacaatcattggaagccgtttcaagttgggtgaggtcttatttcgatactgcttccccagatacaaaaacctttttgcaggatattgattcgctggcgcagaaaccgctttctattgaactccctgaacacctgagcagtcagccaatactggcagacctagtgcgcaagcgcatctacaatttgccacatcagtcagacactcaagttcagcctcaatcagaggttcaaccccagccgaaacccccagaaacatctggtcaggcagaaacgcctgttcaggagggttgaacatgctgaaagtattattgctgttcattatcctcatcgtaggtgttgtgctcggccctctgttgtccgggcatcaggggtacgttttgatccaaacagacaatcacaatatcaccactagcgtcactgcgatggtgattatatttgttctgttacagttcctgctgattttaatcggctggtgttaccgcaggttgatacgtaccagtacgttcacccacagttggctctttggcggatacaaacgcagccgggcacgtttgcagaccaaacaggccctgctcaaattggccgaaggggacttcaagcaggttgaacatttgatgacccgtaatgctgaccatgcggaaaaccccgtcgtcaactatttactggccgcagaagccgcccagcagcgtggcgattacctccgtaccaaccagtatattgaacgtgccgcagaagtcgccgataaagatcagttgcctgtcgatattacccgagtccgtatccaactggcacaaggagaagttcatgccgcccgcaatggtgtggataagctactgaaccacgcaccgcgccatcctgaagtactgcgactggcggagcaggcttatacgcagtcaggagcctaccaatccctcatcgatatcctgccttctctgataaaggttggtttgtgtgatgaagaacatattcatcaattgcgccagcaagcctacatcgggttgatgaatcagatcatggcagaaaaaggcagtacgggattgaaggcatggtggaaagatcagagtcgcaaactccgcaatgatatcgtgctacaagtcgccatggccgaacatctgattgagtgcaatgatcacgacactgcacagcagattgtcctcaatgggttaaagcagcaatatgacgaacgcctgctgctgttaattccacacttaaagacagatgatgccgaagccgtgcaaaaatcactggcgtatttattaaagcagcatggagcgacaccattactgaacagtacacttgggcaggtagccttacaccacggtcagtgggctgaggctgaaaccgcattcaaggcggctcttgcacagcgtcctgacgcccatgattatgcttggcttgccgatgcgttcgatagacagcataagcgtgaagaagccgctcaaacacgtagcaaaggctttatgctgactctgaagcgcgaaagtgatgcagaagaataaaacaccttcatgttagatgaaaattcaccaaggttaacggttgcaatacctatcgatactattgaatcgttaaccttggtgcatcatgcaaatctcaggatacaagcaaaaaaaacacctatcaaaaaagacaggtgtataaatacaatcaggtctacagacggatagtgcctcactcaacgttgtgtccggttggtgatgaaaagactaaatgcttattcatctataacgtggaccataggcactgataatcagctctacatcatcccgaggtttatgaagcctgtgctgtcataaggagtgggatgagtatctacaattctttataagcacgtttcgtgccaacttttagtcatcaggttaattctctcttactcaagatgtatcagatacccgacaacaggcattcgacttctcactaagaataatcgaacaataccgtctctcatttgagacgccctttcagctgtttacatatagaagataataatcaatgagttaaatgtctccaaaccgagacattcaatagtatgtttgtcgcggaaatacaacaccatacataaaagacatttaaaaacaaatagttataacacctataaaagtgcaaaaataatagatttcaagctacaagtgggaaatgacaaaaagaaatgaagggctttttgatagttgggaaataacgattagaaatagcatctctcccagagatacaaaaagaaaaagccctacaaaaatagcagggctttctcagaatttggtcggcgagagaggattcgaacctccgacccactggtcccaaaccagttgcgctaccaagctgcgctactcgccgaaatgtacttcttctacaatctcttttttatggtgcgaagggggggaattgaacccccacgtccgtaaggacactaacacctgaagctagcgcgtctaccaattccgccaccatcgcgtgtcataaaaaagatggggtggctaatgggactcgaacccacgacaactggaatcacaatccagggctctaccaactgagctatagccaccataacaactatcttttcgaaagttatcttttcataaactgcttacaacgtcgttcaccacgataacccactgccactgctctcgcacgctttaaatggcgcgcccgacaggattcgaacctgagacctctgcctccggagggcagcgctctatccagctgagctacggg

SEQ ID NO: 16869 - DNA, 964 bp, Xenorhabdus bovienii
  unsure (1)..(964): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattccgcacctaattaatgaattacttatcgtgacaaaaatcacaattctagttattgggttacttagcaactttagtggatacatagttattatattaggttgaattattcccaatttacattaagaaagcaacgtattctcatcatagatgcaagtgttgttggcggatccaactttcaagtgcaacatcacctatgcagcctgcagtaattctttatcgaagactgccatatctgccacagaaagtctaaaaacagcaaaatactggcaactatcgcgatcatgtagccatcttcgacgaagtaaatttccaaaataggtcggtttagcggaaaccgtcgatcaggttaaaaatgccgtgcccaatagcaggaaaattaacgnnnnnnnnnnnnnnnnnnnnnnnnnnnnnnnnnnnnnnnnnnnnnnnnnn

SEQ ID NO: 16870 - DNA, 236352 bp, Xenorhabdus bovienii
acatggtatctgcttgatgctcagggaaacaatattcaggatggcttatggctggtggatatcgaaggtatgcacagtatcaagaggattgccaaaattcctgtcagtaaaatccgtgtcagcgatgatgacgtcacttttgactgttcagtcagcgatattcaattcatcggtcgcgtggctctggtgatatccagacaatagcgatctgggcgacaaaatggttttcatcaaggctatcccgacaggcaggataaccttgatgatgtttaccccatgatgccatcaacttgaacgccgaatccgatatagaacatgctctctcaatcgatgaccttccggcactaaaggatgtagaaatgttttttcgtctctgatcatgcccagttttttcatcacgctttctgagcggtaattaagtacggaagtaagtgctacaacttcatccaatcccacttctgtaaacgcgaaatcaaaaatcctacgagccgcttcacacgtatagcctttgccccaaaagggtttatcaagctgccagccaatttcgacacagggataacagggtaactcatcactgggaatattcagcccgatcataccgatgaactcaccatcctgttttcgctcaacagcccacaacccccagccaccttgcgtttcaaacttacggatcaaattatcaacaaaagtattattttgttctttattcggtctttttaaaaaaaactccatcacttcaggattgctatttaagcgaaagaaaggctcacgatcttcttctttccagccacggagtagcaatctttctgtttccagtgtgataatcataacgcctccttaaagattcaggataaaaatcattcagccgtcaaaataaaaaccgccgaaaaatcatacacattttccggcggttatggcatggatttttattatccaatattaagcactatttttggctttcgctttatctgcctgattttccttgatggaaacaactcgctcaatatccggttttttcttgttttcgaccggttcagactgaccaataaataaaccgccacgccggattgacatacttccacaacggctgataccacgtagttcgccgtgctccaggatatccagcgtttccgcacagcacgtaccgtcaacatggccatcaataataatttctggcgcattaagctcaccttcaacttttccagcatgcatgacacgaatagcaccgccttttacgcgaatattaccaacgatttttccccagacctgaatatcgccttccatctcaatatcgcctttaaataccgaatttttcgcaataatcgtattggaacgagtttcaacactgaggttttttttctcttcaggctgtgtagaaatgattggcgtaacaggactggcaacaggtgcctcagttttttttccaaacatagcatttattctcaatttcatatttgtaaagtaaagtaccaaggctagaaaagatataattgctgttatggcacaaccgagatgagcgccatacaaatatagccctaaggcaacaccccaaaggagccatacactgtataaaaaagcgttatctgaaaaacgatacttttccatatctttctcgttcttgtagttttttcttatctttcatcagcaaatatatctatgcatacgccttagcaggtaacgaggaaaggctgtgaaaattcatcctagcattataccagtataaaaaacaatctacctagctataaccgaggcatttatagcgctattacaaggataacgttactacttgagtttaacactctgaattctcgtttaattatcccatatttccagaataaaaaatccatctctatcgatttaacttattattttgaataaaaaataggtaaattaataatattgcaacaatataaacaaaatattaataatttaatatcatgtctggtttatggaaaacatttcatatcagttgactgatatcattaacatcatggcaatctaaattaaatataacgactcaaaccctggaattatacttttgatctccccagaaaagttaagaataacaatctgatataaataatttcctttcgtcctgagagattttttaagagataaaggaggacaaaaaacacgagttattttaaaaaaatgacgaaacagtgttttaatgttaacttatgaaaataatcggcacataaaaatcaaatcacgttcgcttatatattaaaaatccgtatgctcaattttgttaactttcttttcaataccaccgtgaaattggctggctaaatttaaaagtcatctatctgatcacccgcttactctatttactcattatacgagccgattgacctgcccaataaatcaaataaattataattaatttttaaaatcaaataattacaaatattaactgagagatttttaatgataaaaattgtcatttaatgtggttaaataggattaaaagtataaaattacctaaattaaagtaatgaacagctctccaccaagtgaattataagagtattaaagaccatgagataaaaaacaaacaagtcataaataaacttgctttaatatctttaaaaaacataaaaataaatttaaagcataaattttaacactgaaacctaacacaaatattaatttagagatataatacaaaaagtgatttaattgatgttacgcatgctatttcgatatctatcaatactgtttcaccccgcactcgatgctatcagtataattcgagtgccaaatgaaaggcttttccaacatctattaattaataaaataaatacaccatgcactcatcacaaaaaatgattactcatgatacggaagattaggagtattacatgaaaaggacgacaggcttaaaccagaagagtatttgtactcacctattgaccataccggatttcaataccctcgaacataaacaaagagggctgtatgttttactcgatggtgaaatgatatggaaagattgcaccaatacttaccatatcacatcgaatgagatcctttttacccatccggggagctacgtagccaaaaccaatacagaaaactgtcaggtattatggctacccttacaaatggagttcctgcgcagttttttaaaacgtttcgggtcgttactgagtaaaattgaacgacatgattttccagctcgcaggctgattcccttcaatcagttccccttattgacggaaagtatccgtggactggccaatctgctggctcatgattaccctcctgcactgattcagctcagggttgaagagctgctattactgctttctcttagcaaacagggcgcattactgatgtcggtattgcgacagttgagtaaccgtcaggtagagcgcctgcaaacattcatggacgcacattatctcaaggaatggcggctcaatgactttgcccgtgagttcggtatgggattaacttcattcaaggagctttttaacagcgtctatggtacatctccccgcgcctggatcagtgaacagcgtattctttatgcgcatcaattgttactgaacagcgaaatgagcatcgccgatatctcattggaatctggtttttccagccagtcctattttacccaaagttatcgtcggcgttttggttgtacccccaatcgcgccagatatggcaaagattagtcattcacataactatttatcgtttgttgagtaacaataattattattaatcaaggctttccaggtttatgtaaagatattttagatcaaactgaaaagccgtaagccccttacccaactggaaaaatcagcgttttcctatttgatagatcaaaaatgatcgtttttatcgatcaatttcctttgatcgatctgtgcaatccattggacggcagtatcttatctcacatatagtcgatgtgacttatcaccgctaagtcacactagggttttatgcttcaccgtatcctttggcctgtctatgcaggcctttttttttgcttttatattttccaacaatgacgccggtaatccccctaaaaacgggagaatagctagcaggcatgtactaacaatgaatagaaaatatgaccttgagcgtcaatttgattcgtgatcttttttatcactctccgcttgataaaatactgtacccaattttattctttcccttccggtcgataaacgatgtcggttggtatcccgcagggaataaacacagccacaatattcctgctgataaaactcctcacgtttactgatttctatcatgcgggaagaaccgccgcccttgcgccaattatattcccagtaggttaagtcgggataacgggaagccgcacggacgccgcattcattgatctgctgcatatttttccagcgtgaaatacccagcgagctgctaataacaggaaaaccatgttcatgagcataaagagctgtccgctcgaaacgcatatcaaaacacatggtacagcgaataccgcgttcaggttcattttccatgcctttcgcacgttcaaaccagttatcacgatcataatcagcatcaataaaggggatccccatctgctccgcaaaacgaatattttcatctttgcgcaattcatattcttttagaggatgaatattcggattatagaaaaatatcgtgaaatcaattcctgaaaccagcatggcttccatcacctccccggaacagggagcgcagcacgaatgcaataacactttattgtgtccgtttggcaacggaagcgggttacgttcatagttcagtgacataatattctttacctgattcagacaacaaaaaatcagggagagaacataattcctctccctgtgtttattgggtgattatcttatctttttcttctgccttaccacaatggtagaaaagaaaaaacggtttttatcacatcaaggttttaagcaccctgcacttctggcagtatctgcccgccatcaaccacaatcgcctgcccggtaatatattttgcttcgtcggaggcaagaaaacaggccgtatagccgatatcttccggcaaccctaaaacgcgcatcggcgttgtagattgaacatgctgtaggtaatcttcaccaaatgtctgcaagccttcagtcataattatacccggcataatggcattaatggtgataccccgacctgcatattccagcgccgcactgcgcataaaccccaactgacccgccttactggcaccataatggctgtaacccggaatacccgtcatctcccctgtcaccgatgacgtaagcacgacccggccataacgctgcttctccatgacattcaatgcagcctgaaccaataaaaatgttcccttgaggttgacggtattcactaaatcccaatcttcagccgtcatgtctttaagataatgttgtggaaaaatacccgcattggagcacagaatatcaagcctgccatatttttcgacaatctcatcaatcacatttttacatgccgcctgatccgtcacatcaagaggaataaaatcaatatccagctcttttgcaatcgcctcgcctcttgtcctgtcagtgccggaaataatggtaatggcacccgctcgcttgaagacctgggcaatgcccttgccaatacctttcgtgcctccggaaataaacgcaattttgtccgttaagttaaacatagtcgtttccctttatatgagtggatacagtatttttgttacaaacaatataacttttcaatatattttgaataaaatacattgacaataataataaagatcacaaatatattaataaatataaatcacaaataaaacatcgagataaaaataatagcttcagcattatttcatttaatccaatatttcttaaaaataaacagattagacattatttttaataggttgcttatttcaaaaataacaattacttttaaataaaatgaaaaatacaggacaaaaatatgactctcaacaattcattcttatatgaatatgatggtattgcattatcacccattttatttctcaaaagagccgtattaagtaacagtgatgatattgccgtgatagatggagatcattgttggacctggcgtcaatatgctgaacgatgtgaaaaagtggcaatcgcacttcaacaaatgggcataggtaaagggagtattatatccgcactactgcctaatagacatgaaatgctcgaattacattttgctgttcctttggcgggtggaattttaaatgcactgagtactcgaacagattcagcaacgttaaattttatcttcgaaaaacttagcccacaaatattattgattgatagaaactatatttcattattggataatatcgctattaataatcaaatgaagatcattattgttgacgaaaacaattcatgcatcccggaatcaacatttgatcatgaatacattcaatatgaatcactgataacgcaatacccatcggcaaccttgtcttttcctcagattgacgagcaggaagccatcagtatcaactcgacgtcaggaaccagcgggcagcctaaactggttgtttattctcaccgcggggcgtttcttaatgccgtttctaatattttggattgggatatgcccaaacaacccacattcttatgggctcttcccatgttccactgtaatggctggtgtttcccctgggcaatcgccgcacgggcaggtacgcatatctgcatgcgtcggtttgatgcagagaaagctatccagctcatgcaacaacaccaggtaacccactattgtggtgcaccgattgtgcactattctctgggaaaagcagcacaaaaccagggcatcgattttgataataaggtttatgggctcatcgcaggcgcaccacccacagcaatggtattttccctgctggatgctgttggcatcacagtgacacatgtctatggtctgacagaaacttatgggcctgtcgttgtttctgaagataaacatgattggaaagcactgccagaatcggaaaggatattaaagcgcatgcggcaggggatcgtctccaatttacaggggcaggtcagcgttattggcgaacatagcggattacccgttccttttgatggaaaaactgtcggcgaaattgctattcgcggaaatatcgttgcagcttatgatcctattcgccatgtgactcccagtacaacaagccaatggttttttaccggcgatttggcagtcgtcgacaatgatggctatatcaaaattaccgatcggaaaaaagatattatcatttccggtggtgaaaatatttccagccttgaattggaaaatgccctgtcaggttatcccggtattttggctgtcgctattgtggcaaaacccgacccgtactggggagaagttccccatgcttttattgaacttgatcaacatacattagtgactgaacaagaactggatgattatatttgtaccctggtcgcacgttataaacgtcctaaaggttatactttttcaacattaccccgtaatgtgaacgggaaaattatcaaagaacaactgagaaatattgtccgaaatttatgaagattaaagaacagatagggcaacccatcaggacgtataagacggcaaactgatcccactgctcgccagttgccccatattgcagtagatcgcacaagcggcatcaatcaaagacatcgcaattgccgctccactcccttcaccaaggcgcaaatccagatgaagataaggttgcagacgcaaatgctgtaatgccagcactgcgcctttttctgctgacaggtgtgaagggatacagtaattccgtgcaataggcgccatctggcaggcggccaatgcagaggcataagagggaaaaccatcaagaacgacaggaacacctgacgccgcagctccgagaatcactcccgtcataccgacaaggtcaaacccgcctacttttgccaatacatccagcgcatcattcccattcggctgattgacgataatcgactgacgcacaacggagcctttgtgcatcagtcgctcagtgggcaaattcgcgccctgcccaaccacatcatggggatcactgcccgtcagcacgctgatgactgccgcggctggcgtggtattggcaatccccaactctcccacacccaatacggaaacccctgcggcaatacgctgttgtaccagttgtgcgctcgccagcaacagagtttcagcctgtgcatattccatggctgccccctgtgtaatattgccacagccgcgagccaatttcagggacagcagattgtcaatcggatcaccatcgatcccaatatccacgggcaagacatgggtgccgctatttttcgccagtacacagaccccagttatcccttgcagcatattccgtgcctgtatcgccgtgacattcttgggtgaaattgccacaccttcgtcatataccccatgatcggcacacatgacgatgatctctttttgcagattacgaagatcccagatccccggcatacctgaaagctggatcgccagtgcttcaagacgccccaaactgcccagcggtttgaccagactgtcaatgtgctgcgccgctgtttccattttcgcctgattcagtggctgaattgcatcaagtaaagattgaagagtcatatgcatcattctggctattcttcaggccgatattctgtccgtccattgaagacccgcaatgtggtaaatcccgtgtgattatctacgacactataggcgccttgctgaaagggaaaagaccacatggcttctgtcggcagattgagcagcctggtcaatagcagtgccaggactccctgatgtgcaacaatcagttgatttccctctgccgtggcagaacgcacttcatcagcataactttccacccgggcagcaaaatccctgaacgcctctcctcccgtagggcaggcattttgccagtcagacaaccaacgcgcccacgcctgcggatcgcctttggcaatcatttcatgatgacataattcccatgccccgaaattcaattcattaaggcgatgctcaggctctattgcaaaaggggaaataatacgtgcagtatgctgtgcccgctgcatctcactacagtggagcgattggaaatcaacatgtttcagcgcagcagcgacctgttgcgcctgtttgatccccatctccgtcaacggcaaatctgtgctgccacaaaaaacgccgttaatgttggcttccgtttgcccgtgtcgaacgagaaaaagacgcattggattactttctccaaattgattacctaatctatttccagatcatgaccagcagaaaaatgacttcgcctgcctcgattgaggcacccagcgtatcgccggtctgaccaccaagacgataattaaaatagaaggccaatccataaatgacgatcaatgtcaccatcatggcgattaatccttgccagtctccgagcgcgataaccaataccgcaccgcctaatagcgtgagggcagtcgatcgcggagtcattcgaccaatataactgcttcccatgccctcaccttcacgggcgtaacgctgttcatacatcagtagcacgacggcagtacgcccgacaatcggcgcgcacgtcagcaaggcaaatagctcaagaggaggatgatcagaaagctctgccacggcgaaaaccttaaggaaaaggcagaaaatcaaccccagaccgccatgcgtaccgagacggctatcgcgcatgatcgccagcattgtttctcgccggcgggcagagaaaaggccatcacaggtatcggccaaaccgtctaaatgtaacccgcctgtcaacagtgccaatgccagcacatagccaatggaaccgatatacataccgccgccagattgactaatcgagagcgaaatcagggcggccaacccgccaataatcaggccaatcaccggaaaattcggcacgccgcgccaatactggctgaaatcaaccccttccgcccattttgcaggcacgggaagccgtgtcataaattgcaatgtcgcccaaaagagattcagcttcatttgattttgactccaatccctgaaaccatcagccagacctctttagccgcctgcgccagtttttggttcacgcgcccggcgatatcggcaaaatgacgtgccagccgattttcaggcataatgcccatgcccacttcattcgtcaccaaatacaccggagtcgggcaatgcaggcaagcaacgatcaagtcatctatctgacgctgaataaacacctccagtgatgaaaaatcccattcatcgggtgatgcccccgccgatttgtcaaacagcaggttggcaatcaacgttgttacacattcaagtataacgccctcttcgggttgccgatgctggcggatcacgctagccaagtcttgataaccctcccacgtccgccagtgtgaagggcgctcctgtctatgccgctcgatgcgagccgccatttcttcatccgtaacctgcgccgtagcaatataaagtacctgctcacactgccccgcaatcagccgttctgtgtaggcacttttaccgctccgcgcacctcccgtcaccaaaatcattttgtgatcccaaactccgtaaagccacaatgctcacacgatacgctctgtttttgcaatcagtgatgctcttcatgctctttcattaactgatagatacgatcaatatcgagatgctcacgcatactggcagccagaatattgaactgtttttctttgtgctggacgtaattgaacatcacattttctaatggcgcgaggcctttttggcgacgaagctggttcagtaatgggcgagtaaacgtattctgatcaaacaggccatgcaggtaactgcccatgaccgatcctgactgattgactgcgccgtcaaaccagaccgtctcctctccattacgcagatacattttggcaaatggccttgcctgctcgccaagctgtgtaattcccatatgaatctcatagcccgcaatcggctgctcgctgcatgaattcaacatccccgtcagctcaggcatgacaacgcctttaacctgtgccgtatgtttttcactggcaaactgagtgttagcatccagtaatcccaaaccggccatccggtttaaacctgattcaacctcatcaatgatttgttttcccagcatctgatagccgccacagatcccgatgatcggaatacctgactgatgcgcggcgataatagcctgatcaagcccgtggatctttaaccatgccaagtcacctaaggtatttttgctgcccggcaaaatgatcagatcagcgccatgcagtgccgaaggatcagagacataacgcagatgaacatcagattgtgccgccagcgctttgaaatccgtaaaattggcgatatgcggcaactggataaccgcgatattcagccaattttctgcgtgcttgccagagtgatcatatttgccgacctgtaaggcgacgctgtcctcatcttccagatcgagatccaaccacggcaacacccccaatatcggcacttgtgtcagagcttcgatctgatcaatccctgattgcagtaaagccggatcgccacggaatttattgatgatcacgcctttgacccgtgctctttcctctggcctgagaagtgccagtgtgccataaatcgcggcaaacacgccgccacgatcaatatccgcgaccagaatgaccggaacatccgccaactctgccatgcccatattgacgatatcgcgatcacgcaaattgatttcagccggactccccgcaccttccagtaccataatgtcggtttccgctgcgaggctgtcataggcggccaaaatctgctgttggagctgtggcttatatacgtgatattccacggcgttcatgctgcatactacttttcccatgaaaatcacctgcgctttacgatcgctggtgggtttcagcaaaaccggattcatacgcacatccggctcaatacctgccgcttctgcctgaaatatctgcgcccgccccatctctttgccatcggcggtaatacccgaattgagcgccatattttgcgctttgaaaggaatgcagcgatggccgtcctgtaaaaagatccggcaaaatccggccaccagcacgcttttgcccacatcagaagccgttccctgaatcatcagagataatgtcattgtcgtttctcccttgttctatgcaagatagcaaaaagcgcctgctctgttttgcacagaggcaacccggcttcactgtgtactttcaccagccacggctgcaccaaacctgcctgttccagcagatctttttgcagtaagacggtttctggtttacctgaactgatcacccgaccctttgccagtacatataaaccatcacagatctgatagatcaaatctatgtcatggctggaaataatgatccgcttaccccctgcggcaatcatggtgatgatctccagcatttgctgacgcccggaaggatcaagccccgctgtcggctcatccagcaacaagtaatcaaattccatcactaatgcacccgcaatcgccacccgctttttctgaccaaaactcaagtattgaatcggcttgttgcggaaagcatgggcgtccaccaatgtcagtgcacgttctatcctgcgctgaatttcggcctcctccacacccagattacgcaggctgaaagccagatcgctgtcaatatcggtataaaagatctgttggtccggatcttgaaataccgtgacgacccgctgacgcaaagccatcagactttttttactgtaatccaatggcgcattatcccaccagacagcgccttgttgtggacgcaggataccggaaaggttcatcaacaaagtcgatttaccacaaccattcgccccgataattccggtaacctgatgatggctgaaatcaagtgtcaggtcttgcaatataggttcatcctgataactgaaatgcagtgcctgcgtcgccagcatgttcgcctcctttatctgagccgcaattccccaggttataaatgaaaatcaccctgatacagtttgagtgtcagcgccacactcatctgctgataacggctcatcacccgcgcaaacagcataccgaccagcatcgccagtgagcggtagctcgttcgcagggagcgataaccaaaacgcagtgattgtgcgcggtggatcgcggccgcttcttccacaaagataaaaataaagcgccatgtcaacaggatttgttcaatcaaaagatgaggaacacggcagaatttcagtaacttaatcatctgctcaaagggcatattcagcataaaccagaaggttgccgccaacgttgcaaggctgcgccagagcgtctgattagccatgtttacgccctgtgaatcaatccctagccaatattgccctactttaaatccccacaacaggctgtccggctgcaaactggcagacagtacgatagcaatcaggccaataccgagaaaccccagcgggatcaacagccatttcaggtaacgcagcaggctgatccgcagcagatagcaggtaaatagagcaaggccgaataacaatgcggcctgccatactggagatagccccatcgccaataccataaacagcagatacagggcgaatttcgccctgggatctttattgtgccaacggctctggtcgctcagtttatcaatgccgatcatgatctttacggtcgcgacgataataaccaaggatgtagaaaatcacggcagtaccgaggctgccctgcaatgtgaacaacaggctttcaatttcgccgctggccggttcatacaaggattcaaaccaaggggtataatggggcgcaatttccatgatttgcgcttcagcctgaccatctgcgccaccaaattccccgccgtgatcaatgaaaaacggaataacgcacagagcaatcagcagagacagcaatattaatgtctttttcatcttcaacactccttaaaaactgcgagcctgaattaattgtcttttcaccaactgatcgtaaatcagcacggtcagtaaaccttcagcaaccgcaatcggtagctgggttatgcagaaaatgcccataaatttgatgatggctgcccccatgccaagttgtggatcggggaaagcgacacccaactgaatagaggtgacggcataggtgacaatatcggcgataaaagcacagaagaagacaccgatatctttgcgtacgcccattttgcaggagaaacgccataccaaataccccaccagcgggccaatcacggccatcgacatgccgttagcccccagcgtggtcacgccgccgtgcgccagcagcaacgcctgaaacagcaggacaatcgcacccagtaccgcaacgacagaagggccaaacaagatcaccgccagcgcgactccggtcggatgagaacagcttccggtgacagaggggattttcaacgcagacaggacgaaaataaatgcaccacacagtgccagcaacactttctggttactgtcttcctgcacaatctgacgcaatctcataatgcctgccgccaaaaaaggcagaaaagccagccaccatgcaactgcccacatcgggggcaaaaatccctccatcacatgcatggcgaacgcttcctgcggtgccagcgctaaaagcagtgcgatagccgcaccagataacgaaaacttcgttagtttctgttgcataactcacctcaataattgccagtttttattaatcaaaatcgttgagaaatacgatagcccctgcccgctatccaatgcgccgagatggcgccagcactgttctgtcggcaaagtcgcatcagccatcatcagcgtgtgttgcaggagttgatggcgctggagcagcccgcgtatccgttcaaaattcgagtaaactttcatcaggacgatgcagtcatgattgagcaaggcttgctccaaaaccgcatcgggagccgtaccggcgatgacggacaaggtttgattttccatcgccaatggcattgcgctacgtgccgcaatcgccgcaaatgaggtaatgcccggtacgatttccagccacggcggattaccgatccgctccagcagaaacacccacgtactgaacagcatcggatcacccagtgtgataaagccgacttttctgcctttcgccacttcttcttgcaaggcttgtgcgactctatcccacacgacttctttttctcccctgtctgatttcattagaaaatggtaagtgcacacttcagtttcaggtgagagatattcttcaacaatggaatgagcaaggctctgaacgccttttttaccagaaggggcataaatgacatccagcctggccagaatacgggcagcccgtacagtaatcagatcgctcgctccggggccaacccctatgacatacagttttccgctcatcacgcgccctccccgaccttttcattcatggcatccgcaagatgatcaacaaacatctgccggatcatcggattttcgcccaatccctgcaaccaagggatggccgtcataccggccttctccaactgtgatttccaggaatcgctttcaccagaagccatatcattaatggcatgatcccctgccaccagcatcaacggcatcaggtgaactttacgcatgccttcggctttcagtcccttgataatcaaagcgatttcaggatagctttccactgcccccacgcgagccggaaaatgataatgcgtcatcaggtgatccaaacaggcgtaagcagaaaaagcggggtgagtcgttccgtgtcccatgaagaccacatactctttgtcacccaatctggggagctggtggtgcagcgccctcatcagttgcagatagtcttcaaaattgctcagtaaaggtgatcccagtaccagacgttgaaatcgcggacggaatctttctacttcatggaggactttttcatactcgtcacctttgatgatatgcaggcactgaacagcgacatcgtgataaccggcgtgatacagtctggtcagcgcctcgtgaggcgtatcaatgtggatgccatcgcgctcccgcaatttgcgaataatcatgccggaggtaaaagcgcgaaacagttccctatcaggaaagacagaagccaactgctgctcacaggcttcaatattattttttcgcgtttctggataactggttccgaaactgatcaccaagagtgcttttttcatcgcgttatcccttattagttagctatcacggggaaattcgccaatagctgcgccatctcttccaagctattggcctgcataattccctcaccgttaaacggatgtaccggacggcagatcacgatacagggcagccccagcgcaaggcacggctcgactttctccttgaaaccgccctgttcaccggattctttagtaatgactacatccgcctgacaaaattggtaaaatgcccgattaaaatcggcactgaatgggcctttcagggcaaaaatctgatcaaccgacaggccgcaggattcacatagcgccaagacttctgccgtcggcaagacacgcgccagcacggtttttcccgccaaacggctaacataatcggccaattgtttgctgccggtggtcagcagaatccgttcgcctaatctggcggccacttcgcacgcctgatcaagggtcgtcactttatggatcaaggcatgttcgacatcatcaatatcactcggacggatataacggatcagaggaatatccagcttctgacaggcctgcacgatgttttggctcaaccgctcggcataaggatgagaagcatcaatgaccctctgcgttctctgcttttgcagataatccaccatgccctccgcttccatccggccaatcacaatgtcaccgcggatatcagccgcctgctgtgctcccgtgggcgtggcaacagacaggcgatagtcaatgccagcgctatccatcatcatgcaaatctggcgggcatcactcgtgccgccaaaaatgtggatttgtggctgtttcacaatcggtacccccttggtgtgatcatcagcccatcacgtacgtaagtggattgattgccgacaatcaccaggctgcgcatatcaacgcgggaaaaatccatctcgccaaaagtggtcagccatttttcttctttcttgcgccccgccgccttgaccacaccgacgggtgtttctgccggtgtccacggcgccatcaacgcaaaggctcgtgccaaatggtcttcgcggccacggctgcgcggattgtagaaacacaccacgaaatccgcttcagccgctgcccgtacccgtttttcaatcaccgcccacggagtgagcaaatcactcaggctgatatgacagaaatcgtgcatcagaggagcaccaagcagtgaggcacaagcagtactggccgtcacaccagccaccagacgcacttctacatggcgttcatgctgactgatcagttccagaaccagccccgccatgccataaatccccgcatcaccgctacagaccagcgcgacatttttgccttcttctgccagatcaatcgccacctgacagcgctcaatctctttacacatgccggttttgataatctctttatcgcccaccagcggctttaccaaatgggtgtaggttttgtaacccactacaatgtccgcggctttcagtgcggctatcgcttcctgcgtcatcatggcttcactgccggggcctattccaatgacggttaacatggctgcaatactcctaatgtgatagtgacgccctgctcacgcagggtatgaccaaccagctgcccctggctcatcagccaggcaacgggttgggagacacaaccgacgcccacggttttgcgcacgaattcagaggcagggaatgcctgttcacattgggcgagctggttaacagagaaaatttgaaaaggaatgcggcgtttttccgccagttgaactaaagccggctcttcttgtttcaattccacactgccgatggcttttaatgccagagggtcaaaatcatgttctgccagatgacgatccaataactgcgcgacccgttcagcggcgaccccgcgtcggcagccaatacccgcgataatccggcgtggcactaatttgaaggtcgggatcgccaatacgggtattgcccgtcggtggctgacgtaaaccaaggcatcgagttccggcagatcatcaagggattccaccggaataaacccacgggtatcacactgccttttttcgccaatcagtgccggatgccaccacatacctactcgtttgccattgaccagcatttggttcactgtcttgacgctggcgcgaaaatctgccatttcgccgtcaatttgctgggataacacatcaagtgcagcgagttggttgacatccgttgcggttgtgataaccgcctgtccgccaagcagatccgcaacctgtcgcgccagatcattcgcaccgcccatatgccccgataacaggctgatggcaaactggcctttttcatccagcacaacaaccgccggatcagtcagtttgtccctgagcagtggtgcgattacgcggatggcgatccccgtcgcaccgaccatgaccagcgagccatattggctgaatgccttgcgtaccgtattggcaaagccactgtcgaaagcactgaaccccgtttccaccaattcaggggaagtaaaacaatccaccgccaaatgggagcgcagacgatgtgccagctccattccccccatcgtcaggcagaacaaggcgattcttttactatgcttgacgatattcatggctgaaccccgcatcatacagttttgagtagtggtactcctcgccaagaaacgcgccgaccaaaatcaaggcggttttctgaatccctgccgtgcatacctgttccgcaatcgtgtccaatgtgccgcgaacaatccggcaatccggccacgttgctttgtaaaccaccgcgacgggggtttcttgcggatagccgccctgtatcagccgaacggtgacaccagctatatcctgtaccgacagaaagatcgccatagatgtctgatgagccgcaaaggcttccagtgtttcccgtggcggcatcggtgttcggccggccatacgggtgatgatcaggctttgcgccacttcggggacggtatattccactcccaattgcgcagccgcaccgagaaaagagctgacacccggcacggagacaaaccccattccctggcttgctaatacttcggcctgttcacgaatagaaccgaataacgacaaatcccccgtttgcaggcgcacaactaattttccggctttgacgctgttcaccatcaaatcagtgatttcctgtaacgtcatacctgcactgtcatggcactctgcatccgcgcggcaatattccagcagctcccgattaatcagcgatccggcataaatcaccacttgcgcctgttgcagcagttgatatcccttcagggtgatcagggttttatctcccggccccgccccgacaaaccagacttttccggcatcaaaacgcgcaggttcagtatcaacatgctcagtcataagcactctcctttggatcggacagatgttcgacaaatttctggcaggaaattaaataggtgggattgttgggtttgaaatagtgcccctgccccaatggggtcaattccccgatctgaatttcacggccatcaagggacaccacctgacaagattgcagatgcaccaatgcctgcataaagttttccagcaggataaacgtcatcaccaaacgcccaccttggttcaggtgtgtcagcgcccaatcgattaattccgtcaagtgtccgcccgttccgccgataaaaatggcatcggcggcttcctccaagggcagtggtgcaacacccgcctgaatacgaacagtgtgacagccaaagtgccggacattttcatagatcagtgccagcgcctcttccttacgttcaatcgcgaggacatccagcgtgggataacgtaatgcagcttcaatactaacgctgcctgtccccgccccgacatcaatcagatgtcgggctttattcagttccagccgttccagtgccagcgctctgacagtttctttggtcatgggaatgcgatgaccacgcaaaaacagttcatctttcattaaggatcaccaccacgttcaagccataattaatgtcaccgcattcggcgacctgttgcgcactcagacaaacaatccgctcgttctcctgtgacaagttttcaccaatcaccatccggcgatgctgcccgtgtgccaaaatctcctccgcaatctggcgggggccaatcagctcatccgtcaccattgcgattttttcgtgctggagcagccagtcaaaatccggttttcgaccgtggctgctggtaaggtagatatcgttcatatccagcagaattcgggcgcacagatattgaatggcagtgatgccagaaatgatgcgaatgttttgcggctcgccgacaaaatgttcagcgatgcgtttaccaatgccataaaacaggggatcacctgaagccagcaccacaacctgctgatattggcgctgttcaagccattgcatcaatccgtccatatcggcattcaaacggcgggtttcgccacgaaaatgggggaattcagccagatgacgggcgcctcccaccaagatttccgcctgtttgatggcgtccagcgcggccagcgtttgatttgcgatggcgccggggccgatgccaacgaccgtaatcatcggaacccctccacaatctcatccactggccgattgcagcccaggacttgattatcaaaggagaaaagaatggcatcgcactgtggcctgccgctggaaaaacgcagcatttgatcaacgcgtccgcagatcttctgggcaatctgctgatgcaccgcctgccagccacgttccgcgatcagttcgatggcggcttcggtggtatcacagtgatcaacggcctgaatcaattcgaaaggcgctcccattacggcaagattggcgatcaacgtttccatacggccatccgcgatatggctgtgggtatgaaaaatacccgctgcgattttcaccagcttgccgacatgccccaccagtaccacatggctaaactgcaaacgtaccgcttcctgaagcatgtagccgacaaagttactcatcgtcaccacataatttccgtcaatacccaactgctgactgacaaaacgctcaccgtgattacctggcacaaagataatccgatccaacccgctggcgcgtttagcttccaattccagcgccagcgaacgcttccagctctcttctgacatcggcatgacgatgcccgtcgtaccgataatcgaaattccccctttgatccccagccggtcgttataggttttcttcgcccgctcctccccctctggcgcaaaaatcacaatatccgccccacgctgaagaccaatcacctcacgcaccgcttcttcaatggtgtgccgcggcgttttattgatggccgcccagcctattggcagaccgatcccgacccgcgtgactctgccaaccccttcaccgccatccagcgtgatgattccgctgtcattcagggagacgcgcgcaaaaatcaacataccgtgcgttgcgtcaacatcatcaccgccatctttgcggatcgccgcaactgcctgctgaccttcaatcagcggctgttcaacgttcaaggccaacgtgacgccggaaggggttacgatggaaacctgatggataatctgctggcgcaagatcattaacgccgccacccgcgcagcggccgtggcacaagagccggtggtataacccttacggtactgtttcccccggtgccagaccgttccgaggctttctgcctgcgtgtgtggtgtttcattcaacgtttcattcatgccgcacctccggcatccgatacaaaacagcgttgataatcgccgccgcaatattgctgccacctttgcgccctcttgctgcaatgcagctcaagccgctatatataagcgcgtttttggactcttccgccccgacaaaacccaccggaaccccgacgacggcaatgggcgcggattgatgttccagcaagcgaaacagcgcagtgggagcattaccaaagacaaaaatcttctcccctgcttcttgtaaagcaatattgaccgccgccattgaacgggtgatctgctgcactttcgccatttgcacgacacggggatcgctgacataacaacgacattcactgccatattgcgccagacgggttttattgatgccggataacaccatcgtggtatcggtgtataacgtgcagccgcgcaaaatcccatcgcgaatacgatgcagggcatccggtgagaaatggaggatatcgagccagtcaaaatcagcggtggtgtggatcacccgtttaatcaccgcttcctgcccggcatccacaaaacgataatcagggcgcgattcacggataatctccgtgataatgtcaaagctatgttgctcaatctgctgaggttgttgaatatacgagcgttgaggatagttcatcttgtttcctcttcttataacactacgttgaatggcgttacgctgaccaggctatgcagcagcgcaaacagcaggagcgccatcaccgatgccacccacatcatctgcacggactgcgggatatcttccggtgtgacttcacgccgtgcgtcaccgatccacggtttttcaacccgctgattaaaatagacactcggcccgccaagccggatacccaatgcgcctgctaccgtggcttccggccagccactgttggggctgcggtgttggtaacggtcacgccagccgatacgcagtgcctgacgaaaatccagcccctgccacttcgcagccagcgccagcaaaagccagcccaaacgcgcaggtatcccgttcgccacatcgtccatgcgagccgagaacatgcccagcgcccgataacggggagtcttatagcccaccatcgaatcaagggtatttaccgccttataagccattgcgagtggagcgccgccaatcatcaggaagaacaacggagcaatcacgccatccacgctgttttctgccaccgtttcaatagcggcacggctgatttgcggcggttgtaactgtgacgtctcccgtccaacaatctgagccagttgttgacggctggccgccagatcgccctgtttcaatggctgatagaccgcattggccgcatcactcaggctacgcccggccagcacggtataaatcagccagacttccaccagcaggccgaaccagaatgccacaccataagccaaccacagaaccagataactcatcagccagacactgcccaccactaccagccacaatgccaccccgccccatttcaaatcagcttcggttttgcatcgcccacgaataacgtgttcggcctgattgatcagccgacccatccagcgcaccggatgcggccaatgcgagggatcgcccagtttcatatcgaggacaaacgccgcaaaccaaagtaaaacggtcatgattgcccccttgccatctgctcgcgggctatcgtcagccagcgatggagcaaatcagggcgttgggcaaaatgaatatgcagataccccgccagcgtattgccgttttgatatccgccaaaccagcttttctgcgccatgccgctacgctgtttggtacagtggaataccggcgtctgggcggacgtgaaatcagaataatggaattcatgcccgcgcaaggtttcccccttcgccaccaaaagcgtgtcgcagatcgccgtcgcctcgcagtaaccaaagcgtttcagactctttcccatctggctttcaccagcaatcaaacccaccatagggtggcgaacgccctgtacatcggtcagggcttcaccgagatacatcaggccgccacattccgcataaatggcaatgccttttcgttgcgcctgacgcaatgcctcatgcatagcgtaattggccgccagtgactgggcatacatttcaggatatcccccgcccagatagatcatctgacactccggcaactggctatcgtgcaacgggctgaaacgtttgatggtcacacccgcgtgttccagcaacagcaggttgtcggaataataaaaatgaaaggcttcatcttccgccagtgccagtgtcaacccctgaccgctagccggatcgacaagggaagcgatatcgccttgcggtaatgtcggtaatggagtcaacgccagtagcttgtccagatcgaccgtcgtttctatctggtgcgccaggttctgccactgttcatcatgttggttattccgctcttgagccgggatcagcccaagatgacgggaaggcagtgcgatatccggcatgacgggaatatgccccaagacgggcaggccgcaatagtcttcaatcgcctgtttcaacaactgaaaatggctatcatggttcactcggttgagcagcacacccgcaatattgacggaaggatcaaagtgctgaaaccccatcactgtggcagcaatggacgtagaaaccgccttgccatccaccactaaaatcaccggacagccaagctgctttgccaacgccgcgctactacagtaatcagggtctgaaccatagccatcatatagccccatgacgccttcaataacggcaacatccttatcggctacagcctgattaaacaggccattcagaatagggacaggcagcataaaagcatccagattgcgggaagccactcctgtcaccgcacgatgccagccgccatccagataatcaggccccgccttgaatggctgaacccgtagctggcggcacatgagtgctcgcataatccccagtgtgacggtggttttgccacatccgctgcctgtacctgcaatgacaaaagcatatttctgccgcataggatttccccagactatttacttcaaactatttaccctgaaccatttagctaaaactattccctgccattagaactggaatatccgatctctctcattgatatttatcaaataaaacagattcaacctattttaaataatcaaatacacgcataaccttaataataggaaaataaatttatttcattattatattaataaaacacccgacagagtcttaaaacaaccgtttgttaatcacacaaagaatacattaacactatcattacaaactggggttttatattaaaataacggagagtcattaatcaattttcaaaatacacagttttcctatttataaaaatacacataatgacttttgtgatcttgttcatacttattgaattttaaacactatttttattcatagataaataaaaataattatagaaaaacaaatataccgacaacaaaaataaacataacagattgaataatatttattttttatatgaaaacaataaaacaaactaaaatacagatcattaatatgacaaaaaactttcatacagaaaaatattttctggtaattatcatatgaatcaaaagaatccattatttttaaataaacgaatattgacctaaatcaaattcattttattcacactcacgtaataatgcgttaaattaaaaatcattcataccacccgcgttcccctatacgcttctatataagaaggaaaatataaagggagttctatgaataaaggcaaagtatggctaatcggagcaggcccgggcgaagcagcgttaattactgttaaagggctgcattacattcaatctgcggatgtcattgtgcatgatcgtctcgtcaatcctgagttgattgcacaggcaccagaacactgcgacatcattaatgttggcaaagagcgcaatcaccacccgatcccgcaggaagaaattaaccagattctggttaaacacgctctggccgggaaacaaatcgtgcgcctgaaaggcggcgatccttatgtatttggacgcgggggcgaagaagcagaaacgctggcacaacagggcatcgaatttgaaattattccgggtatcagttccgccattggcgggctggcttatgccggcattcccgttacccaccgcgattatgcatccagcttccatgtggtgaccggccacctttcccaaggtaacgagccacagaactggcgcgcattggcgcaattgggtggcacactgattattctgatgggcatgagccgtctggccgaaatctgtcagcaattgatacaattcggcaaacctcccgctacacccgcagcggtaattatgtatgccagccagcccagacaggagatgaccatcgctacactggcaacgctggccacagaagttgaacaccaccaactgcatgcgcccgcattgattgtgattggtaatgtcgtccggttaactgaaatactcgcctttacctccatccccattgcgctcagttcaaccgcagtcatgatgaaccctctcacccggcaggtgacataatgagtgaacacggcggcaatatcatcgaagttgcccaacaattcggcattccagccaacgaactcatcgatttcagcgccaatatcaacccgttgggcgccccggaacgggtgaaggcgctgattaaagataaccttgcctgcatcgaaaaataccccgacatagagtatcgccatttgcatcaggcgctggctgacgcccatcagtgcgataccacttctgtgatagcaggcaacggagcaacagaactgatctacgccgttgtccgttacctcaacccgaaacgcgccctgctcctcacccccggattcgctgaataccgccgagctttgcagcacgttggggctgagatcatcgcgtatccattaacagaagacgcaggatttcaacccgatctacgcctgctggatacactgacaatgacccaacccgattgtgtctttattgctacgcccaataacccaaccggtttaatgccagacagccggtttctgcaatcgttggtgcaacattgtgaagagcaccgcatagcgctgattgttgatgaggcctttattgattttctgcccgataaccggagtctgatcccacacattgccgccacccgccacctttatgtgctgcgttcactgacaaaattcttcgccattccggggttgcgactaggctatctggtcagcggggatagtacaggggtggcgtggatgaaaaaccagcgcgaaccgtggtctattaatgcccttgcggcgcgggtgggtgaagtcttgttggatgatcaggcttatatcaccgccacccatcaatggctaaaatcacaacagcattatctttggacgcacctttcctcctgccctgaactcaccgtctggccaccttccgctaatttcctgttctttcgctgccatcagcctaatcttgatttatggcataccctacttgagcaccggctgctgatccgccattgcaaaaactatgtcggcttggacgagagttactatcggatcgccgtacgcaacgaatgggaaaaccgacgcctgatcgccgccatacagcacgttttcgcacatggctgaagcctgctgcccggcttcctgcggagaactgctgcaagggtggctattcggcggagagaaattgatctcctgccccattaactggttcagttgtgtcgcggtcagcgaaggccatgcctctgctgatgaacggccacgtatgcgccagatggtggaattgctgctggaacactggaatgaacctactgaattatcggcctgcctgcacatcgaataccaatcgacgatcccaatagccaaaggcatggccagcagtaccgcagacattgccgccactgcacacgccacggccaaattactgggtaaatcgttgaacagcaccaccctcgcgcaactctgcgtcaagctcgaaccgactgacagcacggtgtttgcaccattaacgttattcgatcacctgaccgcccaaactcagatccccttcgcctggcagccggatatcgatattttgctgttgggaagtcggcaaactattttgacagaagagtaccatcggcgggatcgccatcaactcttgctggaaagtgcgccgctgctccaacaagcatggcggcaatttcgtatagcgaataaatatcatgacaactatcgtctaggggaagcctgcacactgagcgccatcgcgagccagccaatactgcctaagccccggttttatcaattattggatttggtcgaacgaagtggaatttatggcctgaacgtcgcccatagcggcagtgtcattggcttgctatgcaacaaccatcagcacgatgtggattacctacgctggcagttaggccagaaacttattgctgactactacccacagatacaccctgtcaaaatgattacgggtggcgttcgttaacagaattcatgaatgaaagcgagaatcacacgaattttatgcctatttttggtgatctgaccgacaaacgttacctgattaccgaagaggatcatattgctgaacacaagctcatcacaagccaacccgctgatatgggatataccaacgctagatcgaaatgggttgaaataaacccgtttcgggtagaaatgaatatgtaagcaattattatattcaacatgagaacttcatacataacaaattgatattaccactaataaattttattacaccaaatggatacatggagactatgctgattagttaccgagtcttcctcttaccggaacgaagcgaccatacacgatttgcggcaatacaaccaacaagcccgcaaacattgcttactggggttacatcaacgccctcactttatcaggataaagataaataaagacgatattccggctgataaagctcccgtcaaaaatatcaatggaatatagattgattcaggcaaaaaatatttttcagtattcccatttgaactaggaaattaagtaaggtacataatttatgaatataacatgtaatcactgccaaaaacctgttgaagaaatgaacttaaaacaagctaaaattattcaatcggctgagtttattgaaaaaattgttgatttagtcttagcttgcccacattgcagccaggaatacagtgtatttgtacctacatgggatttacagccgctagaaaccgcctgtatgtaaaaagcgtcaaaccgttacccagccaatcattgagaggaactgaccactctcctgactgaataaaataagtacacataatacgcaatcgcaaccacaacaatgcctgctgaatactgcgggcattgttgttttaatcacaaacgcaccagctcatcattgcgatcaacattccataaatcagaagccattttgccctgaacattttttcgcattatgcttatgttaaataatattatttgaacaactcatcatacattatggaaaatatacatctcgaacctgccacctttgacgcctttatgtcgctcgatatccgtgtaggcaaaatcatcaaagcagaaaaaaacgaaaaagccattaagccagcctataaactttatatcgattttggcagtgatatcggtgaaaaacagagctccgcccagatatgccaaaactacacagaagaacaattaatcggcaaacaagtgttggcagttgtcaacttcccaccaagaagagtggcaggctttaagtcagaagtcctcgttctggccgccgtctgtgacgatcaaggcaccgtactgctccagccagaacgagacgtgactctgggaacccggatgctgtaatttatcccgtgcgccgtaaaaccttggccttcagagggtgtcaacaaacaacgtatccacttgtgcgggatctttcgtcagggtattaagcaccgcccgattactgcggttcgatacggtgatgtcagtcgtataattgttgttgcttattggtgcactatggcgaatttgcgtcaggttgcctccttcgtcatagatatagttgcgggtgtagtgggtataactgctgttgtctgtcggcaatggaatgacaggatgaggcagggaagtgttctgttgaccgatattggcgagttctctgcccgtcgccacaaccaactggtacaggctgtcataggtgtacgtgttggttgcatctactttctgattgcgccagaagcgggtggcttccgcatcattacccacgctgagtacattccccaccggatcatagtcatagcgcagatccagcagaactttcgctcccgcagcatgacctgccggccgttcggttttaatgccaatcagccgttgcgtttccacttcatagcggtaagttgtcaccagcccattgccatgctcctcccgcaatttctgcccggctgccgagtaggtctgggatttaagaatcacctgctcagtttgtcctttcagggtcagccaactgccacgcagtaagcctgccacatcataggccatgcgctgtctatttcctttcgcatcggcctgggtcagcagcgtacccgtggcatcggtcgtcgtcgtggtagtaaagacctccggcgataacagggcattccaagccggctcgtcattcccctgccaatctgcattgacatcatctttcagtaactgacggctgacagactggggaacattcgtcagggaaatactgtttgtcagatttaaacccgcagtatcgtagtgtcgggtataagtccccgccaaattctgggcttgctctgacgggctattacccgcccagacgaaacgctcggttatccgagatgcgccctcttccgactgttcggtgatactgagcaggcgccccggcaaggtgctgtcttcatactgccaagtccgaataacattggttgtattcacattcagcaccggacgattagcaatatcatccagcgagacgttgctacctgcatccacactatcggtacgaagcacttctcccgtcaatgcgtgaaaataggcgaaattgggtttaacggtcgcgtctgtctgctgtaactcaaacagacgtgggtcaatactctgaatccgttgcccaagggcgttgaactgatggcgggtgatacgcttatcggtggtttgcggcgtattcggatgacggtggtaatggatgtctcgaaccatctgaccgagattatccaataccattaccgtcggtgttttcgtgtataacgtgtaatctgggtgactcataactgtttctcctcaagaggctgtgtgggatataggttcggcttggggggaaattctgtaagaactgacattgttttcatccttaatgtcataatgggggtaatattggtcgctttatgatacggtatatttaagaaaaaacgttgttaactgttacagaatgcgaagaataaattatgttacaaatatctaattaatatgctcctagtaaattttattattgctgatgaaattttcatttttaatatttatttacataatgcagatttatttttataataataaacatttttaatatagaatattttgccaattattagtttttattaatatatattcaatcagtaaaatagatggaatgaatcatataaataacccacctataagatataaaatataattttcaaatattatcaatctagcgataatagtattttatttgaaacagataataactaaatggcttgactgatctaaatttaacacacgaaaatatataaaaaagaaattcattaattccgcaaatgtccattattggataaaagacattccaccacttaatatgtcatttccatattgaaataatgaatcatcaaatgcaccgtatattttaccatcacttcctaacattaatgtaatatatccattacaacactcaccaaaaggaattaatttacatgaagttctatcttcatattcctcaacccaatccataggaattaattttgaagcttctataggatctgtatggaatttttcaggtttagcttcattgtctttatatgctgaatgatatcctttaattccgccataattagttacaaactctaaatataaagaaaatatattatatccttcattcagtagaaagttggcacaattagccatatcaagcttttcttgataaacctcaccatatttacttgctaattcgattaatttattcatattacccactccttacattggcaccaatagaactaggaatacctaatttactattaccataaccaccaactgttactcggcagttttcacacatagcaaaaggctcatgtgataaatcagtagttttcaccgtataaacatttagattttctatctttgctccatccaataaagcattattaagacattgaaattcagcacaattacgaatatcccagaacttcagagatttattttgcatatgatctattcttccctgtaaatgtggatgaatattttgaggaaattcactactgtttttaccagcaccactataaccccgatagtgttttccgttcaaaatatccactgctactgatgtagctcttggcttacttggcaatctatatctccacctgtccctggcttcttggtcagcatatccagataaatatctatccgtgaatctatcgtgttcagtccgagagttagaactttctcctttacaggagtccattaatcccagtggatcaataaaattcacagaattatacacgtacccatacggattcaacccaccttgtagccctatcgggtccggcgtcagatattgccctgtatcacgatcataatagcgaaagcgattataatataacccgctttcctcatcctcatactgccctgcaaagcgcaaattacagctaacataataatcttcatcattcgccgccagtagcggcatcctctcggccttaccccaagtggtcagccgacttgcccataccagcttaccggcttcgctcagtatttcccggggcgtcccctgatggtcactgacgatataatgtaacttgcccttttcataacgagccgaaggcgtaaaggcacccggcgcatacaaccaacgaatgctgtgatcatgggcaagcgaaccatctgcatacagtggggtttcctcaactaactggttgccgctccacaggtagtcataccccgtaatggtatccggcttcgcggtcaaatccggcttgccgtccagccagcgttgcaggttgaccgcggtcagtttgccatcatgaactttcagcttacggatacgccgcccaaagacatcataacgatagtgccagcgtgagccgtctggtgtttcgcaatgggtcagttgattttgagtatcccagcggtaacgccatacctgtggccggaaaccatcatggtgctcagtcttttccacctgccggccattgtcatcgtaacggtaagaaacattacctcgtttaacgacccgtcccgcctgctggcgctgttcaatctgctcaaccgcgccccgtgcgtccaccggcaagtgttggttcaggttgccgttggcatcataaccaaactgttcttcatagggcaaacggccattgaaggttgcgctgactatctggtcattctggttgtagcggtaacgggtttgcccccagataccgtcatcaatcactctgacgctgtaggcgcgatcatattgccagctacggttaaccgccgtggcctgcggcgggaagtgcgggtcattctgcgccaaggtttcgcgaaacagcgctgtgactcgtcctgcggattggtgtgccaacagccctgtagcgttataacggctgacaaggataaacccttccgcactttcccgcacagtttcccgccccagagcatcatggttcagagtcagtggcatatgctggttaaattgaaagtgattcagccctcccatcacggaatagccaaaatgcagggcatgctcaccaatagtctcggtagtgatttgccctgtcaggctattccactcacgggtgatttcccgtccattgatgcgctcacaaacaggcaaaccaaccgcatcatattcatattccactaccgcatcgtcattgacggcgcgagtaagctgatggcgagcgttgtactcataggtggtggaggctttcagttcagacctgtccccatcctgataccaggtttcctgtcgggtcaacaaacccgatgaggagtaatgccagcgtagcagatgattatcaggataatgtgcctgaatacgacgccccagctcatcatactgatagtcgatagtgcggccggtaaaatcgatttcacggataatctgaccggcgacatcccgctcatagcggtaagtttcccctgtagacgcagtgacagaacaaaaacgggtgagacgatcataaccaaagtgcaatgtcgtaccatcagggcgggtaacttgggtaagcaggtcaaaagcgccataactatagcgagtaatgcggccttctccgtcggtgacagccgcaatccgtcgctcgctgtcatattccatatgctgggtgacgccatccggcagttcaatttcggtcacgctgccattcaggctggcatggacgttactgtagcgataacgactttcctgcttcagtgcattggtaatacggcgcagacgccccagttcatctaactccaagccggtagtctggccgtccggcgtcataattgcggcaagccgctgatgctcatcataggcataatgccactgccggccatctggcaacagatgttgccgcagttccccatgagtgccgtactgatattcttctttgtgtccttgcggattggtgacagcagccagattaccctgctcatcatgatggaagtgccaagtatcgcccgtaggctgagttgcctcgatcagttgaccatgttcatcatagtcataataaaaagcgtcccccgttggtaatacaatttctgttaatgcaccgtcattgttgtagccaaaagtggtatagccacccagtggatcaatttcccaaaccttctggttgtaacgccactgagtccgcgtttcacgccctaacggatcaacctcacggatcacttgattattttggttgtaataggaaagggtctttcccccttcggcatcaagataagtggtaacacgggcctcatcgtcatagataaaacgatcgtcccaataaccagcggaagaatgggtggaaacgactcgcccgcgttcatcatagtgaatataaaaatcggtcttatccgtatcgtgccagcggatcataaacccttgcgcggtgtattcatgccatagatggttttgctgaaaggcatcacattcagccagatatccgtattggtcataacggcaggtgaccagacgctgttgtatctgctgaaagtggtaatctactgtctggagctgattatcttgatagtgaagcgttaatcggaaaccgtcattgcgtacaacttccatcagctgatgctggtcgttatagataaactgaatatgattctgatggcgatccgtgatggcagacaaccgacgcctgttacccacaatatggttaaaatggaatgttttctggatctgtttattaaccagacacagttcaccatcaagctctcctgtcagtaaacaatgaaggagatgacgattacgtgccaatacctgtttttccggtgttgagaaatcataaacctgcccatcagcatcggtaaaatggactttttcatcgtccagtactagttgacgtgaccaatcatcagcccattttcgccctaataatccactcagacaggcggcagagcgataggttcgggttagggtgattggtaacaagccggggatggtaatgattgagaatgtttgtaagtaatcgccagaggtgatatcgacaggttcgccttttccacaactaccaccttcacacttagaagaatcattcttgcccgaatcatctggaggatcttttttggttttctttggtttcttggaactaataagcggctctttttccgttcttgcagatcggatacctgtctgctctgtttgggttaatttttttgctccagttacagtcctgacgccggacaatcctttttctgtttcgagaactttagttattactccttctccttttactacttttgagagaaaagttactgactcagcacctactttcattactgtttttacttcaccggggccaataaagaacatggcaatattacctattaaagctccaccttgctgagccgggttacttagctccatatgtaaagcccctaaagctccttgaactgtatctccatacccctgaccaaaattaaaaaccgcagcacctgcgttttttgctccaataagtgaaagcgtcttccccagtgctttcatttccatttcaggaattttctctataatttgtgccagatcgactacagtattaaaaaaatcctttccccccccttttattgcttcgacagggtgcttgactgcttcaataagattatatccttgttcattaacccaatgaccaacaagactaggagctttatccacaacccatcgagaagcatcagaacctttattcacaagccaataagcatcatcagcagcgttatctataagccgatgagctaaatctttccccctaaaatcaggcgctttatccaaaagccaatgagcttcttcagcagattcactcactaactgatgagcaacagtagaacctttatttataccccaatgaaaaccatcagaaattttctttttaccccaatgaaaaccatcagaaaatttatctccaaaacgctgactaaaatttttatgctcaggcactgtaccgtcggtatctttgtttatatctccatgctctttatagtcagacttttcgttttcattctctctgcccagtttttcagaaaaatcagctacctttctcttctttctcttaaccactggattggactcctgtggcgatttattggcttgtggagcctgccccacaataacgcccaccgtattccctgtgcctgttgggctatcacttcttgcgccttttgccatatttccacccttatgccccattcatccagaacttatctgcatggcgcaatgtcaatttaccgcccgcccgcaccgtttgagtatgttctttcgggtgacacttcccccccaccgtgccacttttaatccctgtagccgtacccgcttcatcccccaatgtctgtgggacgaaactttgcccaaataccaccactggctgcccgtttgcccgtaccgatgtgactggtgcagaggaatcttccagtttggcgataacaggataaggaactggaggagtggccggtcccatcggggttttacagacatcaggaaccagactgataatcagccattgggtatctttacgggcaatatagttatccgccatgattctgctccggttggggtgcaaatgtgattaagggggctttgggatttatttcaaaccgcgcttctgtgactctgatgagtaagtcaatgctgaaatgcagacgaaaagtcagttccagtgtcattgcatcggtatcaataatcagggtatcgaggttcatcagaaccggaagaagatcaccatcctccatacggaacaggataaaaggacgatgtcccggcagttcggtttgtaaggagccatccggtgtcagattagtcagttgcagtgtgatatcggtggacggccagtcaatctgttgatcttgtggtgcaccattccagtaaccgaagtcaaaatcctgtggcaggtacggatggcgctcgtccagccacgtctggtcataagtgccggccagcgttcgccgtggcagccacgcccgcccgataacgcccatcccttgtggctggcagacgggttcagtcgtcggtaaatgaccggacagcatcgcggcgaagtgctgcgccgtgatgggcgcatccggccgggtaatacgcggtgctgcatagcgcggtagatctttggcctgtgcataccagggcaagataaaacctgaaccgatagggttgtattccaaaaccgcatgagcaatcggtgcctgttcaccatcaggatgctggctgcgctgttcaggggagagtttatcgtcttccgtcaaagcattggcaacttcatcatcatccgcctcaatccggcattccccaccaaaagcgtaacgataatcaaggggcagacggtcaaaaggtttgggttcggagagttgccattgcccgttatccgtgcggaaaaattcccgctcaccggaaatctccagtgtcttatcaagcagagtgtcaccgttggcatcggtcagtagcagacgcacaggaaaagccggacacggcttaccttctggtgcataggcggtgccattgacaatcacgtcacatttcggcttaaacggtgccagatcactttcctgcaacacctgcgagatattcagcgccccccgatactgatcctgtacacacaaggacataaccggcagcagttcagccagatattcacccttccctgcgggcaatagctgataacccactttcatggcaatcacatcgtattcctgatcttctgtatccagcatccggtagttcatcaccgaaaaaggggtgagattcctgaattccatcgccctgtctccttagttcaaatcaatgtctttgccgtggatttgcacagggccgctggcatcaaacaggaacgctttccctttgatggtaattttgccgtctttgtccatacgcaatgtgctgttaccgcatttcagttcgatcaccttgccggccgagatagtcagtgtttgccccacggagacggttttttgcgtgccgaccgtttcggtctggctcatggaaactgaggtattcatattggcgccgacggaaatggtataagactgtcccaccgtcaatgtcttggcgagtccgacgacttcggtgctggtatgctgtaccacttcctgcttattttttttcactataacggcctgattcccatcaatcgtttccgtatgattcccctgcacttgtgtcgtccggttattcagcaccttggtgttcatgtctttttgggcatggataaacacttcttcgctgcctttcgcatcctcaaaccgcagttcattaaatccttcccctttatgggtacgcgtcttgaaggtggtacgggttttctgtgcgggtaaatcaagggggggacggttcaggccgttgtagttacaccccgtcacgatgggacggtcaatgtcgccattcaggtaagagacaatcacttcctgaccgatacgcggtatcgccataaaaccgaagccattgccgttccagccctgtgccacacgcacccagcaggaggagccgtcccccggcgtatcatggcggttccagtgaaaatgcaccttaatagcgccgtgctcgttgacaaaaatctcttcgcccggcggccctactactgttgccagttcatccccgtcggccagcggtttgtaacggtacggcgaccgccagtcgtctttccccggaataaaggtgacgttattggtcagtgtagtgccttcacccgcaagacctgccgcctgtggctgggaaccatagtgattcacggtcaccacctgccagcggtcattcatggtcgcaatgggatgggatttgaggataaagattttgccgggacgcaactgaatgcagttggtttgagccgaacccagcttactttcgctgttcagttggttaagtcgcacctcgcccagcggcttaccttctttgctccctgggaaacggccgtaactttcaaacaccgcatgacgcccgccctgcggtaacgtggcctgtgtctgcaacggttgggaaggccgcaggtagttgtagtctttgtgaatatactcatccggacagaggtattctgcgtactgccactgccaggcggtggtatctttatcatcggtactgggctggacgttgtaagtcagattaagatccgccgtcatccccaaatgggaatcactgaaaaacagttgttcctcctcaaaccagaaaacaaccccctcttccgctgccagccggcaccagaagtcataggcagattcgcgcttctgggtggtgtattcccgaacggggtggtgatcactatcgtcataaaacttgctgtccgatttgacacgatgttctttcagcagttttttaagtatgtccggtacggactcccgctgaaacaggcggctgtcctgatgaaggctcatccgccacatctccggccggacagtaaacgtgtagtaagtctgccgcccgtcagtattgccctgcgcggcacccgctacgatccctttgaccgtgcgatccaccttgccattgcgggtgacggtcagagaagcataagtgcccaactgatcattgagtaccacactgttaagcgggctgaccacggtcagatacaggtgataaagctgtgacagcccttcttgtaaactgaaactcactacctgaaaagtcgtggccggtagcgcacctatctggcaagtaaacactaatccatccattttgcagctcctcacataattgggcgatacccttgaagcggacaaggcgctaaaagccagcggatatcggaagtattcccgatgacggtcattcgcatacgcatatcttcggtaagacagaacggcaaaaactggtacaaggcattggcaaaccggaacagttcgccctgatgggtataagccgattcatccaatgtcagttcgacatggatacagcggtaaggcacgccacggatcagccagtcaccgggcgtggattgaatcgctaacatgcctgtggttagccgctggatatcgcgatgggcatgacggtcaagatccgcataaaaatcgtaatcccataacaattgtttgagagccgataccgagttcagccagaaaccgttggcggcatggtgtgacagcaacccccaatagcgtgaagagtcggtaaccggcggatagctaggcgcggtgggcgtgagattgctgacttgcaggccatcaggaatatcctcgcttgcgtggcagatatcacccacggccaatgtcggcagccctgtatcgaatgccacaaaatggcaggtaaattcctgctccggcggctgttccatcggccgggcatggctgtcgtaaaacatgagtgcatactccagatgccccaacgcatcacgggtaatatccagcgcatagaaccagacttcttcatcggcattacggaagaaatgcgtgaattggctcatcggataaaactgacatcgcttgccgcgctctttaccgggttcatcttttaaccggaggtcagtcatatgcaagagcccctgtccgggtggcaaaggcaggggataacgagcggtatcgggcgcaaagggctgtgtcacctgcaatcggcgttcaaggttcacgacggggacacaatggagctgaaaagcatcagccagttgcgcctcagacaaaggcagggcgtcatagagtttcagcgtcacgctgaactgccggctttccttcatggataaccgactgcgcatcaccgtaggcagggataatgtcaggaaatgatgaacatggggcagatagagcgattccatcagcatttgcggcgcccagttacccgcaacagcgatcggcggtgataagatcagccgggaagcccctgacaacggttcaaaccagaaaggctcgaccggataagtcaacccgccatggtgcagttctgcgcgctgcaagaggcggcatagggacagcatcaaggtatccgctactgcctcatcagggctgagaaacagactaagcgggcggataggccagtgatcatccttgccaatatattgaaacgtgagggtgatcagggtggtttctgcctgataagtgatatcccgcgccagcaatatcagcggttcaatagggcagtctcggcttgtgacaaatgttgcccccgtacctgatgaaacttcggagcccctcggcagggtgtaggaaaaatcaaacccttctcgcctgtcgaactgaacgacactggtagcggggatgcctttgatagattgcgcggttaatcgttgcagcagaggcagggtcatttccggaaatgcatcatctactttctgatgtaagcgagccattaaagcagcaaagccttgattcagtctttcaatatccggatcatttccattaaagtgatctgccagatggggcttttcctcaccgaccagtttttcgagttgccgcagataatccaattcccagtggtaataaaactgaaaagcctccatacctgcctccttcaaaaagctatgctgagtggaatattattttcattttgaaatatataattatttatgtatttttatattgcagattactaataaaacggtgttttaagcataatctaatttattttaagtaagaaaataatataaaaaagacaaacgtcaataaaataactaacactcactcctacaaaaaagaaaatagcattataattattttcaataacaaaattacacaataatatcactcgataaaacatcctttattaacatccagttaacaataattaatacaaaacaaataatattaaattcattatatttatgaggataattctaaaatactctcacactgattcgttatttagaacctatccattaggtgcaataattgccgtcagtttaaacacggcctacgcacatccaccgaagcgtacacgtcgcatgtgaggatcttgagtatagctcaggttaaaatgacaaataaaataaccttaataggataggatcttaaaataagatggcggagaggtctgcggccaatattgcgatgcatctttatcattccctgataaagatgcatcgcagcgcatttaggaggatgtttttcatgtcccagatgatttccggcgacttatttcttccaacagcggtagtaatcacgtagccgctttgttatctgctcatccttgcaagagaatgcaatcaaatccgggggaggcgtatagatatcatcaatagattcaacttgtgcaccataactattgagtaaagattcatagattaattcatcccaccctggtttaagattccagataaattcataacccatcgctaccgtttgctttgccgcttccgaaatagtcatatctcgactcagccccactaaaggccgacgaataggtgtaaaatccgccaaatcaatctccagattaggtagccccatgagtgcattcgcaacataatccgctaaaagcggggattgatgcaggccatcccggtatgtacccgtgacaagccacagcccgtctataccacacggcccaatcaatggaaaaccatccgcagagatgggtctgttacccacctgaatggcaaggatctctgattcaaacaaatcaacatttaactggttgtaggcgcactccagaaggaactgtatggtagcaactgtcgcatgtgtacgaggctggttggacaaaaggttagtcgcgccgacgtagagaacaccatcactacgcggaacacaatgtagcccacaagcaaatgcccgattaggcgtacgaataacggatgtcggtaactcatcgggatttttaactttgagtaaaacagacacgccataaccggcaaagagcggtggaattttctgcacgatagaagtctggtctgataatatatcgagggattgcacgcctgccgcaataatcactttatttgcagtaaaacgtactccatcgacagtctcaacgcccactatgattccattctctgtgagaacgcgtttaacgttgttatcgacgatttctccgccttcccggagcaatgcagcatccaacatttcaagcaatagatgggaattaagggcatgttcttctggaatataaagccctttaagcgaacgcgccaaatcgttaggtttcattcccttaatcgatcgcggctcaacaacttcataaggctcattatattcacgaagaacactctctatagcatcataattaacactatcaacaacctccattccagcggtattaagaatgacatgagtcccttttgcggtaaacagagggcgggtatctcccgaagatgcggccaaacgctgcgcccatgttgaccagcgatccttcgcgatacgatccattttgagtttcagttttccataatcgctcgcaataagcccactggtcacttcaccaaaacaaccattcattgcccctgcggctctcgatgccgcattgctacgatcaagacaccccaacctgcatactttcaattggcgaccagcaagttcataagcaattgaacctgcaatggtgccagatcctacaacaatcacatcatagttcatcggttctatcctcttcacattgcgcgttgatagacaaacacccctaaaaatctctagggacagattagagatgattttctgacagctaagttatggaaaatacttccgttatgtgcttattctggctttaacgagatcagattagatttgtttatgatggtgactatatcaggtgtatttaatctaacagagggttttaagattagtcaaccgcaatataacgcttaccgaatagacataaatatccatatatccataagtgtttatgtggtgtttagctttgatccgatattttgaaagcacaaaaaaagcgccttaaggcgctttttttactttgcagattttgataaaaatctatcatcctgaatttggagtggaaacaagattcaagctagcgacctcaacccagaaggcgcagacaaacctaacaaaaaattctacgatccacacgtttgactgcgtgctgatcaagtttccatgaccgttcgtctggaacagacttaaaattcagctatatctgtgtttaggttgatagctactccatttagtgtcagcgaatatttcgctatggggtacggctttcccatctcgccaaaattttaaattctctttcacttctttagtatctttatggcgatataaccagcgtaattcgctagatgttatacttgcaccatgaccttgttttgatatcaccgtattaatatcatcgccaatggtatcaaccaaaaaatgaacaggggctttattcacaaagagttgatagtctaatccagctttacttgttttttgccaaagcggtactgatgtagtcattgatggattattaattagcgcagttacaagctccgtatcatctttaacattgtatttaggatgttttgataaaaactccctaaagttaatgacacgctcgtagtcatgtacctcttttttgatacttttatcagtagcatattctctgggtttactggcatcccaagtcgcatttgtgatatcattttgtatcagtatatttcttttggtgttatttgtttttcggcgaaatggcacgcacccagaaaacactttacctgaattaactgtagatttactcgtgcgtttaaagccggcttttgctaaatctgctaaaacagtagctctgggattatctaaaccataaagaatatctccttctttaaacttatccatgagaaattgtatttctgtttcttgtagtgattcagatgctagaactttatccctacaaggggaagaaatagcgttatatggatactcaagggcttttggtttattttttgtatattctccacgattatctttattcttctcagataattcactcaattcattcgagtaagctcccaattccgaattatcatgataagacgatccgttttttgaattaatatctttatcattaaggtatgtaacatttggcatataagatcctactattttttcttctataataaagtccagattaatctgcaccgttttctaataaactcgcttaaaaaaccggtcatttaatgaaagtcatagggtaaaacaaataaattcagcaaactgaataatatcttattcatctgtatagataacgatgtgactggggtgagtaaacgcggctaacaaaaatgacggtttattcactcaatgactgggaacgatgacgttttgagcgctgcgcagaaaaattgctgcctgcactgcctaccattcccgtgatgacattagcgggcgactgaataatcccagaacagttatgacaagctgggaaatcgtttcctgcattagccgtggtaagtcgtttggtaaagattaatgactgaagcattgccctagcataacgagctggatttaagggggaagaagactgacaggatgtctcgtctgattcaataaataccttattcaacgcctgaacttcagcatgcaacccagcaatacctgccatcgtcggcaaaatatttccattatgtgcgatatgctcttcaaccagacgttgagtcatcgggtgcagcgtttgcccacttttttcatacatgctttttaaccccgagataaatttactggtgtcctgtacctgatattcatttgccatgttatttctaaattcatcttctatgtcatagctgcgtttgctttgccagcatcccgcaggcctgtttatctcaatggttttctgaggcagcagttccacaccgggaaacaattttccaggagccaggttttggtttttatccttaaagttaacaaactcatcttgataggagccgttatgcaagtagcctgcatgggcagcaaagtcttttaatgcatttttggtatattttttcatccccggtgattttgtcttaggcgttttttgggattcagtgagaattaagtccgttttattttggaatgtcgtcatttccttagaaaaaaacttacgttgataatcagcggctactttctctgtatctggtttatcaagatgcaaaacatccaataccgtattcaatccttgcttgttaacactatcgccaacattgatacgattttctccttgagcatgccaagaggaggaaatggcgttatatggatatgtcatcatccgctcaggagctcttggttcattgcttgtatattctgcgcgactctctttattattctcagataattcactcaattcattcgaataagctcccacttccgaattatcatgataagaaaatgcgttttttaaattaatatctttatcattaaagtatgtagcatatggcatataagatcctactattttcttttctataatggtcataactcagtccgttcagttatttttagtgattgatcagatcgcaaaaatcggactgaattaccttcaaatgaacgattatcttgagaatttatttatatataaacctcaaatagataaccttattatcatattagccagatgggtatcgtccggcgcaagactacgcccagcctaagattattaggccaagaagacgatgaaaaatggcaaaaattatcatgagataattactgatctccatttaagcgcgaaagattttttacttgtttatcaatgctattagttctaatatctattttattttttgctctggccattgtatctaacgttaatttacttccctttattttagcgacaaccccaggaagactcattccactatcaccatagtttttacgcataaacatgactgcatcagaatgactttcatttaaaacctcacgaatataattagtaacctctaatatatgttcgactttatcatctctcaacggttctgatgctctatcatgtgataccaagaggtcaataagttcataggcgggaatttttactggactggctttacccgtaattgttgagattaacatgccgccaccggtgacttttagattatctttgttaatattctttttaactactttagtaataaaatttttatcataattattgatcgctaatatcatgttccttgttttaggataaggatgtgctatctccaatttatactttaacttgtcaatagctataccactaagaatatttaatccaatccctactaataaaccaattcccgcgccagccacagttccagcacccggaaataccgcggttccaaccgctgctccaatcgctgcactggctgcgctcgatcctgtacttaacgcggtttttagggtggcaacccccatgtttttagctgtattagtcactgcggatttcggggactccatcgcttttaaagtcagatctaatttttttaattcttctttgacaacaaccatccatttgtaataatcggcaatattttctttccaaaatccaggatctttaatttgatctaatctaacagatccgttactgaacatagcattagtgtcccagcctatttctgatgtagcgctgtctatatcttcatcagtagaatgatttgacctaaacatatcaattttttcatctattgttttattggaagggataggcatattatatttcctttttaatccggtaattgctggcaatagaatatatagaatatcattccatatataatcagaataattatgttggtagaaattttataattcccgcattacatcaaatcattatctctatttttgataaactgcatgatagggtgatttatgatttttgtaatcattttcaatatgttcaagctgctcacaaattgatgaaactttattatataaacattctccttcttctgttaaaactaatccttggctttttctttcaaagagtttgacacctaatgaaaattccaatttttttaagctacgacaaatgggtgactgtgtgataaatcgctcctgtgttgctttgtttattgatttattcttagctacagcaataaagtttaataactcttttgaagtaaacattttaaccgaactccttttttaatatggtagagctattcaccagcactataagctgctaatgaatttattgaatttttaacttcaatacattatttaactcagcaaattagcataatacgatcattgctgaggcgacaatcatatatagacatcagtatttgtcaacgattgaatatataaattatttcccgtgaaaaaactattttcttaaataataaatactaattaaataacaattgaatgttaaaacacaataataaatcaaaatcattattcataaattttatttaaataacgggaaattaaatcccaaaaagattacctgtttctatcttttcaatatagatattgcaatcattgattgtagtaataaccacactattatttccccagacagataatattttattaatatctgtcaaatatttcttatgtgtaatacccgagatagacaaagatagcgtcatttgtgtcagattgttttgtgcaatattggttggaaccgtgaatatttccactttgctcagcgctaacctaatatcatctcccttccctaattctgtaataagtcgttcccgtaaagcatgacttattgtttcttggctaagtgccgtagtttgttccacgctggaagaaacatcaataatctgagttacattatcttgaccactgtttaggctaataggaactgtcactgaataattcagggaaagccgtgggcgattacccaatgcctgccaaaaattacccaagctgtttaaattttcttgttgtggaatgactttcgtatatgcaccgggaatatcggttaattggcgattattaatcaatgcctccaagacttgtgacatcacttgtatagcttgattgcaaggttggctttccgggctactggcgtccgattttgggcaggaagattcccaataagtaatcagatagttgcatttaacattgacccaaccaggcaataattttccggcagtggcattaaaccctcttgattctgctgaacgaagttgcaaatcttcatggatatcataaagaaaaacactgactgtcgcattaggcggcaccgtattaatttcaggcaggtcaaaacgaatttcaatatctttattcagatatttgcgcagcatagcatccattgccttattgacatcaataatggtttgcatttttaacataaagacctctctaatgttattattataataactatttgttaataattttatttaatattttagtgtttttattgctgttattttcagaaacttaatcgccccattttagctaattcccgtgccaatgctatttcaataatttcgttattaacttctccattactattctctgcggcaaaaaatgaagacaataaagcaatattacgaatatttgcacctgtcacgctggctcgttgagctaatttatcgaaatccacattctgtgatacttttatatttttaggccagattgcctgccacatttccttacggagtctttcatccgggtaagtaaagcgagtaataaaagtaaaacgacgattaaaagcactgtctaaatggctgcggttattggtggataaaatgactaaccccgggaagttttccaaccgttgcagtagataagagacttcgatattggcatgtcggtcttgtgcatctttggtttcactgcgtttaccaaacagggcatccgcctcatcgaagaataaaacccctgcatcctgttctgccaaatcgaaaatacgggataagtttttttccgtttcaccgatgtatttattcacgacggtagataaatcgacttttattaaatcaacaccaatataatcagcaatcacctctgccgccatcgtttttccggtaccggaatcaccataaaacagcgcgctgatacccgtaccatagccaattttatctttaaacccgcccgccaagatctgttcccgatatttaattgcggtgagtatttcttgtaactgttgagcaacctcatcagttaccagcaaatcctttagtgaacgtttgggggtaatgcgctgcgccaattggccgaaattttgctgggcacgtaaattgagcgccttacggatatcacattgctgcaaaaccccagaaggatctcgctgttgctgataaaactgagcctcttgcaaaatcaatggcagggtttcaggggtaaacgtgtaacgctgacttaaggttatcacatcaatatcctctgaacagttatccggtaaactggccgttagtagtctggttttttccactgatgtgaaaagtggcatctcaaccagtaatgtcgatatctttttcaaccataccagtggggaatacggttcgaccagacagacaacccttaattcaggttgattcaataacgctgatagggaatcgagtagctgtctatttttctcggctaataagcagaaattccgtaataataaacaagctccacgcatacgggtttcccgcaaaatatgctttatctggagcaatgttattttatcatctccgtcagccaatttagcgatatccaccaatagcgtttgccgcttttccgacgccatcatattggcaacggcatgggctctagcactaccggccatgccccgtaataaaacaataggtcgaatatcatcatggtcagataataataagttacccagtctttgttttaagcctgccggataaccgccgatttctatgggcgttatccactcagcataatgttctaaagccggcgtaatatagtgatgcccaagtaaaaaatgatacacgccgctgtcagttacaaaagaagtctggagccaggtcaaggttttttgacggctatcgacggataaaagttggcagccaatcaaaggcgcccggtgcaggaaactggcctgctgcgcttgtttctccagcagcgagtggcaaaacagctccaaagccagcgcaaaacaggggagtcgggattgttgctctccctgaatcagcacaaacaggcgatagtagcggctatcgaaatggggcaataaacctaacagcagcacatccctttcaaaatctgtcagctcaaaacgggcaatcaggtcagttaatcgggatgccacggggttgactatctggggtattgccaaataatcatcattgagccaatggggtttgcccagtggcttatccagtctggcgataacgtcttcttcgcttagcagaaactcatcaaggaggtcatctctctgacctgatatgcagtgaaaatggtattgaaggacaagatcgattcgctccagttggctaaataaaaacgcgagattagggtcattatcttgcttaaatgcatcagagaaaacaggtgcgatattcataaatttttactcaaactaaattattgaggtcaagggttataaccacgtcatcgttattggttgttttaaccaactaaaacttgccatattgattggccacggccattcacctagcagggcatcataaacttcgggtttaatatagatatttgctataccgtttaactcacttaattccccgggacgttgcagaaataagtgacgcacatcgtttatccccatttttttccaagccggaagttgtacgatggttttttccagccattgattgattgcaatttgttgttttggttctggtgtacgccagagcgttttgtcattgatgggaaggccacagatcactttattgagtgtcaaccgccatgccggtatttcctcttcgccccaaatcagccaatcaagtaaacagacggcctctctttgtgcttcaaggcgggtaaaccgattttgatccaataaatcaaaggagcggaaaaatgttggtaacagaggccataaaatcatgcaaccggcattgttgatgggtaaaaccgacggtgataattggggatgaatagtattatcagagccatgctgtatggataatacctgttcaggtggcgctgatttcagtgcaattttatgttgatcctcattttgtaagattgggtgtttttgttctccagaattcttaaccaagccataattcagttgtatgggatttatttgataattcgtttgcatggaatgctgtgaaaacgactgcgctacatccatcagggtattggtttcaaaaatatctggtgttaatgggctattaccatttcccgtgacacttttcactggtgtcagattatttatatcttgtaatgctgtttttacctgctgggtggaatttatatatctcatctgatgcagaagataatattcagccgctaaactcaatttttctggtgtcacttttgtgtttatgattgtctgcgaattaacacattcagatgttgttgtttcagtaaataactgacaaagcctactaagaacgtctggctggcagatctgaattaagcgacttagccctgtaggttgtaaacagtgtttagctagcataggcagccattgttgtggctggaggttaacatgttctattaaccaataactgaattcaacatcttttatctgctgccataaagcaggtgatttccaactaccatgctttaaataattatcaatattctctatcacagattgttctgaatataaggtattggttgtcataaaattatgttgagatattgatgaaatcttactcgtagatttaactacttttgaagaaaataaatcattgtcaatattctgttttatatttcgtgtgaattcatgagttttgttttttaattctctttccagtcgacagatgaattgttgttcaaaattttcaaaagttatctctccaagatctaaagttatttttttaaataaagaaccattattctgtattgaccatttctccacctcttcattaattaaatgacgtagttttaatttaaataagttagaacatttttcaattgttttatcactatgacgtttttccatttcaagtacgatagataatttatcaatcacacttttaaaatttattttgtgattttttttcacaataatagtcgctttacattctatgattgggtttaatgggcgaaaatataaacgcccattttcaaaaaattataactttataataaatgctaaaatatagtaaggtggcataatatctgttatatgattatgtgcgttagctgtggcatcagccccatgtgaatgtccttttccatctcccttagaggaagtgtaaggataatatgggtttttattatcataagaaatcaaagatctcggaatgaaagcattgtttgacatataaccattttctaaccgattatcaagctgatagctattctcacctgttttataataaccatttctgaaccctgtactattatgataaggcatccccccagtgtgttcatgtttaggcatctgggataaagttaattcagtgtcctttattttaacattgacagaaaccactttattatcactatttttattacactttttactattaccagaacctgataatgtagcattattcttagagtttatatcactgatcttgccacccagaataaatctatcaattaagtttggtgtaccattatttccatcacataatgcccagccttgtggtactgtcgagccggaaaacatcacaatcataccttttggcaataccttgttaggatcgatagccacacgatcaccatctatcttaataccattaccagttttaatacaaatacctgccgaattataaccaataccgccattctcatgaagatatacttgcaagccattatcaaccttaattcccttaccagtattaacttttacttttataccggagctatcaactgtgatggttgaatcagccgatttcgctgccaacgcaccatctgagctaaatttcaccccatcgcctggttttatggcgataccattagcatcaacaaccatacctttattagttaccaatttaactgccacatcatttttatttacaacaataccattaccttgaccaacagatattccattggcgttattaatcaggccgctgcccagatcgacagataaaatatctttctctagtattaatggggaaaagtcttggctggatattgtacccatttttaaactcagcgtaccactatcgtccagtttcaatcccttgcccggtccattttgttgtggtgactgaccacaggctttacgcccaatatcagcaatatcaattaattgattgaaatcggtttgtaagggaatgctgccatctttaaatttatcctttaatttatcagtctcagatccgacaccttttgtgtcagataatgcttgttgctcttgtacagttgcagaataacgaatctctttcatgattaactccataaaatatatttaatataaaattttggttgataaattattttttattcgttctctttcggaacatagaataattcgttctggattatcttatcggtattccactgatcattatttttaccgacaacttcctctctttggtgcagtgtagcaatacgcattgtccctattccttttaaagaggaaggtaatttacctagcgtcaagctttccaaaattgaataagctgcatcccctaatggcgcgccattattttgccaacgctgataagtattgcctaaatttaaaaacggttcccgatccatccagtgaataatcatagaaatatgagcaggaaattcagtaagaatcgtttccttaacccattcttctaatttatacggatcaacaccgggtattttaattaaatcactgtttaccaccacgctaatgacaaatgagaaacggtcagttctttcatattctttacctgaaaaatgccaactgtatcgccatgactcttccgatacaggaaaaggtaatgtcgaattatctttacgctcaataaccaaggtgcctttgatgcgatcaaagctgaccactttggcatacagtttctctgaatcctgagaatattcccgtgttaaattaatgactccaaagttctttgtcagggtaatttcattacctacagtaatcaaggcagggaaaggcgtttgtgttgttcgggtcaagcgccgttggttttcaggcaatgggcggccattcttggattggtcgctatcgtaggccagacggtagttcatatcttccatccagactacgctattttgccagaacaatttttttgctttggcggcggtcatcacccgttccagattgtatttcagttgagagctattacccacgtccagccaaaactgatccccctcggttttgactatcatttgaccacgtactgtaaatcggttttctccttgggcgccttcatagaggactaaattgatcacctgcccttgtgtcagtttgccattaataccggcctgcttaatcaccacataatgctgaccagtttggctctctttctcttctgttaccgaatctggcttctgctctttatcaaattggctattgggtttaattggcagcaatgcccgatgttccaccagataaaaaggcagtttgctcaggtcaggttccggtttaaacagttcaccgcctaaccccatgcgggcagcaatgcgtttttgtagtgacgagacttgatcaatacgaatattagcccggtgataagtcaatattggttgctgcgccagataaccctgttgcactgcgcggaaatcatcaatgggggtggtaaaagtacgtggcgcccgctgagtgccaaaatagccaagcagataattgacgatatccaattcatgatcactgttatgtgcgatctgttctaacaacttctttaacgcaggggcataatcctgatgagcttcatcattgacagaacccggcttaaatggccattgatcgccccagacttcatatccttcacgcttaaaagccaacaattttggcagcatggcagcttgctggcagccacaagccaacagttgttcaaatggcagcagaaactgatgaagtgacaacaggcgttgggcatgttcactttcagataagggctgttgtagctcatagcaagcgggcaacgtatcgctgacgggagaataacgatccacatcacgatgccggccgtaagccaataccaccggtttattctgaatcaggggagggttgggtaaactgtctcgaatttggttttcatcaaccgtgacgctgatcccgcctttggctaccactctcagcgggccatcatgttgtgccaattgatggagtggatctttaccccaaagacgagggtaatagccttctttaattgaccatgaccaagcatcttctttagctcgttcaatcagggttttatcaaagttatcgtccagttgaaggcgattaacgttctgaatgcccttaatctcaagcagcttgttaaccagtcggctcagattgaggatgatccgtttggtataatcacggactgccggcaattcagtgatccagccatgttccagttgtggcccgtcaaaaatttcatcattgcgcatgccggcatcttgcagcgttaccgtactgaaacgctgggcctcaggcatcagatattgttctgcggtagtatagacggcagcaaaaatacccggaacatcctgtacctttacatcgtcatccagttcaatatccagtaatagcggaaaatcaaccggttttgaccagataatctgactgacagattcaccaatattgcggttttgagtcaaaaagtccgttaattgctgggtggcggtggttagattttcctgagtacgacgggttggctccagatagagccagtaatttccccgcagggtaaactttttcgcctctttactctcaacaaagctatattcccttttggtggcatcataccaataggtatagcggtgctcttcctgctcgcgtacccattgcacgttacggaacaaaaaatcccctttatcctgttctgacgctgactttgttcctgcccagtcactgctatgcagatccagcaacgccttgcggtaatcatcagtggttatgggtccacacgtcagcgtattgtgggggccaaattcagcggggaaaattccgtcttgctgttcctgctcattgggcgcaggggtcagtaagtcttccaaaggaagggtatggcggtaagccagatctgacacaccgtaactgagcccttccagaaaggtgataccgggatcgtgctccgcggtgtcgctccacagttttccggcctgttgctcaaccacctgatgagcctgttccagcaaggtatcaaagtgaatatcgtctttcacactgtgaaacagtgcctcttgattactcatcgttatttcctcgacattgcagcttatcgtctgcttcccagaccaaaatcagcacctcattatctttggcttccactgatgcggtgatatcactgcctttggcggcatccgaccgacgcagtgtcagacaagtaactcgttcaaccagtggttgctgttggatggttgccagtaactggtaataactaatgctgttgttcagcgtgacggggcgctgctcatcaacgctccagggcatatacgcttcactgagttgctgccgtagctggcgatagccaaaatcttcgttaacatccggcttaaaaatcaccgtgtaattgattttcacatcaacatattggggattactgatctcaatctcagcccagggagaacttttttgctgtaaccacccggccatttcttgcaggcgtgccgggttgagtaccggacgaaatggatcatcgctgtcattgtatcggttagccgggatgatggtcagttgctgtacctcccgtgccggtactcgggtgagttcatcatcgcccggatacttaacatcaaagatactgacataacgctcttttaacagggtcgccatattgccccacgtcaaggcgcgatttcgatgagacagatgctgcgctgtacgttcaaaaaaggcgttataagattccggcacacgtccaccccatgacggccaaggctggttgattgatgccaccacaataatcggttcaaccggacgctgaatgctgccggccagcaaaggcgttaataaatggttgttgttgatgctatcggcattgaccaacgtggctgttatggcgttatagatcaggccgcataaccaagggttttttccccatgaacctttgtgtgtagggatgaccacaacggcttttagccaatagcgttctgttggcatctgtgttgcttgcttggcagcatccgcgggcaggacaacctgccaagtgccatcctgatacagatgttgggtttgatcattgacccacgcatccagtgcaatccactgattattttggttcaggtaataccagaaaactttttcaggttgctgtggtgattttaatttccaatatagcgataaggtttgttccggttcgacgtcagtgataccaaggtataaagcgggactttctgccaatggttcaatttcagagctataaccaaaaggagataggtgatacgtctcgaatgcggctttatcgaccgggtttttttgtaccttaagagctgtcaccgctggcagtggttggctgtctttgccttgtagcctgaggactggctggctgaaaaccagattatccaaatcctccggggccgtgattgcgggttctttatctgaaagcgttagtgtggctccttctttatccaccttcgctgtcaaagttagccattgattaccgctgctgatctgggcgaccagattttggctactaacgtctttatcaaaggtaacagtgatctttcttatcccttcttccattgccagttgcgcagaggtgattaacacgccacccagcacaggtttatcctgatccgtttcactgaataaccttatcccaccagatggcaatgataactgtgcctgagaatcccacggtgtcgcggtaacccattgctgtttttctttattccgtaaccagtacagatcactgatatagccacggttcgccaacaaactggcatcctgcgcatattgcaggacattgccttggtcatcttgtcccgcttcaaataaggtgcctttagtgagtagttgctctgtcacggtggcattcagctccaccgataaggcaacttgatcaggttgtgccggacggcgggataatcccaaaagcgcccgataataaagattgcgatgtgccgcaggcaaggtattaaataaggatattggcgtttccaataatcgcagtgccgctaatagaaaagcctgatgaggtaataactccccattggattcgatttccccctggtataattcggccagcttttccggcgtattattcgccataaagaaaaaatcattccaatatttatcacttttattaaagggaattaatttggtgtactcttcaatatattggagtaattgcaaactggttcgattatctaatttaaaatcgctcatcggcaccaaatttgacaatttattatttaactcagttaattccataatatcacctgtgtttatttgtcacagcgattcctctgtgaataaatcattattcacacctttaacattctgtttaattcagccagtagcttaatttacggtggcaaaattctgttgggtcataaaactgccttttcccgatgaaggtgtcgtcacatccggttggggtggagttaccgtattattcatggcgggtaattcaggcgtaaacagcgccgtgaatttctgccctttgataattaaggcggcgccactggtacattgaagagcctgctggctggcatccagcgcgctgatggtaatggtgccttttcccggtgtcgtatgcggtgctgtggtatagattgcagaaacactaacctgtttctcatcccccagaatgcagacttttttgccgttcacctgcgcatgcccggtgccgctgattttagcggggatggaaattatcacctgccgatctccaaagctgggatcaaactgtagcacatccccgtccaccacaatggcttcactcataccacctccatcacccgaccttcactcagcgccagcgtaccctgaatttgctgattgatatcacttccccgcaggcgatacataacctgcacttgcaaagtactcttattatttggcgactgacgaacttggatatctgtaatatctgcccgtgattcataacgtaatacgttgtcatggatatgggattcaatgtcagcaagcagttcattacggatattttcaaacataaaatcatttaacccgcagccataatgttcacgcatcaggcgttctccctgatcagtgctgaacagaatgtgcaaactctggcgcacatcgtcagcaccttcggccatctccacccctttctcaagggaaaaggccggaggaaaagcccaaccacgaccatagagttgtgtcagtatttggttttccatttttcacctttcactgggtaagattaatttttgcacccttgatttcaacactgtttttgcccgatatcgtcacggatttatccattgtggcattcatagtctgtgctttcagggttaattcttttttcgttgtcagagaaatatctttatcttgctggagcgtgatttgattctctcccgcattaatttggattattttctctttaccattaatgaataactgttgttggttttcaccttttttaaccaccaacactttttcctgattatcttggctcggttctaaaggggctttatttttcggattatgcatggctccgagaataaccggataacgcggatcattttcaaaaaaaccgacaatcacttcatcaccgggttccggataaaaacagaaaccgctttcatggctggcgtaaggtttccctagtctggcccacagaaattcattcggccgattcagtacgggcagactaaccggaatgcggttcagtgccgcatcgtcctgctgatatttcgcgaccgtcgcagtatgcagttcgggggcatcaggtaacatcggcaaatattcctgctgtaagccaatgtttacggtggtttcccaatcaattcgtcggttaaaacgatggcgaaccgcagtaatgcttgccgtaccgtccagttgtgaaccaaaccccgtcagctgaatgttgtcccctaactgataacgcccatcgcctttgagcagaaattcaccggttacaccggaaatacgctgattcagcaataatccctgcgccagatagccactctcttgagtggttaacgggctactgtaacgaatgtcccaactctctttattcaacgacgccagcctgtcaggagacagtgccgctttgcccatagcaacactgccgtagcgaccgcctgataacgcctgctgtttactgatatcccaaccgctgacttccagcgaagcggggttaagatggttgtcaaactgccagcaggcatctttgacgacgatatcttttttctcatctccccggcttttcagggtatgggaagcgttggatttcagggtttcaggctggacaagccgaacgccttctatcgttggtaacagccacacacccgttgccgatagccggcacaacagaaaacgccagtctgaacagcgaaattgcaccatctgctcatgtttttgatccaacgcggctatccgttcaaagtgagccttgatgcccgtctgattcaacaaggtatttaagatggttttttcgttgctggccttaaacagttgtgaatgctgggtatccaccagcagttgcaaccgatgtttgacgaccaaagtaagcagtaattgcttatttttgatcttcaaagtcttacgggtaatcaggccgttaaacagcactgattttctgccgccgttggtcaattccagccgcagggttttccctgcctgacagtgagccagttctgcctgaacatccttctggctgaaagacgagagtggcctgtccggtacacttagtttcagcgttgcggaagggatgctgttgacacggtaacaggtatccacatcgacggcggccaacagtgacagtaccttgccatctgcaataattttcagttggtggctcatgatgcgtcttctctggtggcctgcaatatttcacccggcacaaatccgttgaggttatccagaccgttttgccaagccagtgtcagataatccaccccacctgatagcgttgaagcggtactggctgccatcagcgccagagataccccatcctgtacccgtaaggcaattttcgccggcgatttcaggttttgttctgtctcctgcaacaccagacttttatccgccaccaatgtcagaatgactcgcgcccgcaagggcgtggcatcacgatcaaacagggtgtaactcacagacagacctttcgcccggccagcaaaatagccgcgattgtcccaacgcattttgccccatttaatttgcaggaatcgcgtttcatggctggtggcatcgacactgcaaagctgcttaagctgttcaagttgcgcttcaaccggcgttttgttacccggcatggtggcatcaaaaatcagctcaagggataacccggcgggtttggcctgtacataaaggctgctttgtttctcgctattaatggcttgggactgctggtaatccgtctggtaatccagttgcagggaatcagggttatacatggcctgcacagtgcctgcccgtatttttccttccctgtctttataaccattaatggttagtttcgctaaaccacgttcaatcagactcatggacgccacccttcttcatcgcgtaatgcggccaacacttcgcgtttaattttttcaacccaagttgcttcatccagactctcctgaaccaaagaatggccttgcctttcggattcagtcggttgcgctgatgaaaccacttttgcctgaatgattaattctctgatttcgactgtcatactttgactcccagccagcacatgtcctgataacgcagttcaagagtattcaccaagatggcgttgctgttcgcgtcaaagtcgctggtttgccaacgtaccggtaacgcattgctgagtgtccaactggacaagggcagtgaattttcgtttaacagcatcaccaccacatcggcataggcgattttttcaccgcgtaatacgcgatcaaacatccaggtcaaaggtgaaaccgtcatcacgccgcgttccagcgttaatgtaccgtgttggatcttatcggccagatagtcattgcgggcgttttcacccccttggctgtgttgggtcacgtgaagctcccgactgaggccggaaatacgctgaaagtggatatccagtggatcgggaatgccattaaaaataaaactcgccataaaacggtgggataccacgggcgtgtaaaaatcgttcattttgctctttccttcttaagacaaaagcgcccccgtttgggtatcaaacaccaaactgatctcgataaattcggcggggaacaacacggccaaggcgactttcataatcattttcccggcgcggacatcctcttcgctcatcgtttcattgacccctaactgcacggtaaatgcctcatcttcccgtgagccgtacaagccaccctgtaaccacaattgccgtaaccagttatagctttgtcccttgcatttcatccaggtcagttcgttattcggctcaaagacgtacatacgcgctaattgcgccaaatgaacggtgacataggataccagacgacgggtttgcaggtagcgccacggcgtgttatccgaattttccagtgtgcgacatccccatacgcgtatgcctttagcggggaaactgcggatcacattgagcgaggtgccattagtgttaaacagtacagctccctgaagataaggtttaaccggccgaataacctgagacagagcaatattagcaggcgccttccacaccccagcttcgctatccgtacgctggataactgccgcaatggcggcggtgggagaaagcacgatacctttttgactgaatttatcctgataagtggtttccagacgaggccaataggcggctccccattggcgatattctgacgataaactttccagacattgttgtgcctgtttaacctcatccggcgcatccagcagcacaaagagattggcgcggatctggctcagttgcagtagtgtcatccaaccttgagaccatagattcactaaggttgatccatcatcaatagcgctgtcattgagccgggcgatatccggtgccagaatcagagtaatctgcgtttccccgccaatcgcttctctcactgcgtcagagcctaatgcggccatcagtatttcggcttccatctgggtgatattggctgagggcatattgccttgcagcggcaaaataaaagcctgttgcccgccattatcgaaatagagcctgaccgtcagcgccatcagatgatcatcaccaaataactggatatattccgccagattgttgatacgaaccgcggtttttgctggtcgtagatcatggacggtatagccaataaataccggcactgcgctgggaatttcttgctgacccgtggtggtgatactttccgttaaggttacgcccggttgaattctttccatcatcatctcctctaaagtggtgagataggcactgtcaatacagtgcctggtgtttaatcacggagattactgggcgacatcctgcgtaaattgcagaacgataaattcagccggtcgtactgcggccagacctactttcatgatcattttgccttgtttgatatcagcatcagacatggtgatattctggccaatctgcacaaagtaagcctcttcagggctattgcccatcagggcatttttctgccacagggtataaagatattgatcaacggcggccttagcgcgcatccaggtcggttgattattggtttcaaacaaaacagcgcgcagcgcctgacggatatcgcgttcaacggaattgaataaacgacggacaggaatgtaacgccagtcggtattattggcctccacactcgtgcgggctccccaaaccatcaagccacggccagtaaatgaacggatgacattgatgcccttgtcattcatcgctccctgccgttcatcgtcgactttatcaagcagacttttgactccagtcagtgcaacatttgcaggggctttccagacacctcggctgctatctgtccggcagtaaattcccgcgatggccgcgctcggtgaaaggatgagagcactttgttgctccacttgcagtgtttcatcaatcctttttgcaatcgatgcattagtcttccgcaggtcggccaaattcttcggctcatccttacctgaatcatcctcataaccactgatacgaatatccttatcttcaggcaagagggaaaatttcaggtcagtttgtagctggggataataggcagcagctttagcattgttccccacccctgatacggattcgccatcattgctatctgcaatcaggaaataacccacttttttatcatccaatagcgggagcaaaacactgtaaactttggttttataatccagatcggtttctggacaaaccagcagcgtgatatcccctttttgttcaatcacatcaggtatagacgccagaattgactcgtctttaacatcatttaatgggtagatgtagcaagctccgcccccattttggaaataaagctgcaaggcttgcacggctggcgataaattgactttctcaatatcgtgaatccagttttttttattttcagcttcagagagagttctggctttaggagtctctttgttgtcagtctcttcttttgtttcaggattagctggaggttcaatgctcgatctgatcacaatctctgtcgtaggtgccagagagaaagcagaagtaaactcaagccagttgctgatacgggtacatacttgggctggattttcctttttcggggtaaattttccgataaaaacaggtacagccgttgcgctgttgctgaccgacaatgcaagggaagcatcttcttcaatataaacgccgggtgcttttagagtagcaggcatgataattcctcaatcgatatgattaacgctgttctacatcttgcgtaaactggagaatgataaattccgcaggtcgaacagccgccagaccgactttcacaatcatctgcccttgattaatctggtctggggtcatcgtgatgcctttgccaatttgcacgaagtaggcttcttcttctttactgcccgccaatcctccttgctgccacaggccatgaagataattgctgatcgccgccctgacacgttcccaagtcggctggttgtttggctcgaacatagcaaagctcatcgcgcgcttaacatcccgctcgacggtattaaacaggcggcgcacagggacatagcgccagttgtcactatcttccaacgttcttgcaccccaaactgtagtgccagtattgctgaaatttcggatcatattgatggcacgaccagagttatataccccctgcaattcgtccgtgaccaagaatgcaggttctaaaccccctttcaaggcaacattagcgggtgctttccacactccacgagataaatcaactgcggcataaacccctgccatcgccgcactcggtggaatggccgctttagcccaatccgctttcaaccacgggtaatagaccgcagcaaactgggtggcggtatactttcctttcgcctcttctgccccgttaatcgtcaactctgtttcagatccatcaaaaatggcaaataacccttttcctgcctgacataaaatatcaactgacgttttaatctcttcgcccgcagccaccagtaaggtcacatcatccaaagttgggataattttttctaagctcttagtttggatgagatagcaatagccgccgccattggcaaaatatgcccgcagagaaacagctaatttatctttattatcaaattcacccgtcaaattaagataatccatccaggaattaatacgggttgcagtatcttcgttgatatgtttgttttgttcattcaccgcaaaaacaggaactgcggtggcgctatttgatacggataaagctagactatttaattcttcaatataaacgccagggtaactggtaacagttgtcataaaaacttccttatacgagatgatgaaatatcaatgtttcaaacagcctgcatcgttacgcgatctgctgtcagggtaatttcctgtacggcaatatcattgctggtggcatcaaatgaaggtgaagtcagagaggttgggaaagcattggagacattccaggtcatcaataattcggtgcctgcgtcattggttaagctaatggtaatatcttttttctcgacttggttaagttggatagaattaatccaatcaaacagttcggttttgccgggaaagacgcctttacgcagggtgatattagtaggttgacgttgacccggcattttgaaccaatgacccgtaccatcgcggtattcaatcgtgtcataactaatatccaaccctgaaacactgctaaaggggacttgctcatcgccgacagaaacaatgaaacgataaacaggaatagggtattcaactgcaatttgagatgtacttgtagacataagagcctctttttgaataacaatggttatgattagttacaattaagatacgatggaagacaatatattaaagaaagctaccgccacaaaatgacaaaatatcattttgaattttctgtggtcacataattcttacatcggtaatatcgtgccgaaaaatccataataaatacattgccaataatgcaatttgctttttatgcattttgctttttatacaattccatttacaccagaatgaagatgaatatattatttgtttattaatcatattaatgatgattttaaatataattagacagcggaaaaatttaataataatcctatctgattaaatgcatctaatataattacagacgtggcaatataaaataaatacaaaatggcaattaattttaatcctattgcaattgcataaaaattaattattgaaaggtagataaatccattcattattttttgaaattaatagtgctaagtaagttattatgacaatttcaaaagacttgatgatttaaaaatatattttactggcaacatatctaataatactaatatttatggcaatagattaaatcaggtagagattattattggcattaaaataatctctacgaataaccaaccgcattgatcagtgcaacttatcacgccatatttgattatgtagcccaactgggctacgaataactattaaccaaacggaggtttcaacatggccgcaaatgctattgttcgtgctcgtatagatgagacactaaaaaatgaagctgctgatgtgctggctggcatgggattaaccgtgtctgatctaatacgtataactctgaccaaagttgcaagagaaaaggccttaccttcgatatgcgcattccaaacgaacttacagctgaaaccattgccaacagtgaaaaaggtgtggacgttcataaagcgaaaaacgctgatgatctctttgataaactgggtatcttatagaccatgaaacaaagggaaattgagtagagttatttattaaggcccggttcatcaataaaccgagcctgttctcatcatcattcggcgcaatcaatatacctgccataaaaatcgcgccgttttttcactgaaagtcagctcaatccacccgctccaacacaccttcaataatctgtgctttcagctcgataatattgtggtggtcacaaagcagtggtatgacagacagatgccggcaagcctgccctatctggttatcatcagcgtgcagtgctgccggtatttttccctgctcgtttaattgagcgtggaactccggcaactgagtcgctttgaatagagtgaccgggctatgttgtagaggttgcgaaagctcatgctggcaaatcgcatcgtccgcagggccggcctccagcgctcgtaccgcggcatccccttccagccccagctcctgtaatagcatctgccgccagcttggatgtaaagcccccagactgactcgatagaagctgtccagcaggtagatatgggtatcacgtatccctctggcttccagttgtgccgcaatctccagcgcaattaatccccccattgaccatcccaacatacgtaccgggccttgtgtcaatggctgataccgttccatctgctccagatagaaactggctatgtcacgcagtgacatgattaacggccggtggtacaggttataattatccacgcccaaacaggtcagtttgccatccagcgttctggcgatgtccagataaacttcgcatcccgccatagccggatggatcatccataacgtttctttagctgaaccgttattcaatggctggatcagttgatattcaaggcttgcaagaatgccacggatgctacgccgcttgaacagttccatcacagtgaccgcctgccccagcaaggccgacatctgctggcaaacaggaatagccagaatggaagtcccgccacattcaaaaaagtcatcgtttacaccaacgtgatccagctccagtttctgctgccataactgacagagttgctgctcttgttcggtctcgggcggttgatactgatgctgtcttggcgcgatgtaatttaacgccgacaattgtttacggtctatcttgccactggcattcaacggcagttttggcagatgcgtcaacacagccggcaccatatacggcggcaacacttgtgcgaggcgctgacgcacatcggcttcatccagcggttcgtcactgacataataggcagccaggctatcagataagccactgactttaaccaaagcacactggcgaatgcccggtattgccatcagcgtattttcaatttcccccagttctatccgataaccattaattttgatctgactgtctattcgtcccagaaattcaatgttgccatccggtaaccagcgccctaaatctcccgtccggtacaggcgttcaccactgatcggatgttgcagaaaacgttcttctgtacgtgccggatcccgatagtagccaatggccacaccgaccccaccgatatacatctcaccgatggcctgagcgggtacaggttccagatctttatccaagataaggaagtattgattaaccagtgccttgccataagggatgctctggctatagccggcgccttgtggtacttcgaagagaatcgaccataccgaagcttccgtgacgccaccaccgctaaagacgcggcaaccggggagccagtcacggcagcgcggtatatgattaaccggtatccagtcaccggataacagaacgcgatccatcgcaacagttggccgctctaccagattttctacttcctgcaatagcaattcgaacaacgccggtgccgcattccagatcgtgacgccgtgttcacggattaatctgagtaaggtctctggctggtatcgctgctcttcacttgggatcaccagccttccccccacgcccagaataccgaacatgtcataaaccgataaatcaaagcacagggcattaagagccagtaaggtatctccccgcacaacgttcaatttacggttgatgtctatcaaggtgttgcaggccgtgtcatgacgaacagccacgccttttggtgtccccgtggagccagaggtgaaaatcacataggccagactgtcacaggggatcggcacgggtaatgacatcggttgaggctcagtcaggtgaatggcacagccgtacggatcaagttggatgattccacaggtttcggttgtccacgctttgctactgattaccaactgcgtttcagtctgatcaatgatctgctgacagcgttgctgcggccaggaaatatcgacgggtacgtaggctcgtcccgccagtaagacagccagaacagcaataatctgcgccctgcctttgcttacctgaatgacgatcagttcagattgattacgcggatgttgatggatctgcgcggccaatatctgcgcagtctgaagcatttcggcatagctgcactggccgatagtatcaatcagggcgatgtcattcggctgctgccgagtccaatcgaggatcccctgatacaatggatggctgtagagagccgcattctgcgtttccatcggcggttgcaacagagccattctctcttccggtgaatacagactgatgtcttgcactaattgttccggatgagccaccatttgcatcaatatattctggaagtgcctgaccatttcactgatggtttccggcgcaaacagcgccttggtgtagttaatgttgccggacagcgcatcattcccctcttcaaacccgaagctgagatcaaacttggcaacgtcatataactccgccagattttgcatgctgaaaggggcatcaacatccgtcgctttctgctccagcgagaaagagatctgaaacagcggatggcgtgataaatcacgatttaacttcaggaattcgaccagtttttcgaaaggcatctcttgatgctgctggctggtaatcgtgctggcaaagacctgacgaatttgttcagccacgctccactctggcgatatctgattacgcagtaccaacatattgacgaacatgccaatcagtggctccaactgcgggtgtgagcggttggctatcgggctaccgatgacaatatcgtgcttgccgcaatacctgaccaacaaaaggttcatgcctgtcaataagaccgcatgcaaggtcacatccaattggcgcgccagttgccgcagttgctggcttaactgaggcgtaagggagaagaaagtcgtactgccacgatggtcaaaaatatcagggcgcggatagtcgcagggaagttccaactgaggacaatcctgcaactgtttcagccagaattgttttagctgttccagtttatcgctggacaacatttgttggtaccaggcgacgtaatccatatattggatggataacggcggtagtgcgggtggacgtttgtccaattcagcaccataaaactcggccaactcctttaaaaacacattcaacgaccagccgtcaaaactgatgtgatgaatgttgagcagacagaaatgagacacatgtccatctgattctacccgttgtaacagcgtcgcccggatgggatattcgtggcgtaaatcaaagatacggaaaatctcccgctgtaagaaatcatgccactcatccgcctgcacttccgcatgggcaacagccagcgcctcatcatgggcttgcaggaaagattctccgtgctcatcttgctcaaaagtacaacgtaatatctgatggcgatgcaccacggcttgcaaactatgaacaaaactgtccatctgaatatcggtctgcaagcggaataacaggggaatgtggtaaacattgttttcctgcatcagcgtttcgataaaccagagtcgcatttgtgaaaaagacagaacaccacgttgcaacccagcttgcgggatcacttcaaggtgtgtgcaattatcggacaggaaggcactcagggatctgacagtaggatgccgattcaacgccactaatgggatggtgcactgcaataactggctcaaacgattactcaactggatagctataatagagttgccgcccagccggaaaaagttatcgtctatgccgatacgttcacattgcagcaactccgcccaaatatcacaacactgctgttgcagcggcgtctcagcagcagtgtactcctgctgtacatccgtaaaaacaggcgcaggacacaggcggcgatccagcttgccattgatagtcatcggaatacggggcaatggaatcaacgcactgggttgcatatagttaggcaacacctgtgccaatgtctgccggatctcggacgaaagctcattatcggtcgatgtactaccgttcaatgtgttgtcgctcaatgtatagtagcagacgatttttggggattccttgccatgaatgatcgccacagcctgatcaacaccatcgatattggcgagcacacactcgatttccccaagctcgatccgatgtccccgaatcttcacctgactatcattacgaccgagatattccaacgagcccccatccagccagtgcacaatgtcgcccgtgcgatataagcgggcatgatccgggtgctgctggaatggattaggaatgaatttttcacggcttaattctgattgattcaaatagccacgcgccaaccccacgccggataggaacaattcaccgggtgcacccactggcaacggctgcaaatcactatccagcacataagccgcacactgcgccaatggtctgccgatgttacacgcgccattatagcgataagggttaacagtgcagcagacactcgtttcagttggaccatagcagttgaatacattacgcccctgtgcagcataatgatccaatacatcctgagaggaggcttcaccgcctaccgccagccattgcaggctatccggcagcgtcggtttgagtttgagcagcacaggcggcaacatcgcataaccaatctgccacttctgcaacaacgtttgcaattcctgcaagtcataacgctgcgcgtcagatgccaccaccagcgaatgtccacccacaaatgccgggaaaatttccatcagatgggcatcaaacacaatggaagcaaattgcaggaagcgcatgcctgactgcgtcatttccattcgggtaaacaaactacgcgccatggcagcagaaccccggtgttccaccagcgtacctttcggcttgcctgtcgtgcctgatgtgtaaatcacataagccaattgccttggttccacctgcggcaaccgcgattgtatttcgtctgtggcctctggatcggccaattcgctcaggtatagctgttgtagatcggggcgctcaaacagcggtgccaaagcgggttccgtcagcaccaaccttatttggctgtcctgtaggatgtaattcagtctctctgccggaacatttgtgtccatcggcacataagcagccccggctttgaggatcgccagcaatgtcacaatcatgtcgatactgcgctcgcaacacagacctatcagctcacctgacgctaattcacgctggaaaagacgacgatatgccgcccgcagccgaacagcctgatgtgatgtaatctcatccaactcttgatagcttaatgtccggtaatcatccattaacgccggattctgcggtgttaatcgcgcctgcctttccagcaaaccatgcagagtcatcagttccaagtcttgatcaactgcaaaagcccattcttctaacagttgttggcgtttgtcatcactcagcgccaataaccgctgatgtggatagtgaagatgggaaggaagacgcgccagcaatgttcccagcatctgcaaaatggcgttgccacgttcagcatcaaggcaattctggttataggacagagatagcgtcaaaccttgttctacatcgccctcagcaatcaggttcaaggggtagtcggtcgtattgtcactggtagcccgcagattggctcgcagggtatctaattctgtcgttggataattttcatagacaaaaatagtttggaacaacttttcacccgcggattgtaattcggccagtggctgatagctgtaagtatccaaatcaatcatgcgttgatgaagcgtgcgaagctgttgcagacaagtcgattgcggttcccagtccatcaccagtggcaaggtattgatgaataacccgacactgctctctatgcctgatacggggtggttgcggccagacaaggtgatacccacgatagtctgtgattgttggctaaacagatgtaataatttgtgccagacgaactgaagcatgacattgagtgtcaagccatgattgcgggcggtttcctgtaatgacaaagcgactgcatgaggcaatacctgacgcactaccgcctgagtatcaggcgtttcattgccggaggtattccgtgcaccacgagccagcaacagggaaatatccgtactctcccaatgctgagtccccaattcctgccagtgatgacggcactctgcaacctgactggcgtaataacgctgggtcgccagataggctgtatcaatgcaggtatcgagcatttgtcccgcctgtagctgctgataagtgcgatggacgtattccagcaatatctggctgctccagccatcaataataatgtgatgactggtgtggatcaggctgtatcggtcggcagccagtttaacgaggcaaacccgcatcagctctggtttattcagttcgaaagattcgtggtattgttgctgacaaagcgcagtcagtgtctgctcctgtgtcggactggtactgaaatcatggtattgccataataattcagcctgcctgaacacaatttgctgtggctgttcctgccagtcaaagcctgtacgcaacaccggatatcgctgctgggcgtattcccaagcgcggtagtaatcattcagatcgatcggttgttcgtaatccaggacaaactgaaagtggtaggttgagttatcgggataactcagataatgatggataaatccttgttgcagactgttggcgggataagcaaccacgggcgccaatcctgccggtaatcgagccagtaatgcggcatcaatcccatcgtccactgcctgctgaatcttactggctgatggtgccatcgtgtcgataagcgatatcaaggctgtttggaaaccgtgatccaactgagcaagctgcgactggctgagtaagccatcccaacgataatgcagctcttggccgataagccagatattgagggtaagcaaaccggaatcaacattgtgtgggctgatggtttgtccggccgattctgcactgatctgccaatcattttcaggcgcctgtaactgccccagataattgaatatcaccccgggatagggcaaagacaatgccgacgcctcagcccccaaatgacgcaatgccccgtatgaaatgcctgaatcgggtacgccgccaagagtggtatgaacttgctgcaatgaaatcgtctcttcaccctcaacagaaaaatgcagaggatagagagccgtaaaccaacccacagtacgacccacatccaactgtaccgatggcagatggcgaccatgaccttccagaagcaacgtgtggttcgttattccactgagatgacccaatgcgtgcaggagcgcagtcagtaaaacttcattaggcgcaaaacttgccgcacctgtggtcacatccagcaatcgaatactggtggcagggtctaaagattgttgcaggaattgacgagtatggctggcctccaataatggccggtaatcagattgtgaaacacattgctgctgccagaattcacgctgagattcaaagccggaaagctgttcagtcaaggcagcctgccattgccgatagctggctgttttggcgccgaggtttttaccatgataaagctgttttaaatcatcaagcaggatgcgccatgacacggcatccacaatcagatgatgcaaggcacagtaaatgcgggctgaaccatctggatagccatcaatataggcaaaacgccacagtgggccagccgtaatatcgaaatcactttgccagctatccagacagtcatggaatgcgtcatcggtcaacgggtcataatgccaaatttccagcgccgttggtgcgacctgattgatatccagataaagctggcgttcagcaggaataaatctggctcgcagcatatcgtgccgttccaccagtgcctgaatcgctgtttccaatttctgcggttgtaaaggcggcacccgaatcaaaaaagcctgattccagtgatgaggttcagaaaacacctgctcgaaaaaccaatgctgaataggatgaagaggaaaatcaccctgtagtattccctgttcggaatgcatcatctgggaatcaggagtggtagccagttgtaccgccagttcagcaatcgtacggcattgatataatagtttagtgctgcatggcaactgctggcgacgcatttccgaaaccaaccggatagcggaaatagaatcgccccccagatggaaaaagtcgtcatcaatccctatttcgtccaaacccagaatcccgtgccagatattttgcagccggtgttctaactccgtttctgcggcacgataaacatagcggctctgtttaaaatctggctctggtaacgccgctgcatccaatttgccactaatcgtcatcggcagcgatgccagttgcacgaatgcagatggcatcatgtaatccggcagcgaaagctgcaaagtacggcgtaggttatcttcgtttaaggtcatctctgacacatagtagagcacaatgtgcgagcgatcctgaccgcgtacctgcgctgtgcattgactcagcccggatgccgcaataaacacctgctcaatttcagccagctcaatgcgatagccatgaatttttacctgaaaatccttgcgtcccagatattccagttccccattcggcaaccaacgcgcctgatctcccgtgcgatagagccgctgatcatcggtatgttgagcaaatgggttggcaatgaacgtcttggctgttaattccggctgccccaaatatcctctggccagcacggcgccagagaggtaaagctcaccgctcatgcccatcgggactaactgcaactgctcatccaagacataagcctgaatgccgggaaacggacggccaatattttgggcgccatcccactgataatggtgcatagtgacacatacgctggcttccgtggggccataggcgttaaatatccgccgtccctgcatggcgtagtgatccagaatggcttgaggtgttgcttcgcctcccaccagaatattttgtaaccgggcaggcaacgcgggttttgttttcaacaaagtgggtggaaaagtggcgacttcaacctgataattttcgattaattttatcagcaggtcaggatcatgacgctcttcttctgaagcaatcactaatgtatggccgaaacacagtgccataaaggtttcgaacacatgagcatcaaatgccagcgaagcaaactgcaaccaacgttgtggccgttcaataccctcaatcactctggcatatagaccatccagcatgagtaataccccacgatgttccagcagagttcctttcggacggcctgtcgtgccagatgtatagatggagtaggctaatgaattcggctctgaggctgtttgcggagcactgtctggctgatcacggtaatcatccctgtcgtttccgaatgtcaacaaagccagattttgcccgtaatcgcgcaatatgggctggtgcgtcatatctgtaattgccagccgggattggctatcggtcaggatataggccagccgttgcgttgggacttgcggatcaagaggcagataagccgctcccgctttcattaccgccagcatggcaatcaccatatccaccccacgattcataaaaatcggcaatagggtgtccgggggcagtgattgtcctgttgcttgcagatagcgttcccgtatcaaatgagccagttggttactacgttgttccaattccgcataactgagttgctgctgattatcaatcaacgcgatttgttgtggatgcaggcaagcctgctgttggaatttttcatgaatcgttgtttcgggaacatcaccctgttctccctgatgaccgcatttcagtaaggccatacgctgatcctgtgtcaggaacggaaattgtcggatcggtttttctggatttgtcagggcattaaccaggagttgctggaactgttcggccaaggcagtaatttgttcagggtggaaacggcggcgtggatagcggatacggaaagaccattgatcaccttgctgctgatattccagcgcccattctgaatccgctaaatcgttgtcgaaacggtgattgtaatggacttcacaactctccagttccagacaaaaatccttgaaatgagcttggttcacgacgacatttaacttacggataggtgttaaaggcaacaccttaaaaagcggccaatatgagaaacgcaggccggagggtgtcttcaatgatgaggtgtaatgtaacgtttgctggtaaagcgaagcaaagctgactgtatcatccagctgcaagggaaaaacagcggtgttgatttgggcacccaatgaaagcgattctcctcctgtcacggcaaccggataactgacgtgaacctttccatcaggcatatattgagcaatcagtgccgcccacagcgttttaaacaccagaaatggcgtacagtgccgcagagaacgcttaagctgctgccaatcacttaatgacagattgaaacgaacctctcccactaattcttgttcatctttcgccggttctgataaataaggcaacggattcgttgctgccacttccgtcaaacatgttttccagaactgtgcaggctgatgttcttccaatgtttttatctgctgacgatattgtgcaaatttttcggcaatttgatccagtgtcagaggagtgtggcgcagggggcgctgattatagagatccgatatggcgtgataaaattcttcggtactcccgccatctaccacaatatggtgcagtacaatgactaattgaaattgtcgctctgcctgttgaaataatccaaatcgaatcagtgtcccttgccttaaatcaaagggctgtaaggcaaactgacgcagtttttcttcactgtcaaaaatttgtagggtattaagactattcggacccggtttccaatataattcaccattttcttcatcaagctgatattgaaataatggatattgattcatcaatccctgtatagccgatctcaatttacgttcatccaaatcgccttggatagtttgatccataaccatattgtatttaactgaatcaggttcaagaatccattcattccaaaataggcgtgtaaatggcgaggccagaatgttatccatatcgatactcccttcggattttttattaaataaaaatttgcttacctgaccggatatcaggtaatgactttttgaatcagtcctggcgataaatgggaaaagaaatgcctcaactaccctcatacctaaattggctgacagatagatatcgtgaattatcgtcgttatcggaatttttaattaggcaggcatcctgctttcgagacatattcagccgattatttgattaaatatggcctcttactgcctctttttttattagtcttcgtccttgatatagccgtgcatagaattgaaggttgccctagttactcaattatttttttgaaaataatcaattatataaatagtaacaaatggaaaattaacttaatgttattaattaataaaatggcgtttcatacggtaatagctttattattctgcatagcggagttaattcagaagtaaataaataaaattaaaatattaatagatgttttaattaaattgggaattttactagcaagcaatttatttcgtaaaaatatactttcatattaaaattaaataaatatcattttaaatgatacaacaatcataaaatattcaataatatgaacaaaataatcatttttgagtactaagcatatcaggataatattaacaaagaatataaataactattagttactatattgagaagtgatttttaggatgataattacaatatgaggaaaataaatgatagaattattgatgcagaatcaccaaattcatattcgctaaaatgaatttgatgaacaattatatcaacaaggtggagaggggagggtaatataaatcaaggaattacaatccataaagattatattattttcgatctgttactagactgagatatacgaaagaaaggaggttttttataatattagtcttattcaaacccaaaaaaccaagccagatatttattagaggatgaatggagaggagaggaaaggagaggaaaataagatatttgtggagggaataaaataataacgcccgaaatgggcgtcagctatcttttcttctgctaaaaccataccaatataatggccaacagttttcttttcctatgttattaataaaagatgcaatgatgaccagcgccagactacccgttaagacaggcgttaaaagaaaatcaaaacctacggcctcttgccctgcgagaagtaccactaacggattagcccctgcaggcggatgaactacccgaaataactgcatcagcataatcgcaatgccgactgccagagacatcacaatcatggaattacccaatgtatatagtgcgacaagccccacagccgtagtgagtaaatgtccaccaataacattccggggttgagcaagcggagaagtgggtgcagcaaacaaaatggcacatgtcgctccaaaaggcgccattaaccaaggatattccgtcgtttggcttaaataactgagcaacaagatccccaaaaaaccgcctgataatcctttcattaattgaacaagatccggctttggcggtaatccaccacctcccctcaatttactcatgttttagtctccctatgattcgtttgcgatatgactcagtcaatgtgatactctaagtgtacagttctgtacacacgcaacaaatggtacagatctgtacactaaaaggcaacgttcgatttgtcaggaatatggacgatcattagaactaattagaataaacaagaaaaaatattatgagcaaagaagaacatatcttagatatcgctgaatccctgtttaatgaattcggctataacgcggtgggagtcgatttgatccgagataaggcgaatgtgtcaaaaacatccatgtaccgctatttcggttccaaaaataaactgatagagagtatgttaatcagacgacataagaggtttgaagaggaacttaatacggtggtgttcgccaccaagggaatggaaaataagctgaatgctatccttgactggcacttctcatggttcagatcagccgattttcaagggtgcttatttatgcacgccttagccgagtttaaaggccacgatgagcttattgtcaaacaggctcaatgccataagacgtggttaaaatcactcttattttccattttctctgccaatcagacggatgcagaaatcaaaacagaagcccttatgacatttatagaagggatgatagtgagagcagagtttggcgaaatgacaggccacgaggagatctatcgactatctgccaagatgatagcctcaatgtgttttctgagctgatacccttatctttcaagtcactgcgttgttagctacgttaacttgccgctgaacggcagattgaaatccattgggtatagtagattgttcagtcccttaaccaaaagatctggttaagggactgactattataagaataaaaaatgtactaatattctggtgttgggcgaatagaaatcatctattcaaaataatgaaaataatttgtctgtttaaagggaggtcagacttcccttatcaggacccagacaaaaaacttaattataacttatattttaacgattaaattaatacaccagacacacgctaaaatcaacatataaaaacataaatgttgattttagtgatgaatattcgtgtcattatttgatgcctcatgaacaaaacaacaaataaaacaccatatctaattgatatttaattaaattttttatatgggcacagaaaccattctgtgcagcaaaaaacaaggtaaatcacccgtcataatagatagataacatgaatatgagtagggttattgtataaaaaatcgaaatggcagcagaatcacaataacggagtgaatgatagatagtgacacatagcaaaagtgtcaacccatcacatgacgacgatgcaaaacaaaataagacagggttttatcaaaaaatggcatggagaagttccccatgccattcattagtttgctgttttaccaacccaccgattaaataaataacgtgagccgtaagcagggaaaatattaaataatgcaaagaaaattttaattaaaatctgaacaagcatcatgacaacaatttgatttacaggcagtttcccatagaatgcgatgaaacagaaaacaaaactgtcaagaattgatgcgataaaggtactaaaaaatactcttaacgctaaaaatcgggagtttgtcatatccttcagcttgcataagatataggagttgacaagctctgaaactagaaatgacagtgaagaagcaaagatcgccgataaaatatgattcatcagggcattgtactgatcatttaaatcccagtttgcgatggcaggtagacttgtcgagatactcagcaaggatacaatgatcagattagaagccaatgacatatatatcgcttttcttgctagcctgaatccataaaattcactcagtaaatcaatgactaaaaatgaaaaaggataaatgaaagtacctggggtaacaatgatatcaagataatcaatgtaaacgggtttagctgccgctatattactgaaagtgtagaaaattgtcagtagtaacgcgagaaatgaataaacaacccaagatttttcattacgttcttcaatttcatagactgaggggacatttggaaagctagaatatatctttctataaagtgattttatttcgtgattgtctagatcgtctgctatttcacttttctcaagctcctttacgtttatttttaaaacttttcctgttgataaaattaatacattcgctgtactatcttgactgttaaatcccagtaatttatatttttttcccatatccgaaccgctcttccattatatctccaatcaccatcaaatttgtcgtaacttcactattaaactctttaatatgaaacagttgctgcctttgatcgaaacataactttggattattgttctggtaattacctcttttgattattaataaatcacccgcattatatttacctgggaaatcattctcaagtagaatagcaacaatattcgggccagaaccaaaataataagtgagttttctttcaacaataagcgagccgattttactgtcaaaaaacccagagataatacattcagattgcataaatagcggaacggcacaggggttcatgtttccttcataagaaacaatggcatcaatgcgttctttttctgcaatatcgatcgtttctatctctctatacgacaccccaaaaaagttggatactttctgtatcgttgaagaatgaacgttttgaactctcccatccagaatattataaatagtcgtgcggttaagcccggttcgatcacagatcgataccctactctctcctctggaatcaagtaagtattgcaaattttttctcaggtgttccattttttgttttttatacatatcaacgcccagaaaaatatataaccaattaatttacatgactttttaggataaacactttttgttgggtctggaaagagtgaaaaatacccttgtcgtaaaacataaaaagtgatagcaatttatttttgaacagaattatataataatataataaaactatcatatatagaaaatattacatcaataggttatattttaatagacacactaagaaacggataataaaaaaccgtaaaatagtcaaaaaatagaggagatatcgattatgttgatattttttagtttaaatacaccatttttcaaaaaaaattagtattcatacatcagaagttaataagcacatagatacaattgttattatttttaatataaaatttaacatatataaattatatgagataaaaatgagtttttcctataaaaataatgaaccctatctcaagggattgatcgccatgatggaacatctaagcgatccttggggcattaaggatttagcgtcccgacatatctatatgaataaagccgcttatctttacaccaacacaccagaagattttgacatagagggtaagcttgactgtgaatttccaacacattggtctgaggatcaattttcacaagacctaaaagaacatgacaggagaactgaagaatctaaagacaaagtttctatcattgagacacattattggtatggaaaaaacagcttagctcctttcatcagtgagaaattccctgtgtataacgataaaaaagagtgcatcgggatagtttggaatgccaaaccaatgagtactctctcccctctaaaatatattaatcgccaaaaaccaagcgttctcactacagaagctacaacagatctatttaccaaaagtgaactggataccatcttctttatgttgcaaagacgttcaaataaggaaatagcccagatatacaatgtcagccataagacgatagaaaacagaatatacaccatctatcagaaggctaatgtccactccatccagcaatttgaagaattttgcaggcactttcaattagatagctatattcctgaacgcctcattgaaaaaggcgtcctctttatctaaaacaaatcgaggaacgatgatagtgctcaaaattgaacactgtccattaagccgagtgccacaagatcagcgcttatccctgctgtgtgtggccgtcgttcatatgggcatgttaacggcattggatcagtttatgcttggtgctgtactcggcaactcgatgactctgatcgatgcatttctcgccgtttttatcggcagtctgatctttggcgttgtcactttcgggctaggatttgcgggtatgcgcgaagggctgtctggcagtttgctggctcgctggtgtggctttggccgaatgggttcggtgttaatcggccttatcgttgctgtcagtttactgggctggtttggtattcaaaatgccatttttgccaagtctcttaattttgcctctggtaataaattgggatttggctgggcggcagcaatatccggtacgttattaacaacgctggtcgcttttggctttaaggcactgcgctttaccgccagcattgccgttcccttgtttattctactggtcgcttatatctcaactatcgtgctatcaggcaaagcaggtcagcctctgcatgaggtcataaacctgccccattctggagaaactttatccattagtgccggtatcacaattgttgtaggtggtgcgattgttgccagttttatgacccccgatctgactcgctataccaaatcaggcaagcatgtttttgccattacactactgaccatcatcgcaggagagtttgtgattaatggtctggcgattctaattgcaaaagcactgaatacggcggatgtcgtcactattatgtcgcaagccgcgggtggagcaggtttattagttgtcgttttttcaacactaagggtcaatgacttaaatctgtattcttcttcattgggaattatcaacgccgtagagggcatcgcaggcaaaaaactgcgttacccgccaacaactgtcgtgatcggcgtgttgggcactgtgctttccattttaggtattctagaccgatttgtagattttctgactatacttggcgtcgtattcccgcctattcttgggattatgctagttgattactatatcctgcgtacccatcgcaaagtgctggacgaaagtcggcagaaaggaaaccttcccaatgaaacacccaccatcggctgggcagctattatcgccagtattatcggctgcattgttgggttagcgacggaatggggtgtaccaacaataaactcattactgatggcgagtgtggcttattggctatttaagatcgcctttagccgccgctctctgccataaccacttatgctattgctccccatcaggggagcaatttgccagcttaacggcgggtatgtttttccgcatactctgcaccattaacccactgatggtctttttcccatgtaaataaccacttacggctagggccagccatcacattcaggtaataactgtcatatccggcaatagtcgccacggggtgataccctttcggcaccatgacaacatctttgttataaaccgccatcgtttcatccaacgaacggtcatccgtataaacacgctgtaaacaaaaaccttgcgatggatttaaccgatggtaataagtctcttccaaataggtttcctgtggttcgttatcagtgtcatgcttgtggctgggataagaactggtacagccttcgtctgtatacacctcaaccaccagcaggctatccgctgatttgtcatctgggaggatgttatggacatagcggcggttattttcgttgccccgctgctcagcattaatatccttcggcgcaatcaagcgagtgggatagtttcccctgcctttcgcctgacagacagccagttcaaggttagtctgcgcaataatttctatggattcattcggcgtaacgtaaactgcataaggtcttttacgttcaaatggattcatgcgctcgccaatctggtcaaatcgctgcaagggagtgattacggtggcttttcccgctaccaacactaaacaggtttctttttccgaggcgggcaatgtaatagattctcccgcattcagttcataaacagcaaagtggacatatccccagtttgctgtttctggcgtgatatgctgtgtacgtttgtcctgatcaggcgcatggtattttgacagtagcttagacatgtgacctacctctatgtctatgtttatacttaaaattaatgcgattaaaatgtcagcgtttaaatcaatccggcgtctttcgcgaacctgtgcaggttattatacccgagcgtagcgtaagtcagtggatgggcaatcgtggggtcctgctctgcttccaccactaaccaaccgtcatagtggctagtcttcaatacattgaaaatagcaggataatcaacacaaccatcacctggcacagtaaagacgccactcaacaccgcgtcaagaaagctggttttacggtttttgacatctttcaacacctctgggcgtatgtctttacaatgaacgtgattgatacgtgtgcaccaacgttttgccacagccagcggatcatctcccgcaaaggtcaaatgcccggtatccagcaacaagccgacttcttcacctgtatgctccatcaagtgatcaacatcttccgcactttcaatcacggttcccatatggtgatgataagcaatctgaactccttgagactgggtataacgagcgaattccgtcagtttttcgccatattcctgccagcgttcgactggaaataatggcctcaggtgtaccggttttccctgatcaccatgtatacagtcagtcacttcggcaaacaccatcacactggcacccaattcgcgtagcagggtcaaatgcggctgaacggcagcaatttcttcttctacactacgtgtcagcaagttaccggagtaccagccagacaccagtttcaagttatgggaagccagtattggccccaagatctgagactgacgaggaaatttattgcccagttcaaaaccagcaaatcccgcctgacggccttcggtcagacaagtttccagtggggtttctgcgcccagagaaggcaagtcatcattagtccaggtcagaggattgatgccaagttgaacagccatgatggatctcctgtaagatgaaaaatcggtaaggttttattttttatctacttgtttttacttaatgcgcttttatccacgctgacgccagtagctaatcagattgtggtaattcgtttttatctgaagaatgagtgtttgatcatcgatttcgccagccagccatttcagtgagggttgaccgaatagtgtacgcccgacagcaaaacctttgacgatggatttacctgccgcagcattgaaactcgccttcaagattgcctctgatgcatcaagaccaaggatcacaacaccacgacaatagcaatctcgttgtacaaccaaggcttcaatctgatcccacgttgctgattgcattggcggtaatttccaccagtccggcttgatgccaagattgtagaaacgctggagggcgcgcaggtaaaattcatcagaatgtgtcatatcggatggcaaaatcacttccagcaacaattcatgacccgattggcagcaggcggcgtacacttcctgcacggttttttcctgctccagacgtaaaggatgattgtcttcaggatggaagaacaccagacatttcacgatatgctccagtggccaactgacaagctgagagccaatgtcaccgtgttctaaacacagtggacgagagccgggtaattcaatcggacgcccaatccataacccttttcctgtcgcggaattgagcacatcctgcccgaaggtgctgtcacataatattcctgcctgcccttcaagatgggcttccgcgatcacttcctgacttgcacggaataacagttttttcagttgcgggatgcgttcgagactggcgttaaccttacgcgccatttcaacaaactggatacggtgatcaaacgccataacacacaattctccccactgtttgtgacggcggctaattctgtgcaagtggttaagatgaacatccaaatccgggcgcagtacatccttagcccgagcaaggtagttatccagttcaattttatctggcatggcgggcgcacagccatgacgggaaaccaccagtgcgccacaggcattggcataaatacaggcctgttcccagctttcgttattcagataaccacgcagtaaaccagacataaaagcatcacccgcccccagaacattgagaacttccactctgacgccctgtatggtgatgccctcatccagtgtatcgggaatacttgcgttgaacacagagcatcccaatgcgccccgtttacagacaagagtcgcctcagtcaatgcccgaacacaacgcagagcttcaacggtatctgtggagccacccgcaatatgaaactcttcctccgtaccaacgattagatcaaattgggggaggacttcctgcaattgcgctgtcacctgctctgatgcgatataacgggtttcaccatcgccaagtgacgtcagcccccacaataccggacgataatcgatatcaatggcggtttttactccattacggcgggcatattgcaacgctgtcagcacggcatcgcgggtttgtggatgggaaagatgagttcctgtaatcgccaaacaacgggcagatgcaatatagtcttcgctgaaatcattacgggtgatagccatatccgcacaattatcacggtaaaagatcaacgggaaagtttcgttatctttaatgccgagcaataccagcgccgtcagccgttctttatcggtgatcaaatggctggtatcacagccaaccctctgcaactcttcacgcagaaaacgccccatgtgttcatcaccgacccttgccagcatagaagatttcagcccctggcgcgcagtgccataagcgacattgcccgaagagccgccaaggtatttagaaaaacttcccatgtcttccagacgggtaccaatttgctggccatacagatcaacggcgattcgccccatgcagataacatcaaactttttatactgatccattgttccaccttttaccgaatacggtatggcgccttcgccgcgacaggccgtttaaacagtgcactgcctatttgatagaagacatagcccagaacacctgcggcaaatacagagtagagcaccattacatatgcaggcacgttatgtgcgaggaaaacatacatggaaatggcagccagtgtgattaaccatcccatcggttttaccatcgaccacggcgtaatatcgacctgctttgtatacacttcctgataagtttcagccgggaagaaataaccgatagtcagcataaagataatattcagtacgaataaaatgccgaccaaatggaagaagtgaatattgatgtgcaggataaagttgcagatgatataagccgatacgccaaacaacagccccagttttgctgcaatcggtggaacccgtttcgtcattaatccgaccagtacgacactcaggatcggtgcgttgaaaataccctgtagctgctgaatcaggtaaaacaaaccatccggcgcgttggcaacgagtggcgcaatgatcatggttgccaacgccagtccaagccccagatatttgccgaccgccacagtctgtgtttcagtcgcgtttgggttaattcgcggtttgtagatattgacaataaacagagtcacggaagagttcagcccaccactgaatgtggaaaataccgctcccacaacgaccgcagcaaagaagccaaccagaatttttggcagtaccaattgcaccagtgcaggataagcgttgtctggattatctatctgcccactgaaaatatggaatgcgataatccccggtaggataataatagagggaatgatgagcttaaataaggcacacagcatcacgcctttttgcccttctgccagattcttggcacccagtgatttctgtacgatggattggttggtacaccagaagaacatattggagacaatcagccccgtaaacagcgtggagaatggaaccagcgaatcttcactgccaatcgaattgaatttatcaggatgtgcctgataaacatcagtaaaacctttccacgcgttgccatccccgacatacaacaaggcaaaaaccgtaaccattaatccgccaacaatcagcccaacgccattaacagtatcagcaacggcaatagccttaatccccccgaaaatagcataaactgcgcccagcccaccgacaccccaaaccataatccataacgcagtagttctatcgacctgaaatacctgagacacctgaaacaaactttccagcgcaattgctccggtatataacacgataggtaataacgaaattacgtacattgccagaaataaaattgaggtaatcagcagggtgtttttatcaaaccgacgttctaaatattcagggatcgtcgaaatgcccaatttcagatatcttggcaggaaatagacggcaaacagcacgatggtcaatgccgcgatgacttcccaggccataacgataaatccggttctgaatgccaacccgttcaagccgaccaaatgctctgtggataaattcattaatagcatggagctaccaatataaattccggtcagagaacgcccgccaagaaaataaccttcggtagaatcaattaagtgtttatttcgcgttttataataggcaatccctgctaccagcagggtaaacccaataaaagaaagaaaagctaacatatgatcctcccccctgattgactatcttcaggcaacaatacttttgtcgttatcaaaccctacagcggtagtttgatttcttggccggatagcagggattcgagcgctttgtctgcaagatacagagcctgttcaccgtcaatggcggtggtttcaggtatcgctctgcctgccatgacatcgacaaagtgactccattccgcaatataggcctcacgataacgttgcaggaaaaagtgctcaggtttagcagcaagacacccttcttcaccccagagttcaacgctgttttctttgatattgccggcagtcagcaaacctttctcaccatgcaattccagacgttggtcataaccatatcccgaacggcggctattagtgatggttgccattgccccggacggaaacttcataacaataaacgcggtatcaatatcgcctgcctgcccaatcgcaggatcaacaagattgctgccttgtgcataaatagcgcaaggctcttcaccaatgataaaacgagccatgtcaaaatcatggatggtcatatctcggaacatgcccccagacacccgaacatattcaactggcggaggggacggatcgcgcgaagtgattagcagggattccgctttaccgatcatgcctgcattaaacagggttttcagccgccgaaattggggatcgtagcgacgattaaagccgacaaacagaggaacctgacactcttttaccgtagcaaggcactgacgaactcgctcaagatcaagatgaaccggtttttcacagaaaatcgttttattgtgccgggctgccagctcgatcagatcggcatgggtatgcgttgctgatgcgataaggacaccatgaacatcagggtcggacatcgcttctttgatggtctgtatttttgcctgatatttctgtaccaacatttcagcacttgcccgatggggatcaaccacggaataaaggcaagtttctttatgattagcaatgttaaccgcatgaacctgcccaatccgcccagcgccaaataatgcaatattgaacatggatgctccttaatgcctcggtgtctgtttttggtatgaataaaaatatatcaagcaaaatatttatttcaattttttactctttgaaaattttattttttagagatggttagcattttgtgatgaaaaaaatgaattcagtgtcatacctgtcatgaaagttaaaataatcacttttgataaatgaaagaataacctttaaaaacataaagtaatgtaatatacaaacctgtgtattattttttgaaagcagtagatggaattggagagcaatagcattacgggatatgaaataaaaattccatatccaacattaaaatagggtaactcagattttaacaattaatattggcgcgtctttttctccacatattccctgatgttttccgccgcctgtgtaatcgctgggttatccgcgatctgggctgtccctgttctccaccatgattcataatcatgggtcatggtttttggcagcactttaatatcaattaaagtcgcgcacggctgtgtttgggcatccagcaaagcggtaattaattgctgctcatcatgcacccgataactcttgcagccataactttccgcattcttggcaaaatccacctgcaccagccccccatccagccgcccactctgctgattgcgataacggttttccgtagcgaaactgcccatgccttgactcatctgcaaattattgatgcaaccgaacccagcattatcaaacaacagaaccgtgatcttgatgttttcctgaatcgccgtttgtaattcactatgcagcatcaggtaagaaccatcccctaccatcgcgtaaactggctgatccggacaggcaagttttgctcccagcgaggccgctatttcataccccatacaggaatagccatactcaagatgataagtatcaggctcttttggctgccatacgcgctgtaaatcccccggcagagagcctgccgctcccacaatgatcgcgttcggctccaaatagtgagccatcaggccgagtacccgcgtctgagtcaggttggtttgcagcgtttcactgtattcgcctagtttgtcatctaaatgacccgagatttctggtttatctccggcctgatactgaatggcaaacaaccgctccaactcttgttgccaagctgctttcgcctgcgaaatttcctgctgccagcctgaacgccatgctgtttttgccaatgactgcacgatgacactcagcccttctctggcatctgcgacgacaccgacagcatccagtttacaggcgtcaaattccgccacattgatggtaaggaattccacttctgggttctggaacagggattttgatgccgtggtgaaatcagtaaaacgtgttccaacaccaataattaaatccgcttccttagccagcaggtttgcagccagacagcccgtcgtaccaataccaccgcaatttaatggatgagccgccacaatcgcacttttcccggcctgcgtttcagcaaatggaatattgaatatttcagcaaactggcgaaaagcgtcatgcgcttcggaataacgcacaccaccgccacaaattaacagcggctttttcttgcgctgaatcagttccagcgcatcctgaatacttggcaaagaggctgggcggcgttcaagacgatgtacccgtttttggaagaagtaatggggataatcccacacttcaccctgaacatcctgtggtaagcagatcgtgactgcccccgtatctgcgggatcggtcaatacccgcatcgcgtggatcatggcactcatcaattgctcaggtctggaaatacgatcccaataacgggaaacaggccggaaacaattattggtgctgatagtaccatcaccatactgttcaacctgctgcaaaaccggatcgggctggcgacaggcaaaggtatcacccggcaataacagtaatggaatacggttagctgtcgctgttgcggcggcagtcaccatattggcagcccccggccccacagaagatgtgacagcaaaaatctgccggcgttttttctgcttggcaaagccagtagcaatatgcgccatcccctgctcattacatccttgatagacacggagatgaccgggttcctgttccagcgcctgccccaatcccacgacgttaccgtgaccaaatattgtgaaaacgccacggataaaaggatattcttctccatccacgtcaatatattgctgattgagaaatttgaccaaagcctgcgccatggtcattttcttggtattaattgccgctgtattcatgggttactccatcgctggcatgacaaagctgctgtcgtgagtctcatgaaccgtgctcaatgtaacctgacggatttcctgaccagtagccggattaaacacggatgagcggcgatcactttgacggccaatgagttgcccaccaacaaaatttttaacctgctccattctgagcctctctcaatacgttgttcgttatatcactgggaattgagtcactatgctacagatatatgaaatatacgtttcattttcaatggaaattgaaatgcactttaattaatgtgatcaacacgctatttttatgcaattgcattcatcagaaagtggtaacttgcgagcatcttcagcaggcttgtctgatgagtgaattatctatttcattacaatttattatggaggcattatgtctgctgcgtcgaacctgaatgagctgcaagaacaaattcgttcacgttatggtgagttaagcaaacggttacagcaagttgcaaaatatgtactggataataccaatagtgtcgcatttgatacggttgcggttatcgcaaaagcggccaatgttccgccttctacactcattcgcttcgccaatgcctttgatttcagcggcttcaatgagatgaaacaattatttcgtctgaatctggttgaagaaaccgccagttatacggatcgggcgcggttatttaaggagttggatggcgatcagcagataccggaagatccgcagcatattttgcaggaattcgctaattccaatgcacaggcaatgcagcaactcgccgctcgcacgccagcggaagatttaaacaaggccgtggatttactggtaaacgcccacaatatctacattattgggctgcgtcgctctttcagcgtggcgtcgtatctcacttatgccctcagtcatttggagtgccgctccttactggtgaatggtctgggcggaatgtttcgcgaacagatgaataggattggttctgatgatgttgtggtgtcaatcagttttacgccgtatgccgaagaaacggtgatggtcagtgaaagggccgcacaggcgggggcaaagcagattgtgattactgatagccaaatcagcccactggccagtttcagcgatgtctgctttgtggtgaaggaagcgcaggtggatgcattccgttctcagtcagcaacgttgtgcctggtgcagtcattaacagtggcgctagcgtatcggcaaggaaatagaaagtgattacctttatcaactaataatatgctcagaaactattgcttttgggcaaaacgcattccagacaaaagtgggcttttttgcttgttatcttcacatttttgggaacgtgtcaccagtttgtattgatctaactgatttataaatgcttccaaatgagatgccgcaggaatatattactacagcgacagcatccaaagataacgacagaatgtttcaacaataaccccattattcatcactcattaggagtttcccctatgcctgcagctatttgggctctagccatagcaacatttggaattgctacaaccgagttcattatcgccggattacttcctgaaattgcaaccgagtttaatatttcaatacctatggcggggtatatggcaaccagttatgcccttggtgtatttgttggtgcgcccgttttgattatattggggagacaggtagaaagaaaaaagatgctcgccatattaatgctattatttattattggaaatgctttgactgctttagctcccacattctatctggcaattgttggccgcatagtaacatctcttacccacggcgcttttatgggaataggcgctattattgcggccgaactggtgccagaaaataagaagacaagcgctatcgcatttatgttcagtggaatgacgcttgccaatcttattggcataccgttgggtacatggataggaaaagttatttcatggcgtgtcacttttgcaattattacctttatcggcattatctcattactcggtattttaagattattacctaaattcattcaacaaacgcctaccagtatcaaaaaggaattgctggcctttacaaatatccatgttctactggcgatggggatcacggttttaggccctgctgcattctttactgctattacttatatcgcgccattgatgacccatattgcaggtttttcagaaagcgcaatcacatggattcttgtcgtcttggggctgggatttttctctggcaatatcgtcgggggaaaactcgcggacaaggcgatgatgccattgttatattggacactggggttacaagccttagttttatttattttctggctttatggcgacaatccattcattgcctgcttgagtatatttctgatggcggcgtttggctttgctacagtatcgccaatccagcgtctggtgatggataaagctcaagaagccggtgcgcctaatctcgtttcttcagtcaatattggattttttaatttaggcaatgcagtcggtgcatggttgggtggggttgttatcgccgctaattatggttacgcttcactcaatttagtgggcggtctgctcgcctctacagcattactattggcggtaatttcaggtttccttacctacaataaagcgcgtgtagaagcgcttaaatctgcttaaagaaacatcttcttttgtggtgctgatattcattcagcacctacagttactgagcaaataatgacaacgcatccgcgtcatgtcccccgtaatgagggaatacgatcaattcaaacataatcaatcatcatgtttcacaggcatttctgaatacaatagattagaggcccgattacacaactctgtaaatattgctatttccccttgcgacatgctggaggcgacaatatccgccatattatggcgactcaactcagctctttgcaaaaacatcaatcccttatgacttaaacgtgtcacgagttctcttttgtcattttcacccgattcttgttcgattaattccttttctttgagcgaacgtagtattttggatgtttttgatcgggtaaacccaagcttttcaccaatcatacttgggatcataggttgaaactgtcgcaaaaaatgcagggtatcgtattgagcccatgagacaccttccggattagtcgccgttcgtctggcaacaagaacacactggagccgacctaatgcattttcgaatggagtcactgttgcgctatctgtctcactatcgattctgtttgtattgcaattttcattacataattgattatcttttttcattataactttctcaaaattgttttattccctatatacaacggcaacattaaaatataataattatttaattacatcataataaagataataataaatccgcaaataataatttaaataaaatattgtttatattaaagataaaaataaaaacaatatatataaattagttgttttaatatctatataataagtaattacaatgccttaattatttaatagtattaactctctatttaacacatcttcgtaatcgtgtaattctttaatttttccgcttttaatcttaaacacattgatatataaacaataaaaacccctcttttccggcaaagtttttccatttaatcggtattcgacaataaatgtgtcacaatcagccgtatcatatatttccacatcttcaattgaaataaatactaatggcgcctgaccaaaactcgctaaataatgttcaagaatattggagttaccctcaattataggtcgacctgttctaaatggtaactttaaaataccatcatcacagaataatgaagccagctttaaaggtgacttttcaataacggcttcgatatacttatcaaataaaacgtttaacattatttccccttatgattcatcgtgtttttttgatttaatcttgcaccacagatctcaattgcgttttgcatatgatcactcatctattcatttcattgcgcgcactaacattaaggaaaaaatactgagcgccccacatcccatcatcacggtggcaacagggaaaagagaaattgaatgaccaagacctgctaagacagcggtcaacgaagcaacgccaaattgaaacgcgccaagaaccgccgagccagtcccccgaacttccggcacagcagccaacgccaaacttgctgcattcccgaacacaaatgccatcgtaaacatgagcaacatgaaaattataatggtcagctcagactgataagcatcaatgtaattaacacctagcaacatacaggctaaaccaaacgaactcacaacccccatcatgaccagtttttttgccccaacgcgcacaacccaccgtgcactcatgatactactcagcatcataatccctgcattgatagcgaaaatgatggagaaagacgtcggagtaaatccaaacatggactgataaataaagggggaagatgaaatataggcaaatagcatcccaaacgttgcagcaaagattaatgtatatccgatataaatccggtttttaaacaacttaaaaaactgacttaaaaaaccatcaccctccgcatggctattccttttttccggcaggctttcaggcacatagatgaaagccaaaatagtcagggtgaatgaagtgattgccataaagataaatacaacaggccaaggaaaaaatgcggctacacctcccattaacggagcgacaatgggtgcaacaccttgtatcgctaaaatgaggttgaaatagtatgccgccttatttccaaaactaaggtctgacacgatagctcgcgttaggacgatgccagccgcccctcctgccccttgaaaaaaacgacccacaatcagcgcctgaatactggtcgatagcgcgcaagcaattgaagcaacagtgagcaataccataccccccaataggaggtttcgacgcccgatcacatctgaccaaggccctataattaactgaccaacagcgagacccgccataaacgaagtcaggcttaactgaacacctgctggagttgtatttaatgcatgtgaaatagcggggaataatggcaggtacatatcggttgaaagtgccgctatcgcactaagcatgcccaacacgagaacaagttttaaacttaattctccttcgcgatgatcagattgacgaatctgatctatgtaaatctcagttaccttatcctgcgattcattcactgccattcatcccatataaagaaacatggtacgactatagcactggcaaaatatgatttcaatttggaaatcatattttacaacttcccgctaaaaatttataaaaattagcttttttaaataaatttaattaccaaaaagaaattatttatctagggataatcagagtcttattcagttacatattgtaaaagttaagaacactgatacatctgtcttgttgatacccgccgacaatttcacagtgcagacgggcttcagtactcaggctcccagcgtagcgcctccatcaatgacgatatcctgtaaagtgatgtggctggcaagatcagaggcaagaaacaggactgtgtcagcaatttcatccggtaaggcaatttttttcagaggaatgcctaacttaaatttttcaggaaaaccatcaatagtatgctgtcttgatgccggtgtctgccacatgctttgtagcatcggcgtatccgttgaacccggtgagactaaattacaacgaacgccatagggtgccaattcaagcccaacactcaggcaaaggctgcgaagcgcggctttagacgctccgtaagctgacatttctacgcgaggaacatgagccgcattggaacaaatagaaacgatattcccactgcattgccgctgaaattgtgggatcacagcctgaaagaagttaaaagctccgccggcgttaacattaaggcattgctgccagtcttcccaactcaacgtttctgtgtggccagtccgcaaaatgccagcaccattaaccaatacgtccaagtgattttcgggtgtcagcaacttacggcaacagtggctgacggccagatgatcgctaatatccaacacataagaggtaaaagggatttcggcgtcaggaaaagccacatcaaatccagtaacattagcgccagcctggctaaaacggctggcaatttgataacctattccacgcccagcccccgtgatccagacatttttaccactgaaatcaaaaacagtgctcattatctgacctcctgtttatcagtcaacagcgtaagccagttcgataaggttggtgttttaaccagtgtgatgaaatctagttgatgaccctgattattccagcgcgttatcaacgacatgattcgtaccgaatcgaggccgtaatcaagtaaattttcatgatcatcaatgtcgccacaatcatcgtctaataacggtaaaatttcagcacgaaggtgttcccgatcccatttattctcccctagagaagaaggtgacatttcattgagcaatgttgcagtcgtcagtacacggccactacgtcctgcgacataacgcagagacatcatgtgttcttcgcggctgaaatctgccagtgcgtctgcaacgaagaaagattttatatcacgcataaaggcatcagtggctgttgtcatgcagccgatatgagcataaataccacagataattaattgatcccgttcgctatttttcagtaactgttccaaatcagaacgttgaaaagcactatagcgccactttactaataacgtgtcatcaccttcgggtgctaatgcgtcagtgatactttgctgttcagggtgtttattcagccctgccccccacatatcattaagtaagccccggtcagcatcgctctggtggtcgggctgcgcggtataaaaaacaggtatgccaagtttctggcactgtattttcaggcgggcaatattatcgatgatttgcgtcactagctgactatcaggttgccaaaaattgagaaaataattctgcatgtcatggatgagcaaagccgcacgtttgctatcaaatgcccaattcactttattaacaggtaattcctgagcagcaggcagaggataatcgtttagtttggggatgctcattgggtttctccgacttgaaatggagtgtgctgtgtcatttggcgtaatttttgtttatcgatttttccgacaggcgtcatgggaaggtgagtgacgcgttcaaatcgatccggcagtttgtaatcagcaatgccttgttcacgtaagaaacggcgtaatacggcagattttatctcttcacgggtaacaatataggcgcagcttttttctcccatcagtgggtctgggatagcaatcagggcagcatgaatcatctgaggatgacgtaataggatattttcaatctcttccgcagcaatcttttctccgccgcgattaatctgatctttttctctgcccaccacttttaaatagccttcgctggtttgaataacgatatctccagagcaataaaagccgttttcatcaaatacctgttcgttgtgcagagggcttcggtaatagccacgaaaagtatatgggccacgggtcattaacctgccggcgacaccatgtggcagagggttgccttgtttatccgctatccatacttcatcatcagcgctgattgggcggccttgggtcgtgaaaatggtttgttcatcgtcatccagccgtgtgtagttcaccagcccttctgccatgccaaatacctgctgtaagcggcagccaatctcggaaggtattcttctggctgatgattcactcaatcgtgcaccacccacctgtaataattccaggctcttgaggggcgagttgtctcctgtgctgctaatcgcttctaaccacaggcttactgcgggaggcactaaggcagtcacattaatctggtgttgctggatcaggggaaaacagcttgatgcactggggtcattagccagaacgagctgaccacctgcataaaaaacgcctaaggcccccggtgaactcatcgggtaattatgtgcagccggcagagcacataaataacgcgtatggcgattaaaatgacagatttcaacgctggcgcggatactgtagtagtagtcattatgggttcggggaatcagcttgggaatgcccgtgctgccacctgaaagctggaagaatgcaacttcatccgctggcgtaggggaagctgtgaagccatgtgctttttcatcaagcaatagagccaaatcgattgggctatggttatcaccacgcaggaagatttttttcagcgtggggtaacgtcgttgcagctcatgaagaaaattattgtcagaaaatagtgtatgactacggtcagcgatcagtaatgaaggcgtaatctgatcagcataagctaacagctcgctgcgttgatggctgaatatcgcattaacgggaacgactcccaaacgcagcagagcaaaaaaagtaatataaaattctgcgacattgcctaattggactaacgccgtttgcccgtactgaacccctcgatgcttgaggccagccgccagattatcgaccagacaattgagctggtggtaactatactgatgtttgccagcaataagggcgatattttcactagcgacttggcggctgagtatgtcgctcaggggcaagtcaagccagtaaccacgttggcgatagtgttgcgctaatttctcaggccagtgattgaattcaatattcataaacaacgttccttatcataagacaatcccagcgcctgtagcatcgtgccaaatttcacatctgtttcatgccattcggcactgggtttcgagtcagcgacaacccctgctcctgcaaaaagccgaatatggttttcaaacacttcaccacagcgaatcgtcacgacccattcgccattacctctggcatcacaccaaccgacaataccgccaaaatagtcgcgcttgaacggttccaattcagaaatcagcgtcgcggcctgctgtctgggagcaccacacagtgccggggttggatggagcaagcaagcgatcgagagggcatctatctggttatcggctaattcaccacgaatttctgtcgcgagatgccaaagcaagggagtgctgagtaacgaaggcgtctcaggaatagctaattcagtacagcgttcagctaatgcttttctcattgcggtaatcactaattgatgttcatgctgatctttcgctgaacgcaatagcgattggcgcaactcattgtcttgcatgacgttgctgcttctgcgcgaagaacccgccagaggttgagagataatggtattcccctgtttacacagcagtaactctgggctggcaccgataagggtgctgttgccaagtggaacatggaagttatagctataagggttttgttgattcaatcgcataaataactgcgtagcatcaggctgttggtcaaatttgatgttcagcaggcgggaaaggacaactttatcgagcaaaccatgatgaattgcatcaacgccatgagtaaccatctggcagaattcgtctttatccggcagtgaatgtatctgctgtaatttggggcaggaagaaacagatgaaaaagataatgcctcacgctctagccaagagtaatcctccggaataaacagagcagaaggctgacgtttatcaaatggaatagcacccactataatggggttttcaatacctttatttttagcctgacggaaaagctcaggtatatcgcgatgtaattggcagtcagtatctgtattataaccgactggcgtggttattttggtaaagcatccgtgtgcatgtagacttttattagatgacaggaacacaaaatcatcacaacaaaaatcctgcaattgggatatgcggaattcagttgctaaattaggcacggttttttcctatattttattgactgttattttatttttttctgcctgttacggttcgaattagaaaaacgtattacacctgtgttgtatcaaagttatttctcagggacatcagcaaagtagaaagcagcctgtgccagcattgctttatcaatgcccctgagataaatgcatttccgcttaccagctatacgctacagtggcaaaaatgctgcgaccgctgccatagaagcaggctccgtcattcgagcacgaagcaacataacgtttgtcggtcaggttattcacgttcagttgtacgctagcaccttttaactgaggtgacgcttcaccaagattatattttgccatcagatcatagagggtgtaggacggtacattgaatttttctgtaaaatcaccggaagtggtgccgaggtaacgcacgccagtacccagcgtaagcccttccagtacggattgtttgaagctatagctaccccatacagaagccgcatgttcaggaaccgcaggcactcttttaccgacacgagcagggtttctatcgcttttcgtcttggtatcggtataagtatacgacgccatcagattgatttctggggtgatttgagaatgaatttcggcttccgcgccttttgagccaatcttgccaatttgttcgctaatgcgggtaactggatcacgggttgtcacgtttttctgggtgatatcaaacagagaaagcgtcagcagggtatcgtggtctttgggctggaatttaatgcctatttcggtctgttcacccattgttggtttgaattccggggcacctggtgcacctgtatccaggttgggttcaaaagaggtgctgtaactgatataaggcgaaataccgttatcaaacgcatacaataaacccgctcgtcctgtaaacgcactgtcattctgtttttttgatgtgtgcttgatgagatcttgttgcttgacttcagtccagtcataacgccctgaaagaactaagttccagttttcccaattgagttgatcctgtaaatagagacctaactgatgaagtttctttttatcatttgagtcaagtgagaggtttttctcatcaatgtgaacgttcctagtgggatttgaccagtcaaaacgatattggggttccctgcccgggtttttatcattccatgttttattgtgcctgtctccccacttgtaatctattccactgataatgttatgctcaatgttagctgttgaaaacagagccttcagttgattatctataccaaattcctgcgctttattatgttcacgttgtgggcgacgcccaatgatggaactggtaacatcttttgtataaacaaacaatttagtgcgttcatccgagcttgagtaacgtaaggtttgttggaaagagaaaatatcattaatatcgtgctcaagaatatagccgatagaagtctgctcccgtctggcctgattaaaagaaggctcactgagattcatatcatagggcatatagcccacattggggataggcgtaacagtcccgactttagggtaaaagttacggaatcccattttaggatcgtattgataactagtcagtaacgtaaaggtcgtgtcactgttcggtatccatgtcagcgccggagcaattgcaatacgctcctttttatagtctttgacgaattgctgttgagtactgagaattccattcaagcgatagaaaaggggaatatcgtcatgtactgccccgccaaaatcaaaggcaaactcaccaagacgctgattaccggctttcatctgcactttatgaatagattgtgccgtcggtcttttgctggtcatgctaaccaacccaccggggctgacttggccgtatagcacggatgctggcccgtgaacgagctccacacgctccaaaaaccaagggtcaatttggcctgccgtagccccctggccgtttaaaccatagctcaatccatcaagaaatttgggcgcataacggaaaccacgtgtaatgacttcatcactacggttggaagaaccccgatagttagtaatcacaccactggaataattcagggcatcagccactgttgtcgcgccctgagcctctatttgtgcacggttcactaccgtgatcgcctgaggtgtttttatcagtggtgcagcacttttcgtgcccgcagaactttctgattcaacgaagccgctggagccgccctgtgttgatgcggtgacgatgatggtgtctttctcattagccgtttcattggctattacggcgtgaggagataaaaataatacagaaattaatattaacggtactttattattgtaacttttgattgttttattttttagcgtttttttcgtgggcattaccatatatttcatctcttaaaataggatttcttggaaataatttctttataatcagattattatgtctcttattttccctaagtctctataagaggattccagtcctattctcctctgcgacgaccttattaattccattaatcgataaacttcgctcataaaagacgcctaatgctattgcaaataaaaatgataatcaatattgtttagcaaatgataaccatttatctttacctgcgtggttataaattgttatgccagataggggcattaatggaacaactagatggggcaattattttgaagaggataagggaatgaaattagcatttcagccatccggtactataagtaatttattatcagcatcttacgctggcagtgaattatggtgggagcatattgcagctttagggactccgttagtggaagcaaggccggagcatcaggttcaactcacgtttttctggcgagatcctgccggaaatgaacagaattcagatattcgccgggtttatattgatattaacggcatcacagatcaccacagtccacagccacaaagtctgcaacgattgcccgaaagtgacatttggtattggtctgtcacgattgatgatgactggagaggaagttacagcctgatccctgccactcatgcccatctcccctctgatttttacggcgatacacagcagcgtaaccaacagcaacgcgaatggtggtgttcactttttcccctgtctattccagatcctctgaatttacaaggctgtcatcgtaatgggctcggaatgtctttatcggccgctcatatgccccatgctcctgagcagtcagcttgggtatcaatcgggagaaatagtctcgctcagtcggatacacaacagcctattctgttgaattggcagagtcatcgcctcggtaatcagcggcgtatctggctttacgctacgggagaggaaccggagagaccacgcccgctggtcattcttctggatgggcaaaattgggcagaaagaacccctgttttttctgccttagaagccgctaccgaacagcagcacataccgggagccgtctggctacttattgatgtgattgatatgtcccgacgggagcaagaattaccctgcaacagagatttttggctggcggttcaggatgaacttttgccgcttgctgcacagcatgccacgttcagcgattcccccagcaatacggttgtcgccggccagagttatggtggtctggccgcactttatgcggcactacattggccgcaacgctttggctgtgtactcactcagtccggttctttctggtggccctacagcaaaatgatgaagtcatctgagcgtcaaatcggttggctgacacagcaggttattgagcaaaaagttcccccatcctcattgaaaatctttcaggaggcgggttcccgcgaagatgatatcgaaggtgttaaccagcaaatgtatgaagcgttaaaaaatgccggatatcacgtgagttatcgtgtttttaatggcggacatgattctttgtgctggcgtggcgggttgattgatggccttagctggttactgtctgaaaacgcataaaacaatgactgaaactctaaatataacgagagctaaagatgtctcaggaacaaaaaaacccttttgatgatgataacgcgaccttctttgtgctgatcaacgctcaacagcaatacagcctctggccagcttttgcggaacagccggctggctgggaacaggttgccgggccagattcgcggtcaacatgtattacatacatagaagaacattgggtagatatgcgccctgcccgtttgcgtgacttattagttagtcgagaatcggttaatcaggactgataacccttgtgatttagcttgcgccaagaaggaaatacacgtgtccagtagattacaagaggttggggttgaaacaataaatttgacgctaccactggttgctgcccagccagggatttggatagccgatcaactcgctgacccacgtaacatatttaccattgcacattatattgaaattaaaggggcattagaccagccattatttgatgccgcccttcgtcaggggttgtctgaagccgatacgatccatgcccggtatttcctgaatgaagatggaataccggtacaacagatcccgctttactgtgacccacagcaagtcattgcccctgaatggattgatttttccagagagccggctgaacaggctgaaatagcatcacatacattgatgcaggaggatctctcggctgaattacccgcagatggagaacgtgcgctgtaccggcaggtggtaatgaagattgatgagcaacctgaacgctggttctggtatcaacgctttcatcatctcatgctggatggtttcagttttgatgcactgactcgtcggattattcagatttataatgcactgagagccggctatcagcccgctgagacccctttctgttcctttactcaggtagtggaggaatatcaggattggcaaagttcgccggcaaaagcaaaggctgcggcattctggcaagaatatacccgtgagccgggtgcctgtgtctctctttcagttgaagatattgccgcttcggggaacagctcgcctttaaattatcactgccattttccggcagctcagctgacttcattaatagcagaggattcactacgccaatttcaacctgctgaaattgtcatggctgcactcggcatctatttctaccgcatgtgcggagaaaagtatctctctattggttttccgtttatgcggcgtatgggatcagccgcgctctgctctaccggccctgtggttaacctgctaccgttacaaatcaaactgcaagacagcatgacactggccgatgtcgtgaaggcttttgtggcagaaataaaacaagtccgccgtcaccagcgttatgacgccaaacagctacgctgcgatttggggttatcgggaagcagcaacctgctctatggccctgtttttaactataaaatatataacgagacgctgaaattagacggcaggccgattacgactcacacactcgccacggggccagtggatgatctggaatttgaattgaatttccaggatgacgttcttcatctgaccttcattgccaatcggacaaaatatagcgaacagactttacgctggcacagtgaacgcatccgttatctattagatcaactgctcattcagccgaaacaaccgattgcttttataccgatgattcccccacaggaacaacagcgtcttgatgaatggtcccgcgggccatgcgtaacaccgccatcaggtagggtttctgtgcttgatttcttcttatctcaggtgaagcagcaaccagataccttcgctgtccgctgtggtgatcaacaacttagctatcatcaattaatggcaaaaagtatgcagcttgcgcgcctattgctggcgcagggtattggtgccgaggatgtggtcgcgataggtgtaccccgctcagtagattcggttgtcgcgattctgggggtattagccagtggcgcggcttacatgccacttgatctcgattatccgcgggaacgcttacaattaatgagcgatgatgctcaaccggctctgttgataacctgcattaatacactgccacaaatgcctgatataccgaaggtaatctgtctggatgatcatcagatacaggagcggtgtgccggtctgtcttcccttcctgtcacagatgaagaaaggcgtgaaacgctgtgggacgaacaccttgcttacatcatctatacctctggttccactggcaaacccaaaggggtgatgagtacacatggtgggttactgaatttgctggcttcccatgctgcacggttgtttgggccagtgattgacaattttcatcttcagcatcaacggcgtatgcgcgccggtcacacagcctctttctcatttgattcgtcctgggagccgctgttctgcatgatgttaggcagcgaactttatatctttgatgaagagttgcggcgagatgcctggggtgtggtacagcaaatgaatcaactgcctgttgacctcatggatattaccccatcgtttttgactcagcttattgacagcggtttgctggaagaaggcaatcaccagcccgcgtttattatgattgggggtgaagcggcgacgccgcgattgtgggatctgttaaagcaatacccacaaatgaatatccataattactatggcccatcagaatataccatcgacacgctgggggccaatattcaggtcgctgatcagcctgttattggacggcccgttgccaatacggatgtctggcttctggatagtcatctgcaacccgtaccagttggcgccgtgggggaactttacctttccgggccaggcattgcccgcggttatctgcgccgtcctgatttaactgcggcgcgttttgtcgccaacccattcaagaatggtgaggtgatgtatcgcagtggcgatctgatgcgttggcggcctgatgggcagctctcatttgttggccgagtggatcaccaaattaaagtacgcggttttcgcgttgagttaggagaggtagagaatgcgttggctgctttacctgaagtcagctcggccgtggttattgcagaacccatgggagtcacctatcggctgattggctattgctcggttcctgataataaactgcgagccttagcagatatttctgcacgattgctggctgaactggcaaaacagctacctgattatatggtgcctgctttattggtgattttggaagagctgccattaacagtcaatggcaaggtggatcgcaaggcgctgcccaaaccgcagcaacagcatttttctatagggcggcaagctgaaaatgaaaaagaaaaatatatttgtgaagcgtttgcaaccttattagggatggttcaggtcagtgccgatgatgatttctttgcgctcggaggcgacagtatctctgcaatggcactgggaacacaattgcgtcgtgttggctggcagcttcgtccacgagatattttcagtgaacggacaccagcgcgtatggcgctgaaaatgtctccggtcgctattggcaagcgaacatctagcgccaataagatatctaaaccagtacaaatcggcgagatcgatcacttacctattttgcattggtttgcagaatctcatggcatcaatacccgtttcgcccacggtgtattcatccgcgtaccgactgaattacggccagaacatttatcatccgcccttctcgctttgagccagactcacccggtacttcatgctgttacccgcaataatcgccttattatcggtgaaaaacctgtacaggcagacggatcgtattacagcgttatacaaaacagtggtcatatagaaacgagtgcagaacaggctttccacgaggcggtgatgcgcttggatccggccacgggtcatttattccatgcctgtttactgcaacaagatgaagagactcagggattagtatgggttattcatcatctggcaacggatggtgtgtcatggcgggtactactggatgaactgcaacaagcaatagaagctgccatggcgggtaaaacaatcgctttgccaccagaagagtacacattgtatgactggaaccttcagctaggtcaaaatttagcaagccgtgccggagagctgtctttctggcaagccatgcttgacgaaaaaattcccctgttaggaaaacgcccgttggatgcgcatcgggatcggcaagtcgctgtccgtgagcaacgaacactattaaccggcaaacagaccacggcattactgggagcgttgccgcagcagtaccatgccaatattgaagagatattattaacaatattggctatagcctgtaaccggtactttggtgtcagcaaattacgtttccaattagagtcgcatggtcgtattgaattggaggatgacgttgatttagcacgaaccgttggctggttaacggcggaatatcccgttgtgctggcgttgccacaggcagaatgccaatccacagaaatcgctgccgaaaatccctcaaaaatcgtacgggcagtgaaaagcgccctgcgtacaatacccgatcgtggcataggttatggcctgctgcgttatctggatcaaactggccgacaagtattagcccaacaggatacgccagagatcttatttaactatttggggcgttttgctacgactgataacttatgggcgccacagcgaactgaaaacctgttccgtgatacttttgctgtttatcaagatccgcaaatgtcccccaatcatagcttggaaatcaacctgtttgttgatgaacagggaagtattccgcagttagcaattaactggcaatgggtagatggtatcttcagcgaacaagacatctctgaattacagcgcggcatggaatgggctaccgactgcctaatcaattttgcccgacagcagccacagcaggcggccgcgacgctggttgccgcagaaattgttttaccgagacttgaagaaagtgatctgacgcaactgactgaacgttatgggcctttgacgactgtgttaccgctgttaccgctgcaacaggggctactctttcacgctcagacagcaacagataagggtaattataattcactcacccgcctttctctgcatgggccattagatcgggttaaactgcaccgggcactgtctggcctgatccgccaccatcctcagcttgccgcacgttttgatactgagcaaagtgcttctcctctacaactgataccccttttatcagaggatagcgagatttggccgcttgatttttatcagctccccgaattatctgagcaggaagaagaggcggcattattagaactggaaggaactgaactggcgcgcgatcttttccaccagcctcaagccatgctgcatgctttattggtctgtcacggtgaaggttcacgttatacgttattgttgaatattcaccatctcgtcgtggatggctggtcaacacctatcttaatacaagatcttttaaccttgctgaatcaaggtgagcaagcgttacctgtacccagagtcagttatcaagagatcgtccatcaattggcggcacgagaaacggcaacggcgcgccaatgctggcaagatgtgttgaagggcgttcaaccaaccaaactgttcagtgatcaaccccataacggcaaagtgagagagcttgatatcgtgctcgaacctgaaatggaacaggcactattcagcttatgtcagcaacgtggtttgacactcaatacgctgatgcaggggatctggtctgttctgctcagtatacacagtggttcatccgatgtggttttcggttcccccgtgtctgggcggtttggccagattgaagggttagaccagcatgttgggctgttcagcaacaccctgccggttcgaatgacgctggatatcacgttacctctcttgcctcagctggaacaattgcaggcacagcagatccagttgattgaacacgacaatatcggtctgggtgaaattcaacatattgcggggacaagtacgctttttgataccttactggtagtggaaaattatccagaaaccgatactgaatcagattgcacccaaacgatcatttgtcagcagattaataaccgtggttacacgcattatcccttaaccttgctggttctgccgggtaagcggctgcgtttattaatggaataccgggaatgtgtcaaacaacctgaattattggttcaacgtatccttctcctgattcagcaactgcttgagcaacccgatacggctctgcgggattgggttttacaatcaccggatgaagctgcattgattaccgaagtgaatcggacacaccatgaaattccttctggtacactccaccagtttgtgattgaacaggctgaaaaaacgcctgatgatttaacattactggataaccagcatcaactgacttatcggcaaatgcgtgttcaaactcgtctattagttgatcgtttaattgaagcaggggttcagcccggtgatattattgggattgctttaccccgttcagtaagactcagcctggcattacaggcgatactggaagcgggagcagcctggttacccctcgataccggttatcctgatgatcgtttggcgatgatgctggaggatgcccagccacggttagtcattacggaaagtgaacttcaagcgcgttttgctcatcaggctcctttgctggtactggatcagttggcggatgaaaatcagcagccggtgcatcccgcagcccaagtgatgccacagcacacggcttatatcatttacacctcgggttcaaccggacggccaaaaggtgtgatggtcagccatcaatccattgtgaaccgtctgttatggatgcaggatgcttacccacttacccgggatgatgtggttttgcagaaaacaccatgcagcttcgatgtttctgtttgggagtttttctggccgctgatgacaggcgctaaactcgtgatggcgccgcctgaagtgcatcgcgatccagaagcgctaatgcagcttattgatgactatacggtgactacgctgcactttgtgccatccatgttggcgacgttagttgactcattggcatcacgtcagcaaagtactttattctgtcatagcctgcgtcgggtgttttgcagtggtgaagcgttatcctgtgaactggctcgccgctatcaaacattcatcgctgcacctttacataatctctatgggccaacggaagcggcagtcgatgtcacatggcagccggcttatggtgaggcattagatcactgtacaggttcaggtgtgcctattggccgaccggtatggaatacccaattgcgtattttggactcttggctgcgtccggttcctgttggtgtagcgggcgatctctatctctgcggtattcaattggcgacgggctacctgaaccgggctgatttgacggccagccgttttgtggctgatccttttgcctgtggcgaacgcatgtatcgaactggcgatattgcctgttggttgccaaatggtgaagtggaatatcttggacgcagtgacgatcaattaaaaatacggggtcagcgtattgagctgggggaaattgaacaggttctactggaacagcccggcgtcgctcaggcggcggttgctgcgtgtgaattaggcaaaacagccaacaccgttagtaatgcagatgcccgtcagttagttgcctggttaattcctcaacccgatgtttcactggatacagaggcattacatcaagcacttacccggcgattgcctgcttatatgctgccggtcagttatgtgcttcaggacagtttcccattaagcgccaatgggaaattgaatcgcaaggcacttcctatgccacagaaacttactactgggcgcttgcctgtagcaggcacggaaagccaaatggcagccctttttgctgaaattctggactgcgacaccgtttgggctgatgatgatttctttgcgctgggtggccactcactattagctatgcgcttggccgcagaaatacgccgtcgttttaatcggtctatttctattggtcatatcatggttgctcgcagcgtcgagaaactgagtgcactactgtctgatgaaaatggacaaaattccgcagaaaatcgtggcctaggggaagtattcccgctgagagacgggcacggcccggcactattctgcctgcaccctgcatctggctttgcctggcaatatagtgggctgctgcgttatttaaaaggcgactggccgatcattggactacagtcacctcgcccgctgggcgttattgccgactctgataaccttgaagagatgtgtacacaccatttagcgacattacggcagatccagccacatggcccttattacctactcggttattcgttaggcgggatgctggctcaaggcatggctgcgcgcttgcgacaagagggagaagaagtggctttcctcggattattggatacttatccaccggaaggccaagactggactgtcttaagtgaagaagaagccaaagaagaagctgcgcgtgaacaggccgaatttatggccgccacggaagatgagcatgattcgctgctgcgtgctgaaaagcaggccatgttcgccgatattgtggctaactataaggattctgttcgtatcctttcatcagccgccaatcaaaaatatgatggcgaagccattctgttttcggcaacacgcacattgcctgctgatatggatgttgcagcgacatgggcgccttggatccggcagttaagcatctattggcaagattgtgaacatgcggatattctttcgccaacatcactgaaacagttagggccattgctcaatacactgttgaaaacgcatcgcgattgaaaaaatacctagcttgaaacattacctaaaaatcccgtcatcattcattggtgatgggattttttctttttaacggtttttaaatgtcttttaccgaatggtagcggccgcagggaataatcaggggcgtgtgggaaaccggatcttcaatgacaacacaagataagccaaacaccgatttgataagttctgtactgataatatcctgaggcttaccctgtgtaacaatctgccctgcctgcatgacgattaaatgatccgcatagcggcatgcctgattaatatcatgcagcactgcaacaagggtgtggctgctttcctgattaagttgcaggaaaagatccagcaggtcaatttgatgagcaatatcgagccaggttgttggttcatcaagaaacagtaagggagtttgttgggctaataccatagctacccagacacgctgcttctgccctcctgataactcatcaacatagcgttcagctaattgtgcaatccctgtggctttcatcgcctgagccacggcagttctatcatccagactccattggcgcagcaggctttgatggggatagcggccacgcgcgactagctcggaaaccgtgatattttccggcactatcgcttgctggggcagtaaacctaactgacgtgccaatgccttagtcggtatttgttgaatatcttttccatccagcaaaatatgaccgtgatggggcttcagtaaacgacaaagcgcacgcagtaacgtagatttgccgcaggcatttgggccaatgattacgctgaactgtttatccggaatactgatacttaaatcttcagtaataatttttcgttcatagcctaatgtcaaatgtgaagcgctgaggcgatatgtcatcgataattactctttctgtttactgtatgattggcattattggcgagcttcccgaataagaagccaaataaggtagataccaccaatactgacggtgacagcacccacaggtagctgcacatttgaaaaagtatgctgcgcaactaaatcagcagttaacaatagcaaggcacctgtcatggcagcagaaaacagaggaacataacttgtacctgttaatcttcgggcaatttgcggtgcagcaagggaaataaaggatatcgggcctgtcgttgccgtcacgacagcagtcagaaggatgccatagagaataagctgcatacggttagtttcaacattacagcccaaggcgctggctttatcatcccccatttccattattttcagcgactttgccaaagcaaaagcgccgaaagtaagcaaaggaataacaaacagggctgaggccgatttttgccaggtgatgccgttaagcgaaccattgccccaaagtgctgcactcatgacatgttccagcgaacccgttacgataagccaagtattgaccgctgtcagcatggcactgatagcaatccccacaataatcaggcgaaaaccgtggataccctggcgccaggcgagtaaataaattaaagcagcagttaatgaaccgccgatcagcgcgcccagggtcatttgataataaccgccatttagaaaaatcagagtaatcagtacgccggtccatgcgccggtactgaaccccataatatcggggctgcccaaagggttgtggatgacagactgaaagatggcgccacttatcgccagtgcggctccgaccaccagcgcaatggcaacacggggggctcgccattgcgtgacgacagcaataatgccgggatcaccttcaccttgaaaagcctgccagatttgccagaaggaaagtttcagcgttccgtaataaacagcgaacagcgctaataacataattaaaaatagctggagagtattcaccagtagaacccgaaggggaatgcggccatttatccacccttctggatgcccgacttgcaacattttcggcatgaaatctgtctcctgctcagtatttacgcttacgtacctgccagatcagcacgggcgcaccaataaaggccgtgacgattgatacgcgcagctcaccggcaaccaataaacgcccgacgatatctgcactaagtaataacaccggagccatgagtaatgaatgcagaatgatccagcgctggtctgggccacaccaccagcgcgcgatatgtgggatcatcaatccaacaaacccgatcgggccagccaatgcggttgccgttccacatagcagcataatggctatgatggctgaaacttttacccagaggattttgacgcctaatgttgttgcgatttcttcccccatactcaacgtattgagcggccttgaaatcaataaggtgagcgcacaaccgataagaatgagcggagcaacaaggagagtaacctgtaaagatcggatatccagcgtacccgcctgccagatgcgtaattgatcgaaagttgaaggattgagcagggcaatattggttgttaccccggttaacagggcgctgatcgcgactcccgacagtgttaagcgaacaggattggatttatcaccagactgcatgctgattaaccagaccgccaggctggcaagaaaagcgcccagacaggccacgctaacttttgccataacactgcttaaaccaaataatgtgattgccactacgatggcaaagctggctcctgcgttgacgcccagtatacccgggtctgccagagggttacgtgtcagtgcctgaattaatgcccccgcgccacctaatgccatcccgaccaaaataccgacaagggtacgaggcaggcgcgattcgagaataatgatgctctcattgttatgcagctcaccggttaaactattccagacggtctcaggggcaatatatttactgcctaataacagactcgctatagaaaaaataatgaggagtaataaacagattatgggaccagttaaccgacgggtgcgataagtatgaaattgaggcaagggttttgaagaggttatctcacgatgcattggggcagcaggcataaccggaaagactccattcgttattgattgtgataatcatttgtattgccattatcattaacggtcgatatgctagcacagctttttctggaaacatatttatattgcggcaattaagctgcgaagatcacttatttcaattcctgtttacgtattgcatggagcatcatggctaagtcatcaatcctgctggacttcagtttacttaaaaataatgcacacttccgcgctatctttatcgcccgtatgctatctgtttttgcattaggcatgctgacagtgggtgtcccagttcaaatgcagtttctgaccggttctaccttgcaggtagggatcgtagtggcattggatgggatcggcatgtttatcggattgatgctgggcggaatactggccgaccgctatgacaggcgtaaactgattctgtttgcccgaggcacttgtggcttgggttttgttgcattgagttttaatgcgtttttggattccccttcactgtttgtactctatttcctttccgtctgggatgggttctttggcgctttaggcatgaccgctttaatggcggcgatcccaaacttagttggccgggaaaatctggctgcggcgggtgccttgagtatgatcacggttcgcattggtgctattctttcccccgcattagggggtcttattatcgttgccagcggaccgggctggaactttgccattgccgctgcagggactttggctacactgatcccgctggtgagactgcccaagatgaagccacagtcaaccctgcaagagcatccactcagagcgttagtgagtggtgtccgatttgtctgtcagcataaaatcgtaggcagtgtgatattaatcggtatgttgatcagcatggcgggggcagttcgcatccttttccctgcgttatctcaagaggtttatcaccaaggtccttccgcgacaggtttgatgtattcagccgttcctctgggtgccatgctaggagcatttaccagtggctggataggacgaagcgcccgacccggtcttttacttattatttttgcgctgggctctttcctcgcattatccctgctcggtgtcatgacgcatattgtcccggcattactcgcattggtgtgttatggctacctgaatgcttttgcttccttattgcagtttacactcatccaaagtcatacaccggatcacttattggggcgggtaaatagttttgtcacagcacaggatgttaccggtgattccttgggagcattgggattaggcgtaatgggacgcctgttatctcctctcataacggcgctttcgtttggttcttttgcggcaattacctgtctattgcttgcagcactggtaaaacctctgcgccattctactctgcatgataatgccgcatcattagagggcggtgcctctgaaaagtgaatatgatgcagcaatctttgtttttttgaaccggctaattttttaattcttgatttgagaaatagtgttcaatgcgatcaagcatattgtttgcactgtaatagtctaagcggaaagtatccggccccatcgcatagaggcgttgggtgctgacagcaggcaggtgctgtaaaaaagggttagcattcacagcttgaattgtgctgtcattggtagcgaacagcataaaggattggccgtttaaaccatctgctaacccttcagcagaaagctgaatgatatcttcacgtttgcccatactggtttctgttttcaggctggtcggtaatgtggcgagtgtaaaacctaattgatgcagtaattgcccttgtgcagatgatggcgtccaaagattgacacctctcccatcagcataatagacaaatgcagaaacaggattcgggggtaaggtgatatcttgtttcactttctgcaaacgttgctcaaagcgcgcgatgatttccccggcaccagcttcattcccggttatttgcccaagttgcagggcaagctgttgccagctcttatcgccataatcaataaccagtatgggggcaatggttgagagttgttcatacagtttcatggctgaatcccctcccgtcgctgaaataacaatcagatctggcaccatagccgcaacagcttcggcattgggttcactgatatagagaagctttacaccacgttcataagcgactttggcccattgaataaaaaagccttggctatcagccacatcagtatttgggcctgttgcacctgaagcgattaaaggggcattgatagccagcaaagtgccactgagcgtcacgctggtagaaacaatacgcttaggtggctgtgttaatgtgagagggccttttactgtttcgaaggttcgtggccagcccgccatgctggtggtttccccagaaggttgaggatgtccggatttaacttctgtcgatttttcatcgcagccactggtaagaattagtgcgataaaagcaaaaataacggtgattaatcggtaataagaaaaagtaaatttgcactgcatttttaatttccttaatcatcagagcgtaaatggaattctggcatgggaatacccaaaactttcattcgaactatttgaataaagggaaagagtacattttacccagaagtaagggacacattacgcaaccataaatgaaaatgggaattattaccattaaatatgatcattttttacagaggcttacccattaattctatatttactcttcaaactatttatgacgaatatgtttttgctgtgcgttatgatgtcggtattgccctttgcgcaacatacagatcaattcaatccctgccaacacggtctgagctcgtctgaagtttttgaaccccagcataggatgtgttcgccatttgacgttgcggtgatcctgttcaatcagattattaaggtacttattctgccggataaggatgtcgttatccttcggttttccctgatttaactcgtccactgcggctttattggcgccacttttatcaatcgtcaccccgtcgggttgtccatgctggcgtatggctttcttaaagaaacgcaaggcgtcctccttatctcgatgggctgtcaacaaaaaatcaaccgtattgccatctgaatccacagcacggtaaaggtaacgccattgccctttgattttgatatcggtttcgtccattcgccaccgacgcccaaccgtaggctgactccgccgataacgtttgaccatcaacgggatcagacgatgaactcagcgggaaagcgtggaatgatcgacggcaatcccacattcagccataatttcttccagattacgcaggctcagcgcgtaggccaaatacccgcgaacacactgagcgataatatcaacaggataatggacgcgtttgaacgcttttcggataagggacatcggtgaattactcaacaaaaaagcggcatgatacccagacaccgcttaatacgacagaacccgtgaaaataacaccggaaaccaaaaatggataaaatagttaatttggcaagacttaaatcctgaacaggagataaattttttggtgaatcgactcaatatcgtcccgaaaaattcgaggtaaaaaaacaccgaataaattattcaagggaatacgaacgtatttcctccctgattaataatattgcaattattatgcgaaaacaaaattatctattatgaaatatcaattcaacatctaaaatatatttattaaacatcgaaacggcgacagatatcactatttaaaataataatatcgctgacaacaatataaaaataattattcaaatccatctatatttattatttactaccttattcaataaaaccacgtccgggaataattaattatttccggacgtggttttatcaacacttccttatattacaaaatattactcacgaccagtcctcataccccagctctgtgtctgttgctgtaattgccataattcatgatataagccttgtctgtcgatcagttcgctatgcgttccttcttcaacaatatcgccctgatccatcaccacaattttatccgcatattgtatggacgataatttatgcgcaatgaccagaaccgtttttcgctgaattaatgattgcattgcgagctggatctcacgttcattttctggatcaagagaggccgtggcttcgtctaaaatcaccagaggggcatcttttaataatgctctggcaatcgagaggcgctgcaattctccgccggaaaggtgaacgccacctgcaccgatataggtatccaaaccttctggcagtttgttgagcagtggtaatagctgcgctgaacggcagacggaaagtaattgttcttctgtcgcatctggacgggcaatttttaaattgttggcaatcgtgtcattcaacatgtagtttttttggaaaacgacacttaaaaaacgctgccaatattctgcatccatctctgcaaggttaatgggattatgttgctcacccacccagatattaccctgctcgatatcccagaaacgggcaatcagtgaagccaatgttgatttgcctgatcccgaaggcccgaccaaagccgtaattttgttttcttcaatcaacaaattcaggttgttaaataaagccggttgatcgggataagcaaagccgatgttttccagtctgatccgcatggcggtgatatcgggccgcaagtttccctgagaaagttcaggtatctcaaacactttttggatacgctcaacggccaagccaaaataattcagttcggctaaaaacatcgacatgttcaataacgggcggaaaaaacggacggcggcgatcagaaagaccaatacttccgccagggagagcgaatgccccagccagccccatgtcaacgcaaccagcagcacaataaagccacattccaccagcagattaaaactgtatatcggccatacacctgctttttctgcggttaatgattttttatacgtggtgtccaagacttggttgagacgctgaaatgcaccgcccaccatttggtaggcttttaattcctttaagctgtcaatatactccatcaacccatcatttaagcggaacatccatgattgcacacgcgtctgccagagacgggcataacgacgggtgaggaagtaggcacagacggctaatggcaaggtggataacatcgctaatgccatacgccaatcttttaacagcaacccaaaagcaaaaaagcagagcacggatacggttgcaatcatcggcgcatacaggtgagtgaagatccgctcaaccatatcaatgtctttcagcagtgtgttattgacactgctcatctctgaacggtagaaaaaacccatcggcaaacgccgtaaatgttcccctaagtgctttctcaatgacgcgccggcattaaacccaatcaatgacacattgaaatagaggatccgcaccaataaaatccgtatcagcatcaacacagcacaggcggcggccaacataaattggtaatggatatccggctgggccgagagcatatccagaatgatgtaatagagaaatgcgtaaggcgcagaagtcaggaaagcgtcagcgatagcaacgcagaccatacttttcagccccttgagcggaacaccgattaatgcggttaataccgagaatttattcatgaatcaccgcctttggccgtgtgatgaaatgccattctttcgctgcctgatgcgctgaccacatcttttggtatagagcacaatgggagagtaactgcgggtgggtgccttccgatacttttttgccttcgtccatgaccacgattttattaacgtgagtcagagtattcaggcggtgagcaatcacaataaccgttttatctttgatcagcgcagccagcgcctgctgaatacgcgattcgttgcgcgcatcagcataagccgtcgcctcatcaagaatgatgacgggggcatttttggctatcgctctggcaatggcaatccgctgtgcctgacctccgcttaagatttccggcctgatgacagtctggtatttttccggcaatcggtcaataaaatcatctgcgcaggccgcttgagccgcggctttgatctgctcttccgacaatgcctcattgcccattctgatattgttaaaaaccgtatcctcaaagatgaacgcatcctgaaaaacaaaggcggtcaaggacatcagttgttcaaggggcatagcatcaatcggcgtatttcccagcagaatctctcctgattgatactcatacaaacgcggtatcaactgtgccgcagtggtttttcccgcgccggaaggcccgacaagtgcggtgatctctccctgctttgccacaaatgagaactgattaatagtctgagtttcagagccgggatgatgaaaactcacctgattaaagcagatgtcgtaattatcgatcgctacccattgtttgccttctttctgtgcaggcgaggtagagaactcacggatattctcaacacctttgagtaaatcgctgaacatattggcaaactgagacaggttatacagcggctccatcaggccaattcccaacagcataaaaataaacaggacagataatgtcacctgcccgtcggcaaataaccagatccccacaggcataatgcacagtaaccccaattcaagggaaattttaaacagtgccgtcgctgtacgggtatcccgtagccagttcgtgaccagttgatggtgttcattgaccgcctgtgtatagcgctgatgtgaattgacggtcatattaaaggctttaaccagcggcatgcttttcacgaaatcgacaacgctggtatgcagatccgcaacgacacggtgataagcgccgatgcgttgattgaatcccttaaacatccagccctgcatcgcaatggctaccggcaaaggcagtaaagccattaatgccagacgccagtcaaagaaaaatagcagaacggccgcgcccacgggggtcatcaccgcggcggccatatcgggcagatgatgagcgacaaaggtttcgatccggccgatatcatcggcaataattttcttcagtttcgcactggtatgttgatggcaggtgcttaatggcaggcgcccaacccgttctatcacctgcttgcgtaattcaaacagcaattggaatgcagcctgatgagatagcagccccgatgccagttgtagcaggatttttcctattagtgccaacgccgccatgatcaccatccaccagacatgttgagcggcgatttctggctgattgaggaaatcgacaatcaattgataaacgatcacataaggaactaatgccagcagcgaataacagatagccagaaacatggcagcagccagccgtttatgctgactactgaccaatttcattaaccatctgaaggcagtttgttgattttccggttctttacctaccattattctctctccgtaatgcaacggggttcgtcaaatccgcggtaagagcggcgactgtagcggaagcagacgattgtcaatagaaccacggcaaaaccactggccgcagccaaagtaaatgcttgtgtgaatcccaaatgatgagccaataaaccggtcaaaaccatcgccatgctactgccgagaacttcgcagcactgcaatagtgtgaaatccgtgcctggctggacgatggtgtgatctttttcgccttcactccagcgcataaaccaagagaaaagagaaacacagcagaggttaaaaaagaaaccttccagaataaagaacaggaataccatcgtcgggctttttgccgaggccatgagggataatgccgttcccagccagcagcaggcgcttccggtcagcccgaatacggtcaattgcgggctggagaaccatttatgcagaataccggacgataccgctccggcgatataactgataatcagcacgccgccggatattaacgcaatcagttccagattcacgcccatatcaaccagcagtggcgacactaaagccacgcccatcgtgctggtaaatttgaaacacagtgccatagcaataatcggcaaccagcctttgcgacggaagattttccacaatgacgccctgcccggtttaaccggcagttgattgtcttgcgtgaagctaccctgatggcacataaacggcagatggcaaataagctggattaacaggaatgacagcacagtcatatgccaccctgccgcactgaagatatacagactgagcacaccgcccaataacatgcccaaactgaaccctgcgatctggctgacgttcacattaacatgccggctaccggcaaacacccgaacggccaaagcatccaccgcgacatcctgactggcgtagcagaagttgataatggtgattaagaccaataaaccgataatgtcagtgtctggagaaaagaaccacagcaaggcggccagaagcagggataatcccttaaataactgaatccagcctacccctgcggggagtgagccaaacccccacggcttatggttttcaatccatgaagcccataagaatttaaacgcccacggcagcatacttaaacccaccagcccgataaactgcatatccgctccctgcgcccgcaagatgccgggtaaggcaaaaatcgcaaaccctaaaggtgcaccctgcccacaatataaaccaaataaactcgcaatattgccgttatatttcattgttattttctttcccttacttatacgttcatcactggctgatttttatttgccaaacattgattgagaaaatcaaagagtgatcccctctggtcattcagataaaaatgcccaccggaaaacacgttcagttcaaatgttccactggaaatttgacaccattgcctgaaatcactgacagaaacttcactgtctgcctcaccaatacaggcaatcaccggacaattcagtcgctgttcgcagcgccgctgataagtttctatcgcggcaaaatcagcgcgaaaaattggcaccagcagcgatttcagctcaggctgccggtaatccatatccgcaccttgcagcgagataattttgttcagcagtgtttcttcgctctggcgataaaaatcggtaccggtatttttatgcgggggaagccgtccggaaacataaaggccagcaatgctttttccctgccgctgcatcctcagggcaacttcaaaggccaaagccgcccccatgctatgcccaaaaaataccgttggacgggcaggcagaaatgaacacgcagccgcaatctgatccgccatttgatggagatcgtgcaacaagggttcctgaatacgggaaccatgccccggaagttgaacggcatagacagcggtatcatctgcaataccatttttccaaggcataaaatactcggcggttccccctgcatggtgaaaacagaccatttgttgatgggtgccggatttaatcaatctgaaagtgcggtcattcatttgctttactcctccctctcacttttccatttagataaaaaacgcgcgatctcaggtgacgccatcatcggatcagcaagggaaacgctttcagggttgcccgcttgttccatcaaggatttccacgcgttggtcagcgatagcaaatattgtgcatccgcgggtgccgacgtctggcattggccggcaaattcacgcagtgcatggcgtaccgccgatggccaatgacgatttaatatgtcctgcaaattgtcttgatgataattgtcttcatgatttgagaaggactgattcaggggcggtagaaaatagtccggcgctaattctggcgcaatcagttcacgacatcccgatgccgttttcactctgggaatatgaaaacagttattccagataaccggcccatgagtattcgccagcagcaggttgccgctgggtaatcccacacagatgcgatgcatgatatgaaaatggttatcgggatcggcaggatcaagctgattttgtaaattcagcgttaagggaacacctgcaatcacaccgcgcaattgggtataaggcggtgtgtggttcattaagccgagcaatttattgtcatagctttccggttggctgaacccacagggggtaaagcggccaaagatacggccaagaatatccaataatccacagataacctgaacaccgcaggttgcttcgataaacagcgcctgctgggtctgcaaggcttcccgcagataagcaataaattgacggacagccggcacatgggggtaatgggtattgacctgataaccgcagccatgttgacgagccagttttaaacattcagccacgtcacgcaggtaaaccgggtgttcctgcaaaacagaaatgccccgttgtaataacgctcgggcaatttcgctgccttttccacccacaatcgcggaacgaatcacaacacaggcgatatcaatatcatcgggtagctcatcaacacggtgataaagcggtacgccgtaagcctgtgccaattgttgcgagcgttcgctgccctgcgccagaattcctgccaattcaaatccggcaaatgcacttttgaaggcagaaaggtaaacctgcccgaacagggtgccgcagacgacgacttttaatggctggctcatatttccccctcctgaaagagcacgatttcatcgtcaggcagaaaatctgagctaaaatggctgaaaagagacaattcatctaattgggtcagcaaggttctgatgttgatgatatccggcagccagtaaagccctgtcactggctgtttcagtagctgatgagccgccagtgccgcaatgctgcccgtcagctgatagctgttgttaaagcggatttgaagtctgagcatggtcggctgacctgccagtaagccatgcgcttccatcagcagatgctgctgctcaccttctttctccacaagctgctggctcaaggttattaagcgttgaatcgcatcggcctgatttgcaggcgcggtcagtaacaaggttctgtccgccagtaggttatatgccgccaaatgagcaagtgacagtttttgcgcgactctttcctgttcgaaactgaaataaggcagtgcatcaaacattctttctgctgttgagatagacttagttttttctatccccgctctgataagttgaccgccggagaggatatatcctgttttgccctgctcccgctccggttgctggctggcaaagaaatcttgtgccgatgttgcggtaaaggcttcgataccgcctgtatacaggcggattttcgagactggctgcaagtattccgcagcatataagggcagcattcctgccagccccggaataaaacctgcgcccagcacacaggcagaacgacacggctcttggcgcatggcgatctgttgtaagattttcttctcaaccgccggatcacccgcgacatcaacataatggacgcccgcgttaagtgccgtttcggcaatcacatcttcaatcagtgaagccggcccggcggtattgagcactaaatcggcctgttgacagcagtgagctaatgccgttcggtcaaacagatctagctgataataatcgtgatattcagggcgctcagtgcgccccgcaatcatgacccgatagcccagtcgggaaagtacgtcaacggcggcacgtcctacggcaccctgcccgccaatcaccagtacggatttccttgtcgtcattctgcttccctcattttgccctgttcaatatgatgcaccagcggatcaatattgctgacattcatgcaattaaaatgatcgccattcagatcgagataggtgacatcgccaatgcagttggtctgccagaacgtcttcatatcctgctgcaaggccggtaacaggtgggtatttccctgctggcaggcaaaggtcatgtctccggcaaaatattccggctggtagccacagacgccccgaatactgtggcggaacacttcaaccctctgtttccactgggtctggctgacgtcagattgagccgatgcggttccctgaatagcagccaataactgcgataagcgctggtcttcgggttgctgctgaacttgtgcatacgcggccgccagttgatgtaacccttttgcgtgagcacgctgcgtcacgacatcatgggtaatgacatccggcttctcagccaaaatttcctcataaatcgcgtcaagttgggttttctcaaatggccacgggctggcaatgcccagcgcccagacaatcgacatatcgatcatcaggctatcttctatgcgataggggatctggtaactgctgacaaccgttacggatctgaccggtgtcaggttttccatcgcctgtctggcaatttcgaatgtcagcagcccgcccatgcagtagcccacaagatggcaatgcggtgatatcgcctgaatttcctgtaagtaatgggcggccagttgtgggatcaggttgtcggccggaatggacaggaatgcctcaatatctcccacgctcaacccatacactggccctgataatttttcgaccaatggcagataaggcaaaatggtgccgctgccttcatggagaataatcaccggctcgccatcgcctggtttcaggcaggtgacgcgggtacgctggctctgctgagtttcctgctgttctgactggctgcgcaaatacgcggccagtgccctgactgtcggctgttgcagtacctgccttaagctcccttcccagggaacgtgatccgcgcccagtgtttcccggatgcggttgatccattgggtaattaacaaggaatcgccgccgctggtgaagaaatcatcatcagccccgatggccggattgccaataacttcgcgacaaagcgtcagtaaggtcatctccagcggatcatcggtctgcggtgatactatctctgcccggttttgcgtctgatcaggcaaggcaggaagccgtttgcgatctaacttgccatttgcggagacaggtaaggcatccaggatcgccagtttagcgggaaccatgtattccggtaattgatcccgcaggctggccagtaacgcctgaggttcacaatgctggcgacgtgagttgaactgcgccagcataaaactttgccccatctgatataacgcgtcatcagcaggcggataggcccaaacggtttcgcctcccacatcgtgcagcgcattcagccagttttgctgcggcataaatggcgaatccaattcaagccgttcatcggcaaactgggttaagccgtgcttaaattccatcgatgtcattaattgatagttatcgcgggtggcttcaatgatcagcatccagccaccgggagtcagaagctgtcgcagattatccagtccctgacgggcaataatggcgttgtgcagcacattggcagaaataatcagatcaaactggccgcaatccagcccctgttccgtgggtgactgattgaaatcaaacagctgatagtgaacaaaatcaaattgttgataacgttttttggcttcattcaggaagaaggttgaaacatccgtaaaggtatattcgacgttccatccggccaaatgcgggatcagcacattacttgtcccgccaacacccgcgccgatctccagcactttcaggcaacgatgctgttgctgatttacttcaatcgcttttttctcggcggcactgatcaataagcggttcatgaatttgctgatcaaattgttctgataagcatgggtcgcgacgtcaaggttgccatccgggaacagtaagttaaggggatcttctttcccctgtagcaattcaggtaaacattggctgctgcgttccagataggtcaataaaccgcgatcgtcatccaattgcgccatgagccgttcgcattgctgccagtcgtcattgatctcgctctcagagaccggtttgattaaacggtaatgatcgcctgtctgttccagataatcgtgctgtaccaacgcgcgcagccagcgtcgggttagttgccggttttcttctgcaatgttgcctttctgaatgatttcatcaagggttacggtttgatgcattggcaaggtctgcattgctgataaggctttcaccatctgcatcaatgccacctgatccaataagaagaacagtttttcgatcagtgccttatccagcgattctgcggtttgttcagctatcgcgcggatctcttgcactgcctgtcggcaataatcggcgtgctgctggctttgaggtgataaagccggcaattgggcaggttctacgtaagcatgtaattcagcctgatgtttatcgccggatttaatcactgccgcctgagcaacaggcgaggacttcaacaacaatgcttcaatttctcccgtttccacccgatagccacggattttgacctgatgatccattctgcccagaaattcgataacgccgtcaatggcatagcggccaagatcacccgtgcgataccagcgcacgccgttagcgtcagtgaagaaatggtgttcggttttctcttcatcgtgccagtatcccagcgcaacccctcggccgccaatccacaattcccctgcgacccaatcagggcaatctgctccctgaggatcaaccactctgaattgttggttggtcagtggaatgccgtaaggaatgctggtttgataatcgacctgcggatcgaccggccagcagtttgaccagatcgctgcttcagtcgcgcctcccagactgagttgcgcggcattaggtaacgtctgcgccatcgctttaggcaggctgacgggcagccagtcgccggaaagtaaactgtagcgcagcgaaggcagaacgagattttcggctgacaaatacgctgtcagcattttcatttgtgccggtacggagttccacagggtgatttgatgctgtgccactaaatgcgcccatttagccggattctgtaaatccccctcatcaggaaataccagcgttccacctgcacccaataccccaaacagatcaaaaacggataagtcaaaactcagacgcgccagtgccagcacgcaatcatcggcgctcagggagatcctctgccgcagatcgcaaatcgtgttgtaagccgcatcatggctgatcatcacgcctttcggctgtccggtactgcctgaggtgtagatgatatacgccagatcctgcggtgtgatgctgacaggctccagacttggcagatcgggatacgcctctgatcggtgaagattgagggcatgaaaacccgccgccgtaagtttagtttcctgctcttcttcccctgcaataatgacggtttccacaagagcgtccgacagaatctggacgattcgcggccacggctggcttgcatccaccggaacataagcgccacccgccaacaaaatagccagcgccgccacaacctgcgggtggcctttttccagtaagatggcataacgccctttacccgacagttttttcgccagtttctgcgcctgatccaccagttcgccgtaagtcatcacgcgctgagaatcaatcagcgcagtggcttctggggtttgttctgcctgacgcagaatattgtgatgaagcagcgcgggttcaatcggctctgcggtggcattgacctgctggcgaacctgctgctgttcttgtggcaacgacaaggtcagtgaatgttgccagaccgtttcatcggtaataacctgcatgacggcatcaataaatgccgcaaacatggcgtcaatcatgccagccgggaaaatatcggccaggacatcccagttaatgcgcagccctgactggagttccatcacctgacagtcaatccagacctgtggcgtctgactgatgccgtagctaaattcaatgtccatctgtgaggcaataatcgcttcctgcgcctgcgttttgccctcgcctaccaaagcgctggtaaacaccaccggcatttttgcctgttctttacctcgctggcgtacccattcgcgaatcacttcgataccggaaaaggcgttatgttccagatcctgccagagccgggtctggatctgttcgacacgctggcgcaacagacgggagtcgcgcaaatccacttccagcaagctgacggaagtaaaatcgcccactaattttgctatctccggatgcgcatcagggcggttcatgaccgtcagattcaggctgaaatgacggctttcagaccatttggcaattgcttcactaaatagcgtcaacagtaacgcggaaggcgaaacgccctgtgactggcagatgcgctgtaattccagccattgctgaggcagaagctggtagtcgtggcgaacaaattgcggggtgtcctgcaattccgtgcgcaaaacaggtaattgcgggcaggcgggcagatctgcaatgcgatttaaccaatattgacgtgactgggcataatcacgcccgtgcttctgctggcgctgatattgaataacatcacggaagctgatcgctaacggagcctgatctagcgtcttgccgctgtatccgttcagtaattcagccagtaagatctggacactcaggaaatcggcaatcaacaggtcaatactgaaatgcaggcaggctttgccattgacctgactgacttttaaatcaaacagcggccatgtgtcaggctggtatacccgatgcgacatagtttcacgcagtgattccggcgattgcgaaaccgcctcaatagaaaaaggctccacataaggcaagatcatttgctcaccgttgggcatgattatcgctcttaacatgccgtggcgagcaataagctggttccacacctgctctaatttattgatctcccaagccggggataaaatctcaaaatagccatgacagccgacaccgccatattcgaacaagctttgacgcccgacaaaataagccgcctgtacatcgcttaatgggaaaggtttgtgctgcctttcaggatggatcaggaattggctgtgatgctgccagtttttcaataactcaataagctgaggcttgagtgactttagccgggaaataatctcgggagtcatgacgccttccggcgccctgaattttaatgtttctccctccagccaaaaacgagcctgtttattttcaagactgaaaagaagttcggtagcctgatgctgcatttcctgattcatagtgaaccttcctcaaattgaatatctgcttcatccatgaatgtggattcaatggtctgggcgatgtgtgaaatagtctgtaagctaaatattttccacagcggtaattcaatgccatgatgccgacgcagtgccgacgttaaacgggtagcaatgaaggagtcaccgccaatggcaaagaagttgtcatgaaaattaatgtgcggaatgtctaataagagtttgagctgatcacagagaagttgctccgcttccgttaacggacgtgtggtttccacggcacggacataagggtgcagcagggtttcaagtgcctgatgatcacgcttgccgttatccgttaaaggccagcgctgacagtgaccaacgcgagtcggtatcgaatattccggcagtttctgacgcaatgcgtccatgatatcgccccaattcggttcatcgtgggacatcacaacggcagacaacaatggacgatcatgttgttgagtgacaaaaaccaaagcgtcttcaatatcagggcaggttttcagcacatgctggatttcttccagttccagacggtaacccgaaattttgacctgctgatctttgcgtcccagaaattcgatcaccgcacccggacggtaacgccccgtatcaccggtacgataccaacgctgtccctgatggctgacaaactggcgttctgtccgttccctgtcaccaaagtagcccagagcaacacctttcccgccgatccagagctctcctgttacccagtccgggcaatcttcattgatttcattcacgatgcggaatgattgattaggcaaaggaacgccgtagggaacagatcgccagccagaagccgattcatcctcttgccactcgttggctaaccactcatcggctaaacagtagttagaccatatggctgcttccgtcgcgccgcccatcgccacacactgagcatccggtgcgaatgttttcaggcgctgcggcaatgccggagccacccagtcaccggataacatgactaagcgtaaactcgccagcgcaccgtcggtctcctcatgttgctggatcagcagcgccatttcgagcaaagcaggaacgctgttccagaccgtgacccgatgccgactgaccagagacaaccaagcagcagcatctttttcctgctgctctgcgacggtaattagcgcaccgccaaccgagagcagcccgaagatatcccagacggaaagatcaaaatgcagcgctgagagggcaattcccctgtccgcttcatgcagatgatgctgacggtttaccgcttcaatggtattcactgccgcaccgtggctgatagccacaccttttggtattcctgtgctgcccgaagtgaaaataatgtaggcaagatcttctgatgtcaccgccagcggttcaggacgcgatgcggaatcaggctccccttgtacagacagcaccgtgaccgtatccggccatgtcagtgcagggtgactgatgacgtagcgtatttctgcttgctcaatcacctgctctctgcgatataacggccattggcttgatagcggcacgtaggccgctcccagccattgcacagccagtaacgcgatgatctgttcaccactgcggggcagtacaatacctaccaaatctttttctctgacgccctgctcggtcagatactgcgccaattttctgaccgcctgctctagctgctgatagctgattacgctatcgccctccaccagtgccgttcgcggggcaaatttctgcatcgctgtagctacacggcagtgcagcggagaaaaatcaaacggcgcgcgggtttcattcacctgctggcggctgatttgctgagaggcaggcagcggtacagccaaaggaacatgccaactttccgcatccgccagtttttccagtaactggcaataagcactgaacatctgatcaatcatctgggcaggaaacagcgcttccaccccatcccagttgaaatgcagctcgccttcccgctcaaagacctgatgatcaatccagacctgcggcgtctgtgatattccccagatcgaagcagggaaatcaacatcaggataatctgtcacctgcgcgcccaaagcgctggtaaataccactggcatcgtgacatccgtggttccacgctggcgattcagttccctgattacccagacggcggaaacatctgaatgttccagatcctgccagagctgctgttgagtccgctggacacgctcaaaccaactttcgtcctgatattgctgacaggccagtaatagcagagaggtgaaatcccccataatatggttgatatcaggatggcaaggctggcgatcaaacagcgtcacgttgatcgtcagagccgcagattcagaccatttcgccagtacttgcgcataacaggtcagtaacaggcaagagggcgtgatttgatagctgcgcgctttggcggccagtttttgccagcgagccgcgggcagaacggactgccagcgtttgaattttggcgtccccagcgatttaggatcgcataccagaggcaaacgcggcgcatcaggcaatagttccaatctttcacgccagtagttttctgagttgttctctgattctggtttcagatgcgttgcagtcagataatcacggaagccgatatcaaccgacggcaaatcaacggcggcattggcataaaaaaccgccagctcggtgaagaagatctgcatactgaggccatccagtatcagattatccaatccaaggcagaagcggcttctgccgtcatcggactgaatcagtgtggcgtggaataacggccattgtgccggctccagcacgcggtgtgacagatattcccgctgggttgcggtaacgatttcccactcatcagcacgacaagaaatcatcgtgagtgctgatgaaggctgctgcgccagaacccgctgagcgccgtgttcatcaaatacgatgcgtaacgcatcatgacgggcgaccagttgtgaaagcgctttttcaagcctgatcggatcaaatgccgttccctcattcccgtgatattcatactcattgtaataatgcgtggcgacgccaccgagatggaaccccgcctggcgtcccatcaaataagcccgctgaacatccgtgggttcaaacggcgcataacgcagttccggctgatgaattaactgagctgacggcgatactttcgcgctgaatgtgatggaactggcaaaatcacgcaacacgggcagcgagaagatctgtgccagtgtgacatccaccacgccttctttttccaactgagcgacgatgcgggttgcatgtaagctatcgcctcctgacaggaaaaagttactgtcagcctgcggcacaacacccaatatctgctgccatacccgcgcaacgcactgttcacgctcatcagataaagccgctttttccgccggatcagtaaatatctcaggtcgtacagccgccgcttgtgccgccagtgcattacggtcaattttgccattggccgtgagcgggaacggcgttaatgacgtgatctgcgcaggcagcatatacaccggcaaatactgccgcagatgctgcatcagtgtttcacggtggatcagtgttttcgcctgtcggcactggcagataaacagcatagaatgaggctgaacagctttgacagcatggagaaccagcccggcatcgctcagggtttgctgccagtcctgctgattgagtagcggtgaaaacgcacctttgcgctgatcgctaaagccattctgatcttgcaacaataatacggtcagcaacgccagtgggctgagtgtcagactttcatacgcataaatgagagaatccgtgccacagagtaatttgagcgcctcgattccctgagcaatatcgctaaaccgatgcaaggcattgttggtgatcacaatatcggcagagaataccacctgctccggcgccgatatcacgtcaaccgtatgctgatagcctgccagacgatattcagccagttttctcagagaacccgccgattccatcaggcaataatggacgctctccgctttcagacggctgaggagataacttgccagtatgccactgcggccatttaattcagccactcgtaccggacgttgtaactgtgccgataagctttcaatttgctggcaaagcgcatccgccattgccagcgtatccggtgaataagcaactaagttctccggcgaaatgaccggattatccagtaataacagcggattttcattgcccgttaagaccgccaccagccatgtggctttctgttcgatggcatgatggatcgataataatctctcatcatggatagccaatcggcgttgttgccaacgtgcagttgccttgaaacggtctgaatgacactccagcattttctgttcaaccagccacgccaaccaagcgccaaatagcggttgccattgcgccgtaatacccgctttttccagtaatacttcgctggattgacagtcagtaaaatcaagggcaaaaacatcggtcagaatatgatgcagcagatgacttgtgatttctttttcatcatgacgctgatcaatggcagtgatgtgatcgggcagttcgctcatcacagcataggctggcgcggttaattcacgggagctgtgctgttctttgccttcgataaatagctggatatgtttttgcggcttatccaaaaacaaggccactgcatgtttaacctccgtcaaacgttcggcaaccgcttcaatttcgccgagttcaatccgataaccatgcagctttatctgcctgtcctgacgccccagaaattccaggcaactatctgaccagaagcggccaaagtctccggttcggtaaaaacgctctcccccttggatcacaaactgcgcggcggtcttgtcgggatcagcgtaatagcccaatccaacgccttgcccgccaatccatagctcacccgttacccaatccgggcaatcccgcccctggttatcaacaacgcgataatattgatgcgccagaggatagccgtaaggaattgaattccaatgcgacgggatcactgaaacgtcgatggcattcgaccatatcgccgcttcggtcgcgccgcccagcgcggtaaagttcgccccgctgcccaaagccctcaaacgcggtaacagatccagcccgacccaatcgccggaaaggaggatctggttcagcgaagcaggcagccctcgcggttcctgttctgccgccaccagcagcatttcaaacagagccggtacgctattccagtgcgtgacctgattctcatgtaacagagcaagccactgcttcgcctctttttcctgtcccgcattcggtaaaacaagggttccgccgagggagagagggccaaaaatgtcatagaccgataagtcaaaattcagcgctgataacgcaaaaatagttatgcgctgcttttcgttattttgactgacgctataacggaaattgatgtcatcgacggtattggccgcagactgatgtgagatcaccacgcctttcggtacacccgtcgagccggaggtgaaaatgatataggcaacatcggaaggatggccgaaaacaatccgctcaatcgggagcatgttcgggctttttgcggctatattcagccagccataatcggtttgatcgtcctgtatttcacactcttgatgaccaataactaaacggatatcagactggctgataatctgctgcaaccgctgcgctttgattgcaatatccagcggaacatacaccgcgcccacggagtggcaggccagtaccgccacgatttgctcaacgcctttcggcagcagcaagccaatatgatcgccatgctggatatgtcgatcctttaaacgccacgccagttcacgcacctgttcactgatttcctgataagtcagggcgatcccttggcttatcaccgcaatattcgtcggtgtcttctctgcccagagccagaattgctgatgtaaaagccggggagccaacggcgggattggctcgttttgaggcgggtttctacgcagtgctaatcgcgaaggcgcaatataggccgtgaccggtgcatgtaataccgtttcatcctgaactatcgccataatcagtcgggtcataaagctgaacatctgatcgaccatgtctacaggaaatagcgtatcgaccgtatcccaactgatcagtaattcctgttgatgctccattacctgacaatcaatccacacctgcggcgtttgagaagtcaggtaactgagtgtgcccagtgttttttcactcaacagatcccgcccaaggttactggtgaagaccacaggcatagtcacctgctctccccgctgctgtgaccagtcacgcaagacctgcaccgcactgtaatcagcatgatcaagatccctcatgaattgctgatttaaacgacgcacatgggtcagaatgctatcgtccgcctgtgttttgcaggccagcaataacagtgacgtaaaatcagccaccagcttcgatagctccggatgttctccccgccgattaaaaatagtcagattgagtgaaaaatcaggctctttcgcccagcctcttaaggtttcagcaaaacaccctgccaataacatggagggggtgacaccataacggcgggcgatattttttaaccgaccccaactttccgcctccagccgccagttacgatggctgaatttctgttcattcaattctgcgggttgcactgccagcggaagttgaggcgccaagggtaatcctgctgtaacacgttgctgccaataggctgcatgttcagtgttattgacgttttttaaatcctgatccagcaaatactgtgggaaattgtaattcaggggagtgagtgacaattccggctggcgaataaattcgctcagttcatccaacaggatctgaaggctcatggcatccgctatcaccatatcaacattgatatgtaagcaagttccctgagcactgtggctggcaattaactggaagccactttcttgagtcagatccgccattcgatgcgataactgacgtcttaagttcatacgctcggcagaacaggcttcatcagataaatgtaaccattggtgactgctaacagtaaccggctgatcatcgcggatcaccgccaatccctgctcgttaatgcgcatccgcagcaggtcatgccgttgaaacagcttgttgaccgcctgattgatggctgaatctggcagtgaaacacagtccagttcgagatagacctgacaggccacgtcgccaagcacctgcccttgttgccgtccttgccagtaagcctgctgaacagaggttaatgcaaatggctcaccattccaccggccggaagaaaccgcaggctctttttgtagctcatgagtcacatttatgctctgccaatactgccgccatgctgacaaagtggtgttttcgaacaatttcgcgagcgtcagagagacattcagtttcttgcattcgtccaccagatccagcatctgcaaagaatccagccctaaattgagcaagtcttcatcgtcagataatgtactgatatcgagggataacgtgtctgcaacccatgaacgaacaaaatcaaaattcaggcgactatgctctggcaatagcggctggttttctgctttatcgccatcaccgattaacagcgcttctggccagtaactttgtcggttaaaaggatacaaagaaggtaaaaacactgacggtacgccatcagtcagattttctgagcgtacttccggttttctcagtacgactccggccatcgtgccggtaaaactgaacgcattcaccgcgacccgattgatctcgcaagaaaccgtttcacgctcaaaatgataatggtcaaaatagtctgcaattagcggattgcattgggtaaaggtaggatggccaaaggctttctgctgctggatctgcgccactgcccgcacaacggcacacaggccggcagcggcttccaagtgacccgtctggcttttgcttgcccctaaacgcagtggcgtttttcgctgaccatatacggcattgatggcgctgatttcgatgggatcgcctaacgccgtccctgtaccatgcgtttccagtaacgaaatatcctccggcgtcagtgctgcatcggttaataaccgtgtcatcatagctgcctgagctttgggattcggggcggttaagctgctgctttcgccgtcttgtgcgacaacactgccttcaatgacagccagtacgggatcaccatcagccaatgcctgttgataaggtttcaacaaacataaaaccgccccttcacctctgacataaccgtcagcttcacggctgaatgtggcacaacgcccatgaggtgacaacatacccgcattaatcagggcctgttcaatttgcggtgacagtaagagattaacgccgcccacaacagccgccgagcactgtttttgttgcagggcattcatcgcactattcaaggcgacaagggaagaagaacacgccgtatcaatggtcaatgccgggccggttgttccatagaatttagccagtcggccagacgtcgcactggtattgatccccgtcgccagataacttttggcataatcagggttattctgctgcaacaacagttgcccgtattcactgccactctgcccgatataaaacccgatatcgcgctgtttgactgccttcggcaaccaatctgtctgttcaaacaagtgccagctcagttctaataggatgcgctgctggggatcgagtaatagcgcttctctatcggcaatattgaaaaaatgggcatcaaacttttcaatattattgattgccccgattggctgaacaaaatgacgataacgactctgttcatgacgtaccgcagattgccctgctgccagccatttgccatagtgctgccagtgttcatcggtctgcccgggtaaacggcaactaatggcaatgattgcgatttccttatccgccttttttggctctgccaacgtctcattggtgttgatttgactacgatgctgctcaatataatgggctaattgggctaaagtcggataagcaaataaatccgtcaccctcaatttgtagtcagaatatttgccatcaaggtactgattgactttttggcagaattttaccgccagcaggctattcagccccgcatcactaaaaccgcgatggggatcaaatgaatcaatgcccaataaatgacacagtgtttgctgtaacccgtcaaaaaggggtgaagacgttattgcggcagatttttcttcagcagaatagatcgataccacttcaagctgatgcgccagatattgcgataacatatgacgacgacggattttgccgcttgaggttttgcttaattttccttttgccagcagaaccacgttgccaaccatcaattgaaagtgcttcgcgacttccgccaccatagatttagcaatcgaatctaattcatcgtgattaagatggcggtaaacttccgccatgataattaattcgctattatcaaaatcctggcaaacgcaaattcccccgatttttacgccggggcagaaacgttcaataaccgtttcaatgtcattgggcatatagttttgaccgcccacgataatgacatcttttaaacgaccacaaataaataactcaccttgatacaggaaagctaaatcgccggttctcagatagtgattgcctgagtgatcgcctgccagcgtgtttttaaagaccgtttccgtcagcgcctgattttgccagtatccccccgccgttgaagccccattgacccatatttcaccgatctgcccttccggcaatggccgatgggtttcaggatcaacaatctgtaattgccactgatgagcgacctgacctgaactgattaattcccgtccgtcaggagaggggatagctctgccttttgccagctcttctgcattaaagcgtctgctaacatagtccgtgccaatcggtttatagctaatgactaaagtcgattcggccatgccataggccggtgtaaaactttgcggatgaaatcccgttgccgaaaaccggcaagcaaatcggttcatcgtttcggctcggatcggctcggcggcattcatcgccattttcacagaagacagatctaattgtgtaatccactcatccgtcaccattgaagcgcagagctcccaggcaaaatcaggagcagctaccgaattggcctgataatcatgaattatttttaaccagcggaaaggctccgaaaccagatgaacaggcggcataaaattgcagcatccccctgataacagaggcaataacaacccgcagaacatgcccagatcgtgataaaaaggcaaccagttagccgtgatgattttcggctgacaatgctgatgtaattccagcaatatttcatgctgcacccgcatgttgtcatcataattacagaccgctttcggttttgcggttgagcctgatgaatactgaagataaacgggagcatcactattatgacaaagtgagagatgataaagtgcgtgatattcttcctctgtcgggaatacctgctcagaatcaacaagagccgctatgactttatcgacaaaaattaattggcgatctttattccagcctcgttccgcaatttcatcggcaaaatggctgaaagtcagaataaactcaggctgactatcttcaataatatggtcaatcgtttcactgctacgattaatccgcaaatgactcgctaaatgtacaggaatagccgatatgccacgaataatacaggcgataaagcttatgacaaatgatgagtcaccgggcattaataataatgccgaagactgcttttccgatcttagcgttagctgactggctaatttgcagccaagcgataataaatcctgataagtataaatttcggttttatcttgagtcccatttgtgtttttaatgcagtaacgtaaggcaataccttcttttgcctgttccgcctgcttaaataaagtatttcttacccatcgggttgaattttttatactattcatcgctattacctgcaattacaaatataccggagacttaaagtttattgggtataattaatttgtgattgaataagggctttatgtattcacataaagtccattcaggacatagctcgtgtgcttcaaaaaaataaatggctgccactataattcgacagccatagttaatttattattggaatttaatatttacattcacgccgaagttcattccttccccggcacgcgcataccattttccatcgtccatctggaatgcacgggtagcatatttctgattaagcgcatttttaacccacaatttcactgcatagtcattggtttcataaccggcaccaagatctaataagccataagcagattgttttttgctgttactgttatcgaaataagtctttccttttacattgtaatcggcacggacaaagtagccattgaggaagttatagtcgacacccacaccataagtataatctggtgagttagccgggcgattatttttgtaattcaccgcggcaaacttaccttcagtggttttgatttcggttgggaaatctttgaagttagcatgggtataacctgcattaacagatgccgttaagctacgcgtaatacgccacgccaattctgattcaatcccacggctgacagatttaccactgttgacggtataagacagtgggtaagaagccacttcaacctgctgatcttttaaatcaatccagaagaatgaggtattccagcgtacacgtttatcaaaccattcggatttaaagccggtttcatagttggtggtatattcagctccataagaacggctggattttggccctagggtattaaagccaccgctcttgtaaccacgcgaaacactggcataagacatgacattgtcggtcatgtaatagttaacgccaactttaggtaaccaagtatcaaatgacaggcggttattgtcttgggattcgcccatgccactcagtttaaagtcgatatttttcttttcgtagtcatagcgaagacccgcgactaactcaacattatccagcaaataatagcttgcattaccgaacagcgcgtagttatctgtttttatatcagagtcccttaacatcgagaacttattggggatattacgataatcaataatatttttgtctttctgatggaatgtataagcaccaatcaaccagttaaaggcgccctcattttttgaatttaaccgaaactcttgcgataagtaattcgtttttctcttcatcagtaactcactgatggagtttttggtaaaatctaaatcctgattatcaattttcttttcatcggtataagcactgattgaagtgaaatcaagattatcccaagaatagacggccttcacctgacctttataagaatcaacattgactttaccaatataattggaattaacgtatttacgcccttttttgatatcatccaatgcggcaaaagacatgttgccgttacggcggttctgcatatcaaaagtcgtaatcacatcccagttataatcggatggctgccagcgcagttttaaccggccgctgaagtcacgattattatctacgttcttcttaccatcataatcacgtttaaaatagccatcgctataaaggtatttcagagcggcacgataagcccaatcttcactttggtttatactcccgcccagaatggcatttgcctgcgtgcgattataattaccataagaaaggccgaaattatattcaggtgaaaaatccgggtctttagtgatgacattcaccacacccgcttcggtattacggccgtataaagtggcctgtgggcctctcaatacttcgattttatcaatatcgagtaattctgaatcgtaagtattggtattcacaccatcaatgaaaaagccaacagattgctccccttccataccgggagtaattccccgcatagagaaaaaaccggcatcagatggattgcctgcctttaccatataaaaattggggatacgcattattgcttcagaaatattttcaatattctgccgctcaagatcaaaatcagttaatacactcatactgacaggtgttttctgttgttctgttttgattttctgcgcggtaacggtaatagtgtctaattcaatcttctgatctttttcattcgtttctgcaaatgaattgaaaggaatagagattaaagctgccagcgtcacagcatcccggttaaatatcatcatccatctccatgaaaattaaaaatctcttatctaacaatctgttagttagatgatatttactcactttatctaaataacaacatgttttgatgagttatttattatccagtcaacatttaataacaaatttaataacaaatttaataacaaatttaacaaaaaaataattcaataattataataatacttaatgccatatattttctttatctaaagcgtcggcattaaaacacaaatgattctcattcacaatagttagtagtaacaaagcgaaatcacccttattcatttcagggatatgtataccaaatattagttattaatctttatggggataaatctgatatgttagatttttttattatgaatgataaaaacgcgtatcaatatgcccgacagacctattaaaaaaatactaacgcaaatctgaatacttcaatttttctactaataatctttttcttatttgagctatttcaggctcaattttcccatccagaataaaaaaaccgccgcaataaactgctcaaaacacacagacagttcattccggcggcctttacgccaccattaataaatcacttaattaatatattaatgcagtacggctaccgactactcattctctgtctctatatcttcctgagaggggtttccgatggaagtaaattcatccagcaacgctaaaagctgggccaattttgctggagaaaaagcatcctcaatcgccttataaccctcattaacctgccctctggcctgttcgtaaagctcctgaccagccggtgtcagggaaacatacagcttacgctgatcgttcattggctttaggcggaagataagaccatcacgttccatacgcgtcagaatgcccgtcaagcttgggcgcaagatgcaggtgagacaagctaagtcatgaaaatcaatcgaacggctactcgcaagtacgcgaataatacgccattgttgctcagtcaagttatagcttttcaaaataggacggaaaaaacccattgcggtttcccgtgcctgaagcaatgcaattgtcagggattcatgcataagtaaaggtgactcttaagttaaccactagtcattctctataaattgaacgcgtacgctactcattatagacaacataaacgtcaaaaagactaacatggtcataattatctacaaagggaaaagaattcaacattaacaaataaataaaattattttgccaaataaaagttaaaaataagttaaactcaatgccaaatgaccttatgaattaagataacaatttgatctttctgtggcaaaaacaatcaatgccagaatgatgttacatagatcacaattaaaattaacaactatattaacatgttgaacattgacggcagttgatttattaatatattaacaaacaatcttgcgatacgtcgttcaggtttcaaggagttgttaatgaaaggcactgtttttgccgtcgccctcaaccaccgcagtcaactcgatttctggcatgaggcatttgacgagctaccttataaaacaccaccaaaaactccaatttggtttattaaaccccgcaatacggtgattggctccggtgatattattcctcatcccatcggggaaacggtacaaagcggtgcaacgctggcactgctgattggcaaaaccgcccgtaaagtttctattcaggatgcagagcaatatatcgcgggttatgcattggccaatgaggtcagcctgccagaaacttcgttttatcgtcccgctatcaaagcaaaatgccgggatggattttgtccaataggccagataatcacaacaaaatcagtgaattcactcgaaatcatcactgaaatcaacggtcaggaagttgatcgctggtcaacccgcgatcttatgcgttctgctccggaactcctggcggcattaagtgattttgccacgttaaacgaaggcgatgtcatcctgctcggcaccccccatcagcgtgttactctccaccctaacgacaccgtcacggtcaaagctgaaggttttcctgcgttggaaaataccgtagtttcggaggatatcgttttggaaggaatggcgcaggcaggaggtcagtcatgagacaagccagagttcgttatcagaatcaagaaatgagtgtcatcgtcgatgaacaggaaaatgtcctgctgtctgatggatgcgtcgtcagcggacacgatgttttgtggctccctcctgccaatggcaccctgttcgcattggggctgaattatgccgatcacgccacggagctggaatttaagccaccggaagagccgctgatcttcatcaaggccgccaatagcctaaccggccatcgtcaagtttccgtccggccggacaatgtggaatacatgcattatgaagcggagttggttgttgtgattggcaaacccacccgcaatgtttccagagaacaggctatggattatgtcgcgggttataccgtctgtaatgactacgccatccgtgattatctggaaaattattaccgccccaatctgcgcgtgaaaagccgcgatacgctcaccccgataggcccgtggatcgtggataaaaatgaaatagccgatccccataacctgatattgagcacctgggtcaatggggaattacgtcaacgcggcacgacggcagatctgatctttgatattcccttcctgattgcctacctgagcagttttatgacactacagccgggagacatgattgccacaggaacgccgaaagggctgtcagatgttgtgccgggtgatgaagtgattgtgtcagtcgaaggtgtcgggcgtctggtgaatcacattgtcagccagcaagaatataaggagaacctgtcatgaccaccattaatcattggatcaacggcaagaacgttgccagcaacacctattttgaaaccaccaatcccgccactggcgaagtgctggcacaagtggcatccggtgggcaggcagaaattgatcaggctgttgcagccgcaaaagaagcgtttcccaaatgggcgaatacaccaatgaaagaacgcgcccgtctgatgcgccgtttaggggagttgatcgaccagaatgtacccgatattgcggcgatggaaaccaaggatactggcctgcccatccaccagacgcaaaatgtgctgatcccgcgtgcttcccataatttcgatttcttcgctgaaatttgccagcagatgaatgggcggacttatccggttgatgacaagatgctcaactatacgctgatccagcctgtcggggtttgtgcactgatttctccgtggaatgtgcctttcatgactgcaacgtggaaagtggcaccgtgtctggcgctgggcaataccgccgtgctgaagatgtctgaactttccccattgaccgccaaccgtctgggcgaactggcgctggaagcgggtattccggctggtgtgctgaatgtggtgcagggatatggcaataccgcaggcgatgcactggtaaaacatcatgatgtgcgggcgatctcgtttacgggaggaaccgcaactggccgccggattatgcagagtgcgggtctgaaaaaatattcgatggaactgggtggcaaatcccccgttctgatctttgaagatgcggatattgaacgggcgctggattcagcgctgttcacgattttctccctcaatggcgaacgctgcaccgcaggttcccgtattttcattcaggaaagtatctaccccgaattcgttaagcgttttgctgaacgcgccaatcgcctgcgtgtaggcgatccacaagatccgaatactcaggtcggcagcttaatcagtcaatcgcactgggaaaaagtctccggctatatccgtctcggtattgaagaaggggcaacgctgctggctggcggccctgataagcccgccgatctgcctgaacatctgaaaaatggcaacttcctgcggccaaccgtgctggcagatgtggataaccggatgcgcgtggcacaggaagagatcttcggccccgttgcttgtctgctgccttttaaaagtgaagaggatggcctgcgcatggcgaatgatgtggagtacggcctggcgtcttatatctggacgcaggatgtcagcaaagtcttgcggctggcgcgtaacattgaagccggcatggtgttcgtcaattcccagaatgttcgcgatctacgccagccgttcggcggtgtgaaagcctccggtaccgggcgcgaaggcggggaatacagtcttgaagtgtttgccgaagtgaaaaatgtctgtatctcaatgggagatcatcccattcctcgttggggagtgtaattgatcccagcgttaaccacggttcatcgtcctgatatcaagtgaggatttatgggaaagttagcgttagccgcgaaaattacacatgtaccctcgatgtatttgtccgaaatgccgggcaaacatcatggctgccggcagggggcgattgacgggcacaaagagatcagccgacgttgccatgaaatgggcgtcgatacgatcatcgtgttcgatacccactggctggtcaacagtgcttatcatatcaactgtgccgagcacttctccggcatttataccagcaatgagttgccgcattttattcgcgatatgacttatgaatataacggcaatcctgaactcggccggatgattgcggaagaagcccgccagatgggggttcgcgctcaatcacatgagatctccagcctgaaattggaatacggcacattggttcccatgcgttatatgaacagtgaccgccatttcaaagtgatttcaatttctgccttttgtaccgttcatgcctttgaagacagccgcaagctgggagaagccgtgttgcgggcgattgaaaaatatgatggcatggtagcagtgctggccagcggctcgatgtcacacagtttcattgatgatcagcgcgcggaggaagggatgaacagttacacccgcgagtttgatgagcagatggatcgccgcgtggtgcagctttggaaggaaggtcagttcagggaattctgcaaaatgctgccggagtatgcgcaatattgccgtggtgaaggcaatatgcacgacactgtgatgttgctcggcctgctcggttgggacaaatacaacggtaaggtggaatttctcaccgaattgttcgctagttcaggaacagggcaagtaaatgccgttttcccgctatccgatgatgcggttaatgaacaaaccgccgaaaaaatcagagcctgacaggagcagaccatgccacatttttacgctgaatgtaccgaaaatatccgtgaagccgccagattaccggcgctgtttgccaacgtgaatcaggcgctggccgatacgggaattttcccgctgggcggcatccgcagccgtgctatttggctagatacatggcaaatggcagatggcgaacaagattacgcctttgtccacatgacgctgaaaatcggcgcaggacgcagcctcgaagatcgtcagcaagtcggcgaaatgctgtttacgttaatcaaagcacactttgccgatttgatggcacagcgttatcttggcctctctttcacaatggaagaacttgatccgatactgaattataaatcgaataacgtgcatcagctgtttaaatcaaaagattagacttaacgaatggcataattcagcacaataaagttcacctttttgcttaatgaagagaaaaccatgacaaatcatctagagacattactgctgcgccaacaggcttatatcaatggtcaatgggttgatgcgcataataaaacgacttttgccgttaccaatcccgccaatggcgaagttattgccaatgtcagtgatatgggttccgcagagacacagcaagccattgaagccgcccagactgcccttcccgcatggcgagcattgactgccaagcagcgcagccaaaagctcaaacaatggttccagctaatcatggataaccaaaaatcgttagcggaactgctgagtgccgaacagggaaaaccccatgcggaagcgatgggagaaattgcctatggtgccagttttatcgagtggtttgcagaagaaggtaaacgcatttatggcgaaactatcccatcaccgatgccgggtcgccgtctcgcgaccatcaaacagccgattggcgttgtcgccgcgattacgccgtggaatttccccaatgccatgatcacccgtaaggttagcccggcactggccgctggttgtacggttgtactgaaacctgccgcagaaactccactgtctgcgctggcattggccgttctggctgaacaggctggcattccggcgggtgtcctgaatattgtcaccggtatggatgccaaagtgattggcgaaacactgacttcaagccagatcgtgcgcaaactctcttttaccggctctacccgcgttggcaagttactgatggcgcaaagtgccgataccgtcaagaagctttcccttgaactcggcggcaatgcgccttttattatttttgatgatgcagatcttgatgctgctgtggaaggcgcgatggcgacgaaattccgcaacagcgggcagacttgtgtctgtgccaaccggattctggtacaagaaagcgtctatgatgcatttgctgaacgtctggttcatgccgtcaaacaacttcgcgttgggccagcccatagcgattcatcacaacctgcgtcacaacaagggccgctgattaatcaggctgccgtggaaaaaatacaggcgcatatcagcgatgccgtttccaacggcgcacgcattctggccggcggcaagtcccacacattgggcggattattctttgaacccaccgtgctggccgatgtggatggttcaatgcgggtcagccatgaagaaaccttcggcccactggcgccgctgttcaaattccgcgatgaagaagaagccattcgcctcgccaacgatacagagtttggcctcgcggcttatttctattcccgcgacattggccgaatttaccgggtggcagaagcactggaaagcggcatggtcggcattaatgaaggtttgatttccaacgaagtggctccattcgggggcataaaacaatctggtctggggcgtgaaggttcgcgccacggtatcgaagattatttagaagtgaaatacctctgttttgggggattgggcgctaaaggagcttaacacgctatgcaacagcagctacagcaagaagtcgtatcacaggttgcacgccgtttacatcaggcagaaaaaaaacgagagcagatccggcaaatttcactggattacccagagataacgattgaagacgcctacgccattcaacgtgagtgggtcaatctgaaaatcgcggaaggccgagtactcaaggggcataaaatcggcctgacatcccgagccatgcaagtcagttcacaaattgaggaaccggactatggcgcattactggatgatatgttttttcaggacggcagtgatattccctgcgaacgctttattgtgccgcgcattgaggtagagctggccttcgtgctggcaaaacctcttcgtggcccgaactgtacgctgtttgatgtctataacgcgacagattacatcattcctgcgctggagttgatcgatgcccgctgtcacaacatcgatcctgaaacccagcgcccgcgtaaggtgttcgatacgatttctgataatgccgccaatgccggtgtcatcatgggcgggcgtcccatcaggccggatgagctggatctacgctgggtcagcgccctgctctatcgcaatggggtgattgaagaatccggcgtagcggctgcggtgcttaaccatcccgccaatggtgtcgcatggttggctaataaactggctccgcatggtgttcagcttgaagccggtcagatcattcttggcggctcctttacccgcccggtgcctgcccgcaaaggcgatacttttcatgtggattacggtgcaatgggttcaatcagctgccactttgtttaaggccagacgttaaagtcaaagtttgaaggtgagtcagtggatctgttaaccaatagatttaaacaagccctgcaagcagggcatccacaaatcggtttatggcttggcctgtgcagttcatacagcgcggaaattctggcaggaacagggttcgactggctgctgattgatggcgaacacgcgcccaatcatatcccctcaatcctgacccagttgcaggcgattgcgccctatccaagccagccggttgttcgtccaccgtggaacgatccggtgcttattaagcaacttctcgatatcggcgcacagacgttgctggtaccgatggttcagaacgcggagcaggctcgcgaagcggtgcgcgcaacccgctatcctcccgcgggcattcggggcgtaggcagtgcgctggccagggcttcccgctggaatcgtattcccgattatctggctcgtgccaacgatgaaatctgtgttttggtacaagtggaaactcgcgaagccctgcacaatctgccggaaattctgaccgtcgaaggtgtcgatggcgtgtttatcggccctgccgatctcagtgcggatatgggctattccggcaaccctcagcaccctgaagtcaaagcggccattgaacaggccatccgtcagatagcggcatcagacaaagcagcagggattttaatgacccatgtcgaaacggcggaacattaccttaatctgggcgcacggtttgttgccgtcggggtcgataccactttgctgacaacagcggctcactcgctggcggtacgcttcggcaaaaaacaggagaatgtaaccccgccttcattgagcacttattaactcattctgattactgataaataacaccacaatcggtattcctacatggcagatgtcgatcgccgcatctgccagcacagtgatagttttcatgccagtttccataaaaacgcgacacgcatcgtataataaaaaaggtaacgacaatgagcagcccacctgaagccatacaagaaccagagaacccggcttacccacctcaaaaactcacctaccggcagcaaaatgtcatcaacaaattgttccgacgcttgatcctgtttttatttgttctatttgtgttttcctttctggatcgcatcaatatcggctttgccggtctgacgatgggaaaagatctcggcctgtcgtctacgatgtttgggctggctgctacgctgttttacgcaacttacgtgattttcggcattcccagtaacgtgatgctcagtattgtcggcgcccgtcgctggatcgccaccattatggtgctgtgggggatcgcttctactgccacgatgtttgccattggcccgacaagcctgtatatcctgcgtatgctggtaggcattgcggaagcgggtttcctgtcggggattctggtctacctgacttattggtttcccgcctattaccgcgcccgcgctaatgccctgtttatgatcgcgatgccggtcacaatggcgtttggctcgctggcctctggttatattctggaaatggatggcatctgggatctgcgtggctggcaatggctgtttttgctggaaggcttcccttctgttctgctcggttttgtcgtctggttctatctggatgactcaccggaaaaagccaaatggctgacgcgtgaagataaacagtgtcttcaggaaatgatggagcgcgatgaactttcgcaggtacaatccaatggccctgccagccccaaaaccagcctgtggcgtgaagttttaaccccgattgtactgatgtataccttcgcttatttctgcctgaccaatactctgagcgccattaatatctggacgccgcaaattatgcagagttttaatcaggggagcagtcacgtgatgattggcctgctgacggccattccccaattctgcactatcttgggcatgatttactggagccgccgctcagaccgtctgcaagaacggaaaatgcacaccgccctgccctatctgttcgcagcggcaggctggattttgacctcactgactaaccacagcatggtgcaactgctggggattatcatggcttctactgggtcatttacggccatggcggtattttggactacgccggatcaatccatcagcctgcgcgcccgtgccattgggatcgccgtcatcaatgccacaggtaatgtgggttctgctgtcagcccgctgttgatcggctggctaaaagatcaaacgggcagtttcaactcaggcctctacttcgtcgccgggttgctgattatcggggctttgatggtctcatttatcccgatgaagcaaacgcagcgctcaggagataactattgatgccgacctctaacacaagcaaagccattattaccaatattgatatcagtaaagactatgatgaaacgcagggatctgacgatgtgcattatcaaacttttggtcgcatggccgcgttctttggccgtgatatgcaggcgcatcgtcatgatggtttttttcaacttcactatctggtgaccggacggattgaactgcaactggatgagctacgttattcagtacaagcaccgctgtttatcctaacgcctccttcggttccccacgccttctttacgcaggaagataccgatggttatgtcctgacggtacgtcaagcattgattacgccgctgctcaattcgctctaccccacccatcgggaactggttgatattccagccatctgcctttctgtggcagataagcccgatgaattggcgacattcaatcactattgggcgctgatcgggcgtgaatccgccaaccaattcgcaggacgtgaacaatcactggcatttctggcgcaatcactgtttacctttctgctgcgcagcattctccttgatgatcatcgctctggtggggtaagaggcgaactaaaactgtttcagcgttttaaccagttgattgatcagcattatcatcagcatcttgctgtaccggaatatgcggaaaaactgggaattacggaatctcgcctcaaagatatgtgtcgaaggtttgccaatcggccacccaaaaaattgatttttgaccgactgttacgagaatcaaaacggttgctactgtttagtgacagcccggtgtttgaaattgcgtatcagcttgggtttaaagatccggcttattttacccgtttttttaatcggttaatggggtgtgcaccgagtgtttggcgggagaggagtgtgggtgggggggtgaaaaacaccctgcttttgcctagtgacacatctcgcatttaacagccagcactggaacacatcgtcaattcttggatcagtcgttgtgatcattgccaacgagccgctcttaaaagaacaaagccggaagataacgcggatctttccggctattagatttcatcaattataatttgtgcattgctaattgaagtttttcttttagttcaaatacattacttgctgaatctaaataaacaggattttcccagttaaagtctttaattaacgccaatttaaactgtccatcaatctcgaatgagggtctccagcctatgtctaaaagatatccattaggaaattctacctgcaacatatcttcttttaattcatcaagttgattctcaaacggaatatcatcactaatagaaaaatcattaaaaatgatcatcccacttttttctgaaaaatcaatgttcattattttgtcagcttcctaaattcgtttagagagattggatgtccatgaatagtaccgccgctatattcaactctcatccattgacttggtttaccttcactagccccgataatttcccccatatcttgaactttccaaggtttaccatttgtaaccggttgacctgtcttataaacagagcgttctaatgcttcaatgttaatctctggcgtatatttagcaggcccagatttcgttgatttgacaatatctttccaagacatattcttctgagggaaatgcttaaatccatgattagtccaatctggatttaacaatttatcgcagtctttacccgccaatccttacgggtcaatccatcctgtcggattatgcacatacccgtaaggatttcccctccccaacagccctatcgggtcgggcgaaatatactgcgcggtttccggcgaataataccgaaagcggttatagtataacccgctctcctcatcctcatactgccccataaaccgtaggttacagctaacatgataatccggattattggaagcgatgacctgcgatttctccgctttcccccacgtggtcagccgctgcgcccagaccagtaccccttcctcggacaacatttcgcggggcgtgccctgatgatcactgacaatatagtgcagcttgcctttttcaacacgtgctgacggcgttaatgaaccgggttcatagagccagcggatgcgttgatcttctactagagtaccatcggcgtaaatcggtgtttcttcgataagctggtcaccactccacaggtaatcctgtcccatgatggcatcggctctcggcgttaaatccggtttaccattcagccagcgctgtaaattggcggcagtcagcttaccatcgtgcactttcagcttccgaattcttctgccaaaagcatcgtagcgataatgccagcgcgatccatccggtgtttcacagtgggtgagctggttttgggtgtcccagcggtagcgccagatttgcgggcggaatccgtcacgttgttcggttttttccaccagacacccattgtcatcatagcgataacggatatccccttgctgcaccacgcgcccggctttctgacgctgtgtaatttgtgccattgcgccgtaggcatctacaggcagatgttggctcaggttaccgttagtatcatagctgaattgctcttcatgcggacgcgccccctcgaacagagtattcagtatttggtcattggcattgtaacggtagcgggtttgcccccagcagctgtcgtcaatcacccgtacattatgagcacggtcatattgccagctccggttaacggcggtggcctgtggcgggaagtgcgggtcgttttgcgccagcgtttcccgaaacagtggggtcgtctgccccgccgactggtgtgtcagcaggccggtggcagtgtagcgactggcaaggataaacccgttggcactttcccgcacggtttcctgccccagtgcatcatgctggaatgtcagtggcacatgctggttaagctgaaagtgattcagacttcccgacaggttataaccaaagtgcagggtattgccatccacactttcactgactggccgcccggtcaggttatcccatttacgcgtgatttcccgcccgttgatacgttcacaagtcggtaggccagtagttttgtcgtactcatactcgacggtagcatcggcatgagtggctttcaccaattgataccgttgattgtattcgtaagtggtggtgtctttaagcacccgttggttttcttccggctgccagctttcctgtttaatcagtgaaccggcagcagagtagtgccagcggagttgttgaccatcgggatattgtgcctgaatgcggcggcctagcttatcgtactgataatcaatagtacgcccggtaaaatcagtttcccggataatctgacccgccacatcccgttcataacggtaggtttcgccagtggaagcggtcactgacttcaagcgggtcagacggtcatagccaaagcgcaagatagtgccatcgggtcgggtcacctgattgagcaggtcaaacgcgccgtaagtgtagcgggtggtacggccctcgccgtcagggtcatgctcccaatagttagattatccttgcaagatagtattcacgctcaatgaacgttccgatgattttgtcatgcaggatttctgatttagagtagcagatcgttttccgattcagcctttttattcgagtacgcagggtcagattcattctttcgatgcgttgggtaaatttctttcctctgaggtgagttctctcaggaaggcaatcataaacagcataattatcagtacaataatactggatttcaaacgatgccagaagcgccaacagtttttccagcgtttttttactgcgatcgccaaatacatgtgcgatgatttgcttctggtttggttcccacgcataccagagcccgcgttgattcttcttgttgccgacaaatgacccctgctcatcaatttcacagataatgtgaatctcacttcctgccagaggccgtgttgttacttgtctgggttcatgttttttaacgtgcgaagcacggtattgatcccgacgttcaaaacacgtgcagtgtctctgatcccgccgttatttatcgccatatcagtgatttgttctttcactccgggtttgcaggcttgataggtgtaattcagttggaaggttttacggcaggcataacagtgataacgcgggtgcccactgcttccttttccatgccctttgacctcctctgctttgtgacaataacgacaaaccacatcaactttagccatatctcaccagtaataaaaaatggaaagtttactacaataatctaactattgggagcatgaccgccgtcagtaaccgccaccacgcgccgttcactgtcataggccagttgctgcgtggtgccatccggtagttccacttcggtcaggctgccgttaaggctggcgtgggcgtcgctataacggtagtgagtctgctgcttgagggcatcggtgagttggcgcagatgacccaactcgtccagttgcaaattggttgtctggccatctggcgtcaccaccgccgccagccgctgctgttcgtcaaaggcgtaatgccactgacgaccatccggcagcaggcgctgacgtaattcaccgtgggtgccgtattggtattcttctttgtgccccaacggatgagtcagtgccgtcagattaccctgctcatcatagtgaaattgccaacgctcacccgtcggccggacactttcgatgagctgcccgtgttcgtcataaccataggcgaaagtttcgcccgtcggcagcttcacttcggtcagcgcaccgtcagggttgtaatcgaatgtggttatcccacctgcccgatcggcttcccagacaatttggctatggcgccactggcggcggataatgcaccccagcggatcgacttcacggacaaccaacccgttgtgatcgtaatggtattgggtttcaccgccttcgccgtcccgataggtggtgatacacgcctgatcatcatagtggaaatggtcacaccagtaaccgcggggagaagtggtgctgagtacccgtccttgttcatcataagtcaggcttaaatcggtctggtcggtatcgtgccagcggatcatccacccctgtgcgtcgtattcatgccacaggtggttatgctgaaacgcgtcacattcatgcaggtaaccttgcggatcatagtgacaggtcaccagccgttgttgctttttctggtcaagatagtctacggttcggaggtattgattctgataacccagaatcagccggaaaccatcggtgcgcgtgacttcaatcagttgcgactgtttatcgtagataaaccgaatcgcgttctgacggcgatcggtgatcgcggataatttacggatagatccgacggcatgattgaagtggtaggtaagctgggactggcgatcggtcagttgcagttcgccattcaactcaccggtcagcacgtaatgaggaatatgctggttacgggcgagcacctgattttttggtgtgctgaaatcgtagatcacgccgtcggcatcggtgaaatttaccttaccattgacccgtttcaactgacgtgaccagtcatccgcccatttagggccaaacaagccgtttaagttagctgtggagcgataagtacgggtcagggtaatcggcaataatccggggatagcaataaccggccagacttgcaggaagtcaccggtagccatatcgacaggttcaccttccgttttacaagtcccgttgcagcttccgtctttgtcggtagacttgttatcaacctggtcttctttagcgttttggggtttatcgtgtgaggacgtggcagttttcgactattggccttcgattttggcaccttctacggctttggcttcctcagtaagcacttttctttcagctttggtcgccgcagtactgactttgttggcggcagaagctaattcagtcgcgccctttttgataacgtcgattttcctggcaggcaaaccaatggtttcgagaacctgaatatcaaatatccccgcttcttgtgcccggttgctggacgtggctttccagtcatccagattaaattccccactttgctttttctgaatgtctgcgacttcacggaccgtcttcgctttttcggtttcgccatagatttcaagccaccgggctgtatcctccgaatctttggcgccttcaaaataagccccctggatataggattctgctgtgccaaccacggtattataggcaccttttagctggcctttcgcccgctcaagcggatgttttatcccttcaacatgattaatcgccttctcatacgcccaatcaacgacgctgtctttggcttccaccattgccgcccacgcttttgcccgccaacttttttctgctggtgtttctgcttgaggaaggggattggcttcggtcgcgggtacttgcgctgggccggcctgagcggtaattattccgggggtgttccccgtcccggtcggactgtcatcgcgggctttggccggtaagggggaattgggttgagggtattcaggcccttttgttttttccttttcttcccactccttcagcggaaactcaccgcttttgaatttgtcaacggcatcctgtgcggtttttttaaaatactgctcttcgaattttgcgtcttcgtcattgtagtattcatctaattccggatcgtccccgtaagcaccataatatttgctgctttgtggatagagcgtatcgaccttgcccagtgcggtttccgcctcagcctgtgtccgaatattaaattcctcacaaaattccttgcctgcataaacagtgggtgtcacaaccagcgtcgaagatttttctgccatggtttccttccttatgccccgttcatccaaaatttatccccgtgacgcagcaccagtttgttgccagcccgtaccgtcttggtatgctcctgcggatggcatttaccgccgaccgtgccgcttttgacaccattcgccacaccgggctggtcaccgatggtggtggggacaaaactgcgggcaaacaccaccaccggcttgccattggcacgcacggagggcaccggtgacgagctgtccgccagttttgctaccactggataaggtatcgggggcgttgaggggcccatcggggttttacacacgtccggcagcatgccgacaatcatccagttgcccgcagtgcgggcgatgtagttatcagccatcctttttctcctcttccaggggtgccagtttaagcaacggtgcctccgggttgatttcaaaccgcgcttcggcaacccgtacaggcaggtcggttttaaaattcagtcggcaggtcaggtacagtgttttagcgtcgctgtcgagaattaacgtgtcagggcgcatcgggacgggcagcaacatgccgttgtgcatccgcagcagaataaacgggcggtgtcccggcaaggtgacatgtaggttgccaccgggggtcatgccctgcaagtgcagcgagaggttggtttccggccagtcgatctgctggtcagtgggggcgccgttccagtatctgaagtcgaagtctttgggcagataagggtgacgatgctccagccattcagcatcgtaagtaccggcaagctggcggcgaggcagccacggacggccgataaagcccataccctgcggctggcaggccggcgtatcaggcgccgacgtaccactcaattgagcggtaaaatgctgcgcggtgaaggggacatccggccggataatacgcggcgccgggtaacgggtgagttgtttggcgctggcgtaccatggcgtgataaatcccgttcccagcggattggtttcacaaacggcatgagcagcaggcgcatttttcccgtctgaatgctgctggcgctgttccggtgtcagacgatcactttccttgaggtattcgttcgctttatcatctgcctgaattttgcattcaccaccaaaggcatagcgataatccaacggcagcgttgcaaaaggtttcgggttggttagttgccagttgccatccgcatcgcgaataaactcccgctcgccggtcacagtcagggttttgtcgagcaggatctggccctgcttggtttgtacctgcaactgcacgggaaattcggtacagggtttaccttccggcgcatacgccgtgccgttgacaatcacgtcacagcgcggtttaaacggggcaaggtcactctcctgcaacacctgtgaggcattcatctgtccacggtattcatcctgtaaacacaagggaggcgcgggcaataattccgcactgtattccccctgtccggtaggcagtagctggtagccgattttcatgaccgcgacgtgatgctcggtatcttcgatatcgagcatctgatagttcatcacggcaaagggagtcaggttacgaaattccatctcagtctgtccttcttagttcaagtcgatgtctttaccggtgatttgcaccgggccactggcttcaaatttgagctcactgccctgaagggtgatacgtccggcactgtccatgcgcaacacactcaggccgcagcgcagctcaattacatcgccggccgtgatggaaagggtattggtgatggtctctgtcttgtgtgcaccgacttcaataatgtagttctggccggtgatcagtttgcgcacctctttcaccgtttctgtactgttaagtgtgaccgtttcctctttgttctcattgaccttgatggtttggtttttctccacggtctcggtgtggttggcgatcacatgggtatcgcggtcgttgagcaccttggtgtacatgtctttttgcgcgtgcagtgacagccgttcgctgcccttggcatcctcaaacagcagttcgttgtagccctgtcccttgtgagttttggagcggaacgccatctgggttttgctgcccggcaaggcacccggcgggatgttgctggcatggtaagtacgcccggtcactatcggctggtcggggtcgccgtgcaggaaatccaccaccacttcctgtccgatacgtgggatggccagcattccccagccttgccctgcccacggttgagtcacccgtatccagcaggaactctggtcgttggatttgccgtagcgatcccacgggaattgcaggcgcacgcgcccgtactggtcacagaagatttcttcaccggctgggccgaccaccttagcgatttgtgggccatcaaccaccggtttggacagcggagccgggcgccagttctgattctgacggatgaaatagaagtggctgtgcagcgtggtgccgctgtcgccggttgtcgtttcaagggcacccggctggctgccgctgtggctggtggagacggtctgccatgactgattcaggtctgcccggggatggttatcaaggataaacagcttgcccggctgcagggttatcgcattgccgctgccctgtcccatcattgcatcgctacgcagcgcttccagccggtagcgggtaaaatccttgccatgtgcttcgtccttgaagcgaccggggtagtcgtagtgctcgtagtacagttgttgcagattttcgtcccgcatctgttggtgaaattccgccggccacgctggattcttgaaggtgtaatccttaagctggacctgcgccggccgcacctgtgcgctgcatgtcaagctgctgatggcaggttcacccccggtgctgacttcaccgggctgataagggatcactatgcccggcgggactgaaccgcagtcgtcggcaaagaccagcgtgttgcgcccgttactgcattcgaagaagtagaaaatgccctcttccgccgttaaccgttgcaggaaggcaaagtcactttcctgatactgcacgcagaattcgcgcgccggatgaggatggcgcaggctgaagatcacatcgcggatgttgtgttctttcagcagggtggtgaggatggtggcgatatcctgctgctggaaaatgcgcgagttctgtctcagggtcgtgcgccacaggtcagggcggatagtcatttggtaggtagtctggtgcaacccggtattaccctgctcaaagcgggaaacgatccccgtgatgctgcgttgttcgataccgttttgcagaatggtcagcgtggcggtgcgatccagtactgccggaaaatcgatagccgggtcggcgctcgccagtcccacactcaggctgaacggctgggaaaaactttcgttcagcgtgaaatcggtcacgacaaacgtctgcggcggtaagccgcctgcggtcagggtaaattgcaggccactcgggtcacgccctcccatcagcatctgagcggctttttccagcgctttggtggccgcattctgccccccggctgcgcgttctgccagcccctttccgccggtaaaaccgccgcccgggattaagcccgccgtgcctgacatgccgctccctgaacgtccgcctatcccgctggtaaaaccgccgcccggaattaagcccgccgcacctgacatgccgctccctgaatgtccgcctattccgccggtaaaaccgccacccggaattaagcctgccgtacctgacatgccgccgcccaatttgcctgcaacctgtttcgctttctgaacagcctcttgcccctgttgaacaagggcgtgtcctttcttcaatttattgatgttcttctttattgacatgatgtgtctccctgagatgatggaacgttatgtaataggcatcccgcctgatagcgacgcaggccataacatttgggcaccggatttaaatctaactcaccttgtctccgacaaattggttaattcaggacgcaatacgttgtctttcgataatttgatgggactctgtgtccgaatatatcggctgatccgtgataaataaaatgggggcaataataaataacgaaggagtaaagaccaaattaaatcaagtgaaataaaaaacggcatccaacaataacagcgtaaaaaattaaaatgattgctgttgaaaaataatattcttcaataatgtatataattagtgaatcgaaccgtttaatatttaatcataaaaggtgtttttttcgtaacatcatgaagtaaaaataaaaaataggtaatagttttgacaaaatcatgatcattcttattttaagatctttatcacaaaaaagactatttttagcaatgaggttttttattttctgtcttttttatttaaaaaaaatcataataacaaatgatatatttgcattgaatatataaacgtaaactattaattcaaatgaaagtaaatattgcgatgagctaaatcctaaatggaaacagacaaattaatatttagcatatttagcaatatgaggattaagtcaatccaaataactcaactttgttagacaactgtccggatttcaaagggcagctttctgccctatagtgatagtaatttactttcccatggcgctataatttcccgtttttctttcagatagtcgtagcgatcgtagtgtttggttgagacaccgggttttttatggttctgtaacctatctctcatctcagaactgatccccatctctcctgcaagcgtcttaaaggttcgtctaatatccggtcatgactccaaggggttataataacaaaataaattaataaattaataaattaataaattaatattttcaccataatatataaatatataaatatataaatatataaatatataaatatataaatatattgaatcatcattcaattctttaatttaaacacatcctatagtttataatttaaattacttttaataaaaaatacatttccaaaaaataaaaataaaaataaataaaattatgctattggatcgaaagatccttctgtccaaaaaagtcatcaaatatgtcaacgccaaagttgatattattgctatgagtaaactaactatttatttcccttagaaaatttatgcctttaaaacgtaaaggtgatcacactttcgtaataaaccatccactctcaccgaaaagtaccagctaaccttccgaaagtctcttcaagtgcgaccacttagtcgcttcaatcaagcaatggaagtaaacataaaattaacaccacatccccatatagataacaaatcaaaacggggaatttttgacttgtgaggtagccatgagattagaagatttgcgtgccgaccataaacgcccgtttaccagcaaagagtacctgaaatcgcttcaggatggccgggaaatttatatttacggcgaacgcgtcaaagacgtcacgacacatcccgctttccgtaattccgcagcctcgataggtcaactgtatgatgccctgcatgagccggaaacccacgatatactctgctgggataccgataccggcagtggcggctatacccacaagttcttccgctttgcaaccagcccggatgaaatgcgccagcagcgggatgccattgcagaatggtcacgccaaagctacggctggatgggacgcactcctgactataaagcagcattctgctgcgcactaggtgcttatcctgaattttacgggcagttcgcggataacgcccgcacatggtataaacgcattcaggaaagcggtatctatttcaaccatgccattgtgaacccaccgattgatcgacataagccagccgatcaggttaaagatgtttttatccagatagaaaaagaaaccgatgccgggattatcgtcagtggtgccaaagtcgtcgcaaccaattcggcgctcactcactataacttcattggttttggttctgcacaagttatcggcgataaccccgatttcgccttgatgttcgtcgcacccatggatgccgacggcgtgaaattgatctcgcgctcttcttacgaattggttgccggtgccatgggttcacctttcgattaccccctttccagtcggtttgatgaaaatgacgccattctggtcatggataaagtgttaattccgtgggaaaacgtgttaatttatcgcgattttgatcgcgcccgcaattgggctgtccaaggcggttttgcccgtctgttccccatgcaggcctgtgtacgcctggctgtcaaactggacttcatcacgggattgctgcaaaagagccttgaatgtactggtgtggtggatttccgaggtgttcaggccgatctgggggaagtcgtggcgtggcgcaatctgttctggtcactgacggatgcgatgtgggcagaagccaaaccgtgggaaggcggcgcttatctgccggatactcaggcgattcagacttatcgtgtcatggcaccgatggcttataccaaaatcaagaacatcattgaaaacaatgtcaccagcggcttgatttatctgccatccagtgtgcgcgatatgaataatcctgaaatcaataagtatcttgagaaatatgtacgtggctctaacggtattgaccatgtagagcgaatcaaaattttgaaattaatgtgggatgccattggcagcgaattcggcgggcgccatgaattgtatgaaatcaattatgccggcagtcaggatgagattcgcctacagtgcctgcgtcatgcctatggctccggtaatatgaagaaaatgacggaattggtggatcgctgtctctcagactataacttggatggctggacaaaaccccatttacacaataaccgtgatattaacctgttagataagctgctgaaataaatcagtagcaggaggtctattatgtctgtagaaaatgaacatcgcctgcgttttcggaatgcgatggcaagcctttccgctgcggtaaatatcatcaccacggatggtcctgcggggcgatgcggtataactgcaacggcggtgtgctctgtgacagatacgcctccgactctgatggtatgcatcaatcgcaatagcgccatgaatccggtatttcaggaaaatggacgcctgtgtgtcaatatcctgaatcatgaacaggaattgattgctcgtcatttcgccggaatgacgggcgtcagcatggaagagcgctttggctggaatatctggaaaacaggcgctttgggacaaccgatgctgaaagaaacgctggccaatctggaaggaagtattgagcaaatacaagaaatcggcacgcattatgtctatttagtggaagtcaaacagatggccgtcaaggaagaaggccacgggctgatttattttaaacgtgattttcatcatgtgatggataaaagcctggcggatgcggtttaattttatacggtaatttatccaatatttccccggccaatatttttccaagagaagtagaaggctccatccgggagccttcatcaactgaacatttcacttttcccatagctctctgaaataacaatccaataactctaatttgttataaagatacaaaaacgcactgaatgataaatttaagttaactgcatctgaattcaatagtattaattttgaataaaatgatgaaattttattttttatcactagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaagcattactaattgtattatatcgaattttggatattaatggatgatatcaataagaatagctcaataaagagtcgcaggcgaattcaacgggtctattcatcttattgcacggtatacgtacagttaaataagatgaatttaacatttgttcaaattctattactgcactgcctcaaaaacaggcatacatcattgatttaaaataaccatattaggttattttaaatcatttaaccctttgattaacaatttttgacattaacttagtgaatattctgctaaatctggtattactttttacgttagtgtgatctaccactgagaagatattacacctgtatattaacctcccgcgttctacgatcacttgaataaataaacaaaatcacaacccgtacaatacattatgttatcgttcagttaacatcagtataaactctggatgtattgtccattggaatgacaactaacagaggcacctctatgagtaaaaccgcacccgtcggtttatgggatcaaccaaaaccctttttcatgatcttttttgttgaactatgggaacgatttggtttctacggcgttcaaggcattttggccgtttatttcgttcaacaactgggtttttcagaagaacaatcatttattacctttggtgcgttcaccgctctggtgtatggcctgatttctatcggtggttatgttggtgaccacatacttggaactaaacgaaccatcgttctgggtgcgattgtcatggcaatcggctattacatgatcggcctgtctatcatgaaaccggaactgattttttatgcattaggcaccgttgcggtcggtaatggtcttttcaaggccaaccccgccagcctgctggctaaatgttaccgaccacaagacccccgtctggatggggcatttactctgttttatatgtccatcaatctcggctctctgttttccctttccctcgccccggtgattgctgaaaaatatggttataccgttacttacaatatctgcggtatcggcctgatcatcgccctgttggtgtatatcgcctgccgtcgtatggtacataatatcggctctgcacctgatcatcatcctgtcaagcccatcagtctgattgccgttctgataggttctgtagtcatgattggtgtctgtgcatggttactgcacaatatcaaggttgccaatatcgccctgttcgcgattaccaccatcgtcgtactgattttcttctggcaggcattcaagcagaaaaaagtcgcccgtaataaaatgttcgtggcgtttattctgatgcttcaggccgtagtgttcttcatcctgtataaccagatgccaatgtccctcaacttcttcgccattaacaacgtccatcaccagatcctcggttttaatgtcaatcccgtcagtttccaagcacttaacccattctggattatcatcttcagcccaatactggcggtggtttacaccaagctgggagcgaaaggtaaagacttctcgatgccggcaaaattcaccttcggcatgttcctgtgctctctgggcttcctgacagccgccgcctccggtttgtttgccgacgcccaaggcattacttcaccgtggtttatcgtgctggtttatctgttccagagcataggcgaattgatgatcagcgctctggggctggcaatggtcgctgcatttgttcccagttatctgaccggctttattctgggaatgtggttcctgtcacaagcggtggcatcaatgctggcgagtcatgtggcggtactcactgcgacccccgtaggcgtgactgatcctctgcaaactctgccaatttatatgagtgtgttcggtaaaatcggtgttgccactctgattgtcgccgttatcatgacctttatggttccgtggttgaaccgtatcatgagagaagaagtgaaggcttaatctgccgggctctgattgaaaagaccctccactcgatatttattcagagaacgagtggaggacgctctcaccctttctacgattaacgttgtaccctttgcttaggaaactgtgcttgcaggaaaggcagcaataataaaccgatcatgacggcgcagacggaaatggtcataaataaccctgaccagtgatagttttccaggataatggcgaaaggatagcctgcaatggccgcgcctgtataagcaaaaagcccgacaaaacccgtcgcagcaccggcagaatctttatgcgaacactctgcggcagccataccgatcagcaattgtgggccaaacacaaaaaaaccaatcgcaaaaaagccaagcgattgaaaaaccaaccctgtgacaggcatcaaccataaagccgctactgacaagaaaatacccatcgagaatatcagattcatcgggccacgattgccgccaaaaagtttatctgatccccagcctgcgaccagcgatcccataaatccccctacttcaaagagcgataatacggcgtttgcgctcactaaatcataatgatggtactcagtcagatagaggtttccccagtcattgatgacggtgcgaatgatgtataccagcacgtaactaaaggaaagcaaccagatatatttgttgcggaaaacgtagattctcaggatctctctggtcgtcaggcctttgccttgattttcctgagccttttccagcagatcattgcgaaactgaccgatggtcggtagccccatcgtgctcggcttatcgcgtaatcgccagcataagagtatgcctgccaagatcccgacacagcccggtacgataaatccttctcgccagctaaaatgcaaggttaagaaactgacgatcaatgcaatcaacgcactccctacatggtgtgaagtattccaaatcgcccaccagaagccacgttctgagcgagaataccaagtcgtgagtaacttagcgcatgagggagaaccccatccctgaaaccaggcatttaatatccaaagaaaggtaaacatgacaatggagctggacagcccaaacaagatattgatgatccccgtggcaatcagccctattcccataaaatagcgggggttggaacgatcagaaataatgccggaaaaaaatttcgaacaaccgtaagtgatataaaacaacgtcccgatgaggccaatttcacttttatcaaggccaagatcggtgatcatggcaggcatcgcatagttgaagcttttacgggtaaagtaaaatagcgcatagcccacgtatagattcaacataatatgcaagcgccagtaacggtattgctcccggatttctgcatcggacagattgccgtgaggtatgcgtttagattgagaaaaacctgtcatgaccacttcttaaagtttgggcaaaatgatcgataaatctgtaccagcgcttgtcgagtcattctgtcgtttttcgctatgaatggagaattggccaccgagtgcctgtacgcgttcccgcataccccgtaaaccaaatcctttcatgttatcttcagccttacagccaatgccgttgtctttaattaataaacggatcatttccctgacagaaaaatgcagctcaatgcgatcggcctgagagtattttaatgcattattcagggcttcctgacagagacgatataacgtgacttttgttgtgtcactcaattgctcaatgacctcggcagaattagcttcccaatggatttccactgatatgccgcagttttcaaattccatatcccgcagcaattgttcgatcgcttctttcagaccaagatcatcaaggattttgggacgcaaacaactgagtaaccttttggtggtatcataaacattaagggataatgattcgatagttttggcacaattcgagccaataggtgtcacttcgacccgctgaataatattagcctgcgtccgaatggcagtaatgttctgaccaatttcatcatgcagttctcgcgcaatatcgcgccgtaccgattcctctgctttgactaattggcccgcaagactacggttacgatagagctcgcgctttaactgtgtattaagatcacgctgacgctgaactgccatgccaagcattatcccggtgatggtttgtgccaagagcgataacagtaagtcggtgatttccatattcgaaacaccactgcgcgcagcaatcaatacgatgctgttcagtaatgtccccagtaaggcaccctgccaaccataacgaaaggccaacaaaataatggggatagccagacagaacggcgcaaaatagcgtaattcattgggaaaaccaatttgtaacagaatattcagtacaaatagcagggcatacagcataacgtgatgaaggcgaaactggatttgacgcgacacgacgttggctgtcagaggcaaccagatgctttggaacagatagtgccagactaaatagcatgtgggcaccaacataacgccaccggttaagctgaccagaaacacgatgatcaaagatggattgtggttactcactgccacgacattaataatggcggttgctgtgatcaccattgccatgacagcgagccgctgccattgacttccgcgataataacggctggcaacccagacaacagggaggctggctatgctggcagtgagcacagtgagccattgaggctgccccattaatagcgccaaacagatggtcagccaccattctgcaccataaatggttggccaataatgttttggcgtatgtaatacgatgccaaggcgcagagcaaaaggaaaaaataaaatggccagttctgggtcattaacaaaatagtaggcgatcacccacaagcagaaccaacaacatgagaacaataaccagccacaaaatgaattgatcagatatcgacgcattagagatcactagtcgtaaaataattcactaaacccacgttatttgtcacccccaatttactcatcatattggcgcgatgaacatgcactgttttatgactcaatcccaactcggccgcgacaaccttgacatccatgcctctggcaagcatttcacccacttgtcgctctcggttggtcaagtaatctaatgaagtctgactattttttgatgacgccagtttcagcgcaatatccagcgtgagataacagccattatttgccgtcgtacgcactgcctgaagcagctcatccgggctacagcgtttgctgagataaccacgagcccccgccttcaatgcattttctaccatagtgacagaatcatgaacactgagcataatgcagtgaataccggaagggagatcttgcagcaatgaaagcccgctctcatctggcatcgaaatatcaagaatacaaaccgttgctcctgagcctggcagcccatttctggcttcagcacatgaactgaattggccgacgatttcgatatcgggttctaaactcattaattgggcgaaaccagagcgtaccacaacatgatcatcgactaatgctactttaatcattgttatttattaccggatgtgggaatcaacataaactaccgttatcgatgtcgcttcgcaatagactgaacattgagataaaagataagcagaaaacgccactgcgttcaggcagtggcgtcagtgtatttcttcaaggttattgactgtttttttttgcttttcggatttttttctcttccgcaatgacaacaaaagcaagcaagccgatacagataaatgccgaagcatccagtgcaacaaaggtacctttccagccagttaaaccaaaaatggggacgccatcggcaatcatgcccaagccgagtttggcaaagctatcaccgattaagtaagcaaaagtccccttaaccccatcggccacactgatcgcttttttcggtacaaaaccaacagcagccacgccgatcaacaattgtgggccaaataccaagaagccgagtacgaacagagaggacaaatacatgaactcactggtggcatgttggtagaactcaagacagacaataatcaaacccagagaaacacaggcaaccagcgcacgacggccattggctaagtctgacaggtatccccacatcaacgtacccaccagtgccccaacttcaaacaaggtaaaaccggaaatcgcggtttcttttgagtgacctaattcctggtacgcatacacggttgaccattggtcgataccaatgcgcacgacataaaggaaaatattggcgaagcagagtaaccaaatcactttgtttttcaatacgtattcaacaaagatctcgcgtttggtcatttgattttcttctgccgcgatatcttcttcgctgatggcttcatcaaataattcttcaactttccctaagccatagctttctggcgaatcactgccgtagcgtaaaccaataaaaccaatgatcagtgcaatgatagaaggaaaaacaaacatccctaccacatggccatcaaacaggtaattagcaccaaatagcgcaaccccggcagctcctgcgccacccacgttgtgtgacatattccaaaggccaagataggttccgcgtttattacggggagtccatttagtaatggtggaataactggccggcccgccaatactttggaaaaagccactgagggcataacacgccaccatcaggaaaacgctgatgttggaactgcccatactcatactgaaaccgatcatggcaaggccagacaggatcagcataaagggaaggaattgtttggtatttttgctatcggcataataagacactacggttttgccaatcccgtaagtgatagagaaccccagcccgatcaaacccagctccgtcatcgacagaccataagtggagatcatgtcgttttgggctatgttaaagtttttacgcaccagatacatggccatatagccaataaaaaccaccaagtacgactgtatgaagggcttaaaccacattttgcggcgctcttcgaccggaagatccagcgtcggcttgcgaatttgatctagaattttaaacatgtgaaatcctcagataatcacgataaggaaaaccttttttgttgatgcaggaggaagcaaaaaagggagatcgcagaaaagcgagagttttcgtcggtattgtcattacccagaagtttaaaaaagtggagaaagattggcttgagctacagtcttagtggaattaggaatttttcctagttttactcttatcggtcataaagcgtgagaggggtcacaatatttgtatgctgaacctgaacttcggttattttaaaacagcttaaacccgcagtagaaaaaacaaatcctgtttttccaggtcatgctcccaatagttagattatccttgcaagatagtattcacgctcaatgaacgttccgatgattttgtcatgcaggatttctgatttagagtagcagatcgttttccgattcagcctttttattcgagtacgcagggtcagattcattctttcgatgcgttgggtaaatttctttcctctgaggtgagttctctcaggaaggcaatcataaacagcataattatcagtacaataatactggatttcaaacgatgccagaagcgccaacagtttttccagcgtttttttactgcgatcgccaaatacatgtgcgatgatttgcttctggtttggttcccacgcataccagagcccgcgttgattcttcttgttgccgacaaatgacccctgctcatcaatttcacagataatgtgaatctcacttcctgccagaggccgtgttgttacttgtctgggttcatgttttttaacgtgcgaagcacggtattgatcccgacgttcaaaacacgtgcagtgtctctgatcccgccgttatttatcgccatatcagtgatttgttctttcactccgggtttgcaggcttgataggtgtaattcagttggaaggttttacggcaggcataacagtgataacgcgggtgcccactgcttccttttccatgccctttgacctcctctgctttgtgacaataacgacaaaccacatcaactttagccatatctcaccagtaataaaaaatggaaagtttactacaataatctaactattgggagcatgaccaacaaagtgagcagcagcgacagccttgaagagtatcgctatgacagcggcggtatccggatgctgaaaatcggtgaacaacagcgagtcacttatctggcaggcttggaactgcgtacgactaaaaatggcgggaatatcaccgaagatttgcagatgatcagcgttggtgaagcaggtcgggcacaagtacgtgttctgcattgggagagcggtaaaccgacggatatcgataataatcaactgcgttacaactatgacaatctgcttggctgcagtcaacttgaattggatggcacaggacagattatcactgaggaagaatattatccctatggcggtacgtcagtatgggcgacaagaaaccagaccgaagcccattacaaaacgattcgttattccggcaaagagcgggatgcgacggggttgtattattatggcttccgttattatcagccgtgggtgggaagatggttaagtgctgatccggcaggaactatagatgggctgaatttgtatctgatggtgaggaataatcctatcaaattgttagatgttaagggactagcaccagtacatagaacagaggatgctgcaatagcaaaaggttcttttactggtctggaagagcgtttcttccaaaaaatgatgaaatctcaaccattcaaaaggcaacgggccatagctgctcagaccgaaaaagaatctcatgagctattaacccagaatcctattggtaaagatagccagtttcttaaagactacacgaccagtagtaaagctattaatgaggatatccggcaggggaaaacgggtacaatcgttcaacaaggcatagatagggcattatcaccctgcaaagtaaaaataacgaaaaaaaggtcgtttaccgcgttatgacatatgcagataacgagactttctctccctgacattctcaaggagaaaaccgtatgaatgtcggagatattgtttcagaccgtacttatttatctacatcagaacatcgtggttttttagattttaagcataaagaggataaaggtgaaactcgatatgtcaaaatggctttgttatcaaataaaggagttaatatcgctgatatttcacaatacaataatgcgattgaaaaaatggcttttgatcgggcttcaagcaagactttgaccgaacggcttaaaggcccaccagcaggacaggctgagattctcttccccagagaaacacgttttaaaattcattcaattaaacaggatggcagaaatgttcatgtcttgttgagtgatataaccgctaataacgccatgaatgtggatataaaagagatgttttccggggaaagttataaaaaatcttgtttaattataatatatgaagtacataaatattaaattaaaacagcatctaaaaataagagttatccatttttctatataaatatagtaaaacatgaggtaactctcattttttatttgaagaaatacagagttatctacttccagaataacgatgttgcatttgctatgtgaaactgccaaatataattaataaaactgcacctttcaaagctaaataattatcgcttacgggtgcagttcaaaacatttaattaggataccaattacagcacatcaaccgcattcaattctttaaaagcctgttccagacgaacgatcatggaaacctgagcagcacgcagccaaacacgtggatcgtagaattttttgttaggtttgtctgcgccttctgggttacccaattgaccttgcagatagccttcgttctttttgtagtagttcagaataccttcccaagttgcccactgggtgtcggtatcgatattcattttaactacgccatagctgaccgcttcctgaatctcttctgcggtagaaccagaaccgccgtggaaaacgaaatccaggctgttgtgtggcaggttgaacttctcagacacgtagtcttgtgagttacgcaggatttttggcgtcagtttgacattacctggcttatagacgccgtgaacgttaccgaaagaagccgcgatagtgaaacgtgggctgatagcgttcagtttttcataagcgtaagccacatcttctggctgagtatacagagaagagctgtccagatgactgttatcaacaccgtcttcttcaccgccagtacagcccagttcgatttccagcgtcatgtcgattttcgccatacgcgccagatactggctgcaaatctcaatgttttcttccagagactcttctgacaggtcaatcatatgggaagagaacagcggctttccggtctgcgcataatgtttttcaccggcatccagcaggccgtcaatccacggcagcagtttgcgtgcacagtggtcggtatgcaggataacaggaacgccgtagtattctgccatctgatgaacatgatgagcaccagaaattgaacccagaatcgccgcctgctggccttctgccttcaaacctttacctgcaacgaatgccgcaccgccattggaaaactggatgattaccggagcacgtacttttgccgctgtttccaacactgcgttgatggaatcagtaccgacgcagttaacagctggtaaagcgaagttgttttcttttgcgacagcaaagactttttgaacatcatcaccagtgatgacacccggttttacgaaatcaaaaattttagacatgttacgtggtcctgtattgacattgaacaggcagcaaatgctgcccgttatcacaacttaattactgttagcacgttcttccagcatgacaacggctggcagttttttgccttcgacaaactcaaggaaagcaccaccaccggtagagatgtaagagatcttatcagcaatgccgaacagatcgatggcggccaaggtatcaccgccacctgcaatcgagaaagcgtcactttcagcaatcgcacgagcaataatttcggttcctttacggaagttagggaattcaaaaacacccaccgggccattccacagaatggttttggcatctttcaggatttcagccagacgctccgcagaagcatcacccaaatccaggatctgctcttcgtctttaatttcgctggtggatttcagcgttgcttctgctgtttcagagaattcagtggcaacacggacatcggtaggaaccggaatatcacagctttccagcagttttttcgcttcagggatcaaatcatcttcatacagagaacggccaacattatgcccttctgcggcaacaaacgtattggcaattccaccgcccacaatcagctggtcagcaattttagacagtgaatcaagaacagtcagtttagttgagactttagaaccacccacaatcgccaccattgggcgagcggggttgcgcagcgctttacccaaggcttccagttcaccggatagcagtggacccgcacaggcaatctccgcaaatttggcaacgccgtgggtggatgcctgagcgcggtgcgcggtgccaaaggcatccatcacatacacatcacacaaggctgcatattgttttgataacgtttcatcgtcttttttctcacctttattgaagcgaacgttttccagcacaaccagttcgccttccgccacttcaacgccatccagataatttttttccagacgaacaggagatgaaagtttttctttcaggtaatcaacgacaggttgcagtgagaactcttcgttgtattctccctcagtcgggcgccccaggtgagaagtaaccatgactttggctccctgattcaacgcagacacaatcgtcggcaaagacgcacgaatacgtgcatcagaggtaactttgccatcttttacaggcacattcagatcagcacggatcagcacgcgtttacccgccagatctaaatcagtcatcttaattacagacatggtgaatcctctcattgattctctataaaattactcaatcctccgctgtgtgccgtttgtccaagtaacacccgacacaacagaagattatttgaaacccgttgcggccattaccaacgtcgtatcaagcatacgattggcaaagccccactcattatcacaccacacgagagtcttgatcaggtggttcccgctgaccctcgtttgtgtaccatccacgatggcactgtggggatcgtggttaaaatccgttgaaaccaacggtaaatcagtgtaatccactataccacgaaacgagcttaccgctgattcttgcagtagctggttcacatccctgacatccactgcggcgctgaccgtcacgctcaagtcaatcgctgtcacattgatagtcggcacccgcaccgaaatggcctcaaaacgatcactgaatttggggaagatacgtgtgatccccgcagacagttttgtatcgacagggatgatggattgactggcagcgcgggttcgacgtaaatcactatgataagcatcaatcacgggttgatcattcatagaagcatgaatggttgtcaccgtgccagattcaatattgaacgcatcatccaataatttgatgattggaataatgcagtttgtcgtacaggatgcattggaaacgatacaatcttccgccaccagctcatggtgattcacaccatagactacggtcgcatccagatcattccctcccggatgggaaaacagaacttttttggcaccgctggcaatatgcgcttcaccatccgcccgctcgccgtatttgcccgtacagtcaagtacgatatcaatgtccaactctttccacggcaacgctgaaatatccggttgatgaaacagccggatgctgtcatctcccacttgcaataagctgttgttcaggcgtacatcccatgcaaaacgcccatgactggaatcgtatttcaataagtgagcgataccttccgcatcagccagctcattaatagcgatcaccgaaatttcagcttgacgcccggattcgtagagagcacgtaagatactgcgcccgattctcccaaaaccgttaatcgctatcctgattgtcatgttactccctgaatttctctgtggtcatgcaaccgcttagaataactgagcaactgctgattgtacggatgattcatcacaaaattaatcagattgtgacagacaagacattttacgagccaaaactgaaacggttcagctaatatagacgcagattacgagaaaaaaagcgcgatggcaagagtcattaatgagataacgaagcaaaattgcataaaaaaagagcgcattcgctcagatattgatgcgaatgcgcttatcgtttcgtttactgattatttcaacagagatgtcgctttggcaaccacgttttcgacagtgaaaccaaactctttgaacagaagatcagccggcgcggattcaccgaatgtttccatacccacgatagcaccgttgatgccaacgtatttgaaccagtaatcagcgataccggcttcgatggcaacacgagcagaaaccgcagctggcagtacagcttcacggtatgctgcatcctgtttgtcaaatgcatcagtagatggcatagagacaacacgaacctggcgacctgctgcgctcagttgatcagccgctttcaccgccagttcaacttcagagccagtcgcgatcaggatcagttcaggctggcctgcgcaatctttcaggatataagcccctttctcgatattcgccagttgttcagccgtacgcgcctgttgtgccagattctgacgggagaagatcagggcagtcgggccattttgacgttcaatcgcatatttccacgcaaccgctgattccacctggtcgcatgggcgccatgtgctcatatttggcgtcacgcgcaggctggcaatttgctcaaccggctgatgggtcgggccatcttcgcccagaccgatggagtcatgggtatatacgaaaatgctgcggattttcatcagcgcagccatacgcaccgcgttacgggcatattcaacaaacatcaggaatgtcgcgccataaggtacaaaaccgccatgcagagcgataccattcatgatggcagacataccgaattcacggacaccgtagtgaatatagttgccgtcctgaacttcattcaggggtttggagccagaccacatggtcaggttacttggagccaaatcagcagagccgcccataaattcaggcagaactttaccgaatgcttccagcgcattttgtgatgctttgcggctggcaatagaagctggattctgttgcagattctcaatgaatgctttggattcggcttcccagcttgcaggcagctcgccacgggtacggcggttaaattctgctgccagttctggatgtgctgttgcgtaagcggcaaatttttcttcccatgtcgtttctttagctttgcctgctgctttagcatcccatccagcataaatatcctgaggaacttcaaacgcaggatgttcccagcccagcgcgttgcgggtcgcttcgatttccgcatcacccagcggagaaccgtgacactcttctttgcctgctttgtttggtgaaccaaaaccgatgatggttttacacatcagcagagaaggtttgcctgtttctttctgtgcttcttcgattgcggctttgatagcgtctgagtcatgaccatctacgccacggataacgtgccagccatacgcatcaaaacgtgcagcggtatcatcagtgaaccaaccttcgacttcaccatcgatggagataccattgtcatcatagaacgcaatcagtttgcccagtttcagtgtacccgccaaagagcagacttcatgggagatcccttccatcatacagccgtcacccatgaatacataagtgtggtgatcgacgatatcatgacccgggcggttgaactgtgctgccagtgtacgttccgcaattgcaaaacccactgcattggcgacgccctgacccagtggcccagtcgttgtttctacgcccgcagtatagccatattctggatgtccaggggttttggaatgcagttgacggaagtttttcagatcatcgatagaaacatcatagccagtcaggtgcagcaagctgtaaatcagcatagagccgtggccgttggataatacgaaacggtcacgatcagcccagttagggttcaccgggttatgattcagatagtcgcgccacagcacttcggcaatgtcagccattcccattggtgcgccaggatgccctgattttgctttctgcacagcatccatgctcaagaagcggacagcattagcaagggttttacgagtggtcattctttactccaagtcggatgaaagcgttaatgtacataagaactaattttcgcagcgcggcatacaaaccgcaatcattaatgccagataacgggaacaatcttaattttcctctggcatcaattctttgctttatcccgttgttatgacaaattttcagatcaattcgtacaactgaaggtgcatttgcgcaaatgggagataatttcatactgtgacttgcgcaaagggaagtcacgtattagacatgatactttataggttgatcaaggcaaaaagagcgagttttttgcctatgaggataatgatatttaattgatattgaggcttatttgaattgaaacactgatgattttgtatagtatttggtcattacttctcccaaacttaataataaatgtcaaaattcaatcttacatctgactcaacctcaactccggctatcatgcgattggattctattcatacaaaacgtgacgggcttattaacttactgcacgattgtgtcgaaagcgacgcttctgtcggttttattgctccacttgatgtgaacgaagcagagcaatactggcaaaatgttgaagcagatatggtgtcgggtagtcgcgtgctgttgatggctctggagggagaagaagtcgctggttcggtacaactgtctttctgccagaaaaagaatggcctgcaccgtgccgaagtggaaaaactgatagtgcataccgcttaccgtcagcgcggcattggccgaatgttaatgaatgaattggaacggctggcaaagcaatatcagcgtcgtttgctggtattggatacccgtactggtgaccccgcgtcagcactctatcgaaaatgcggttttattgaagccgggcagatcccacaatttgcgttaaattccggcggggaattcgcgggaactacatttttttataagctgatttgaggcttttggtcgttgccggaaaaagaaaaagccccgagttaaaaactcagggcttaaatattctggcggtgcggacggggctcgaacccgcgacccccggcgtgacaggccggtattctaaccaactgaactaccgcaccgcatggtgttctggttgagaacggggtggataatacgagcctcagcataatccgtcaatcgctttttataacaaaattgtgcgcttgcacagtttttcaccttaatgacgaagttattttatcttattgcggcttccgtcactgtaattgttcaggttttgaacgccatagacaacttccccctttcttttcaaccagatccaagcgggattcatgttgaagcaattcctcatcagaagcatagataactttcaatcccgtttggggacgcgtaattttctggatttctgccatctgagcgccacctgaaatctccccttccatcgaaaaggtcagcgatgtctggccacctgtcattgtcagatagacatcagacaaaatctcggcatcaagcaaggccccgtggagagtacgcttcgagttatcgatctgataacggtcgcacaatgcattaaggttatttcgcttgccggggaacagttgccttgccagcaccaagctatccgtgatcgtacaaaaatctgcggttggcgggatatcacgattaagcttgcggaattcatagtccataaagccgatatcgaacgtcgcgttatgaataatcagctcggcgccccggataaattcgatgaactcatcggcaatatcggcaaactttggtttatcctgcaaaaattcgtcactgataccgtgaacttcaaacgcttcaggatcaaccagacgctcaggtttaatatagagatgaaaatggcgccccgtcagacgacggttgatcacttccaccgctccaatttcgataatattgtgtccttcatagtgaacacccagcttgttcataccggttgtttctgtatcgaggacaatttggcgggtaattgcagtgctcatagtgtttttttgtgtcagacttagagtttcgattgaagttgatataggaagagtctaccaaatatgagtaaaaaggtagaaattttcaccgatggatcttgcctcggtaatcccggacccggtggatacggtgttgtactccgttaccagcagcatgaaaaaaccttgagcaaaggctattttcgtacgaccaacaaccgaatggaattgatggcggccattgcagggctggaatcgctcacatgtccatgcaatgtgatcctgactaccgatagccagtatgtccgtcaaggaattacccaatggatacacaactggaaaaaacgcggctggaaaaaagccgacaagtcccccgtcatcaatgttgatctctggcagcgactggagcaagccatagcagaccatgatatcgattggcgctgggtcaaggggcatgcaggacatcgagaaaacgaacagtgtgatgaattggctcgtaccgccgccaattcacccacgttgcctgataatggttatgctgaaagtgaaaattaaataacggtattcaacaataactatcaccaattagcctcatattcttatggggcttaacatatacaatccgtcagttatagatcgagttcatccaccagcaccttaaaccctactcttaccattttcgggatgtcttttgatagctcgtccagcatcgcttttcgttttggaggaagcatttttctgtcttccaaaatcaaatcaccatctttaagcaatctaacccaaccttccagaaccgaccttaagcggggaaatcgtagcttaacgacatcatatacagcaacaaaaaaacgcgatttaatttaaaaaaattatattattcaataaattattgtaattcacattattagaaataaattcacacgttcaacactcaatcataaagttagtctaacaaagttgaccaaaataataaaaacaaatatgcttaatgtatgtacatcaagaggtgatgttatggaaaagattaacatctacgatgcgaaaactaacctgtccagaattgttcaggaagttgctcgcactggagaatctgtggtgattgccaagaatggccatgcactggttaaagttgtcgcatacagagaagagaaacctaagcgtaaattaggcttcctcaaaggcaaaggtcgtattcccgacaattttgacgatatgaacagcgctgaaattgttgatatgttcgaaggaaaagactcttaatggaattgttgttagatactaacattttattgtttatggcatatgaaccggaaaaactgaaagccgatgttattgatcttctcgaagataccgacaaaaccctttgttttagcgcggcgtctatatgggaggtggtcattaaaagcaatctgaacaagcctgatttttccatagatccaaaacagttcagggatggactgtttcaagctggtttgattgaaatccccatcaaaagcgaacacacgcttgttgtatgtgatttaccggaaaagctacataaagacccgtttgaccggttgattgtcgctcaagcgaaatacaacaagatcccactcattaccagtgatagcaagctgatagattttgtcagtgattatattactgtaatccctaacagatagccaaaatgagtatgggtaatgtaactcgtttattacctccccgccttaaaagacggggctttacgatgcaccttggtaaaaattattggcgtcggtgaagatcttttgccgctcccaatacatttctgaacttcggtttcagcgatgtcgcccacatgggatttaatgtcaggggaattgtccgcttgcgggcaattaccaaattcatacagccaaatatcgacgtggaacggttacaaaaacttttcccgctttgccacggtaaaacatgaaagctggcatgatgaacaatttcataattgagcaggcttaaccaatccacttggcgaagcatggaaaacatttgagcctcataagcctgacgacggtgtatcggcaggagcacttttcttaatcccaacaggctgatcgggttaaaaccactgataatcacccagccatcatcagttatgatacggtcaacttcccgtagcagccagtgtggatcagcactgtaagtcagcatatgcgccagcaggcaggcatcaacagatttagcttcaaaaggcaggcagtaaggatcagcaataacatccatacttccctccagtaagccgatattgaactgatgactgatcggacaggcacggctgtcaatttctgcactcagattacccagcttcgccaaatgaagcccaaaaatcttcggccaccacggttccaattgacgttccagagcgacgcggtaatactctccccacggcaactcagcccaagaagcaggggatgttatttgcttgattgaacgcgctgattgcatgtcatcttcctttcaacctactataaacatgaggcatataatggagcttatcaggatccccgccctttcagataactacatttggttactttgtgatgaagacaaacattgtgtcattgttgatccgtctgaatcacaacctgtcattgatatcttagcagccaaccaacttattcctgcggctatcctgctgactcaccatcaccacgaccatgttggcggcgtggctggcctacttaaacaatacgccgaattacccgtatatggcccggaagagacccggagcaaaggtgccactcatattgtccatgaacatggcaccattgagatcggtcattattgtttccacatcatggaattacccggccataccctgggccacattgcattctatcaggctccctatttgttttgtggcgacactctgttttctggtggctgtggtcgattgtttgaaggtacagccgaacaaatgttttcttctcttgagaaaatcatatcattaccggatgagactttaatctgctgtgctcacgaatatactgccgccaatatgaaatttgcacgggcagttttacctgagaataaaactattcatgattattataataaaattataagtattcgcgaaaataataagccaacagtgccaacaactttacaaatagagaaaaaagttaacgttttcctgaattgtcacaacattgatttacaaaaaaatatcggcattaaacctaattcaaaaccactttcttctgtttttcagcaattaagaatttataaagatcgattttgactttattgggttgtcttctgcgtaataggtcagtatgatcgctcaccttttaggcaaacataaaaagagaacatgaagacaaaagcgatcttattcgcctctgttctacttgccgggtgtcaatcgggtctgcaatcaaaaaccccttcccagcaaaatacacagaagatgtcttcaacgaatcagcagacagacggtattgcagaaccaaaagatactgcaaactggaaggagagtccgacaacccaacaagatttgtggggacatatccgtgatgagttgaagatggaaattcctgacaataacagggtgcgcgagcaacaaaattattatctgaaacacaagagttatctccaaaatgtgatgttacgggcagaaccgtatatgtattggatagttgatcagcttgatcaacgacatatgccaatggaagtagtatttcttcccatagtggagagtgcttttaatcctcatgccacttcttatgccaaagcggctggcttatggcagattattccgagtacaggccaccattatggcttgacacagaataaatggtacgatgcccgtcgtgatgtggctgcatcaacgacagcagcgctggagatgcttgagtatctgaatgcacggtttaatggagattggttgttgactatcgcggcttacaacagcggcgaaggtcgggtcatacgtgcaatcaaagacaatcaggcgaagggcagaccaacggatttctggtctttgtcgctgccacgcgaaacgatgcagtatgttccaaaaatagtggctctcagcaatatcattcgccataacgacaagtttagcttgaagctgccacagctcaacaatcagcaggcactttctaaagttgaggttggtcagcagatcacgctgtcacaagcggcggagttatctgggctgtccctgacatcaattagggcatataactctggttataagcagggcataacatcccctgatgggccgcattacatcatgctgcccaaaaggaacgtcaaacagtttaaaaacttgctgacagatgaaaaagtcttgaaggatatccggctggctgttgctcaaaatactcgccagctactgcaacagagccaatatacggttcgttctggtgatacgctgtctgccattgcaaaacgttttaagacatctcaccgagaattacagagattaaacagtttgaaaactgtagatcgactcaagatcgggcaagtcttgaaaatcaatagcagtggccctgtcacgtatcaggttcgcaagggagactcctttttcagcatcgccaaacgccacggcgtcaatctcaacgacctgatgagctggaataaaagcatcagaatcaaggatattaaaccgggtatcaatctgacgctttatcctaattaagtcagtttagtttgttcgatattatataaaactccctgtccagaaggacagggagttttttcgctgaatattaatctgcaatatcatttatatttatatttatatttatatttatatttatatttatataaaacatcataaactatatttaaatacaaattaatatcatcaaaatatttacaaataatatgatatataaaattatagttttttagaattaatatttttattgaatgtatatttttacatttaattccaaccactcaggagatattataattatatactaaattacactcaggtttaattatgaattaacccacaaatagaatatttatttccattgaaattcatttaatttttaagttataataatcacaataaaataaagaaatatataatttaagttagaataacaaaccacacaatttattaattaaagtaaataaaggagtataacttgttaccattagaaaatggtagttggtcattaccatcagatacagataatattcctaattcctttactgaaatagaaaaatccttcttacgccccgctggatttcaattcagtgccattccctaccaagaaaaagaaagccatgaatacaatgccatgcgctttgggattaatggtaaaacgatagttttccgccaagcaaagacaacaccgaataaaatggggcaatttgtcacactatggaaaagacctactcctgactcagaaatcatgccctttgagcaaagggataatatcgatttctgcatgattgcaacacactccggtaaccaaaaaggtatttttttgttcaacactcatattctgattaaaaaaggcattttttccactcaggataaagcaggaaaaagagccatacgaatttatccatcttgggtatcccctatttcaaaacaagcgattcaaacgcaaaaatggcaatcttcatattttatcaatctggataaccagatagcagctttcgaacaattccataaactattttcttatcgtgattattaagtcgataaatcagaaaatttcactgtttttcatcagaaattttttaaaataatattaactaataaaacaataaattatcattttgcctacacagtattttaagtgtatatttattttcacaactcaacaaaaaacctttatattgcatattaaacaatcatatggaaaattctatgtatcaaagcggatattttgtcacagcagaaattaaagccagagataatgttgatctcaatatcgttgtcaaagaacttaagtcactacaagaaaaaacattattggaacctggatgtgaaatattttccatacagcaatccaatgaaaatccagccatatttgttatgtgggagaaattcattgaccgtgatgcattaaaaaaacactatgaatatgaacatactaagtattatttttcattaaacttcactgatgtcgtacaaatttttaccgcagacaccatttgattatattcaaatctttcatttcagaatgccaaaatagatgaatggcacgccacaactgcactcagacaccagcgatagctgctctgctgtggcagtctttcactgacagactgccctttacgtaatcccaatgatgttccgggagaacaagaaccggggtcacgcattttggtcgatatatgagaaagtcaccgaagggtgacttatctgccagatcttaaaattaattcctgcttgctttattcagcatcaacagcctgtttttcaactatattacctgtaatataaaaattacttctctgccatttcaataatttgctttgccgttttgccgttaagtttttccttcataagcgttaacgcatcatctccatctttggcaaccaaaacagactgcatggagagtttcaaaaacgctttttcaaattttgccatttcttcaggtgacatatttttcgccattttttcagccgaggctttcatcgcttcatcattcgaagcatcaaatgttggttcgccaccacagccaaccaaaaacatagataatagtagtggtaatataatttttttcataaattaacccttattagttggttttatccaatcccttagaactcataatacgaacataaattatacatacatatcaatttaaatatataaaaagaagtaagcacttttattttattaaataatgtaaatttatctttagtataatgaaattattagtcatatcttctgacagtctttgttgtgcttctgattgataatagacaggttattaatatggataaaaggtggatgtaacgccgcggcaagtgttttaatgaaaaataactcagcccatctgatggttatagtcatcatcaagacgggctgagttatagggtttataccgtgatatttcaaccaagaggcctacttgcataggctctacattcgattatggtatcatcaggctgtcctgaagttcattaagctggttctgcaactgctgtaattccagttgtttttgcatttcagattgcgatggtttctgctgcgcttcacgcatacgtttttccagttcagcgatctgtttttccattttcactttgcctgcggctttagtttttaactggctaaacaggcgattcaacgacttttgcaatgcggcctgagagcgttttctactttccagattcgcctgacctgcttttttctcgcgctcgatagcgtcataaaccgctttgaactctttattcagtgtctgttcatgctgtagcactttttctttatcaacgactctctgatcccaagtcccagagtaattacaattaaatttcgcaataatactcatatcccctgtcgtgggatcacactcttgtgcattagtgacacacccggtcagtgccatgctgattactaacatcatcaatatacgcatgagaactccttatcagctcactttaatcgcggtacgttgttcatacagactatccagctcttgttgcagcgagccgatatttttgcgcatttggacaatttggttattcagatccttggttttagttccgtcttccgcgatctgagtagagacactctgccactgattttcatgttccttcatttctttaatggtattgcgcaaataaacaatattggcatcaagacccttcagttgtttttgcacctgatcttttttcacgaccttcgccgctatgtccttattaatctgtgccagggtgagtttatctgtcttaatcacctctttggctgtagcagtcacgttttcaatacgttgattttctgctttaacatcattaattgaggcggccagtagttgttcttcgctggcatattttttgcgctggttatccagataggcgttggcacccacccccacaccacagcccacaatagcggcggccgcaatacatatcgcttgatggtcgccattgacgagcagacaggcaagtgcccctgccgccgcgcctgccgcacaagcctgccagcctgatttattaaaaaactcaacgtcctgactctgagtcagacgagaatcgacttctcccgtctgcgcggaagggccttgcggcgtttggcaggcgaccagtagaaaaatcatgcagagagaaatcatagaacgcatggattgcaataccatttcttatatatcctttcttaaataaagtgatgactgttaattattcttcttacatgactccagccaactatcccgtgcaactcttccgttcttccagtactcctgaagattcttccagtaagtattgagataaccattcagattcgtttttccacgagcggacatctgttgctgaacaacacgaatttgtggagcaataagctccgcgttataggtgacgcccatatccaccaaggtgtcagcataataattgacaataaaattgagcacctttttatgctgatctaactgtgattggcgacgggaacaattcgcatccagctcactgcccgccttacaggttttttcatacaacccgttcaaccgatcgtaaaattcaccatcatcctttaattttgtacacaaaaatgccccaagttgcagggaagtgcgtatcgcctgatcgcgttgttcgtcacgcaattgtgcattcgcacggagatcagcacgcagctgctccaactgtttcttcagcactgtatcttgcacttgagacgaaatgctgctcaggttatcaatggaatcaggcgattttttctctttagcttgtggattttctgtgcctaatgctttccactcttcggcgatttctttgatacgatcgcgcgaagttaacgtcggcgaaaccagcaccagacgaaatccgagagttttgttcttattatcactctgcccggtgtaatagggttcttctccacgcagtgagctacgtatatcactttgcggcgtcaggaaatttccgcctctgacgatatatccccccgctttaccatgcgggcgatccaatttatttaagtgaaaaggctcaaacatcatttcagaagcattacccaacatatcatgcaaacccagcggattgggtttaagcaatcccgcaagctgaagtttaccgttggaggattgcgtgccagaaaaccacgcatagctggttatcccttccggcatcgggaaacgttgatcgcgaaattcagccgtggaaacagccaaaccaccacgggcagcaaattcccattctgtttcggttggtaagcgcaggaaacccggttttccatcttcaaccggcagcgctttaggctggttttgcagcaaccaaaggttgtattgattagcaaaattcatcgcatcaacccaacctatgttcactttgggcaaacgcagtttcatattcggtgtaggacactggcctgtcagtgcctgatattgcaaatctgtcagctcgtacttcgccatcaggaaataacgccccttgccggatttaccttcggcaaaactacccgcaatatgttccgcacgtgcctgttctaaataaccccattcgtcatttgcaccaccgccaagggtaatgctgtaatcctgcaacggctgactaaggggaatcgaaactttacgaaacgccatcgcgccctcacagggcatcggcaatatcacatcatctggcagtggcttggggttgtagtatttttcttcccagacggcactggcagaaaacggcagcattgccagaaaaagccctgccaatgtcatattcaaaccatgattaaatctcacgtaaactctccgcaggttcaattttcaacgcgcgtaaggctcccaccgcagcaacacccagtgcgaccactagaacactcaataaagccatcagcaggtgccagggttccaaatgacacacaaacgccgtttcaggtaatgaagcgcccagcacgttattaaataactgactggcgacaaaatagagcaataaacccactccccaggcactgccagtaagaagcaacgcctgaattaagacaaacatcaccacagcctgacgacggaagcccaataacctgagcaccgccatatcttttcttttgcgatcgatatttgccataaaagcccctaccaatgaagcaatacagccagtggctgatatccaggcgataacagtaaaaatcaaaccgagaacatgatcaatagcgcgtacagattcaatctccgcctgttgtgttaccgtttcgatgtgctgctgttgtaaccactctgctaattccgccacgctatcaatgctatttgcgtatagccgcgctttggcaaaagtggtgcgttcacgggttggcgtgccatcatgtaccttgaataaggtaacttgataaccatcacggtaatcttccatagccaccagaagaggcagcgtgacgaaggcagcaggccgggcgaattttgctccgtcaaccacatcaatgaccgtcagcgtatgttgtacgtgttcgtttataccattccgtttacgggcaatcactaaccgcagactatcccccgtttttatctgtaaacgctctgcggcactggcactgagcacaacctgctgttcattttgtggctctttggcattcaccaacagcggatcatgcaaagcagtcggaataatttcagcattgctgacaaaacgctggttatctctgaccagatcggcctgcgtattcagggaacgagtcagcggaatgacaaaacccacatcaggacgagccgcaagctgcgtcaaccacgtgtggtcatagttaccattacccagcatacgaacttcccgcgtgcgtggatcatccagcaatgtgtgacgaagctggctcacgatgccatttttcagcccgaatagcagtaacaaaggcgtgatcacggcaatcagcgaaaaaatgatacaaagcgcaaccttgcgatcgtgaatcagatcggccagcgccatacggggcaaaagcaagcgagagggtcgggcatcggcattaacaggttgtaaagacactttgttttccatccactgtagcggcgtagcgtttaaggccaaaatccgtaacccgctgccagtcgtgactcacgataatggcaactaaattgagtgctttcaccatttccactatcaggctgaaaagcgtttcggcgttgtgagggtcgagtgccgccgtcggttcatccgccagtaacagttgcggctgatgggcaatcgcacgggcaaaggccacgcgctgacgctccccaatcgaaagttgagaaggcatttttttcatcagtccggcaatacttaaacgggcaatagccgtatccagccactcagaacgcgctaccaacccggctatttggcggggcaactggatattttgttcgactgagagccaaggaagcagcccgccatgctgcaacataaaaccaagatccttggcacgcacttgggcaagctgattttcctcaccctccagcagagaggcggtaatatcacgcggcggtattcccaactggtaacattccaaactgtcaggctggagtatcccgccgatcatctccagcaaagtacttttgccacagccactcggccccgttaacgcagcgacttctcctgcgttcagcgacaaccggggcagtctgacggtaaaaccctgatctgcctgcccgcgctgtatctgcatcgattggatgtacaacattacggaagattttccaacggaacgggatagacgttatcccgcggatcactgtctggcgccaaggaaatccaacgatctacatcttcgttataacgctggtaataattcagcttagtattcaaacggcggataaagcgctcttgctccagaccatcccaacttttccacgtctcttcatccagactcagcacttcactgagataaggtaaaccttcgatgtattcacccagtaatcccatttcactcagtttggttgcctgtttattttttgcctgtttaggatcatttcccatcgtggcagctaatgaacgcaggctggcaaacatatcatctggcgaaatcaaaccttcattcgctgcattaacaacctttttcatgacttcgctcagatcgcttaactcactcttggtgagcagcactttaacctctgtcgccggaatgttttgatgcacaagatcgcgatcactgatccaagatttaaacacaggcggcgcttgagtcccctgtttgtcacccagatacgctaatcgcatggcgtgtcccaacaacgcagcatcatgtaatagaggctctttggacaactccgattttttacccatataggattcgttggcacccagcgcgctgcctacagtttcttcaccgcgccatgctgttttaatctggctggtaatagcattggcaaggttatcaactatcgtgccaaaactgttcacgtcaccggagttaatcggataataaagtggcttgtgcaagaaagcattgagcgtcaaatcacggtactgattctccgcagatgcgtggtttttatgtcctgaaggcgttttcaaatggagtgcatacaatgccacgccgcgataggttgcttccaaacgcacctgagtggcgtccaactgagtcgaagataatttatcatccccttccagcgctcccgcatccgtcaccagaatcacgtaacgggcaccgaattttgtccagtccactttatccagcgcggtcatgactccggcataagcatcttcattcactttactgctggaaacggtggcctgtttaagatcgcgtactttagccagaaaatctttaccatctttgaccgtattgggatcaacatacattttgctgtcatattccagaccaggaacagcagcaacgtttgaacgataagcgaccagaccaaacttcacctgaccgagtaagttttctttttcaatgcgctgataaattttttcaatcgcctgcttagtgcgatcaatgtaaggccccattgagatggtggaatcaatcacaaaaacgaccgatgccgagaagcctttcatcatgtttttttctttatcgggagaggtactggcattcttacccgataatgcactggccgttttgccagcttcgctcaccgaagcgacattaagtacccgaacctgatagcccgtgtcagtaaaaatatcatcggaacccaggaccggcagcagataaaagtttttctgctgatcgatcatataatccggttcacgcgccagcacagaagggacggtcttacccgctttcagatcattcagtagcggctgtaattgtgttgccggtttcgcattgttcaggatcttttccacatccgttttatcgcggaagaacagcatcgggttacgacctgaagggttggtaaaagccaaagtgagctgcattttccaatctacgctacaattggctttcatccagccacgggaatttccatagctatcagggccaacctgtagccattcttcgttactctgtttttggcgctggtagacataaaaacggctgaaagcaggttgtaccttccctttttcaccgaccttcgccgacagttcacagcctggataggtcagtacacgctgatagagcgtttgctttccttcctgtaaaagcggtttttgtgctgccaatgcccctgccgatgccatcaacgccagggcagcaaaacccgccttcagacagttaaggtgtttcattatactttcctattttttcagtgccgctaaacgcgctttggcttcactgttctgcgggtcctgattaatcaggatttcgtaccaataaatggccgtttgagcatccgcaacaaaacaacccttctttgtcgctgttttcggatcgtattcttgggcataacgcagcgcgatttgcttatcacccgactgcgatttataagcataaagccgctgtgcgatgtcacactgtccagcatttttcgcctgactgataatttcctgtacttgcaggctggaaggctggctgcgcagacaacttttaacaaactccagcccgttgcctttggccatattttccatcgcacaaggagcagttactgatgcgctagctatgacaggcgcctgcttttcctgcggtttcagcaaccaccaaagcaccccggcaacgaccagcaaggtcaggacaatcagcattcctttgttcggttttttggctgatgcagatgatgctgcgccaatccgttcatcgacgggtattggctgaggctccggcagcccatgggattctgacacagtgagttcaacgaatgattcaacagagggggtttccgtcggcattgagactggcggttcctgatccggaggcacatgttcactcacattgtcagaaggggtatgctcccctttggctaaggaacttaaaaccccattggcaattttcagcccaccaacctcacgctgtatatcgtctattaccgtaacgcgatacgccacctgacgttccgccagcagcgcatcaaccaattcagggccaacacgggcttctgccgcgccatcgacttcctgtaactcaggcaagagcagccactcttcattgttgacccactgcccctgaccattcagaaaacagcgatcctgattacgctggatggatatcttgacgccttcagtggcaccctgccaatcctcaatgcgtaacacagcatatccgggttcaaccggttcataaggcctcagctctggtttaatcacaactcgttactccgacgacagttgaatacgatgaataatggtgcccaaccgttcattctgaacggcggtaatttcgcgtcccgcagaatgacccgcgttttctttgattatttcgccgaagccgaataaccagtcaaagataaacatagcgctgtagttcagttgttcatttgtcagccgataaaggcgttcgtcacctttccacaaggcaggatcttttttgtccggacgggcaaaaataggctgccctttgttaatgcggctcgccgggcgtttctcactcggtacattctgatagcccaaccaagtaatgaaatcattcataatgtgcatcacacgggatacctgacgctccatcattttttcccgccgtacacccgcctgctcagtattcgccaacaccttcatcagctcaccttcgacgttcatccgctggatcgcggtgattaattcatccaccagcacttcgacaatagaacgggaaagcccgataaaatccgtcatactggtttgttcaggtacagtgcgcaagtaattgatccacagtttgatcactcgatgagcaaactcctgttcatggctgtgagccgagacggtttcatccggagtatcactgaagagatcaaaatcactgccaatcccgaaggcagcaacggattcgtttgcatctttaccctctgtgggtaaatcaagttcagcttcctgcatataaagctcttgcagtgcttttcgttgaggcactaagcccgccagcagttcgccatgccttccggcacggttttgtaatgccttcaggatctcttcggagataagcctttttttctccacttcttctgcgccatcaggctgataccaagcgtgtaaatttccttccaccagttcatggcgcgtttcatttaactgttcagtaatgcgctctaacttcatttcacgctgggcgacgatgcctaaataatccgctaaccggcgcataccaccatcatttaattgcagcatggcatcccaagcttgctcaggtgaggcaatatggcgttggattgcagcatcttcgaggaaagtttttttcatcagggtcagcttggaagcagtctcctgactgaactccgcctcgcagccctctttcattgtgatgaatggcgtggcctgacacggtttacgtaccagaaatgcattgttaaaggcacgaccgggatgccattcctgcatccaaggaaaatggccgaaacgttcggtcatggcgattttgatcatcccgccctgcccccagacctcacgcaacatatcttctgatttggtcagctcctgggtaatacgtaaatcgagtttggtgatcgcccagaccaatcctgctgggcgacgtgcgcggctgtcagcatcagcgccctggctataacgtatccattcatccagtacacctcccacatctttcacgttggattgttcatttgaaggcgtacaaaccaccagaacattcatctcctgattgagggtgtaacgctcaaacaagtaggccactttgccacgcaggattaactgtgccagtggattgctgtcgtcgctttcagccgcgttctggagataattcagagattccacacccagacggccacgataaccggggaagtccaacaaatcgacttcctcaaataaccgttctcgcgtggaggaaagtaacggaacatgcaactccacagtcagtgccgtgagttctgccagagaaactgataccggtgcagccagcccattctctcgttccggacacaccgtaatctgcaaatcgttgctcttattcaggcgctccagcatatcaacgttcataatgctgttagtttgtaccaacctgccattctgctcagtgaccaacacattaagtggtgctctgacaacgctggcgccccccagacgttgtagcgtatgcgcaaatcggcgataagcctctgtgaattcatggatattgccccataattcaccaaataactgagcacgatcatcaatcgacaaccaaggtgccagctctaccgccgctggccagtattgcaaagtcattttgctctggctctttgctgcatgacggatcagatagtcccatagcgcgaccacatcatcttccgccacccccgggactttatgcgcctgacgccgctcgttcagtgaggtaagcagcgtattgatgcgtttttcatcataattccagtcgattttctcctgattgaaatcatgaataaacgtattagcgaagattttggcaatctccgcttcgttgaacagttgtagctcaatcggccaatcagggttagatggccgcgcgtggcggctaaaacgtgtaactaggccagtggcttcttttccgccacccgggggattgatatgttcgataaaatcaagctgatacggccccatctgggtttccagccgcccgttctccccggctgccaatgaggaaatcagataagatttccccgcttgagataaaccaaaaaaaccaatggtcatgggatgagtagcccctttggccaatctctgcgcggtatttcggctacggcgcagcttcagtttcaaccgatcagcttctgtgttgagacgcggggcatttccacgcacctcttcaacccattcaatcgcctgacctgccccttgcgccacgtcaagccacgcttgttttaattgttcgggagtaaaatatttcatcagattttaatgctcccactgtcgagccaataatgagtttcacccaagccgttcccgaccagagtattcaatttgaaactcacgtcctgtggacgcgggttctgcgtagattcgacgatctccatctcgctgatacggaacttttcaggacttccgttagtttcagcttcttgcccacgcccttcttccacctccagtttcagtcgcaataccgcatcaccagataaagctgtcgctaagcgcgttcccggaattttcaaggtgtatagtggcgtcgcaggccagcgttcattgtcaagctgacggaaaccaagccgcatttcgccacgagactcaaaatattgctggttatccaactggaatcccggggtgtccagatcaatatcccgataaaacacgttgctgtctttcagcaaattattgctgtcgagcatgccgaaataacggatagtcgaataaggcttaaaattggccgtacggaaatagaagttactcaaccgtgatttctcggccagcaggcaaagcatcgcgcccaccgccgccgtggatttaggatcgtcaattaatccttttttattgaacggataccaaccgcccgtttcgtaaccatgcaaggggagaatgcgtgcaggcggtacgggttgtaagtggcggatcagtgcctgaatccccggcagacgggaaggtcgcccggttaacaacaaaatgtcgcagttgtagtgccagagaacttcgcacaacccgcgtaagctaccgcaaatattgatgcggttatgacgggcatcgataaattcgttatgcagtttcatcaaattgatgtttaacggcacattgagaatggaaaatgggttttctattccctctggtaaactgcgcttaacttcttcatcaacatattcacaaactttatccgtcggttgatgagaaagtagatcattgaacgttgcactaataacttgctcacccgcctctggcgtaaatttttcataacgatgcaaaatagcaagtgccacaggcgcaaatatttgcagtgtcagttgctggcgtagcacctgtttgcctgcctctaatgcttcactgccgaataagcgtgacattaatgcttcagcatctaaatcttgatagccaatattgagcaacgcggcttcgaatgcaggctgcaaatagagttggatcacatccaacagaatatcatcacccgcaactttaaacccctcacggaatagctgtgtcggaacgatacgcacattactgccgctcccttcatccaaggtataacgggtgatcaccaaatcggttgtgccaccaccaatatcgatagaggcaattttcaacgtgcgatcattacccgcttcccgtttattatcaggccgcactgtggctgcaaaaaactcttcactccggccaccaaaatagttttgcgtctcgttgtagagataaactaactgaccacaggtcgcttcatcccatttcacatgcacgtcaggcaaggtacgtttacgggagacgtttttatcttcccgaccgttttcatcaacaccctgatccatctcttcccaatccagcgccttccacaccagcctgatggcctgtgtcatggctttctggaaaatcgcgcgctcaggttttggcatcgccggcggcacggtgagaatgatattttttaactgacgaggggtactggcatgacgcattttcaaacgttgagccggactgttaatctgcatcaatgcctgtgccaatacttcagacaacatcatggtcatcaaagtactgcggctatattccggcgtaaacaccggcatacgctcagaaggcttaagtgcataaagcgcttcgcctttgtcattgatcatgtaggtcatcggcgctgccgtcgcctgaggttcacgatccgatttcacaaaagcacggctgaaacgccagccaggggagtaaggtgcgtcatcccacaaatagcgttttggactggaaagccccgttgagccttctgtacccaaacgctgtgaggccatacgaaacgcttcttcgcccacacgaccaatggtcggccaagtaaacgcatcgctgcgcccgcttttgacagaaaaatcctgcttcccgaattcggcttgagcgaactccagacggctgtcaaaaggatcagtataaatatactgcggttcactcaggtcacgtaattgaagctgatagagattcgacagaccttgatcgccatctctgtgttcttcaattaagatcccacaactgcgtgagttaccaatatcgagcactaaatcgacattaataggattatcctgaagtttaacatcgttgagctgaacttcaggaacctgcaacaacgcattgagtgcattaatcaaattgagataatgcgcttgatgttccttccggttcaaacagttttcagtatcttcatgatattgacgccacaatgcggtggcacgttcggtataggtttcccgcagccagtcatccacccatttcagcaacagaaaatcgcccatctcatgatgagtctctgccagcgcaaagcccacaccggaacgcacatcatcatcgacaggctccagatactgggtatttcgcctatctggagacactttggtatcaaaagccaaagtcacgcgccaggtattcccctgctcatccggtgtatccagtgcatgaaatttcactcgcgaccagttagtcggcccctgcgcaaaactccgtgacgagttaaagcggaaaaagggcagcggtaaccaaatgtcattgtatatttcaagagatttctccagtaccagcgagtaatcggagtccgctgcgaatgcagacgaacctgacgctgaaggtacaagaaaattctcatctctttcgttatataccagacgaatgaccgggttatcttcctcagtcagtagaaattcaccgtattctttctttttgggtaacgcgaaagcaaaatccagaaactgaatgccactgtcacgaatcaatgtcactttttctttgaaatcggtaatcgttgccagcatgctgttaatttgcctctcgcttcatcgacatgggaaataaagttttttcgtcataacgtcctttacactccgctgtaccttggctgcctgattgacaaaccacttcaggcatcgtgtaaaccgaaccatcgctacacttcgcttcaccaatattatccagttgcagcgcccctgaattcatcgctgccttaacgggagcctggcaacgaataccgtcaccgcgcgccatttcaacctgccctttaccatctgccatctgatacgtcagactgagtggtttgccagtacgactatcctgaattccggcacctgcgtgccagctaccattgagaaaatcagtggtaccctgccgcaccgcgatgtctgggattgtaagcgcctcagcaggcggagaaacctgtactggagggagattaatctcaggcagggaaggttttggcgtgccattggataccccatccgcaactggcggtatcggctgagttgggatcatcggttcaatcggattcacttctggtgaaacaggggaagttccatcgacggaggaagatgcgccatctataggcatcgcaccgttaacaggcaccgtactattaacagaagccgtgccattgacggaactcattcctttcacaagaggtaaagaatgagattcattcactgatagagctggaactgatcgttctggtacgggtttcccctctttcgagattatttcaccttgaagtggcggtgtagaatgagtggaaggtgtcatcccccaaatatagacatccggtacgcaaccacgcagtaacaacagagcgaacaaaatcaataacagaggcagaagccaccacaaccaatgaggcaatagccaacgtcgagaacgttcggacacaggcggcggcgttgcaaccacagtttcagccgtgggttcggttggtgcaaccgaagcaactgattgcgtcacagaacgtactgtccttaaacactcaagaggattgggacgagcctgctgcttcgcattgacaaatccccaaaaagtcaccacgggtttaccatcgaccaaatagatgtgatcctgatcgggaaactggatagttttactcagcaaagcgccaaaaagacgcatttcaggcgccttttgctggatcatttgtgcactgagccgttcgatagcggcctggtgagcttccagttgccgcaatgctgactgacgttcatcatacgttgcggccgaccagggaacgacgttacctgaaaagccggcataccaatctatccgatcaccctgctcattgccctgtgggattgccagtgaattagcaacatcagagagctgccgcaggcgcaaggtttctcgcaactgtaatgcggaaagatgcacagcctggccattttctcccagcggcagataactttcgagtttatcaccacgtaaaaaagtttttttcacaagaagccgttccttgctatcagaaaatacgacgttgatgtattcattttgcctaaaaatgccattgtaacgacaacggaaagctcagtaaaacccctgtgtttttattgcgcgataatgctcaccaacacacatgtatttatctggaaaataccttgcttaacataatttttttactcattgcaattttccggaatataatcctgcattgcttgatttattacctgattaaactgattggcatcattcgctgtgaatactttgccaccagtctgactggcaatgcaatttcccgcaccactactcatgatatcgacaacattaacctgtagccggggtttgttctctttcaacgcacgagcgacagcacagggatcaccgccacaagtttcatcaccatctgaaattaataagattatcgcatcgcgattcacaccatccactaaagccccagccttttccaaagccagtgccagaggcgtttttccatccggtgtaatacgatcaatcgcccgtttcagtgctggccgctgcgtaggcgaaaaaggtaatgacgcggaaacatgcctgcaatcgaacgcctccaccaagctgacattcatatctgaaggcaatttatcgataatctttttcgccgacttcttggccagagtaatacggctgggttctcgctcgatgtattcgaaggctttcctttgcaacaaatactgtagttcttgtggagtgacatccacactgatagacattgagccagaagcatcaaaaaccaccacaacctctggagcctgattccgttttcgctgagacggacatcgctttctgacatccactggcggggggatcaccacggcttcaggttttacctctggcactgttggcgcgggttgttctattggttgctttattggctgttctactggctttacctgcggaggttttactgccacagggggattaggttgttttatcgcaatatgagtgtgactgcgtggcaggcagcctcgcagtaaccacagcaataatagaatgaacaataacaacagcaaccaccataaccagcgcggctttcgtttctgttctggctgagatgcgacaagatcgggagaagcagtcccgcttccggcaatattttgagatgcagatgcgctcatcggctcccaaaggataacgggttggctatccacactccaaatgtgttcctcagcaggaaactggctgatttttcccagtaacgtcagtaattcgctatccactccctctttttcacttagctgttcacgcaggcgagctaataccgtcaattgacgggcaatttgcgcctggagcttatcgcgttctatcgcagataactgagcaaaagggacgggttggccttgtaaatcactgtaccattcaatggcaccatcactgcttttgacaggtttagcaaataatgtagaaaaatttatcggtagatgctgaactaacgcagaatgtagggcatcatagtgacgtaatagatactcactttgagcgctttcatgcgctactgtacgcgttattcttatcatgcctgcgacccgcttgcggatgtgtaagtccttttaatgcacccaaaatcgctaatccgtatgggaatgtgatttaatacatgaaaaacagtctcctccatttctcatgcgtattttaagccgttaaaccacaagtttttgaatcgggtcatgatatagatgcgttcaacttttgtaaagaagactaaataaatggctgtttattgtgaaattattgggggtttattctaataatattataagttcattgtatccagctatcaatttctgattcaataaaagcgactgagcgagagcctaaaggggagggttgccctctttttacactaagctctatcagtcagccatagaagaatagattttattaatgtccaattcaccattacatgcgatcctgacatcgtaaacatacaagtagccaaatctataaaacaaccaattgaactcattctccagtattgaggaacctattttattgatgttcacagacggaaaagtagcccaccgccttcatgttacttagcaatatgtattgttgattaaatgagggaataaatatgagcactcaagataaaaagcctgagttaaaagccttagaagaagaagatgaagttgtcatagtgccgaccagaaaatatgtaaaagactccattcaaaaccacgcccagagccgtgatcaccctgatgcaacacttaaagataaaggatttgtgatcctaagcaatgatgtcggtagtgatagcgaaactaatgcagcaacaccaaaagcagtcaaagctgcatacgatttggcaaataccgctaataaaaatgctagcaatgcaaataataacgccaatactcgattagagaaaaatcgaaatggggaggatattcctgacaaagaaacatttgtgaaaaatatcggattagcggaaaccgtggaacgggcaaaaaatgcggtaactattgatatagtatatcctgtcggtattgttttatggtttgcacaaaataaaaaccccaacaacctattccctggtacaacttggaaatatattggcgaaaataaaactatcagattggcatctctaaatggttcagacgttttatcaacaggagggaatgactctatcactttgagcgctgcacaaatacctgctcataatcactcattctcagccacaacagacccatttgattatggaacaaaaacaacgaatagcgccggtgagcattttcatgatagtggttggggagaagcatataccgatacaggtaaagcacgatatggagtttatgataatacgaataataattatggctccggttcctctgattgggataattataaatataacaccagcactgatggagctcatcaacatgaagttgatattggtagtcatacccacaccatatcaggtgcaacatcaaacactggtaacggagaagcaatcgatattaccaacacatatattatgttgatgggatggtatagatcggcataatgatgtgattacattagctgaatatccgattattttggggcggttctttacgccccttctgtctccctctgcctcaaatttcacatcgaatcttccggcatctggacacggacatctaaccgggtgccggcaggtaaatcacacgcctcatcatcggtgtaataggtctacccatccactgacttgatgtgcctgttctgcaatcgggcaggcatatgcgcattctgtcggtgggttaccttgatttcaatagccccatccggcagcactttatcaaactccactcgataacaaatcccccgtttcgggaatgccatcagcaaggccgattttatttgttgctcaaagttggcgagccacgggcgcatggtaatggtcagaaaggcgcgggacgcttcgctaaaattactgtaggtgctgtttgaatactcttgcagcaagatcgggctgacattgaacatacgagcgatatcgtcaatcgtgaaacggtgggaagccagccattcggcatcttggttactcatactcaattgttggtattccatcccgccagtcagcggatttaatcaccccagccgccattgtgatggtgtaggcaaaccagtgatcggatagtcgctgagggacaaccgcagacggcgggtaaggatgcaacgattgcggctgaccatcccgccctctgccgcaatgcccgtggacaaggtgcgggtttctctggtcagaatgtaatggcgaagttcatcattgctgagttttttactgatcggttgggttttacctgcctgactgcgttcttcatcagacagtgcttcataatgggtaatttccgtattcagggtgtcggactggctgcgcagttcgtcgaactgttggcttcattcaaataagagtaatctcatttggaatactgttactattcatattctgactaaattagacaggctgatttcttccactaaccttgaattttccacaggaaataaagaataagccctcttatatagctccatagggatatttttatttttatgaaagttaattaatttttcccaagaattttaagcatcaacgctaagatcacactttaaataataggagtttattatcctaacctcctcatttttttccaatgctcttatatcttctgagattttttcgttatttgatatccttctaaaagactttcttttctcaataattttttctcttgattgaaaaaacaaatgccttatacagtaaggttgtatgtatatttacaatggtaaaaacaaaaagtaagaacgtgaaaacacataataaaaaacctatccatccatgattaattattagctccacagttttaacgaaatccataatcaacccttattattaatttatgagttattcttaatcttttaatacctgaccaactttagataacatccccctcacaatgctgccatgagtaagagacaccggtatcatatacacttttccaaaaaaattatgcgttattacagatgcagtcacagtagctatgcaaccgcctttatgattatcatcagagaaaacattcagagatatcagcaccgtcaaatgtatgtccttagacaatagacatatttcatcatcactgatacgtacaatcttaaaaaaatcgatatagcttccagcgtgaaattctttatttaaattttcatctgagaatccatgaattttttctaaaccagcaagacttgatattttatctcttattgaaaaagacaagcgtaaccataatggtgttttttgtgtcatttgattataaacatcaagggcagtcattttgttttcaataaaaattttctgctgactataataacctagattatcttttttatctaaaagcaaaacaccgaatttatcacgatagtacatgtttcaccataatattatttactaaaaaatagtttccatagcactaataaatattactaattaggtatgtcatatgatctgagcagtcaccagtttgtatctttattatacttccatatctctatatcatcatttatatataactacatagattttcacgggataacgggatatatagatatttttttatttatttcaaatagttatcctaccccattttatcccacttatcccgtagcacagaaatactatttttaactctttaatattcaattaattacagcctaccaaaaaaatctttttcgggataactaaattatcagaatacaacattatctagcttcacatcacattacgggatgcaatgggataatacgggataattcaaaaaaaaacataacttactgattatagataattaaatgtttttatcttgtgtgagggctaatcttcatccttgaaaatcaaaaccacaaaccgcccctgagtgccattcactgaaatggttttactgataaagcggtctttctccattttaatcaacatcccagctttttccagagcctcaaagcctgatttcttctgtaatccctgcaatatttcctcttcaaacacactggggataatgtgatattccacctgtccatcactgcggcggttatgtaccagataacccgcgaaattgttaattttcatggcgttagcggtgtctatattaccattcagttttccataggaataaggctgaaaacgcgataagccgtatttctggataaaatcacgggcacgggtgacaacctgatatttttcacggttcccgataccaaaatcttctaaccagtcatcaaaactttgctttatcacagtgtggcaatcttccttgctccagactgtgatatgtgtcgccagttctcggctgcatccagtaagcgccagcgcaccagaaactaccttagcggcttcaaaaatagtgttcccttatagctcttgccactaaatccagtccatcaccgtgattcggttggtcgcactggcgacaatgccagtcaccattatcatgatcatcaataaagtgaaataagatagcctaatttcaataattataaattagactaatcaaattatctgactaagtaataatgttatttttcaaataaatacaatcgtttggtaggatcaagcgtttcaatccccatagtgctaacactgctggtactatatttgcataatatgcagtactaaaagcatacttacctagcaataaaaatattacagcaagtattaatgataggatgaatataataatagagccgcttatgctctgagggatccccacaaattagcgctaataaatcaaaaccatgttttggtagattttggcgagatatttgagtgtgttattaagaacgatttcaaataatattagcggggaatgccgtaatacattctccgctaatgtaagatgagagataactcgccttgatttaatactatttgcctgataattaagatgtattcctttattttcggcataaaaaccaatcagccaaagtacaactgaactcagtgtagcaagtagactcaatactgataaacgaccagtaccgtggctataacttgctctaagaccaaatccaaaacgttcactcttttcatccctaaaattttgctctatttgcattcttcggctgtaaattttcataacctgacgaggtttaaaatcatccatactagtaaaaataagccaaggttccattgctgccgaacgtccatctttgacctgagattttcgtaccattcgatatcgtgattttttgaattttctccctttattcggtcttttatgaagataaaaataaccatcgcaacgtgcatattctgcttttgataatgtgccaaaccctaaaaactgtggggttgtagttgcttttaaagcttgccgtttaaaccaaagctcaccctatttttcaagtcttagttgagtatttcctcgaatgcgtccgacgaaatcccaaccgagcgtttttatctgtttgaaccctgcattttgaaaacctgcatccgtaacaataattactctagctttagggttaacagcactcgctagcatgtcaagaaatgcattttggatggttacattttgttgttcacatgagggaactatttgacttaacaaaggaattgagcgtccatcacaaattcaactcgcacggagtacatgatgttcttgtgagggatatccactccaatcaacagctatgacacacaatgagagtgactcagtcagcatagcaataatattacgaaagatatcaggaatatccctatgaagagcttcattaccgagtagccgatcaatacgtttaattttatgtttgacgtgagcgtttcctggtaaaaagcgcccaatgctggttaacgtaagagaagcaccattaatcaaagcgatagtggcatcgattaatgcattctgacgatatttatgaaatggtgataaagcatctttaaagaagttatgacatatttcacgtacaggcatagcagtgaccttattgacttggtggaacaatcagtagatcacacaacgctatgcctgtctattttctggggattcctcagcgcccagtgcgaggttttttattacctgaataataggaggatttatggattggattaaaactagcgatagattgccaaatgacgatggatattatttagtgtacgaaacttttaataataaagtaggtgatgattatttctttcataacggaagtggcgatcattggaagttatttcatgaataagtaactcactggatgccatttccagagccaccgaaaggagaatgatgatgtttatattaccaaatatgccatgctttccagatacgtctgatattacaaatataatagagagcgaattaaatgaattaaaaaaatccctgactagagataactacccaaaacttgaaattggttacacggttatcttgttgaatggtgatgtcggggttgttgaagatatttttcatgacggcacttatgattgccgaatggaaagaacagaaaagttacacatgttgccacctacaggtatgtagcgaccaaggcaaagcacttagcattgatgaagtctctgctaagggcggctgaacgggattggaaatggttagagaaagcacccgtgatcaaggttccagccgtcagagataaacgtgtcagatggttagagccttgcgaagcccaaagattagttgatgaatgccccgaacctttacagtcaatcgtcaagttcgcactggcaacgggattaaggcgctcaaacattatcaatcttgaatggtctcaaattgatatgcagagacaagtagcatggatacacccagaccaaagtaaatcggctagggctataggggtagccctaaacgaaaccgcttgcagggtgttacgtgcccagataggaaatcataataagtgggtgttcgtccatactaaaccatcaactaatcccgatggaatagtaatgcctaatatcagaaagatgcgtgttgatgataacacagcatggaattccgcattaaagcgagcaggaatagaagatttccgcttccatgatctgagacatacgtgggctagctggctggttcagtcagacgttccattgtcaattttgcaagagatgggcgggtgggaatccattgaaatggtaaggcgatatgctcatttagcacctaatcatttgactgaacacgcacgtcaaattgatgagctttttggaaatctcgtcccaaatccgtcccagtcgggaaaaattgtagttgcaaagtaggggtaagtgcttgattttaaatccttacaggattcgataatgtaatttaactaattatttttaatgaattttattttgttcaattatataacgtgccccccacaatgcccccaaatgaatttgtgtgattcatctataaacagttccagttagcttgcatctttagtatgttcaattaacattaagtatttggaaaaatattttcagagctatattgtgaaactaactaaacttcaaattaaaaatttccgttcactgaaagatcttcaggttgaccttgaagaatatatttcaattatagtcggcaaaaataactcaggaaaaacatcactactcctagcacttgaacgcttccttggtagcacaaatccgcattttgagttggacgatttcaacattgactttcaaaaagacctcgttaagctcattgaaagcgagatatttcctactgagccttgccttaatatgtcacttcgattgttcattaaatatgaagaggatgacgatcttgctaatgtcgggaacaagataattatggatcttgaccccgcaaataactggatcgttctggactttctgtaccagctttccccagagaaccttaattttctcaaacgagactatatagctcacagcaagaaaaaaggtgcaaaagcccaatccacacttgattttcttcgagaaaaccatagcttctactttaagcttgcacgtagaagtatccaattcgatcacgtatcacaagcagcccaagaggatgattatgtcgatctaatcaaagaaggaattcgtttcgaaaacatcatttctttcaagcgtattaatgctcgacggtctgtatcaaataaagactcagaccgaagcttatcgacgatgtcagcaaaaatttattcagcaattttaaacaatgccgatgaagaaaatgtttttgacgatttcaaggaagcactaaacaatacagacggacagctagatagcatctatatccgtcgtcattgaagatgcttgatttttcatttgtatcagatcatgatcgcgctcatgaaaattaatctgacagatgcccaaaaagaagccctcgaattgatgcatgatacgactcgcgatggacgagtacgtgaccgcattaaggccgtgcttttggcctcagaaggctggactgcccagatgattgcccaggctttgcggatccatgaaagtacggtgagtcgccatctgaaagattacttctctgaggaaaaactcgcccctgaaaatgggggctctgaaagccgtttgtctgccgaacaaacgacagcattagtggagtatctgatggcaaatttgatgcacactaccgcccaaattgtggcctatgttcgggctcgatggcaggtgactttcactgttgcaggaatgacgaaatggcttcaccgtcagggtttcagctacaagaagccaatgggtgctccgcataaatttgatgcggataaacagcaacagtttattgaaacctacaacgcgttgaaagaagaatgtggccagaatacgcctattttgtttattgatgcggttcacccgaccctgtccacaaaattaagttatggctggatgaagagcgggcggaagcacgtcaaagtggttgaaaccacgggcagtcgtactcgactcaacatcatgggtgcccttaatttacaacggattgaagagactattgttcgtgaatatccgacgattaacgcgaaaaatgtcgtcctttttttcggctcaatccgggaaacctacccactttcgcaaaaaatccacattattctggatggtgcgggttatcaccgttccgcagtcgttcaattttttgccgaggttttgaatattgagttgcactacctgccgccttacagccctaacctcaacccgattgagcgattatggaagtatgtgaatgagcaggtacgaaacaatgtctattttccggataccaaaacattccgtgaaacgctgcgtcacttttttcatgtcacattgccagaaaaagcgaaagagctcaccactcggttgactgataacttccagattttaaaacccgcctcttcaagttaattgcgtatatgctgatctttttaaagacattattgatgatgtcaggagatttggtggtatcagggagggtgatactcaaatccaaatcaaatcaaccttgcaacatcacgaactactagagggaaacactacagtaatgtacgggcaaggagaagaagcttatgccttacccgaaaattttaacgggttaggctatctgaatttaattagcattatcttcgatatcaaaattattctaaatgagtttaagcgaaataagtctccaaagcccgcagatataaatttgctatttatcgaagaacctgaagctcatactcacccacaaatgcaagcaacattcataaaaaacatcaagaacttgataggcagagatatagtcaatactaatggtatcacgaggccattacagacgattatatctacacattcggctcatatcgttactgaatctgatttcgaagatatccggtacttcaagagaggcagtggaggaacgtactccaaaaaccttaaggatctagaaacacattataataatgctggacataatgagcattacaagttccttaaacagtatctaacaattcaccgatcacagcttttcttcgcagataaggcaatccttgtagaaggtgagacagaacgaatattactacctgctatgatgcgaaaaaaagatcaatccgatgaagcagaggcttgggaaacaggtattcagtctccagtgcctttgctttctcaaaatatctcagtagttgaagttggcgcacactcacaaattttcgaaattttcttagattttattgggataaaaactctcatcatcacagatattgattcagcggtggaagagaaccgtaccgcagaagatgggcaatctaaaacaaataaggagggccatcctatcaaagatctgtgcgctcatgaggtaatgggcgcgacgcatactacaaacaaagctcttcagttcttcttcaatgtaggtcccgaactcaactattttcttgaattgaaaagtgaggaaaaaagagtccataaaaacaaagctaccaaccaatggggaaataatcccgctgggcagatcatgtgtgcctatcagatttcagaagctaatgcagatagtacagcctatcatgctcgtagttttgaggatgcttttcttcatgttaatcggcaattcatgggtaacgcttgcgatgggaatggtgatattgacaagacaaaatttccaagtctagttaagaagcatctaatacaatatcttaacggtgattctccttttgagatggctgaaaacggtattactaaaaagccatcattcgctattgaaatccttcttaatagccaatccactacagttacgaagaaaaattctgccggagatctgaaggtgttctacttagaatttaataattggcaaacaccacaatacattgatgagggactcacatggctcaaaaaggaatgaaattagaacctgaggtagttgatatcctcaaacatattactgaaggaaaaaattttcttctaagcggaggtgcaggaagtggcaaaacatattccttagttcaagttataggcgagcttctgaggattgatccgtgctcatttattgcatgtattacctatactaacgctgctgttaaagagatagaatctcgtatttccagtaagcggctctcagttagcactattcacgatttcttatggaacgcaattaaaccctatcaaaaagaactgcgcaatgttctaatcaaattgatgaacggggaagatcctaggattaaaccaagtaatacaattgtatctgaagatatgttcgatagaaaatctatagaatacaaagaattcagaattctagaacaggggattatttctcatgatgaagtcataattcttgcacgaagtattttcgaaaaatatccgaaaattcgggatattttgagagataagttccgctatattctagtcgatgaataccaagatacatctcctgacgttataaatattcttctcgattttctccccttaagctctcgcaaaggagtatgtggcttctttggtgacagcatgcaatccatctatgacgagggagttggaacaattcaaaattatattaataacggtatagtaaaagaggtgcgaaaagagcagaaccgccgtaacccgaagctcgtttatgaactagcaaataaacttcgtgatgatagcttaatacagcatgcttctgacgatcaaaacgcgcccaatatgaacaatggtataattaaaaagggtactatatgtttctattattcttccggagaaatagataaactggattctgttcgtaatcatctaaattggaattttgatgatgtactcgaaactaaagaacttaacttgactcataatctcattgcacctcaagcaggttttggggatttaatggaaatatatgacaaagatggtgtactagattttcgagatcgaatcgtgaaatttgtccaaaagcatggtgacttcaataaatataatgaattgacgttcggtgaagtcattgaggaggtccaaagaggcaaaacggacaaagaactaaacgctgttagcccaacacctcagatgcaaaaatttattgatactcaccctgatttattgaatgaggcaaagaagaataattttcatctacttaggcatatgtatgtcaacaaagatcaacttatcgatgataacaagcttagtgaaaatgacattcgacgaaaaggatcacaacggtgtaattttattaaacatatcttcaagatacaaacagtcatccatctttatgaacagcgacgatacaacgatttcttgcgaaaaacagaatttcaactcaagcgtgtcaatgacaaagtacgtttgaaagagtgtatagaaactatttgttcaatgaaaaattgtcctattattgatgttattaattttgctcatgagcataaaatttgtattaaagacgaccaatttcacaatttttctcaaaagaaagagtatctttttaatagactaattaatgttaaatacgcatcttttcaaaaactttacgaatatctggaaggacgcactgcattttcaactcagcataaaattaaaggaagagagtttgatagagtactagtcgttttagattcaggaggatggaataaatataattttaaccatttttttgaaaaaatcggtacagaacctgttcgattaagaacgcaaaagttattttatgtttgctgtacacgtgcaaaagaaagtttagcagtttattttcgcgatccatcagatgcaacgcttacacaagcaagagattggtttggggctgaaaatgtcattaaaatttgatgagaaagaaatgaatagaaataaacactttgattaagtggctcagcgatggtgtattgtgaaaatctgtatctttctgtttcggtcagttgatataagctgtggcgggaaagacgttctactatagcaactgaccacctttcttagaaattacacttattaggctaatccaagtttattatgtataatcgacctattaataatagccacaacatattatagccatgaatatcaaattaataactacaaatattattttgtctcatggctaattttactggcaccaaactattcagtagaaaccttgcgagctgtccgttcaataagctgaccgtccatatcaatataccgactaggccaaatttccgaaggatgtattccgaggtaattcgcaataatccactcccctttaggccaaggccgaataagagtatttgctaacgtagatgaactaagccccgcctcacgagaaacagccgctaaggtcgtaccacgcttacgtaatgcagcaataatgtcagcttgatgccagtcatttctaacgttattcattcctgctaccccttccattaaattaatgttgatggtggcgattcaaacagggttcgcggaccggcgttcacttccggcaaggcaaagccttccctgcctgaaccgccattgagggacgatagcaggcacactggcaaaaagattatttaccagtgcccgtgaacgcaaggccgcgacgccttgaccattggattttgccaatggcacgattactttaactgattgtattatctgactcaataaccgaactactaagttcaacaactatatcaatcagaaccgttaaataatcgcctactctgtgttgctttcatcaatagcgagccagtcggtaatagctttttcttgccatacatcaactccaattttcttcctgactggctgagggaaattgccttgttgcatcaattgataaatccacaacttcgataaacgagttttttgcattacttgtgcaagagaaagtgttttaatttttgtcatcaatcactcccccttcccttggctataaacccgttcaacataacgcccgcgaccatcaccatgtcccaaatccattgaaaccagtgctcttgcttcctgacggctaaaaccattctgttggtagaaatttagcgcatcttgcgcccacgcataacgcaaactgtggggagaatggcagccctttaaaccaatccttgtggtatgtgtccgccagtagttcatggcctgcctgagatccggtttatcaatcaacctgccgccccgttgttctgcaatggcaattgcttgctctacagcttctttcacaacagcgacatccagtacacgagtttgccttggccgaccaccttttgtaccgaaaacaacatgaagttttggctcaggttgctctaactgctttcgccagcttttcaacgaagcactacattgcaccgcttcctgagaacgtagccccattaagcgggcaagtttcagagtgactgcaaaccctgcatcacgttcaagtgctttctgataaacagcctgaaacattacatcagggattgcctgctttgttccagcacgactggctccgcttaatcccaatgcctgattactcaaacgcggagaagtttccagtttatccctgcctgccatgcggaagatattacgcagtgcagacatttcattttgcgcagttcgtttggtaacgccctgagataaacgggcatcaacataatgttcaacatgtttagcttttaaatggctgagacttttaacctgaatattcaggctcaataacaatgcacccaaacgccctgcgatccgaatgcggtcatgacaggttttatggctaccgccaccctgacgggcaaaaaactttaattccttaatcaatctgctcatctgtttctccctacttatacctgacaacatgccatctctggcgcgcgacaatgctgacaaaacaggagatgcctgctttgtccttgacggatatctgtgcgccagagtgaacgcgggttgaggtattgcggggtatcggttgagtacgctgtactgccgcctgcataaacaggtcatccccactggcaaaatgccagcctcgatatcgtcaagttctccttttgatgctttttcaatctattaaatgcagtgtcagattcactgcgctgttaaacaggcatgagcctgtaatagtcatgttgtccttttgctgcggcgtcactttcagcgataaatccgcaaaaagtgacgccttaagcaccgcatacggtcagcaaaagtagtgcgagcgttgaaatgccaacaggcacagcaaagctgccgtgaggttaagtatcaaacggtagcaatgagctaattatttaggtgtagagaaacggcccgctgaatatttcaagcaggcatagctaagcatgaactggacgcgcgaaagcaatcctgctcattgaagtgaaatgagattaagatgtaactcaatcccactatgcgagaggctgatgggatcacctgacgctaatgtgaaaagtaagcgagcgcgtgtttcagctcacttgaagttaagataaaaccgaagtggatcttccccacctcaacgtcagctacgaaaggaaatggaaaccataacctaacgcgcctaagtaccgttggtactcttaagttaaaaaaccttcatcgccgaactagctaggattgttcatactggcgatatctgcttccaaaggtgcgcagacgtaccgcaattcttactctccctttcaggctacaggagtttttctagtcgctcgaaagcgcttcctctcagacctatggaagcattggtgaccatcgatgatggtgattaagaaagtttaggttaactggatcttttaaatgtggcaatgagaaactgagagttttaatagtatattcataaataaaccatacccattagatatttaaaggaactaagagctaatagcaaccaatggataattttgcaaatatcaggaaaaatgtaaaaatcatcatattttttgtgaaaactaagtacaattacaaaatcatctctacccccaattaataaattaatttaccatttaactttcatcataaaattaaatcgacccacatttttaatataacactgtgggtctataaaaatagcagttaaataaaaattcagcactagctataaatattaattattttttcatcaaaaaaacacgttactctgccatatgaaaataaatctttcttctgattatcaagtatttccttgataaaaacaggaatggaaaaaagtttatttatcaatcccttgcagagtgcctcatttcttgagaaacattcaacaaaattattaatctcatccatgtcaaaataaagaacataacaaacataatcttgtaaaaaaaagtccagtaaaatactttttctattgcattctaatacaatttttttaaactcatcataaaatttatctttatcttcatggtaaacattaatgagagaagcaaaattattaacgctatcaattattctgctacctctatcttcacaatgtacttcaaatccattacatttaccttcgatattatctaatagagaaactgttaatttcttacaactacgtaattcatcaattgtaattggtattttatttttatactgctcataattattaacaaaaaaatcataatactcctcaaaatattttctaacagataccccacttttaatatgaaaaatttcatcatttttaatagaaaatgcatgtaaagtttcgtagttaacagggtgtgcatacagaaagaaatgaaaaaagaaattccttaatttatttttatccctttttgaaaggaattggaattcgttgattttagaaaactgaaaaaatgagtaactttttacaaaatctctaattagattattattatttatttcattaatagttgtggcgctatttatagtaaataataaataaccaaaaacttgttcatcgtacaaatttatattatcaaacctatcagataaaataggtttccaattacattcttgatgataatgtggatcttctgggaataaatgatagttccactctgaaaatacaacctcatcactttcaataaaaaaaagttcagctccgccgtcttcacattgataatatacaaatttatcaatttc

SEQ ID NO: 16871 - DNA, 940 bp, Xenorhabdus bovienii
  unsure (1)..(940): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgacttgcgttgcacgagtaaaggtattcgtacgtaagataatcagcatgttaagcccaatctgagttccaacccccctttattgaggttaaaagttcaaaaatctttttttaaattagggtgctggtttatatgctcggcaataagagcctcaagctcggctaactcatttttcatgtgatgcatcattgcctctatggactcaataaccctttttggggtatgggttgagccgcttttttcatatcggttacgttcacgctggatatcttctaataacgcatcccgacggcataggagagccttcaattcgcgaatttctataggaggaggttgccagacatcgggttgttttaaggcactgtaacaggctaaaatataggcatctactttgtctgttttagtcagtatccccatacctttagcaaaatcacgcacgcgtaaagggttggctattgcaatccttcccccagcctgatgaagggaataagccaaccgttcatgatagactccggtggcttccataacgatattgacttgttgcagggcaggaatatatttagctaaccacgctattaacatacaggctgaatgttcattattcagaagggattttgttttgcgtttacctttaactccatcatatannnnnnnnnnnnnnnnnnnnnnnnnnnnnnnnnnnnnnaggta

SEQ ID NO: 16872 - DNA, 979 bp, Xenorhabdus bovienii
  unsure (1)..(979): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacattntagccttgcctttattacgcaatcgattatatagatcatttatgtgggggttaaaacgagctgcagtgagtgcagacataaacatcttagcgcggatcttagcagtcagcgttatagataagcgcactcggccatgctcggatgtacctgactgctttgcaataggaataacgccaagatatgcagcgacttgcgttgcacgagtaaaggtattcgtacgtaagataatcagcatgttaagtccaatctgagttccatccccctttattgaggttaaaagttcaaaatctttttttaaattagggtgctggtttatatgctcggcaataagagcctcaagctcggctagctcatttttcatgtgatgcatcattgcctctatggactcaatatccctttttggggtatgggttgagccgcttttttcatatcggtctacgttcacgctggatatcttctaataacgcatcccggcggcataggagagccttcaattcgcgaatttctataggaggaggttgccagacatcgggttgttttaaggcactgtaacaggctaaaatataggcatctacttcgtctgttttagtcagtatccccatacctttagcaaaatcacgcacgcgtaaagggttggctattgcaatccttcccccagcctgatgaagggaataagccaaccgttcatgatagactccggtgcttccataacgataatgacttttgcaggggacctgcaggcatcaagctgc

SEQ ID NO: 16873 - DNA, 67162 bp, Xenorhabdus bovienii
  unsure (1)..(67162): unsure at all n locations
nnnnnnnnnnnnnnnnnnnnnnnnnnnnnnnnnnacaatctgtgtgggcactcacaagacattatcgacagcatcgcaagatgccgaaaactttaaagtcttaaagagtgactaaaacagttaattcattacgaactaacagtaataattctttgagcatcagacttttaattgaagagtttgatcatggctcagattgaacgctggcggcaggcctaacacatgcaagtcgagcggcagcggggggaagcttgcttccccgccggcgagcggcggacgggtgagtaatgtctggggatctgcccgatggagggggataaccactggaaacggtggctaataccgcataacctctgtggagtaaagtgggggaccttcgggcctcacgccatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaatagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatttgctggagacagcgaagtgccttcgggaactgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacctgaatgatagtgattgtgcagtgtccacacagattgtctgataaaaatagagtatcacggtataggcttgtagctcaggtggttagagcgcacccctgataagggtgaggtcggtggttcaagtccactcaggcctaccagacacgttgactcctggccctttccagggttacccggtgcggatgcagcggtgtttctgccttgaaacggcgggcggggaaacggtctgtccagtcgtctgacgtaccggtgataacactgtatggggctatagctcagctgggagagcgcctgccttgcacgcaggaggtcagcggttcgatcccgcttagctccaccatacgaataatttcagaacccatggggaacacgcccgtgtgttgtgaaatttttgctctttaacaatctggaacaagctgaaaatttgaaacaatcagtgctgtcaatgacaggactggtgagtctctcaaaacgcacacccgaagacaccttcgggttgtgaggttaagcgactaagcgtacacggtggatgcctaggcagtcagaggcgatgaagggcgtgctaatctgcgataagcgtcggtaagctgatatgaagcattataaccgacgatacccgaatggggaaacccagtgcaatccgttgcactatcctggcctgaattcatagggtccggaggcgaaccgggggaactgaaacatctcagtaccccgaggaaaagaaatcaaccgagattcccccagtagcggcgagcgaacggggagcagcccagaaccaacatcagcatcagcgtcaggagaacggtctggaaaggccggcagtaaagggtgatagccccgtatctgaagacactggtggtgtgagttcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagccttgatttatcagggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatcttcgggggtagagcactgtttcggctagggggtcatcccgacttaccaacccgatgcaaactgcgaataccgaagaatgttatcacgggagacacacggcgggtgctaacgtccgtcgtgaagagggaaacaacccagaccgccagctaaggtccccaagtcatggttaagtgggaaacgaagtgggaaggctcagacagccaggatgttggcttagaagcagccatcatttaaagaaagcgtaatagctcactggtcgagtcggcctgcgcggaagatgtaacggggctaaaccatgcaccgaagctgcggcagcaacatttcgatgttgttgggtaggggagcgttctgtaagcctgcgaaggtgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccggccgggcgacggttgtcccggttcaagcgtgtaggtgggaagaattggtaaatccgttcttctgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacggagtttcagatgaaagacagcagcttgttcgggattgaaaacagaatttgtctggcggccatagcgcggtggtcccacctgatcccatgccgaactcagcagtgaaacgccgtagcgccgatggtagtgtggggtctccccatgtgagagtagggcactgccagacacctatttagtcagagaagccacccccaccgggtggcttttttgcgtttggagcataaaaatcatttcaaagactgatacaaactatagccagccattgctccggcgacatcataaacaaaatcctgccaactccagcctgttcctggtggacgactatcataaaattctttcgctgcaccaaagctaatagacaggagtaggccaaactgtgcactttcccgatgtgtccaattttgacgttccccataagcattacccgcagccgccatagctgcagaaaatagaaaatgttgagctttatctttacctgtccaaatatcgttggcctgatacatattggaacacgcggttgtaaataggagaggaaagattaccaatacattttttattatatttatgacgggttttatcattgtgatttacgccatgatgtatatttctgtaaatcatagcttgttgataaataagatacaaaaaatcccctctagcgatagcgagaagggattgatgaaccgataattatttatgtattttacagtatgcggctaattaatcggtcgactcggatgcggcgtaaacggcgtatcagtttgcgaaccttgaccggatagagctgtatactttccagctcctgataatcattgataatttttgtatgagtacgaatgcagtccagctctaacgtgcgttgttcttgcatttcctgataagggtcgtgaatgagaatagcattctctagatctagtccccatgctcgtggattgagattattgccggtaattaattgccatttgttatcaacccagatcccttttaagtgataagtattatctgcatctttccatagccgaatggttaattgctggctatcgataaagtattgcagccggctagtaaaacgacgtagattaatttcatacagataaggtaatgccccgatgatcctaaatggttcttccggtggaatgtaaaaatcattggctgttttgtctccaatgataatctcaacctgttttccttgtcggagcaatcgtgatattgcgcgcaccagaaccgccggtaaattgaaataaggtgtgcagatgaccaatttattttcagtactggagatcaggtggcatatcgttttattcagcagattctttttacctaatccgacaagaggtgtgactgccaattcctcatttgaagcctgattctcaatgctgtattcaacactgcgtaatgaagcacgaaactgtcgaatcaaatttttaatttcaagactacgagggcgactgtgactggctaaattttttacggcaccggcggtaagaatattatcatcaataaattgcttcataatagcggcgagttttgcattatgcagcaaatggtaacggtcataacgatatttttcatggcgatgcagatagacatcattaatactggcaccgctataaattaccgtatcatcaaagataaagccttttagatgcaaaacccccagtgcttcgcgggtattcaccggaacgcctagaacggaaatgttggcatctgggtagctttcggccatggaacaataccaatctgcatttgttgccgctgcttctacgccgatacggccacgttgagcacgatgccagtcaacgagaattttgatatccagctcagggcgtttttgtttggcgacatacagagcattcataatatctcgccctgcgtcgtcattttctaaatataaggcggcgatataaatatatttttcagcgttcgcaatgtgttccagtaaggtgctgcggaacacttttgattgataaagtgtcttaatgtcagcaactgactgcggtaatttaggcagttgtgcaaggtgttgttggtgttttgctcgtttaaatttagacaacatcacagtgcgttttttctcttagtttggatggtgggagttccatcatcaggtgtatgaatcaaaatgatctggcgataataccattagtttggttaattgtgagtatgaattaactctcaagtgttgattgctttaagtctgtgcaatctatcacgaaagcgaggattaaagtcttagtacaagattgacaacgccgtcttctaattgaatatcaatagtaaatcccagtttcttcgcaagttgaatcatattacggttttctggcatggtaatggcggtcagcatctggataccatggcctcttgtataatggatcaatttagtcatgagctgatagcctaacgtaatacccttcaaatctgatcgaattaatacagcaaattctgcttcgatattatcgggatcggccatcgctcgggcgacaccaataatttctggtgtagttgctgcatgacgaattgcgacgaatgccatttcacggtcataatcaatttgagtcatattggcgagatcatcatgggtgaattcgctgatctcactgaaatagcggtaatagagatcttcttttgttacctgactaataaatgtcttcaacaggggttcgtcttccggcaggattgggcgcagcagacattcaaaatcttttttgagataaatagtttcttccaattcattgggataaggtcggatcgcgagtttattgtgaggatcacctgttactggcgttaattccattgcgacatccaataaagtgaattcactacctgatgccagcagtggatgaatgttcatacgagagatctgtgggcagtcaatcagaagattggatactctgaccaataattgactgagtgcaggaatatccagtggcagcagcgagcccccggattttattttgccgcccttaatcgcttgaatcaccaaataacgggccagcgccatattcaggggaggcagggcgacagcagtctgcgtttcattaatccaatcgatacccccttctccaagcatgattaaggggccgaatatctcatcttgctcaatggctaccctcagttcttgagcgccagcacggttagccatgctctgcaccaataagccatgaattctggcctgggggaagttctgtttaacgcggtcaataatcgcttgtgctgaggtttttacctcatcagaattgcgcagatagagcattaccccctgaacttctgatttatgggaaatatcgggggaacgtagtttcaatgcgaccggatagccaatcttttcggcgatattgactgcatcatcgctggtatatgcgatccatgtcggtaaggtatttaagccgtaggcttcaagaataggctgcacttcgtgggtatctaatagcgtatttccgctattaagggcttgctggatacactcatgagcgcgtgcagtatttgatgtaatgccgattggcatagcgggggtttccttgagttgcttttggttgcgctgatattccaccatatgcatgaaagccgtgatcgcaccttctggtgtgcggtaggtgggaatacccgcttcactgaataaacgcctcgcttccagagaagaatactccccgcaccaattggtaaagattgtcagccacttcccgcgtggatgttccttaataatctgaatgactttgattgcagtattcatactatgggagatggcgcagggtgaatggattaacaacaaagcatcataatcatggctatcgagcaggagtttaagtgcggcaatatattgttcggatgaagaatcatcaccgagatccagagggttacgcaggatcagggtatcggggagaatagcagacaatttattgctagtttcgtctcctaacactgcaagtttgccggttctcctgagtagctcatccagcgccatagccgcaggtgctgaaccgttactgacgatcaataggcgttccccgcgcagtggccgcataaaacttaatgtttccaccgcagaaaacatttcatgcgtatcctgtacccgcaacaatccagcacgttgaatcgcagcgtcataagccgcatcgaaattctgttgttctcccaataattcctgagctttgcgggtgcggctgctttttacaaccagaatgggcttattgcgcgaagcgctgcgtgaggctgacagaaaacgacgggcatcactgatatgttcaaggtgtagcagaatcgcactggttttgctgtctcgcgccagaaaatcgaggagatcgtcaatatcgatatcaacactgtctcccaatgcaatgaaataggaaaaaccaatattacggtggttggcccaatccagaatggtattggatattgctgctgactgtgagatgaaagccagtttgcccttgaggataggaataggggaaaaactggcattcagcccgatccatggagccagaataccgaggctgttaggtcccagcatgcggatgtgatgtttttggctgaactgtttcagttcggcaaactgtgaaggcggtgaggagagaataataaccgttttgcatcctcgttgcgccaattgttccagcaaagataggttacggctgtgatgagtgcatatcacggctaaatccggcgtcagtggtaatttatcaatagagggataagccagtactccgagaatagctgttttattcggcgttacaggaagaattgggccagtaaaatgccccattagcagattccgcatcaacatggagctagctttctctggtttttcagaagcaccaatcactgcgatggattttgggtgtaataatgcttccagtccgcgctgactcatttctgggattcctcattagttatcacatcaataaacaatcacccttgattaaacaattactatgaataactttagccaccatcagacactttagcggggattgtcaagaattactgtgattgactcctcttgacgatgaggtttcccagccagatattgttcacgaaaatgattgaaatggctgagtagtgtttgtgatgcctcaaggtcattagccagctcaagtgcagctgctgcgacttcggcagtacaatgctgttcttttctggatggtatccgcagtaaataatccattttggcgcaattattgatagataatagggggatatcgtccaaatatgggctttttcgaaacattttccttgcttctggccaagtgccatccaatataatgaatagcggcgctttctggttatcagggagttgctgatatacagtacggggaggtgtggcataactctcagggaagatcaaatagggctgtcgagttgggtcgcgcagcgcttcaagcattcgttgatcaggctcggttcttgaccagagaaaagcgtgtgtatcgggcagaatatcggcaatcaactttcccgtattgctgggcttcattggctcagtatcaaacatgatgagacagaagcggctagtcgcgtttactggtgaaattgtttcacacaggcagcttttttggggtaataaacaatgcaggcaacgctgcactcggcagccccttgcctgaaagggacgggtagagcgggctagacgctgttggcgaagttgataaacggtgttgttatttctcatttaggaactcaaacatgtttgtgaataaagccgataaaaaattagcgggtattttaatggattgtcgttgccagaggtagcttcgggcgcgtacatcgggtaatctgcgcgccataacgcagttggagaaatgaatgaacgattcctatagtggtaagaatggcaaagtcaaagtgatgtatgtccgtagtgagggcaacaatgaccgccgcagcaacaatgacagtcgtaataacaataaacgcccgtcgtctggtcagggacgcgatcagggggggcgccgtcgtgataatgaacgtccagcgtattcaggtgatcgttctccttggaaaacagtctcccgcccggtagaagaatccttgacgcctgatcatggcggtatcagcggtaaaagccagattgatcctgaacagcttcgccgtcagcggctggaagagactcggatctatggtgaaaatgcctgtcaggcgatgttccagaaccgtccagaagccattgtccgagcttggtttgtccaatcagtgacacctcgttttcgtgatgctttgaaatggatggcggcaaatcgcaaggcttaccatgtggttgatgatgaagagttagttaaggcatcaggcactgagcatcatggtggcgtatgcttcctgattaaaaagcgtaatgggctggatgtagaaacttatttgcagcaagcaccagcaaaagactgtgttctggcattggaaaatgtgggcaatccgcacaaccttggggcaattatgcgcagttgcgctcattttggcgtgcagggcgtgatattacaggatgtggcgatgctggaatcgggtgcggctgttcgtactgctgaaggtggggcggagcacatcaaaggtattgatgctgatggtttcacaacgacgttgaaccaattccgctgtgcaggttataccattgtgaccacctcaagccataagggaagcacaacgctagccaaagcggatcttccggaaaaaatggttttggtcttgggtcaggaaagtgatggtttgagtgacagtacctgggaagatggtgatatccgtctctcgattggtggcacgggtcgagtagaaagcctgaacgtttctgtcgcaacaggtattatgctggcggaatggtggcgccagaataaagcctgatacagagattaaagtaccttaataaggctctggttatttaaccagagcctttattttaccactaattcattaaaattatttctattaaaaattttatgaaatattttactaatgtaattaaatataaaatttataatatcgttctttaattataaagatattacgttttataactgcaaaattttaaacaatatatctaaaaaaaccattctatttacgtggttaatctggtcgttatttatcttctgccccattctttagtaaaatttcatttaaagtctttacattttatggttgttaatagtaatgattttaattatcatccatgcaagaaaaaatagaaagatcgtaattttagtgagctagaattcacccccccagagctggatagcaatatccaaagtttatatataggtgtatctaccctgtcagtcatgtttatgcatggaaacgggatgatgctggatatgaatgaagggttttattaaatgagtccgttgtacactaaattgagtcctcaaacctcgcatttaactagagaaagctggttacatgccaacaggcatcttatagcaaaaatattgcgtgaacttttgcatgagaaattaatctttccggtaaatcagagcacggataaatcttattcgattaaaattgatcaatttcaataccatttcaaggcacaatcctaccaacttgaccatctggatattgatgttgcgtcaataacgaaattcagtcataaccaaccgcagcctcttgatgccattcaactgattattgagttgcatccactgttggatatttctgagaagatgctgcctatttatcttgatgaaatatccagcacgctttatggctacgcttttaaatatcaaaataatcggctgaccgcacagaacttggctcaagctgattatcaggctgtggaaacagcgatgactgaagggcatcctgtctttattgctaataacggccgtattggttttgatgctgatgattatttacactatgcaccagaaagcgcaaatccagtgacattaatttggattgccgtgcatcggaataaaaccgttttttctgcattatcttcgctctcttattcacagctggtggcagaagaactggaaaaatatttgccagcccgttttgaacaacacatgcagacattgggattaaatctgtcagattattacctgatgcctgtgcatccttggcaatggctgcaccgtattgccatcagttttgcggcagatattgccaaccaagaaattgtttatcttggtgaaggccatgatcgctaccttgcccagcaatctattcgcacatttttcaatatcagccagcccaagaaaaattatgtgaaaacggcgctgtcagtcctcaatatggggtttatgcgtgggttggacccgcatagcatggtgacgacaccgcaaattaatgagtggctcaatcatttagtagaatccgatgttttctttcaggaaaaagggttcaccatattgcgggaacgtgcagcaataggctatttcaatcattactttgaagcagcaattaaaaaagataatccgcataaaaaaatgttgtcagcgttatggcgtgaaagcccaatgacgattctgaaagaaactcagcgtctgatgaccatggcttcattgttacatgttgatagagaaggtgatgcggtcgttgctgccttggttaaggattcaggtttatcggcggaagcgtgggtaacgcgttatcttgatgcctatttttctccactgctacattctttcttcacttatgatctggtctttatgccacatggcgaaaacctgatgctggtattggaaaacaatgtaccggtaaaaatgttaatgaaagatattggtgaagaaattgcaattttgaatggagatatccaactccctgaagagattgatttcctgcatgtcaccatcaaggatgaaatgaaaattaattatattttccttgatatctttgactgtttcttccgctatctgacccctttgttgcaaaaacatcttgcattgccagaagcgcgcttttgggagttagtggctcagtgtgtttacaactaccagtcacaacatctgaatcagatagaaaaattccgcaaatttgatctgtttaagcatgattttgtgcgtacttgcttgaatcgcctgcaaatggcgaataaccagcagatgattgatctcgatgatcgtgaaaagaacctgaaatttgccggaactttagttaatccacttcacgccctacgcgaaaaatacgctgtcactgttgagacagataactgatgggtacgtcaaagtaaaaataataacaaatcaatttggtaatgggataagtagagtgataaatccaattttgcaaccgaatcatttgaccaagaaaaaagtgctttctctcatgatcccgctgattttggcgggaaatagcacggctatggcagaagaaacacagagtaaaaacgataaaattatcgtaacggcaggagcgccagggcatgaaggtgtaacggaagacactggaatgtacaacacctcctcaatggtgaccgcgacaggtttgaatatgtctgcccgtgaaacaccacaaagtgttagcgtaatgaccaaacagcggatggtggatgaaaatctgagcagtgttgagagcgctattggtagtattaccggtatgactgtccgccaggctgacagtgatcgttttactttcacttcaagaggtatgacggtcaaagacatgctacgtgatggcgtgccgactttttatgatatccgttttaattatggtgataacctgatggataccaccatttttgatcgccttgaagtggtgcgtggagcggctggcctaatggtggggccaggcacaccttcagcagcggttaacgtgatccgtaaacgtccaacccaagatttccgaggtgaaatgacgctgggcggtggttcttgggataaatggcggactggccttgatctgtctggcccattaaatgaagacgggacagtcagagggcgttttgtcaccgcttatcaacgttccaattcttttattgatcgtgacaaacatgagaagtatcccttctatggcattcttgaagcggatctgacagaaaatactttgctgaccgtcggtgcggattatcagattaaccatacccgtggcggtatgtttggtggtttgcctatttattttaaagatggcagtaaaaccgattacaaacgcagtgacagttatgcgcctgattgggcgttttctaaagtccgctcattctctacctttaccagtttgcaacaccaatttgataatggctggagtgtgaaaggaacctttacttatgatcacggtactcttgaccaaaaagtattgtgggcaacgggttttcctgatcgggtgactaatgagggaatgtatccgggcaacatgacgctgattgatggaactcgtcgccagcgtaatttcgatttgcaggtaaacggtgactatagattgcttgggcgtacccatcatgccagctttggtctgaattatcagaaacagaatttccagaatgattactattacgccacctgtatgcgtgagggaaattctaataaagaagatcaagataaaacagggaaaagaaataactgtaattacctaggggattttactcaatcttcatggggttatgctgaaccaacgtggggtaaaaacagaacaactggctctgatggttataacgagcaaactgcgggatatgccgttacccaaatctcactggctgatcctgtaacattgattcttggtgggcgagtcaccagttggaaaactcgtggtgataatttcggtatgccacaaaatgccagctacagtgatgaatttgtaccgtatggtgggttggtttataacattacgccagacttctccgtttatggcagttataccaaaatttttgatccagaaagtcgaattaaccgtaatggccaactccttaaaccagtcacaggtgaaaactatgaactgggtctgaagggtgttgctctggataacggtcttgattactcattggcaatttttgatatccgtcaggataattttacggaatgggatagtactgctccacgacgtccagataacatcagaacttattatgtgctcaatggggtaaaaacccgtggtttcgaagctgaagttagtggtcaaattaccgatgattggcggatttatgcgggttacacccaattccgagcgactgatccaaagggtaaacgtatcaatacggataacccaagtcggttattcaaactgttcacaacttatactttaccgggtgtcatgagcgatttaacgcttggtggaggtgtcaactggcaggacaaaacgtggttggagcttgatacacctactggtaaacgccaagatgagcaaggtagctttgccacggttaacctgatgggacgttatcaatttacaccggatctctccctgagcgtgaacttgaaaaacctttttgacaagaagtactacacctcgttcggtggctatacccagtactactacggcgcaccacgtaatgtcgaagcaacattgagttataaattctaagaaaatcacggacggcgacgatgtatttttattcatctgaacaacaacgggctgtaaagggttactggtaatggtattaacacgttgcaaaatgctggtcgccgtgccgttgatattgctggtaagtttgctggtaggctgtgataagccagcggtctcaaaaaatttaccgacggatgccgttggttatcctaaaacgatcgccaccgcgctgggaacggcggtaataaaccaatcgccgcaaaggattgtagcgttgggaacgggcagcgaagatatcttgctggatctgggaatcattccgattgggattgaatctcatcgctggggcggagacgctgaaggctatttgccctggtttagggacgagatagaacggcgtggcgaaaaactgccagctattatcgagatgtaccctgaactggatatcgaaaaaattatcagtctgaagccggatttgattttggcaatgcaatcgggcatcacgcaggaacagtatgatcatctgtcccattttgttcccgtgattgcttatccggaaaaaccgtggcagacgacaccacagcagcagatagcgctggtagctcatgcattggataaaatacaactgggagaaaaactcagtgccgaactggatacaatgctgtcacaggcaggcagcacggttcctaatgtagggcgttatcgctttgcttatattaaggcgggaacgacagggaacattttatcgatctatgtcaaaaatgatccacgcgttgatacgatggtacatcttggcctgtctttgctcccgttggctgacaccttaactgcgccttttggtagtttttcagccaatatcggtttggaaaacgccgacttgctcaatggtgcggatattctggtgacttggtattccagcgaaaaagagcgtcaggatacggaatcacagcctctgtttagttctatccgcgctgttcgccaagggggatatattccgttgactgatcagtcaatcgtaatgtccatgtcctatggctcaccactcagtctgcgttgggggttgtcaaggtttatgccgttgctgaagcaggagatagcaaaacataatgaacgctaaacggcgaactgccctcatattgggtttagtattaatggcattgctaacctgtctttgcattgttgccagcttgagtttgggttcaaaatcattgccgctgtcagcgatctggcagcattattggttgggagatcaaggcagttattacgatttggtcattaatgcccgtgaacctcgcaccctgattggtttaatggcgggagcggcactggcgcttgcgggaacagtaacccaagggctgttacgcaatccgctgggtgatcccggtctgctcggtatcaatgcaggtgcggcaactgccgtagtctgcttttcttttattcctgctctggacatactgccgcgtttttggaccgcttttattggtgcaagtctgtcaacattgctgttctatttgttgagtggagggcctcgcaatacaaactctgtacgtttggttttgacgggagcggctatccatgcctgcctgtttgcgttggtgcaaggtatcgttctgataaatgcacaggccatggacaactatcgtttctggacaattggttctttaagtgcaatgtcgttgaacgaagccagtttgttgatcccttatttgctggtggctgtggtcgtgacactttcgctcagtgcttctctgaatgtgatggtctttggtgaagggattgccagttctctgggggcgaatgttgcccgtacccgcatattatcgctggtgatggttaccatgctggcagccacagcgacggcaatggccggcccaatctcatttattggtctggccgcaccgcacttaatgcgtgcactggtaggcagtgattttcgttggttgttaccttactgcctgttcgctggcccctgtctgctgcttatctcagatgtcgtggcccggttgctgattgcgccacaagagatcatggtgggtattattacggctggcatgggtgctccgttgctttatctggtcgctaaaaatcgttcacagaaaataatggcagagtagagcatggcgcagataaatttcacggcagggcagccaaaaatcaaaatcttcacgttgggcaatgccgtctttattgcaccttcatcgcatacgagcagagtgactctgtcaatgttgctgctgcttgtggtgctcttttatctggctttgtcgttaggccgagaaggcatggataatccttttctggcgatggagacgccttatcaggaatttatcctgttgcagatccgcttacccagagcgctggtggcaataggtgcaggtatgacgctggcactgtccggttccctttttcagttgacgacccgcaatgcacttggtagcccggatatcattggcattaatgcaggagcggctgtcggtatcatggttgcattgcttttctggccaagtatattgccggttcctttgggggcgttattgggtgcctgtcttgctgtattgctggtttatatcggcaatggttcgggtgttggcaacatgcaggctaacaaaatagtgatttcggggattgccgttgccacattttgcatggcatttgtcgattttgctatctcgagtattcgtattgagcaggctcagcagatcagctcgctattgcgtggcagccttgccagccgacgctggcaggatgtcgggcttatcagtggcatggtgattttcattccctttttgtgttggctgggcaggcaattgaactatacccattttggtgatgatattgctaatacccttggtgtacctgtccgtttcatccagattgtcagcatactactggccgtaacctttgccacaatgtcggtattagtcgtggggcctgtcgcttttattgcgctgtctgcaccacaaattgcccgacggttggtacgagcgaaaggagcagcattgttttgctctgccttggtgggggctttattgatgctggcttctgatttaattaccctgatattaccaacggtagctcgcttgcctgtaggaatgattaccgcggtggttggtggtatctatttaatgtatttactgtatgccgaattaaggagaacgcgataatgtcatcggatgctaattccccagtggttacttcacggctgaaagcccatgatctttcactggcatacggtaaaagaaccattattgagggggtgaatctcgcgattcacgatagtgaattcagtgtcattattggctctaacggatgtggaaaatcaacactgttgcgcgctatcagccgaaatatgcagccacagcgaggtgaagttcagcttgatggaatcaatatccatcgttataagccaaaggcggtggcgcgcgagctatcactgctgacgcagggcgccaccgtgacggaggcactgacaatctatgatttagttgcccgtgggcgttatgcctatcaatctttcctgcggcaatggtcagcagaagatgagcgcgtggttaatgaagcattgcaggctgtggatttagatgagatgtcgcagaaattggtcagtgaactttcaggcggtcagcgccagcgcgcttggtttgctatgacactggcacagcaaactccgatcattctgttggatgagccgaccacttatctggatattacgcaccaaattgagttactcgatttatgtcagcgtctgcacagacaaggaaaaacgctggtgttggtattgcatgatatcaatttggcgctgcgttatgcgtcacgtttgatcatgatgaaaaatggtcaaatttatgccgaaggcgtacctgaagagattgtcactgaacaaagtattgcagatgtttttggtttggaatgcagaattatctgtgaccctgagtctggcaagccattgattattcctaaatacaaaatgaataaataaccaacaatgctatttttatatagcgcgtgtttgggttaggacataaatatataataggggaattttaatgataaataaaaataatgaaatctccaatgaatgggtatctaaaatagagattgaagatattattaaactatttgatggcgcattcagtcactttaattcatcaatgaaagtgaatgcggaaaatattccttcagatagtatggaattttatcaatggtcgaacgaaaaagaattctcattattgatgaaacgctatcaagatgcatattatggtaataatgaacagaaaccaaatcagaaagggctttattctttatgggcacaatggtattttggtttaactattcctcctatgatgctaatgttgctggaatattcccaacctatagatacagattatcatctttttcagattgaatttcatgaaagtggcaggccagatattgtgtattatcagttaacgtggctgaacgaatctttatcattattggaacgttatcattctttgcttgatcgtcatattattcctgtgtgtgagaaaatcgaatcttatcggggaataaatgggcgcttattatggaacaatattggttatgtgattcactggtacttggataatttcaagggaagaatgagcactgaacaatatgaatcgttgatacagaatcttttcttcgagcaaacgctaccagatggcagggataatccgctttatcgtacgatgattttgaaaaataatatcatacagcgtcgcagttgctgccaaagaaacaaattgccgggtgtggggaattgtcacgattgtcctcttgaatctacagcataaatagaatcagctaaattcatttttttacaaaaataaaaaattatcatttattgataattacgtattttattaattttttgcttgatgaagatatttgtttttattaaaaataatgtcgagaaattatctaagataatttatataaacaataaggatatataatgtcttaagaggttcaaataaccgccaatccgttggtgaaaaacgcctcattaatgggattttaattattttaaagatagttatttctatcaaatttttttgaatatagataatcaatagcgttattttgaaaacaccagtgatgttattgtcaagataaaaagaatattaaataagataaattttccttttatttttagcatcataaatatgttagctacattcattttccgcttatatttccagcggtgattgctgaaatggtaatcgaaattataaattcatcttatatttattaggagtgattatgacaactaaaacttatgattttatcgcgattggaatcggcccatttaatctgggattggcttgtctggtgcaaccgataaaagagattaccagcctgtttattgatcagaaagccggctttaactggcatcccggcatgatgcttgagagttccaccatgcaaacgccgttcatggcagatttagtgacattggcatctcctacccatcctttgagctttctcaattatattaaacagaaaggccgtatttactcgttctatattcgggaaagttttttcctgatgcgcaaagagtataaccaatattgtcagtgggcggcggagcaactatctaatttgcgttttaatacgcgggttgagaatatcagttatgacgcctctacttcactttataccttgcattgcgctgatactctgactgggcaaaaacaccaatttttctgcaaaaaattggtgttgggaaccgggccttcgtcctatattccaaaatgttgcagaccgtttgctgatcatatggtgacatcgggagattatttagaaaataaggccgccttacagcagaagaaatcgattactgttctgggaagtggccaaagtgcagcggagattttctacgatctgcttgaggatattgatgcccatggttatcaactcaattgggtaactcgttccccacgttttttccctctcgaatataccaagctaacgttggaaatgacttcaccagaatatgtggattacttctatagcttgccagagaacaaacgtgaagcattgaatcgttcgcaacagccactttataaaggaattaacagttcgcttatcaatgaaattttcgacttgatgtataccaagcgattgagtggggaattagatgtttcgttgtataccaacagcgaattgcgacaagtacatttcatagcagaaagacaaggcgtcgcagaagaacagaaattgatactggatttattccagcatgaacaggaagcggcattttctttggaaacagagggattggtgctcgccacgggttatcaataccagatcccaagttttatggagggtatccagcatcttatccgctgggataagcaggggcgttatgatgttcagcgtaattacagcatcgattgtagaaacgaaatttttgtacagaacgtcgagcttcatactcatggttttgtgacgccggatttgggcatggccagttaccgtaactctcgcttgattcaggaaattactggaacggaacattatgtgatagagaaaagtattgcgtttcaacagtttggtgttgcgagtgaaggagtattctgatgtctgccgttgctactgtttcatttgaaaaaacgctgcctgatttgggcaccttttcattgcgtccactgaatctgacagaggatattgttgctattaccgattgggttaatcaggaatatgcctattattgggggatgcaaagccataccgaacaacaggtaaaaaccttttatcaagatctgttgaatcgccagcctgattctgtctttatcggaatttaccaagaacagccagtatttttgctggagtgttattgggcgcaggatgatcaaataggaaaatactatccagcccgtccgggtgacatgggaatgcatattctggttgcgccatctgaacagaaaatcagtcaattcacatggggaattttccagacaattatcgcgtttatttttaaaaatcctgctgtgaacagaattgtcgtcgagccggatatacgaaatgaaaaaatccatcggctcaacttgcgggctggctttgtttacgacaaaactgtgcagttatcccacaaaactgcagggttggcattttgtactcgggagcaacatcaaatggcattacaatcagcgaaattagcagtaccttctaaccagactcattatcttgtcagccatttacatcccgccatttggcagaaggttaatcggctgcatttgaggaaagccatttctgaattttcccatgaatgtttactgttccctgaacaattgacagaaaaagcagatcaagacggttatcaccactatcgtttggataatcctgagtactcagttaattatcatttcagagcgcgccgattggctttagatcactggttgattgatgttgattcgttgcgaaaaatgcaggcaggtgactggtgcgagctggactttatcagctttatcattgaattcaaacaacagcttggtatcagtgatacagtgatgccgacttacctggaagaactgacgagcacattgcatagcagtgcattcaaatatcaccgaaacggtattgatgtagaagagctggtcaatgctgattttcagacaatcgaagctgaaatgatggaagggcatccgatcttcgtcgctaacaatgggcgtatcggctttgatgcggaagatttccagaaatttagtcctgagtcagcttctgacatacgtttggtatggttggcggcgcataaaagtaaagctcactttgcctgcattgaacaactcagttaccaacaattgatggaacaggaactgggggaagcggaaatagccaagtttaatcatcaactgatccttcttgggcttaatccagaagaatatctgctgatgccattccatccgtggcagtggcaaaataaactgccatccgtatttgcgcacgaccttgccaaccgaaaactggtctatttggggcaaggaacggatgtatatcaggctcaacaatcgatacgaaccctgttcaatcgcagccatccacagcggtattacgtaaaagtagcattatccatcctcaacatgggatttatgcgtgggttgtcaccttattatatggcaacaacgccaggcattaatgactggctgtttgatttggtacaaaaggacgctgttttacagagctacggttttcggttgttgagggaagttgcgagcatcggttttagaaacagttattatgagcaggccattcatggtgatacgccttataagaaaatgatggcgatgctgtggagggaaaatcctctgccattgattgaaccaaatcagaagctgatgacaatggctgcattattacatcatgatcagcaggggaaagccttcctgccagccttgatatctgcatcaggtctgccgactcaggaatggatacgtcgttatctggattgctatctgtcaccattactgcactgtttgtatgcttacgatttgatgtttatgccacatggtgaaaatatcattatggtgctggagaatcatattccgcaatacatcttcatgaaagatctggcagaagaaattctggtcgtgaaccccgatgcggatttgccagaaaaggccagccgagtgaaagtcagtatgccggaagagatgaaaacattgaccattttatctgatgtgttcgatggtgtgttccgctatttatcggcaattcttgatgagcagggcggatattcgcaagaacaattctggcagactgtggcggattgcattctggattaccaatctcattatccagaatttagtaaacaatttgtgcgttatgaactgtttacgccagaaataaaacgctgctgcttgaacagattgcaaattaccaataatcgacaaatgctggatttatctgatcccgcactgagttttaagttttctgataatctgactaatccaattgccccgtttgttaagaatattgtaaatgttgtttaattatcaacttatctgtatctgaaacgatttaaacctcatcagccacgactgtctcttgattataagtttgactcaagaggcagataattatgatgaggttttattatatggttatatctctgaattgtatttaattaaataatctatattgaaaaactacgatataatttactttaaatagagtggctaggtttaataatatatttattatattaaaatatacgccaattcatctaatatataatgaaatgattttattaaaatactattttattatgatgtcattttatgataaataattaaatgaacagaatttttataaccatcgggtggacacatcagtaagaatgcttcaaaatcgctgctaagaacagttctgccccaacagttggagttattatgcaagggcttgaattatatgaagagaaaatcgaacgtgaccaatttcgtggagaaattattaaaaacagtaagtttttaaattgcgacttttcgagtagcgatttgagagatacccagtttatcgattgccagttttatgagccaacaaattatctgggctgtaatttcaaacacgccatgctgaaagaggccagtttcaaaaactgtgatttgtccatggcagacttcaggtatattaatgcccttggtatagagattcgcgggtgcaggcttcaaggagccgattttcggggcgccagttttatgaatagggtgagtgccaacatccagttctgctctgcttatatcactaaaagtaacttaagctacacaaactttgcggatgttattcttgaaaaatgtgaattatgggaaaaccgctggcatgaaacccatattttgggagcgaggttcagtggttccgatctttccggtggtgaatttatctcttttgactggaatgcggccgactttacttattgtgatctgaccaattctacactgggtgagcttgatattcggaaagttgatttgaaaggcgttaaattagagtcttatcaagtcgcagaactgttagaacgaattggtattgtggtaatggcttaagggatgatgaattaaattctgagcttaatttaacgggagcattcactcccgttgataagtagtcgatttaaacaggtagacttaaacagatagattaaaaataaatagccctaatgtgcgcctccgctatctttacttcctgcgctaaatgggggttttgccatccataccagtagcaccaaaaccaaaaatattcccgccgcaagccaaaaaatttcattggcagagataattaacccttgatgagtgatctgctttgccagataagctgaaatttgctggtcattcatgcccaactgtgtcaactgctgatatgtttgctgataattcggatcatacggattgatatgctctgtaaagtaggagtgatgcatagcttcacgttgtgtccatatcgtagttgtaatggaggctccgattgaacctgacaatatgcggataaagttggacaggctggaagctgacgccatgcgttccggtggtaaacctgacaaagtgatcgtggtcagaggcatgaagaagcaagccatggcaaatccctgaaaaaattgaggccatgcaacagcggcaaaattcatgcctggctcaaatgtatacgcccgccaatagaaacaaacagtgtaaataatgaaactgactgtcacgatataacgcatgtcgatcttatggccatactttccaatgagcggtgagagcagtaaaggcatcaatccgattggtgcggcagctaaacctgcccatgtcgcggtataaccgaagacttcctgtaatagctgcggcagcaagactatcgtgccaaagtaaaacatgaaggcaaggctgaggcatagtgtaccaatggtgaaattacgctctttaaacagtgatagatcgataatgggatgatcgtcagtgagttcccagacaattagaatggttaatgaaataacggcgatcacggtaaggacaataatttcagtggagttgaaccaatcaagttcttttccttggtcaagcatgacttgcagacaaccaatcccaaggaccaacagcactaacccgacagtatctatggcgtggatttctgttttagtttctctattccgcagtgtttgtcttgcgacaaagataatggcgatgccaaggggaatgttaataaagaaaatccatccccagtggtagttatcactgatatatccccccagaatcgggccacaaatcggcgcaacaacgatcaccacggaccagagtgccagtgccatgtttcgtttggcaggagggtaattattcaataacaggctttgacaaagtggaattatcggccctgcgaccactccttggataacgcgaaataaaatcagtacttccaaactgttggagataccacatagccatgaggagaaagtaaagagtgcggtagaccaaatgaacagcttgacctcgccaatgcgctttgccaaccagccagtaataggaatggatattgcatttgcgacaccaaaggaggtaatgacccatgttccctgtgagtttgatgcccccagattgcccgcaatcgtcggtatggcgacattggcaatagtggagtccagaaccaacatgaaagtagccattgcaagggaaatggtcagcagcgccagtttagcgcctgtaagtggttctcgtgtcaccataacgtccccttaagactaattccttgaatgactattaatgacgtcattaactattttattggcaggagccatatcgatcgtcagtgcattcgtgtgataagcggggtgatggcgttcagaggttgccagtgtcatttcacgggtatctgctgtatctaccgtgacttttgtcgataacccaatgcgcaggggatactgcttcaattgctcaggatcaagctcaatacggacaggcaagcgttgaacaactttaatccagttgccactggcgttttgggcgggtaatagagaaaacgcactaccggttcccatatcaaggcctgccactttgcccgtatatacgacaccatcactgtaaaaatcgctgatgatttttactgtctgcccgatacgcatgttggcgagttgggtttccttgaaattggcctcaatccacatattgctggcagggacgatgaccatcaaaggtgtccctgaattaatgcgggagcctacctgaacattacgacgagaaacatatccatcaacaggactgacaattttagtcctctgtaaggctagccaggcatcacgaacccctgaagcggctttttctaccgtaggttgtttatccagtggagtatccagaatggtggcctgattactgttgtactgcgcgattgctacatccagatcagctttggcaatcgcgacactctcacgcgtatgttgcagctcttctttaccaatgacttccttaataccaagtatttccctgcggtttagatcgttttgtgccttgctgagagcaatctttttcaggttgatgacggcttgatattgttgattatcgagtatgcgctggtgggtggttcgaacggctgtggctaactcattttcggcttttttcagtaccagttcagcatcaaggggattgagttgcactagaacactaccgctttttacaaaatcggtattgtcaaaatagacggtagtcacgctgccagtgacctgagacatgacctgtacctgatttcctgtcacataggcattgtcggtttcctgatgatgacgtaaaacgaggaaccaataaacagtataaacggcaccaaggataagaaagagtaaggtcagtaatatgatgatacttcggcgctgtcttttcttattgcggctcgtagctgtcggggattttatttcctctttaatattcatggtgaatctccgtgtttttcttgtttaacttgctgtttttttaaaaccattgtagacagaacacacctccagtagtgtgcatttacactactggaaagggtgaattacatggattcaaatattatctgaggataatagttagccatatgaggtatcagatgatacaggctagcagaaaagattttttaggtcatgttgccataacacgtttttcttgatgcgaactgttcggtacaaatagaatcactttttaaaacaatctccgatattatccaatcgagccaataattttctcatcaatttctctaactgtttttgttcctcctgttcaagcgcagaccaaagtttaatcaggcagtcatgttgaggtggaagtaaactattcaagaaatttgtacctttctctgttagatgaagatggaggcaacgacgatcgttatggctctcttttctttctatccagccttgcttttctaattcatcagcaatccgagttgcgtttgtgcgggaagaacccaatgcagcactaagttctgatggctgaatgctacgactttctttggtatccaggatcatcagtgccataaacaaggtttcattgattccttgcgctctcagcatgttattacgattttccagtatcttaccctggacatgcatcgataagcgagtgagtaatatctcttgatagggcaaacttttgttcaactctttttgctgtgtaacacggcaattaagcaactcttcagtgggagtgaatgaactttccattgtttagataccttattagtttcaaccggtaaagtaacttctgttaaaaaccctacaaatactatattaaaagttaaatttagcaattgtagttatttattatcatcatatttcttttaatattgatacctaattcataaataccttgaatgttaatccaaaaacagtggctccagacagtgtggcaatgctgatacttcgtgttttatagaacagtaaacagatagtcaggcagccgatcaaagtcggaaaaaatttattatgttcgcgtatgacttcaggaatacctgaaacaataaggagcgaacaaattgatgcaataccaatactgtccagtacaaccccagtatttcccgctttggtcataggcgagcgattgacaccaaagcgcaagggtagataacggaataaaaaattggctacccctacaacaataccgattagaagtattctattatcaatcatcagttttattcttattcaactgtgtggtatgaaactgaagaagtgctgtcaggcaaccacccaaaattcccgcaagaatggcaaccgggatggaaaagcatgtgacacctatcaacgcacccgccagagacgcagtaacgcagtagctattttgttttttgacagatgccaataaaaaacttaaaaacagggctgggagcataaaggtcatggcggcttcaacggctggatatgagtccagataaccattccccagcagggagcctgctacggttcccagtacccaggatagccatgaacacatagcgatcgcgaccatccagttttcactccagctacgctggtctttaatcaatttagcggtcgctgcggcaaaaacctcatcagtcagaccaaaagcccagatcgcagttttcttttctgataatttttgtttgatgcgataacgcagagctgggccatatagaatatggcggatatccatcgccaggacggtcaaagcagaaacccacagagacatacctgcactaagcagagcggtgatgataaattggcttgcccccgcatagatgacacatgaaaaaaatatggcttcgaggggagtaaagcccagctttacggcactcaggccaaatgcgaaggcgatgggaatatagccaatggcaatgggtaagctatcaataatgccttctgagaacgaagaaattttgttcggaatggggagctcaggtatggatgtcccagattttggggtatcgggcgcaggtttatcaggtattggcatggagctgattgtttttttgttaataggtgaaacaacattaacaaaatatggtgaaagtgaaaatatgaaatgtataaattatttaattaatattattaagacccgtgttttttataggtttttagcagtgtggagataaaagtcataaattttcgttaatgaatttacaactttttttgagaagtacaaggttagcctgttttttgtccagtcgcctttctggcagcctcaagccattcatcaacgattgtctggtgtgctctgagccaaccttcagcatgatgttcaatatcaatatcagaaactttgttactgtgcatgcgcaaattctgtgcgttgatatcagcaactggcaatttcatgacagcaaaaagtgttgcagccgccgggtttttctctgcccaggtcttgtttgccacaatatgcatagtactgggaggaaaaccatagttacggccatttggcaattgggtatcaaccacaccgtcatcattgagcgcagagaagggaacctgtagccatatcacatccgtacctggtttcagtacatcgctgatccagtaaggtgtccacgtgtaatagaaaataggtttgccttctcgatagcgagcgatcgtatcagccatcatagcagcatagtttccttgattatgttcgacggtattctccaatccataggcttttagttggctgttaattgccttttcgcatccccaaccggggttacaaccggttaaatctgccttaccgtctccattgctgtcaaacaacttagcaagttggggatcttgtaattgtgcgatattggtgatgcgatatttttctgccgtttttttatcgatcaaataaccttgaacagcattttcaacatatgttcctttgcgatagaattttttatcaccacctgcggctttgtattgcgcgttatggaggggaacccaattaacggccatgaatgtggcatcaccagcggcaatggaagcataagcgacattataatcgacttctttgatgggtttgatgtcatagccgagtttttccaacgccttgcagacaatcagtgtctgaaaagtttcttcgctgatggtgctttgcagcggttgtacactgatgcctttgccgggtagttcaacggcaaatagcggcatgctcactaatgatgacagggttaatcccaagatcgtattcttattcatgatctttttacaccgagttatgatacgcatagtttctctctccgttatttgtcggtttgaacgttattgtcacaggaggattttcgtgcccattttcgggcaaaaagtgtgatgaacagccctatcggccccgagtgataccagagtccgcctctgacacggctgtttttccccagagattgggtcagtcgatcaaggataatggcaagaatgacaattcctgcgcccccaacggctgccagccctatatcaagacggccaatcccgcgcagtaccatctgtcccaaaccaccaacggctatcatggaagcaatgacgaccatggagagtgccagcattaatgtttgattcacgcctgccataattgtaggcatggcaaggggaagctgaactttgaacaacatttggcgtggacttgcaccaaaggatcgggctgcctcaatgagatctgccggaacttgtttgatccctaaaattgtcaggcgaacaatgggcggcaaggcaaaaatgatcgtgaccatgaccccaggcacattaccgatgccgaacaacatcacgataggaacgaggtagacaaaagctggtgttgtctgcattgcatccagcaaggggcggacaattcgggcaacccgttcactgtgtgctagccagatagcgagcggtaagccaatgagaatgcagaacagcagagccgtgagcaccagtgccagtgttatcatggcttcagaccatgcgccaatagcaccgatcaggatcagtgaaatgaaggaagtgacccctatacccgttcctgcaagctgccacgccagcagtgcgaaaattagaatggtcacgggagcaggcatggaaaccagaaactgttcaaacccgtttaagataaaatcgaccggaacacgtacaccttgaaaaataggccggaaatgcaggacgagccagtcaatagcgtgggttacccatgaatcaaacggaatcagtttatgctgaaaaggcgccatgatattgaagtgttctgatgaaatctcagttgcggaagtatccagccaatcattatttgatgatggatcgactgtggcgctattgatccaaggatcactgaaggttgcctgatcagatgctgtctgcggggttttactgctcattcggtgtttccttatctaaagcctgtaacaggatccctttggaaatgacacctaaataacggtcattatcacccacaacaggaacagcacagggggattgcgccacgatagatatcaattcatgcagcggcatatcagccgagacggcggcgggttctttcaaaatggcatattcaatcgattgcttttctgtcagcgctttttgtaaggagcagaccgaaaccacgccaataaatttctggcctttttcgatcagatatccataactcctgtcttcatcatccagaactttcagagccgagcgagggccaaaacctgtggctatatggagcagagcttcttgccgacgacgagcaacatcttttgctgagaatacatggctaatatctacacctcggaagaacgttttgacgtaatcattgacaggattattcaggatctcatcaggtgtacccacttgtacaatgatgcccccctgcatgattgcaatgcgatcaccgatgcgcattgcttcatccaagtcatgggaaataaatataatcgtgcgctggtgctcgccctgcagacgtagtacttcgtcctgcatttcggtacggatcaggggatcgagagcagagaaggcttcatccatcaatagaatatcgggatcattggctaatgctctcgctaacccgatacgctgttgcataccgccggaaagctcatcgggatatgacagagcgtagttttccagattcacttgtttcaaggtttcaagtgccttgtagtgacgctcttttttgggaatgccggcaagttccatcccaaacgcggtattttccagaacatttaaatggggcatgagtgcaaatgactggaaaaccatactcattttactgcggcgaacctccctcagttggatgtctgaaatagcagcaatatcttttccatcaatgagaacctgacctctggtgggttctatcagacgattgagaaggcgtaccagcgtggatttacctgaaccggataaccccatgatgacaaacacttcgccttcttcaatggccagattggcgttttgcactccaattgccagcccggttttttcaaaaatctgttccttgttgagaccggattctaataacttaaatgcgggttctggatgatcgccgaatattttatataaatttttaacttcgagtttaattgtcatgcaataaatattttccgtttgttaatgatatattttctttattactccgaatcattcgaatcattttttcacatatctaccctagcacactgaaatatgttgacaaccccttgtttagaattattaatcaaaatggatatttattatggcgtaatgtttgtgactataatttgatttttaatcttttttaagaaagaaaatatgtaatcctaaaggcgtattttaggtagtgttgatgactcatctttctgttatatatttattttttttgtttttttaggtgtcatttttttaggtgttacagaaaatttgaattaatctgtatttttattttacatgcaataaaaatatttcaatcaataagaaattttaatttattttaacggttttatatcagggtatgtagaaaaaaagctaaattttggtgaaagcaatacaacttactcccttcatttttcaagtcgctgttttgttgactacttttacttactctatccacatcgttatctatatctatgctttgggaattcgttttacttgctaccgtactgcaacttgaaatttattagacacagtatagtaattacttatatatctcatcagacagatcttgcgttgtagagaaggctggcaaaattgtaccaaacacaactgtgtttgccataaatgataacgcttctggtaaaattactttctgagtactgctgtagctaataataaaaactaacatttttgtattatattcggataatctatttatgaaataaatacaatatatgttgtgtttttttataaaagccactatatatagtggctttatcttttttgaatgaaccccattaaaaatagggtgttcaatcagattggcaatcctctgatttttattgtcagagggcgggatggtttctttatcaaattgtcagatgtgtaactgaattcatcattgcaaattgatgaaggagagatttaggctagtatagaaattattaacaataaattaaatggaggtagtttatgtatcatcattacctgaatactccagaaggttttcctaaaccttatatacatatcactgcagatgatgaaggagtcactagcatctactttgttaatgaaaagaaagaattagaatctaaaaacacgattactaagcagtgtgtaaaagagttacaggaatatttcaaaggaaaacgacatacattcacggttcctttgagcatgaagggaacagaattccagaagcgagtctggcagcagctctgcaacatcccttttggcgacatgtggagttataaacaattggcattgactctggggtccgttaattattgccgtgctgtaggaatggcaaactcacgtaatcccatttccctgattgtaccctgccatcgagtgattgggcatgatggtaagttagtcggctatactggtgggctggatatcaaagtatggttgctggaacatgaaaagaataaaaaaattaaagctaaacagagttgaacaaaatactagtttatttatgaaattactactaaagtataaaataactttatgaaataaaacaaaacgtgcgtttttcacattttgttatatatttcgtgatctacgttacagacagtagactatattattgttgtactgtatgtgacacagagtttgtgtcttatttattaaaggtaagtttgatgtcaaaaattaaaggtaacgttaagtggtttaatgaatctaaaggattcggttttatcactccagaagatggtagcaaagatgtttttgtacacttttccgccattcagtctaacggtttcaaaactttggctgaaggtcaaagagtcgagtttgaaatcactgagggtgcgaaaggtccatctgctgcaaacgttgtcccaatctaatttctatccccgtattttgaaaacccgtttactacaacgggttttttatgtttttaaacacaacttgatttagaacctattcatcacagcaaaagcaaacgttgtcatcaataatgagcccactaggtttgccagaatactgctcaatgcccagccgatttttccagcctgtaacaaataaacaacttcaacagaaaaggtggaaaaggttgtcaacccaccacagaaacccgtggttagcatcaatttccaaactggatcaaggtgtgtggccttattaaaataagccaatcccaacccaatgataaatgccccaacgcagttagccgtcagcgtaccaacggcaagaggagtagaggcattattcaggcggaagctaattaaccagcgcaatacactgcccaagccaccacctataaatacagcaaaaataatatttatcatgatggtggcggtaggttatttgacttccatacctttggcctgcatatcagcatggtaagaagagcggacaaatggaccacaggcagcgtgggtaaagcccatctccagtgcggcttctttcatctcgtcaaattcagcagggctgacataacgctggactggcaggtgatggcggcttggctgtaaatattggcctaatgtcagcatggtgacgccatgacgacgtaaatcacgcatcacttctaaaatttctttgttggtctcgcccaatcccaccatcaaacctgacttggttgggatatttggatgagtttccttgaatttttccagtagcttcaacgaccactcgtagttagcacctgggcgaacctgacgatatacccgtggtacgttttccagattgtggttaaatacatcaggtggtgtcgctgtcagaatttccagcgcacgatccatgcggccacggaaatcaggtactagtgtttcgatcttaattgatgggtttttttcgcgaatggcagagatacagtcggcaaaatgctgtgcgccgccatcacgcagatcatcacggtcaacagaggtgatcacgacataacgcagagccatatcttgaatggtttgtgcgagcttggtgggctcattggtatctggtgcagtcgggcgaccatgtgccacgtcacagaatgggcagcgacgggtacaaatcgcaccaaggatcataaaggtggctgttccgtggttaaagcactcggccaggttagggcaggaggcttcttcacagacggaatgcaaaccatttttgcgcattgccgctttgatgccctgaatgcggctggaatccgcaggaagtttgattttcatccactcaggtttacgcaagagtgcttcacgttctgtggccactgtttttacagggatcagagccattttatctgcgtcgcgatatttgacaccgcgttccatctgaattggtttactcataatcgtgccggttccagttatattcttcagattttgatttattgtctaatccctatgtcagagccatcagatcaataaatccattcaattttttttgaaaaatgttaaaaaattatatcatctttcattgattagttgaaatcccaagatccggcagaatttttccaccagaacaggttgtacatcttcaaccgttacctctgctgcgaggtgactgagttgagtcatctgcattcccgcataaccacatggattaatgcgtaaaaatggctgtaagtccattgcaatattcagtgccagaccgtggaaagagcatcctttacggatacgcagcccaagtgaacatattttgttgttctggacatagacacccggcgcatctggacgggcatgcgcttctacaccaaaataagccaaggtttcgattacggtattctcgattgcggtcaccaactggcgcacaccaatttttgcccgctttaaatcgactaagacatacatgacctgttgcccagggccatgataggttacttgaccgcccctgtcggattgaataacgggaatctcacctggcgtaagcacatgctcggctttacctgcctgaccttgcgtaaacactttttcgtgctggacgagccaaatttcatcggatgtttccgcagtacgctgctcagtaaactggtgcatagcatcagaaactggcccgtaaggctggatacccagctggcgtaaaataacggtgttatgttgcaatgggaacttcatcattcgttaacaaaaattacccgccagtataacgtcctaaaaggattcccaccagtttgagaatgctttaatgcaataatattgttaattagacgaatatatttaaattttatattatgatggttatatatttcgatgatttctcctttaatctctgtttgagctaacagatggtcagaaaaaaccaactcctgattgtggggcatctttgtagttttctggtgctcctttacagcctctctatgttgctgcctatttttgttgcactattttataaagaaaaaagtgtgtttgccttttttgagacgttgctcattggattgagtgtcggaagcgttggttggtattttactcgcaaaaccaaggcacaacccagtacccaagatggatttcttatcatcgtgttgttctggctgctcttttcgctgctcagtgctttgcctttcgttcttgataaaagcctgaatatcaaccttgtggatgcggtgtttgaaggtgtgtcgggtatcacaacgacaggagcaacggtactgaatgatgtgtctgaattacccaagtctattctctattatcgtgcacagcttaattttattggtggattgggagttatcgtgctggctgttgcgattctgccattgctcggtattggtggggtaaaactctatcaatcagaaatgcctggcccttttaaagaagagcgcttgacccctcgccttgccgacagtgctaaaagtctatggctggtttatctgctgttgggggctctatgttcggtgagttttaaagtagcgggaatgtcgtggtttgatgccgtttgccatggaatttcgaccgtttctttaggtggattttcgacccgcaatgaaagccttggttattatgacagtgccgctattgaaatggtggggggcattttctcggtattggcggcagtcaactttacgctctattttgttgcactgacacgcagaagcctaaaaccactgttgaaaaatgccgaactgaaattttttctgctggtgctggcggcggtagtttgcattatctggttggagttatatcgctcgggtatgtatggtgtgaaggaagctttcgttcatggttttttcatgaccagttccatgatgaccgataatggcttggcgacttcagattatgcccaatggccttcccacacgatattgatgctgttggcagtcagtttctttgggggctgtgtgggatcgacatgtggcggtattaaggcactccgtttcctgatcctggcaaagcagagtatcagcgaaattaatcagcttgttcatccgaatgccatttcaacgattaaagttggccagtcttcggttcatgaaagggtactgcgctctgtctgggggtttttctttttgtatgtctttttcagttgtttctttatctgggcattgaatctgttgggttatgatttagtgacctcgtttgctaccgttgctgcctgtatcaataatatgggagtcggttatggcgcaaccgcgcaaggtttcggtgatcttgatgctgtcgcgaaatggatgatgtgtgcggccatgttattggggcgtcttgaaatttatccgatcctgatcctctgttcgaaggcattctggcgtttttgaggtggcagtgaacacgagctggttgtgttcgctacatcattaatgatattgataattattatcaaaatgatattgatttaagatattccttgaagtatgttgactaatattttatcaataaagagataacaagcctttttgttaatataatattatgtcttcaacctactctatttttactctgttcttaaaagaacgaatcttggtatcaccatccatattacgctgtgttttccaagggcctgacgtacacaggatgcgaagatatgcacctgatcagcgtattaagttactatttcctgttcaaaataaccctgcactaaagttagagggtggggaagagtggcgtcgtgattacatggcgatacctaaagagcagcgtccattgatgcgaacttacacattgagagcgttacgaattgaaaagcacgaaatggatgttgagtttgttctgcacggaaaaaatagtccggtatccaattggttatcccatgcaaacttgggggatacactccaaattgttgctccgatggcaggtttggatggctgtatggaaaatagcgggggagggtgtgaatggaatcctcctgagcacatgtgtcagacactcctgatcgccgatgagactgccttgccagccgctttgggtatcctcgaacaattagctcagcgtgataacccaccttatgttcaggcattctttgaagttcttgagcaaggggattgtgtcaatgtagaacatttcacatttgctgatgtgttctggttgccccgagatactgaaggaaagtatcagtatggtaaacggctgatagaggaagtcccccagcacgtcactattccagaatcagcgtttatcaaagaacaagctctggatgagaagaccacatcagagggtgaattatgggaaagggcgacaagtgaaaataatgagactcgtttttacggttggattgcagcagaatcctctgtggtaaagaaactgcgccagtatttgcttcaggaacgtcatttagatcgttcattaatcaatttcatggcgtattggtcgaaatcttcatccaaggatgatcacgcatgatttgatgaatttcaccatgaatcgcggcttttaaaatgccccgactggggcattaaatacttaatcaatcacgttgtggctgtttaatcacagaaccactcgcaccagctccagattacctaactcttcatacagcgtttcaacctgttcaatatgtgtggcattgatggtgatggaaaccgagtggtaattgcctttgctgcttggtttcacaactggggagtaatcgcccggcgcatggcgctgaaccacttcaataacttgatccaccagctcaggtcgagctaaacccatcactttgtaagtgaatgagcaggggaactcaagcagttcatttaattttgttttcatgggcactcctagtttacttgccacggcaacgtggtagtttttgccgtggcgtgattattttctaacaattagtgactaatataaggttcaatgcttacctttcaagggatcaaccaaaccaatgatggaacatcaatttgatgtaatcgatcatacggctgaagaaacccccttctttgatttcctgcatcacgaccaatggacgttgttcaatggttttaccatcaagctggaagttgatagtaccgacgacttgatctttggcgagtggggcatgtagttcggtattgttcaatacgtagctggctttcagatctttcaggcggccacggggaatagtcaggtaaacatttttatcgacgcccaattgtaccttatcagcatcaccaaaccagactggttctgaggcaaattctttacccacctgcaatggtgagaccgtttcgaagaagcggaagccccaagtcagcagttttttgctgtcggtttcacggcctttgaatgttgggctgcccatgacgacagaaattaggcgcatattactttcggtggcggaagaaacaaggttataaccggcgccactggtgtggccggttttgatgccatccacattcaggctcttatcccatagcagcccgttacggttgggttgatggatattgttgtaagtaaattctttctctttatagattgcatactcatccggtacatcacggatcagagcctgaccaatcagtgccatatcatgggcagaactgtactgacctgctgcatctaggccatggacagtctcaaagtgtgtgttttgcaaccctagattctgcacatacttattcatcaggttgacgaacgcatcttgactgcctgccacatagtcagccattgcgacacaggcatcattaccggattgcaggttgataccacgggatagcatggcaacagaaacttgatcgccgggtttcaaaaacatcagtgaggagcctttaaacaccggattgcccgttgcccaagcatccttaccgacggtaacagtgtcattcggaccgattttccctgatttaatggcttgaccaatcacatagctggtcatcatcttcgtcaaactggcgggatcacgtcggatatccgaatttttttctgccaatatcttgcctgaattgtaatcaatcagaatataggcttctgcatcggtttggggaacgccggggatcatggttttgaaattatcatccgtgttggcgaatgcagaagcgctggcagccagagcgatgcctaaggtggtatttttaataaaacggggaagaactatgtatttcatgattgattaggtagcatccgtgagaaagggattgataataagcgacataataacaaatgacaaaaaagctgacattaaaacaaattgagtgagttgaagggttacacttttttacccgggtgtttttttaccacctgctgatattgacggaattgtcgaatatcagcaggtgattggctagtcagggggcaacaataaaggaggattgatgcatctggtcagtcaatttcttttgcagttccgttgcttgctggcggctgagaggccccagttgaacgcgatggacattgccaaattgcataatacgaccttgtacattaaagcgctggcttaatgattgttgccactctttggctttctgttcagaactgatggcaccaacttgtaccatgaaaccgcccgttgatgtggcagcaggctcaggtgtcacgggggaagtcgcaacaggttcagtctgtggctgcaatatccattttgtctctgattgctttggtgcagatggtgttcccacgggcggtgaagtgagaaacggattttctgtattcccagacagattctgatcaacagcaggttgccccacagtattttgctctgcgatattttgttcagatgggctgctcatcatggctggtgcgccaatattgggcctgtcaggtaaagcatagctttgtttgacgatagtcgcgccttctgtccccaagccagaaactgatccatcaggtgcaacttgaattccatccagtttgactctgctttgtggcatcagattcaggcgttccgccgccgcccgcgataattcaatgattttgcccggcttattgtaagggccacggtcattaattctgacaatcatcatgcgcccgttgctcaaattagtgacccggacatagcttggaataggtaatgtggggtgcgcagccgctaaagcataaggactggctcgttcaccaattgctgtcagttttccattcgcttcttcaccgaacccactggcataacccgtctgggtgaagttagctgagtcctgcacgatgcgataggattgccgatccctttgatagtcttggttggcacttgggtgataaggctcatattgaggttctgcacccaatacctcacgggttggaacaggaggaatggaggagtcctctcttttattacctgttgttgtacagcctgatatcagtacagccacgatgccgagtataagccattgttgatgcatgaaacctcttccttataagcttttggacaataacttgcgatgcgtatgtattgacataataatgccgaatcctgccattaagacaattaatgccgagccgccatagctaatcagcggcaggggaacgccgactacaggcaggataccgctcaccatgccgatatttacgaagacatagacaaatagaattagtattaaaccacccaccatcacccgaccaaaagtattttgtgctctggcggcaataaccaaaccacgtatgatgagcagcagatagagagccagcaagacaagaacacccaccagccccagctcttcagagagaacagcgaaaatgaaatccgtatggcgttcaggtagaaattccaattgcgactgtgttccttgcaaccagcctttgccaaattcccctcctgagccaatggcgattttggactggatgatgtgatagcccttacccagtggatcactttcaggatccagcagcatcatgactctggcacgttggtagtcatgcatcaaaaagaaccataatattggaagaaaacaggcaatcagtaaaatggcaatggtgattaaccgccagttcattcctgccagaaacagaatgaatacaccagaggcggcaatcaggatagaggttcccaagtctggctgtgcggcgaccagtagggtaggcaagaatgtcagaatcagtgcaatccccgtatttttcaatgagggagggcaaagatcacggttcatgaaacgagcaaccatcaaaggaacggcaattttagcaatttccgatggctggaagcgcacaatgcccagatccagccagcgttgcgcacccttacttatttgcccaaaaacatcaacaaggattagcaggaacacgcatccaatataaagataaggtgcccagttctcgtatatgcgtggcgggacttgagccaagacgatcatgactatcagccccatgataacctgtccggctttacgctccatcatgtcaacgtcttgtccactggcgctccacataatgaaaagactgtagactaacaatgccagaatgcacagtagcagtgggatatcgatatgtactctggtccagaaaggaacctttttctgagagtctgtcatggcgttactcaattagcttgtgttccggttacggcctgagccgcaacgggagtgatgcgctcgctatccttgattaaaatatgatccagaatttgacgaattatcgtcccaaccgcgggtcctgagccgccgttttccagaataatagaaatggcaaccgttgggctgtcatagggcgcgaaggctatcattagtttgtgatcacgcagatgttctgccagtttgcttgcattataggtttcatagctgaatacctgtgcggtgcctgattttacggctgctttgtagggtgcaccggcaaagaacctgcgtgcggtgccgtttggggcattggcgacaccgtacatgccatctttggcaatttcccagtagccggaatggatatcaccaatcgaatgatttacaggaggttggtaaggatgcatttcgccattcacgcgagtacccagcaagaaatgtggcgtttttacttcgccatcattgattaatatcatcagagccttcaccatctgcataggggtggctgtccagtatccctgaccgatgccgacagaaatggtgtcaccttgataccacggttttttatagcgtttcactttccattctcgggttggcatgttgccgggagtttcctccctcaaatcaatacctgtaaattgaccataaccaaaccttgacatccattcggaaagcctatcgatgcccatatcataggctaattgatagaaaaaagtatctgccgattcaacgatagatttatgcacattcagtttaccgtgtccccagcgtttccagtcacgataacgtttttctgagccgggtagctgccaccagccgggatcgaatatcgtggtattcttcgtgatgatatcgctactcagtgccgcagcagcaataaaaggtttaaccgttgatgccggtgggtaagccccttgggttgcgcggttaattagcgggcggttagggtcgttgagcagatttttataatccttactggaaatcccatccacaaacaggttggggtcatagcttgggttcgataccattgccaacacttcaccagtacgaggatcagtgaccacgacagcagcacggctggttgtcagaatttgttcaatatagttttgcagattcaaatctatcgacagataaatatctttacctgcctgtgggggttgttcatgtaactggcggatcaccctgccacggttgttgacttcaacttcttcatagccgggtttgccatgcagagttgattcataataacgctcaatgcccagcttaccgatatcatgggtagctgcatagtcagcgagaataccctctttctcaagccgttctacgtccttgtcattgattttggcgacataaccaatcacgtgggtgagagcggaaccaaaaggatactcgcgacgctgatagcccttgatttccagccctggaaaacgatattggttgacggaaaaccgagcaacctgtacttggttcagggatgttttcaaaggaacggaggtaaaacgacgtgcgcgttgacgttctttcttgaagttttctatatcttcatcggtcaggtcaactatggagcgcaactcatccagcgttttgtcaagattatcgattttctgtggaatgatttctaattggtaaatagtgcggttagtcgctaatggtgttccattacggtcataaataataccccgacttggggcaatgggaacgagcttaatgcggttcccatttgagcgggtctggtaatcttcgtggcgaatgatctggagattataaagattggcaatcagaatccccgttaaaatgataatgccaatgaacgccacgagtgcgcggcgcataaaaagggctgattcagccgtatgatcgcgaaaaggggttcgtttattcttcatcccattgccagaattcacggtgatagattacccaatttattcccgatggtaagggtgattagtcgtgatactccacgcccgataaaggctttcagcaaccagaacccgtaccagagggtgtggcagcgtcagtggagaaagtgaccaactttgttctgcggcagctttgcaggccggagccagaccttctgggccaccaataagcaaactgacatttctgccgtcctgtttccagcgttctagctgctgtgctaactgtggggtatcccaacgagatccgggaatatccagtgtcacaatgcgattgtctttgccgacagccgacagcatttgttcgccttctttttcaagaatacgtttgatgtcagcatttttacctcgtttccctgcagggacttcaatcagctcaaaaggcgtatccttgggaaaacggtgcaaataatcgataaagccggtctgaacccagtccggcatttttgttcctacagcgaccaattgtaacttcaaactcaactccagagtttttccagttcgtacatgcgacggctgtcttcttgcatgacgtgtatcattatttcgccgaggtcaacgactatccagtctgagatgccctgcccttcgacacccagcggcataaacccggctttgcggcagtcatcaaccagattgtctgccactgacatcagatgacgggttgatgtgcctgtgcagataaccatgcagtcggtaatactggattttccacgaacatctatagaaacaatatcctgtgctttggaatcttcaagtttatcaataacaaatttttgtagttctgtgccttgcaaaaggatcaccttaatttcatcaaattggttgaataatgcagaataatagcatgccaatctctgtaaaagtaagcgactcagcggcaaatcacagtatgttttcgttattgtcgatatagcccccgtgaatcgacataattttgtatcgctggaggcagtaaatcatcacagctcagcccttgctgatggcgttgacgaatatcagttgcggagatgtttaataacggagtagcggccagataaatacaaccgtgtggcttttgtctcaatgatatcggagtgtcaattttgtgctgttcaagccatttttgcatatctgaggttgaaagttggctttgataacccggacgtgagcagaccagaaggtggcagatacccagtaattcttcccatttataccatgtatggatagattgcagtgaatcctgtccgatgatgaatgccagtggccgttgctcgccgacttcttgacgaaaggatttcagcgtttctatcgtataagagggcgtctgacgttccagttcacgggtatcgacggtaaaaagcgggttgtcctgtacggccagacgaaccatctccaaccgttgactggcggttgcttcaggttgtggacgatgtggtggaacatggtttggcagtaaaatgacctgctttagccctacctgtttcgctaatgcctccacagggcgcaagtgaccataatgaatgggatcgaatgtgccaccaaacagtgcttgaataatcggggagctcgggtctattgttgaatcagtggaatgaagcattcaagaagctctctggtaatgtttttccgcataacagcatggatagtgtttccaggtcagcccaaatcgattggccataatcctgtttgacgcacagttccatctgggtcagcaaatgtatggctgattgcagatcttgctgtgacaagcgctgtaatgcggttgtcagcagtgatcgacggttttgccagactttgtgttgatcaaacagtgtcttcaaaggggtcgtcttatcctgacgtttgaggattaacagcagcattagctctcgttgtatggtgcgaagcaggatgatcgcttcagtatcttcttgtcgaagttgtttcagtatatgccacgcccgtttgattttgcctgccagcagggcatcaacccagtgatagggggcaaaatgtgccgcatcgttgacagcttcttcgacacggggaagcgtcagccgattatcgggatggagcagagaaaggcgttccagtgcctgagccagtgccaataaatttccctcatagcaatagcatagtagttggttagcttcatcttccagtgatagccccatgcttctggcacgttgtgccacccattgaggaagacggttttgttcaggtgtcagacaactgacgtacacaccattttggccaagtgttttgaaccacggactgttttcctgcgccttggtgagtttatgcccacgtaatatcaataagatatctgcgtgcagcaatccagacagcttggttagccgttctaccattgctgcatttgggccattttccggcagtagcagggtaagtgactggcgagaggaaaacaggctgagtgactggcacaggctgaatatttcttcccattcagtatggttatccaaagaaaaggtgaaatgctccagaaaaccatgctgttcagccactctgcggatgctgtcctgactttcctgcaacagcaacggctcgttgccccatagcaggtaattgtttcgcagcccttcattgagctgcgaaaggagttgttcaggatagagtcggatcattgcttttgtgcagtcactgcttgctgtttttcttcagttttcaagagttctgcactgtgaacggtcagcaactggcgcataagctggtgggctgcttgctcgcgcatttcctgctgaatcagttcattttccgcatcctttgccagtgcttccagtgggttatcgaagaaagaacgatcaacccttgcctgcaatggatagataccgccattcggcatgagtacttgagcatcaacatacagtactaattgacgttccgccgctttaccatcctgaaatacagaagcggtttctttgtgctcattagaacccaagagtttcaggatcggtactgaggcatcgccacgttcaacaatcttgacgtcgttcaggcgaagttgctggcgtactgctctggccagaggcccgtagggatcacctgaacttaattgtaatgtttgaagttcttttggtacctgtgttgtgccacgaagatgaaaaccacagccagcggtgaccagcaccgctaaccccagaaacaacgtgaaaataccatgccgcacattatttcctaccaaaatatggactcctgttatcagccgacgaccagattcagcaatttgcctggaacatagatgactttacgaatactgacgccttcaaggtatttcgcaacgctgtattcttttgccgccatctcttggacatactcttttgtcgcatctgcgggtacggtaatgcgaccacgaaccttaccgttaatctggatgatgaccagcttggtatcatccaccattgcctgctcatcagcctgtggccatgcagcagtgtcaatgtcgctttcattaccaagttctttccacatcacaaaacaagcgtgtggcgtgataggggaaagcatacgtacaaccgcagtcagtgcttcctgcattaaagcgcgatcttgctcggtttcctgtgggacacgagtcagtttgttcatcagctccatgatagccgcaactgcggtattgaatgcttgacgacggccgatatcatcggtgactttcgcaagggttttatgtaagtcacgacgcaaatctttctgttcagtcgtcaggctggcgatatccagcggctgggttgtacctttgctgctgtgttcatacaccaggcgccagacacgtttcaggaagcggttagcaccttctacgccagattcctgccattccagtgttagttctggtggcgcagcgaacatcatgaacaagcgaacggtatcagcgccgtatttatcgaccataatttgtggatcgataccgttattcttggatttagacattttgctcatgccagtatagaccagctcatgaccgtcttgatccaccgacttcacgatgcggcctttatcatcacgctcaacaatcgcgtcagctggggatacccagactttttcgccgctgttgccggtgtaatagaacgcatctgccagaaccataccttggcacagcaggcgtttggctggttcgtcagaattgaccatcccagaatcacgcatcagcttgtggaagaaacggaagtacatcaagtgcatgatggcgtgttcaataccaccgatgtattgatccactggcagccaatagttagcggcggccggatcgagcatacctttgtcataatctgggcaggtatagcgtgcgtagtaccatgatgattccatgaaagtatcgaaagtatcggtttcacgcagcgctggttgaccattgatggtcgttttggcccactcaggatctgctttgattgggctggtgatgccattcatcacaacatcttctggcaggataacgggcagttgatcttctggaacaggaacgacagtaccatcttccagtgtcgccattggaattggcgccccccaataacgttgacgggaaacaccccagtcacgcagacgatagttaaccttacggttgccagcacccatctcgaccagtttatctgcgatagcattgaagccttcttcattgctcagtccactgaattcaccggaattaaccagtgcatttttatcagtagctgcgccttcctgaacagttggcacattgccgtcgttgtccagaatgacggttttcattggcaggctgtacttggttgcaaattcccagtcgcgctgatcatgggctgggactgccatcactgcgcctgtaccgtattccatcagaacaaagttagcgacccagatggcaattttttcgttggtcaatggatgaattgcgaacatgcctgttggcacaccttttttctccatagtggccatatcagcttcggcaactttggtattacggcattcgttgatgaactcagccagttcaggattattttccgctgcctgttttgccagaggatgaccagccgcaacagcaacataggtcgttcccatgaatgtatctgggcgagtcgtataaaccgtcaatgtttcctgactgtcagccacattaaaggtgatttcgacaccttctgaacgaccaatccagttacgctgcatagttttgacctgctctggccaatcttccagcttatccaaatcgttcagcagttcttcagcgtaatcagtgattttgatgaaccactgagggatctctttgcgttcaacttggctatcacagcgccagcagcagccgtcaataacctgttcgttagccagaacggtcaggtcatgtggacaccagttgacggcagaggtttttttataaaccagacctttctcgtacagtttggtaaagaaccattgttcccagcggtagtattctggcgtacaggttgtgacttcacgatcccagtcataaccgaatcccagagttttcagctgggctttcatgtattcaatattggaataggtccatggagcaggtgcggtattatttttgaccgcagcgccctctgctggcagaccgaatgcatcccaaccgataggttgcaggacgtttttgccaagcatacgctgataacgggaaatcacatcaccaatggtgtagttacggacgtggcccatatgtagtcggccagaaggataaggtagcatggacagacaatagtatttttctttgttgctgtcttctgtcactttaaaagtttgcttctcttgccagtgaagctgtacttgtcgctctatgtcttctggacgatattgttcttgcatggcaccgataatcctatggtgagtaataaagctgcgcctgtaacgcgcatagtttgtttatgaaatcttagacctcatagcatagctgataagggataggggcaacaacacttgttaaagtgagatcgctgaaatttacctattttcgaagcagattaaggtcggcggaagtcgtgttatccgccgacagggagaaaatcagtgtagaattttcgccagaaaatcacgggcgcgttctgatttagggttggcaaagaaatcttcttttttgctgtcttcgacaatttttccttcatccatgaaaatgacgcgatgagccacttttttggcaaatcccatttcatgggtcacaaccatcatggtcatgccttcattagccagcttaaccatgacatccagtacttcattgatcatttcaggatcaagcgctgatgtgggttcatcaaacagcatggcgatggggtccatacagagtgcacgggcaatggcgacacgctgttgctgaccaccagaaagctgggaaggaaacttatcagcatgactggtcaacccgactcgttccaagagtttcaacgctttttcggtagcggcttttttatcgcgtttcaaaactttaacctgagccagtgtcaggttctcaatgattgacagatggggaaacagctcaaagtgctggaacaccatgccaaccttagaacgcaattgagccaggttggtgcttttatcattaactggcgtgttgtttacccgaatttcaccctgctggacaggttcaaggccattaaccgtttttattagtgtggatttaccggaacccgaggggccacagaccacgactacttcgccttttttgacttcagtcgagcagtcagccagaacctgaaattggccataccatttggatacatttttcagggaaatcatcaaacagtcctttttttcaaatagttaaccagcatggaagcggcaaaactaatcacaaaataaacaacgccggcaaacagaatcatttcaatctgagtaccgtcacgctcacctatattcgttgctgtacggaaaaaatcagccagactcagtacatatactagcgatgtatcttgaaataatacaatgccttgcgttaacagtaatgggatcattgcgcggaatgcttgtggcaggataatcagacgcatactttgcatgtgggtcatacccagcgccagcgcagcagatgactgcccccgggaaatactctgaatacctgcccgaatgatttcggagtagtaggccgcttcaaatagcgagaacgctaccattgcagaaattaaacggatatcggtttttggtgatatgcctagaacattttgtaataagttcggcacaattaagtagaaccacagcaataccatcaccagtggaactgagcgaaagaggttgacatacagggtggcaaaccagctcagtattttgatagaagataggcgcatcattgccagcaaggttccccaagcaatgccaatgataatggctatcacggtaattttggcggttatcaccaatccattcagcagaaatggcaagctgggaataatggaactccagtcaaactgatacatttttctatctccctcccagattgcctggcaagcgcacttttttctcaagcagagtcatggcaagcatgatcaccagattgatgccaacgtaagctagcgtgatcgccgtaaatgattcataagcatgtgctgaataatcgagtaatttgcctgcctgtgctgccatgtccaccagcccgatggtggaggcaatagcagagtttttcaccagattgagcatctctgaggtcatcggaggaataatgatacgataggcgtttggcagcaggacataacggtaggtttgtggcagagtcaggcccatggcctggcctgcggctttttgcccccgtggcagtgactggatggcagctcgaacctgctcgcagatacgggcggcagtgaatagccccagacagattaccgaggaaataaaaaattgaatattgggatccagttccatcttgaaccaattactcaaatttttgggcaggaattctggtaccaccagataccatataaaaaactggacgatcaaaggaacgttgcggaatagctcaacataacaagcgcctagcgttgctagaaatttgttcggaacggtgcggaggataccgaacaacgatccaacaacgagcgcaataacccaagcgcaaacggaaagtgcaatcgtcacctgaaacccagaaataatccaccccaaataggtggtattaccaaaaggggcagcttgtagaaagatgccccaattccaatcaacagacataatcgtgctccctgaaatggggttggctgtcacgcctaagatgttctattagtggtaaatcattgactcaaaagaacaggctaaaaaaatgaggtagggaacgactacctcacccccatcgtgccaataaaatcgagtgtttttagttaattccttaatttaacgccttatcatttggtgatttaaataaggtcttcatctcatctgacatggagaagttcatattcagttttttaggtggaatcggttgtttaaaccagagatcaaagagtttttctgcttcaccggaggtctgtactttcacaatcgtgccatcaatcaatttcttgaattgaggatcatttttgcgcagcatacagccataagcttcttctgattgtggtttaccaacaatgatccactgatcaggttttttcgcttttgcgcgttcacccgccagcaatgcatcatccatcatgaaagcgacagcacggcctgattccagagtacggaatgaatcaccgtggtctttggcactgattatgcgcatctgcatttgcttctcgtcattgagtttgttcagcagaatttcagatgttgtaccagaagtaacgacaacatgtttcccggccagatcgtcaaacccttttattcctgaatctttattggtcagcagacgagtaccgacgacaaagatagtgttggagaatgcagcttgtttttggcgctcaaggttattggtggtagagccacactcaaaatcataagtgccgttttgcagcaacggaatgcggttttgggaggtaatcgggattagtttgacttgtaggttgggcatatccaactttttcttgacggcatcaacaatcaagttggaataatcttgagcatagccgacaacgttttgttgattatcataataagaaaatggaacagaagattctctgtgtccaacaacgataatcccattgtctttgatttttttcagtgttccagttaattcctcagcatgggcagctcctaccgcgctaagcaacatcatggttaacatcaacttacgcatatacagctcctttatcgggttattctttgaagattgggtttgcttgcagatagtggcgtttacatttttgtagaaacgatttcctgaatctttttgtttatatgctgtaaaaaagtaattcataatgttggttttttgaaaccgtaatgtttctatttcgcgacctgcctcgcactataaataaacaattttacttatgtacgattaaagagaaaataattttgaactctgttcacagtttgtgttttttaggtcaatatatttatttttgattgtaattaagaataatataaagtgtatttggttaagcgtatggtaaaaataatgaattatgcgacttggttggagttttctgtggagtgaacgagtcgtagagaagatcagggtataaataatataccctgatcttttattgagggatctactgaataggaaattaagttcggcggcggttgctgcttatcaatccgaaaccaatgaacagcagtgctaatccccatatcggccaataaccaaagcgaaaataaggggtgctgccactagctggagtaaccttagcttccaacacttgacgggtaaactgtggaagcttggcttgtattgagccatctggcctgataaccgcagtaataccgttatttgttcctctaagcaatgggcgtcccaattcaagagagcgcattcgtgccatttggaaatgttgccacgggccaatagaacgcccaaaccaggcatcattagaaattgtcagcaaaaattcagtatcgggcttgaaattatcacgtacttgctcgcccaaaataatttcatagcagattgcagcagttatgttatgccctgctacagaaagctgtggctgtatataatcaccacgattgaaggaagacattggcaaattgaagaagggggccaatgggcgcaatattgattccagcggaacaaattcaccgaacggaacgagatgatgtttatcatagcggatcgatgccggatatcggtaaggggttttatctcccaacacgataatactgttatagaatttatagccttccaatgtgggacgagcatcaggaattccggtaatcagtctggtattacgctgtcttagcaaagaatccagttcggtcaggaaactaccttgggtgatttcgtaagcagtaatggcagattccggccagatgatgatgggtattttaccgatgaaaggacggctattattcagatagatgtccagcgtattttccagttctgagggattccattttatgacttggggaatattgccctgaaccagtgcgatatcggcagacttatccggcagtagggtataccactgataatacctcattggccacggcagcagcagcagaataaccgcggcgagagccagtgaaagttttttccggatagtggcaagtaccagcagaccactgatcattagtatcaggaaggtgatgccttccacccccagaataggggcaatagctttcattgggccatcgatctggctgtagccaaattgcagccatggaaacccagttaatacccaaccacgcagaaattcagtcaattgccatagtgctggactggcaacgaccagcctgatcccgttggcggccggaaaaaaacggttgagcaggccagcaaacagagtgggataaagagcgagataggtagatagcaggataaccagaaagatattgacgacagtgggcatgccgccaaaattcgcgatgctgacataaacccagtttgtaccactgccaaataagccaaatccccagcagaaaccaataaagagagactgtcgagtggttctgttgagtgtcagaatttgcaggccgaaaagagacaggaatgcagcaggccagaaaccaaaaggtgaaaaagccagtgttccactggctcctaagaaaagtgccagcaaggcgcgcagccgctggcaactcagtaatgaggctttgttcatccagatcctattattgtttatcaaggccaggaacgtcagcatcatccggtattttgacatgaacctgaatgattttccggctatctgccattgctactttgaaaagataaccgtttatgtcgatagattcaccccgggaaggtagatgaccaaatgcctgcatcactagcccaccgatggtatcaacttcttcatcgctgaaattggtgccgaaaacatcgttgaaatcttcgatttgagccaatgcccgtactgaataagtatggcggcttaaggcacgaatatcgttatcttcatcatcgtcgtattcgtcttctatttcgcccacaatcagttcaagaatgtcctctatcgtgaccagaccggaaacaccaccgaattcatcgattacaattgccatatggtaacgctgggagcggaactctttcagcaggcggtcaacacgtttactctctggcaccacaatagcttgacgtagcactttatcaatgctgaaaggctctgcattcgtgcgcatgaatggcagaagatcttttgccatcaaaatgccttcgatgtggtctttgtcttcgctgattacagggtagcgtgagtgagccgaatcgataattacatccagacattcgtccaaaggttgatttcgttttaaggtaacgatttgtgagcgagggatcataatgtcacgcacgcgttggtcagcaatatccattaccccttcgagcatctctcgagtatcgggatcgatcagatcgttctgttcagaatcacggatcagttcaaccaaatcatgacggtttttcggttcaccgtgaaaaagttgattaagaagcgcaagaaagcctttcttagggccagggctatcgttatttgaaggatggtcgtcgctcatggcgtttgaatgaaaattccccattaattaatattgtaaatcgtaatttttagcataaaaatgatgctaacggttattctttttccgctaaatagggatcagcataacccattttttgtagaatttctgtttccagagattccatttcttctgcttcatcgtcttcgatatggtcgtatccaagcagatggagagaaccgtgaattaccatgtgtgcccagtgttcttcaactgttttttgttgttcctctgcttcttgttcaacaacttgacggcagatgattaaatcaccgagcaaaggtaattccacttcaggcggtgcttcaaacggaaaggataacacattggttggtttatctttcccgcgataagtgaggtttaaatcgtggctttctgcctcatcgaccagacggattgttacttcactttctgcctgaaattgtggcagaacactctccagccagcgctggaaaagggcttcatcaggaagcccttctggatttttacatgcaatttgtaaatctaatataactgaattcattgtgcttcctgcttgcgtttatcattaagctcttgtttccgtttctgttccgcagattcccatgcttcataggcgataacgactttggcgaccacaggatgacggacaacgtcttcgctatggaagaaattaaagcttaattcatcaacttcagacaagacttctactgcgtggctaaggccggatttctggcctcttggcaagtcaatctgagtcacgtcaccggtaatcaccgctttggaattgaagccaatgcgggttaagaacatcttcatctgttcgatggtggtattctggctttcgtcgagaataataaaggcatcattgagggtacgtccacgcatataggccagtggagccacttcaataacatttctttcgatcaacttctcaactttttcaaatcccaacatctcaaacagcgcatcgtaaagcggacgcaagtaaggatcgactttctggctcagatcgcccggcagaaatcccagcttttcacctgcttcaaccgctggacgggttagcaggatacggcgaatttcctgacgttccagtgaatcaacggcggcggcaacggccagataagttttccctgtccctgcgggcccaatcccaaaggtaatatcataatcaaggatattggcaatgtactgtgcttgattgggcgtacggggcttcacaacaccccgtttggttttgatattcacagccttgccatagtcaggaatactttctgccgattgttccagcacgcggctttctgtgatggccagatgaatctgttcaggttcaagaactgggatcacgctgcgaacaggtgcggtttcgacataaagatggcgcagaataccggctactgcactgacacacagtggtttacccaccagtttgaaacgattgtcgcggcggctgatctcgattccaagacgacgctcaagttgtttcagattgtcatcaagtgggccacacagactcataagacgttgattatctgcgggttccagaaagatctcttgtgttgctacttgtgagtttatttgtgtcactgattatctctaagttagggcctgttaaggctgataaatgccaacgccgatttcatcttccttgcgggtacgggcgatgactgactcaggtgactcatggatgcgcaaattcatctcatcttcagtacggataattttaccgcgcagggagttggcatacacgtcaacaatttcagcatcaacgaacttgccaatcatgtcaggcgttccctcaaaattaaccacgcggttattttcagtacggccggaaagctccatgatatttttgcgggatgttccttcaaccagaatacgctgtgtactaccaaccattgcgcggctgaagctcatggcctgctgattgatacgctgctggagcagatacaggcgctgttttttctcttcttcactcacatcatccggcaaatcggccgcaggggttcccggacgtgctgaatagatgaagctgaaactcatgtcgaaattcacatcggcaatcagttgcatggttttttcgaagtcatcctgtgtctcaccagggaaaccgatgatgaagtcagaactgatcagaatgtcaggacgtgctttgcgcagacgacggatgatgcctttgtactccagcgcggtatgtgcacgtttcatctgggtcaggatacggtcagagccactttgtacgggtaggtgcagatagctgactaactccggtgtgtcttcgtagacctcgataatatcatcagtaaattcaattggatggctcgttgtgaagcgaatgcggtcgataccatcaatggccgcgaccagacgcagtaattccgcaaatgtgcagatatccccgtcgaatgttgcgcctcggtaggcgttgacgttctgaccgagcaggttaacgtcacgtacgccttgtgccgcaagctgggcaatttcaaacagaatatcatcacaaggacggctgacttcttctccgcgggtgtaaggaacgacacagaatgtacagtacttattgcagccttccatgatggagacgaatgcgctcgggccttctgcccgaggttctggcattcggtcgaatttttcgatctcagggaagctgatatcaactattgggctgtgggtgcctttcacatgattaatcatttcaggcaggcgatgcagggtttgaggcccgaagataatatcaacgctaggagcgcgctggcggatgaaatccccttcctgagaggcaacgcagccaccgacaccaataataatttcgggatttttgtcttttagacccttccagcgtccgagttgatggaagactttttcttgggctttttcacggattgaacaggtgttcaggagtaagatatctgcttcttcggcgacatcggttaactgataaccgtgagtggtttccagtaggtcggccatcttggatgaatcatattcgttcatctgacagccccaagttttgatatacagtttttttatcgtcgacattttatgtatccggtatttccagtgaaatgttgcatcaacactgaaaagcgcagtgtattgaacataatgtatttagcataatattacaggctattgtagtcatttgaggcaccagtgaccagactgtaacatcggatattcacagccggaaagggaaaattccggtacactattttaatcaggaagttaatggcgtgatgaatatgaataatccacagcaaaaattcgatatcgtcgtcgtgggtgcgggtatggttggtgcagcgacggctttgggactcgtacaagagggctggcgtgtcgcattactggagcaccagccgcctcagccttatgatgaaggtaatgaaccggatcttcgcgtatctgcaattagctgcgcttccgtggatttattgaaacaattaggcgtttggaaccatgttttgcggatgcgcagtgcgccttaccggaaattggagacgtgggaacagcatgattccaacgtgactttcgatgcccaaagtctcgggctgacagagttgggctatatggtagagaaccgcatcctgcaattggcactgtggcaggagtttgaacgttacccgaatctgacgctgttttgcccggccgccctgaaatcgatgcaacggcagaatgcacatcaaatgtggcaaataacattgactgatggcacggaaatgaatgcacgtctgatcattggtgcagatggtgcccgctctcaggttcgacaactggcaggcattggcagcaatgggtggcaataccagcagtcatgtatgttgatcaccgtcaaaaccgagcaacctcagcaggacaccacatggcagcagtttttcccttctggcccgagagctttcttacctctgtttgatcagtgggcttcattggtctggtacgattctcctgcccgaattcgtcaactacagtcgatgacgatggtacagcttgagcgagaaatttttcaggcatttccctcccgcttgggcaaagtgactccaattgctgtgggttcgtttcctcttactcgtcaccatgccagccactatgtgcgtgagggattggccttgcttggcgatgcggctcataccattaatccattggccgggcagggcgtgaatttaggttatcgagatgttgaggttttgcttaaagtgctgataaacgccaaagaattacaggaagagtgggattctcaagcggtattgatgcgttatcaacgtcgcagaatgccggataatttagtgatgcaagcgggtatggatctcttccacaccgcattcagccatgatttgccaggattgaaaaccatgcggaatttagtactgatggcggcacaacgttcaggggcgatgaagaagctggcgctgaaatatgcattgggattgtagttaatctgtagtaattcaaacggatcagtgctgggagatagaaagtgattttgaagagacagggcttggatggctacgaagtccggctctggtcgtattgagtatgatggaattgcacaatttattgttgagtctaatgaaaagagcctatgattcctttgaactggctctgcattggtcagatttgacgatggagatactaatatcatactttgtagtgtcgctatcgccgtatgaaaagtgttccatctttaggatatctattgggataggctcttagtcttattttcagaatctgcagaaaagttaatttacaggtatatattgtcaaattgatatgaggtgaggcatgaaaataaaggagttatctagtaaaactggagttagcgctagaatgatacgttattacgaagaacaaggtttacttaagcctgatagaacaaattctggttatagaagattcacatcaaaggatttaatcaccataagaagtatacagtcccttcaagaagcaggtttaacgttagatgcagtcagagtcctgatgccatgtattgttagtgaaccaatcaaactctctccttgtcctctcattattgcaaccctaaagcaacatagagataaaattagagcggatcttaacaaaaatacacgagctctttcgttgctagatcagtttatatctgacgtcacaatttttagtacaaatgtataacataatgttagtatctttttttaaaactcaaataaaaaaggtctgttacattatattttttagtaaaaaactggcgtgtttctcatgccagtcatggtttttataatttcgtcggtagtagatttactagctaaatctattcttatattggcattccttgctaatttttaaatagattgactggacaataaaaacagtattcaatgaaaaagcgatattataaaatattgaagagaatttattacgtaatcatgatataattatcttgaatgaatttcaatgtttaaataataaataataaataataaataataaataataaataataaataataaataataaataataaataataaataataaataataaataataaataataaataataaatattatttcgtgatgtattatggcctaattttaataatctatagcaaagactgaactagattttatttaggtgaactttttgccatgcttctttctcagctgaaatttttatcacatcaataaattggatgtattacctaatctcatttaattaagatgaactgttgttatttagttttatttgaggaattaaaataacgaatgcgattgttaatagtattcctcctgtcaaagctgtagtttcggtgttaaatctatctatcaaaattccgcctataaatgcacctgagccaatacctgtattaaacatcgcgacatggactgaagatgctcgttctccagtgtctgtcgctaaattaagaacaagagattgaagggtaactgttaacaaacagatccctataccccacatagcaataaaagagtaggtcagggcgacattaccttctgaaaaataaccaataccaatgacagaaataattaagacggctaatattgctcttgtagcagcaaccagtctggaatttgttataaatcctgaaattatatttcctattactccaaacataccaaaaagcagtagaaagaatggtaattgttcgtggctgattccagctctattctccagtagtggacttatataggtaaaagcacagtaatttccactcagggcgagggctgtaactggaaatgttcttcttagataaggctgagtaatgatttcttttatagctatttttttgctcgcatcagcttgatgtactttaggcatcgaaaagagtgctgcaatggtaatgagtaatcccataatagcgaggcttataaaagacaatcgccaaccaatattttgcgaaacaaacgttgctatggggacaacagctacagaggcaatcgcaataccaccaaacactaatgacgtcgctttagcttttccactgtcaggaactaaccttactgcaagagggcctacaattgaccaaaatacaccatgaaagaatgcgcctatcactcttcctatatatagccagaataaatttggtgcaaaagaaactatcagatttgatattgagaatgctaagagaatacctataacaagtttcttcttttccactttcataaaaaaagaagtggcgcttattgcagataatgctactacccaagcatatccggtaacaatcaaccctatattacctgcggatttattataagtatttccaatttcatgtagtactccaataggaaggagctcagctgttacgaaaattattgctgccagcgataatataattattgaaaaccagcttgttttacgaactggcttagtaacagcgccttggcaatcattctcttcaattgacatagaattccccaacctttacgccgattattcagatgaatcataagtcaccatgaaatccttgacagtactgtcagagtcaaggggtttgtgatgaaaatgattttttcaccactattttggagtccatgggcatagtcaatggagagatagccgttgtcaataatctgaaatctgagttattttgggagacgtgtattcactcgttgactggctttttaaatccgacaaaagaggagaattcctacctttccacaatttcctgcttttcttttcggtgcgtgtagagaggcgagcctaaaattcgccatagaaacaacggtagaaggagataattggttaacgccagatgactaccctttaaacagataatcgcttggtgagctttaaaatggatttttaggtgttggtattttgatggaaggaaagcaaaaagccacctttcggtggccttctgcatcaaagaatattcttactgtatattctttttcaaca

SEQ ID NO: 16874 - DNA, 5282 bp, Xenorhabdus bovienii
  unsure (1)..(5282): unsure at all n locations
nnnnnnnnnnnnnnnnnnnnnnnnnnnnnnngctatagtttgtatcagtctttgaaatgatttttatgctccaaacgcaaaaaagccacccggtgggggtggcttctctgactaaataggtgtctggcagtgccctactctcacatggggagaccccacactaccatcggcgctacggcgtttcactgctgagttcggcatgggatcaggtgggaccaccgcgctatggccgccagacaaattctgttttcaatcccgaacaagctgctgtctttcatctgaaactccgtctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccgggcagtgccattggcatgacaacccgaacaccagtggtgcgtccactccggtcctctcgtactaggagcagcccctttcaatcttccaacgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgagctgtcactctcgcagtcaagctagcttatgccattgcactaacctcacgatgtccgaccgtgattagctaaccttcgtgctcctccgttacgctttgggaggagaccgccccagtcaaactacccaccagacactgtccgcgacccggatgacgggcctgcgttagaacatcaaacattcaagggtggtatttcaaggatggctccgtgcagactggcgtccacacttcacagcctcccacctatcctacacatcaaggttcaaggttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaagagcttcgcgttgccgctaaccccatcaattaaccttccagcaccgggcaggcgtcacaccgtatacgtccactttcgtgtttgcacagtgctgtgtttttattaaacagttgcagccagctggtatctgcgactggcttcggctccgggcgcatgtcccttcacctaatgccagcgtgccttctcccgaagttacggcaccattttgcctagttccttcacccgagttctctcaagcgcctgagtattctctacctgaccacctgtgtcggtttggggtacgattcactgttacctgatgcttagaggcttttcctggaagcagggcatcaaccacttcagcaccgtagtgcctcgttatcacgcctcagtgttcacagaagaacggatttaccaattcttcccacctacacgcttgaaccgggacaaccgtcgcccggccggtctagccttctccgtccccccttcgcagtaacaccgagtacgggaatattaacccgtttcccatcgactacgcctttcggcctcgccttaggggtcgactcaccctgccccgattaacgttggacaggaacccttggtcttccggcgagcgggtttttcacccgctttatcgttacttatgtcagcattcgcacttctgatacctccagcatgcctcacagcacaccttcgcaggcttacagaacgctcccctacccaacaacatcgaaatgttgctgccgcagcttcggtgcatggtttagccccgttacatcttccgcgcaggccgactcgaccagtgagctattacgctttctttaaatgatggctgcttctaagccaacatcctggctgtctgagccttcccacttcgtttcccacttaaccatgacttggggaccttagctggcggtctgggttgtttccctcttcacgacggacgttagcacccgccgtgtgtctcccgtgataacattcttcggtattcgcagtttgcatcgggttggtaagtcgggatgaccccctagccgaaacagtgctctacccccgaagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcaccctgataaatcaaggctcccactgcttgtacgtacacggtttcaggttctatttcactcccctcgccggggttcttttcgcctttccctcacggtactggttcactatcggtcagtcaggagtatttagccttggaggatggtccccccatgttcagacaggataccacgtgtcccgccctactcgtcgaactcacaccaccagtgtcttcagatacggggctatcaccctttactgccggcctttccagaccgttctcctgacgctgatgctgatgttggttctgggctgctccccgttcgctcgccgctactgggggaatctcggttgatttcttttcctcggggtactgagatgtttcagttcccccggttcgcctccggaccctatgaattcaggccaggatagtgcaacggattgcactgggtttccccattcgggtatcgtcggttataatgcttcatatcagcttaccgacgcttatcgcagattagcacgcccttcatcgcctctgactgcctaggcatccaccgtgtacgcttagtcgcttaacctcacaacccgaaggtgtcttcgggtgtgcgttttgagagactcaccagtcctgtcattgacagcactgattgtttcaaattttcagcttgttccagattgttaaagagcgttattggtaaaccgacttcgcagtccgcttaccaataattcgttgaccctgcctttcacacagtgcctgaacaggatggcgtcccctaggggattcgaacccctgttaccgccgtgaaagggcggtgtcctaggcctctagacgaaggggactcaagtcttcttcgcgggcattcctgctcattttcttttatcagacaatctgtgtggacactgcacaatcactatcattcaggtaaggaggtgatccaaccgcaggttcccctacggttaccttgttacgacttcaccccagtcatgaatcacaaagtggtaagcgcccccccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacagactttatgagttccgcttgctctcgcgaggtcgcttctctttgtatctgccattgtagcacgtgtgtagccctactcgtaagggccatgatgacttgacgtcatccccaccttcctccggtttatcaccggcagtctcccttgagttcccaccatcacgtgctggcaacaaaggataagggttgcgctcgttgcgggacttaacccaacatttcacaacacgagctgacgacagccatgcagcacctgtctctcagttcccgaaggcacttcgctgtctccagcaaattctgaggatgtcaagagtaggtaaggttcttcgcgttgcatcgaattaaaccacatgctccaccgcttgtgcgggcccccgtcaattcatttgagttttaaccttgcggccgtactccccaggcggtcgatttaacgcgttagctccggaagccacgcctcaagggcacaacctccaaatcgacatcgtttacagcgtggactaccagggtatctaatcctgtttgctccccacgctttcgcacctgagcgtcagtcttcgtccagggggccgccttcgccaccggtattcctccacatctctacgcatttcaccgctacacgtggaattctacccccctctacgagactctagtcaaccagttttagatgccgttcccaggttgagcccggggatttcacatctaacttaattgaccgcctgcgtgcgctttacgcccagtaattccgattaacgcttgcaccctccgtattaccgcggctgctggcacggagttagccggtgcttcttctgcgggtaacgtcaatcaacagcgctatttacgctgttgccttcctccccgctgaaagtactttacaacccgaaggccttcttcatacacgcggcatggctgcatcaggcttgcgcccattgtgcaatattccccactgctgcctcccgtaggagtctgggccgtgtctcagtcccagtgtggctggtcatcctctcagaccagctagggatcgtcgcctaggtgagccattaccccacctactagctaatcccatctgggttcatccgatggcgtgaggcccgaaggtcccccactttactccacagaggttatgcggtattagccaccgtttccagtggttatccccctccatcgggcagatccccagacattactcacccgtccgccgctcgccggcggggaagcaagcttccccccgctgccgctcgacttgcatgtgttaggcctgccgccagcgttcaatctgagccatgatcaaactcttcaattaaaagtctgatgctcaaagaattattactgttagttcgtaatgaattaactgttttagtcactctttaagactttaaagttttcggcatcttgcgatgctgtcgataatgtcttgtgagtgcccacacagattgtctgattaaattgttaaagagcgttccgac

SEQ ID NO: 16875 - DNA, 1268 bp, Xenorhabdus bovienii
  unsure (1)..(1268): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctgggttgtttccctcttcacgacggacgttagcacccgccgtgtgtctcccgtgataacattcttcggtattcgcagtttgcatcgggttggtaagtcgggatgaccccctagccgaaacagtgctctacccccgaagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcaccctgataaatcaaggctcccactgcttgtacgtacacggtttcaggttctatttcactcccctcgccggggttcttttcgcctttccctcacggtactggttcactatcggtcagtcaggagtatttagccttggaggatggtccccccatgttcagacaggataccacgtgtcccgccctactcgtcgaactcacaccaccagtgtcttcagatacggggctatcaccctttactgccggcctttccagaccgttctcctgacgctgatgctgatgttggttctgggctgctccccgttcgctcgccgctactgggggaannnnnnnnnnnnnnnnnnnnnnnnnnnnnnnnnnnnnnnnnnnnnnnnnnnnnnn

SEQ ID NO: 16876 - DNA, 39618 bp, Xenorhabdus bovienii
  unsure (1)..(39618): unsure at all n locations
acggatttaatgtcgaactgtccagtgctttttttaaggaaatgatttgtttgattatacttcaatcacttcgttgataaagtcagcatatttccaccgcaaagggtttgcttgatcaataattaatctaatgaactattttgcgttttgccgcaaataaatttccccagccaataagccagtgacacaaatagtaaaaatgcgccacctaccatcagtgaaaaacgcgtatccgggttaatcgccatccctatcagaacacaactcagaaataccagagtcaggtaattgacgtaagggaaaaggagcgacttaaaccgatgctgtttcaatgcttcctgattctgctggcggaaacgcaactggcttaccagaatgacaaaccacggtaccataccgggcaatacgctggcactataaacgtaaacgaataccgactgtggatttgggatcaggtagttcagggtggaacctacaatcaggcagccaatggtgatcgcaatacatctcacaggtacgccattttttgacaatttcagcaatgaagccggtaactggcgattcttcgccaaggcatacagcattctgccaccactgtacatgccgctattacatcccgaaagcgcagcagtcagcaccacaaagttaatgaccgctgcggcagaagcaatccctactttggaaaaaaccataacaaacgggctgccatgcgtgccagcttctgtccacgggaacagggtcacaacaataaaaatcgcaccgacataaaagatcaggatacgccacagaatattgttaatggcctttttaagtgttacctgtgggtttttggcttcccctgctgtaatgccaaccagctccactccctgatacgaggccaccacgatacagagggcaaacaagaaccctttccagccaccagagaaaaagccgccatgcgcggtcaaattatccaagccaataggctgccagtcattacccagtccgaaaaagatcaaaccgataccaatcaggatcattacgataatcgtagtcactttgatcatggcaaaccagaattccagctccccatacaaacgcacggccgccaagttcgctagggcaaccaacccgacagcaaccaatgcagaaacccattggggcagatctgggaaccagaattctgcatagacccccacagcggtgatttctgaaatccccactgaaacccacataaaccagtagccccaagccgtcagacatccccaataaggactgaggtacttatgtccaaacgcggcgaatgagccagtgacgggttcaaggaacagcatttcccccatcgaacgcatgatgaaaaaaacaaaaatcccagcgatgatgtaagccaacagaaccgaaggtcccgcccatttcaatgtgctggcagatcccatgaacagtccaacgccgattgtgccacctagcgcaatcagctcaatatgacgtgcctcaagtcccctttgcaggctttgttttgaatcactcataaaactccctatccatttttatgatgtctctatttgcaagcagaaaattacaggaattgataatcaatcattgtaaaaaaaggcagggatcaaaacacgttttgcccatcagtgaaataaaaaattataaaatcgagtcaaagcctgtttcattatgcatagtgaataacagacacaatggatgtatggaatgaaaagaaattagcgaggcaggtcaaacccacgatatccatcctaatcactgatgttgatacagtgggtagctagataacgggtttacagcttaccaccgtaataatagcccagaaatttcaatagcttgatttgcctccggatgcggcttggctgcgataacagacgataaagccactccaatcccaaattttgccaaattttcggtgcacgtttgacatgtccggtaaagacatcatacgttcctcctacgcccatatacagtgcgccagagtacactttacggcaatcacgcatgaaaatttcctgtttaggcgatcccatggctaccgagacaatggcggcaccactggcatggatacgctcaaacaccgcatcacgcccttcctgggtaaaataaccgtcctgactgccgacaatattaacgttccactgactacgcagtttgttttctgtctgcgccagaacatcaggttttccacctaccagaaataccggcgtaccttcccgacccgcacgttccatcaaagcttcccataaatctgcccccgcaatgcgggacacgtgcgcatcgggatatttgcggcgaatggcgcgcacgatactaatgccatcggcatataagtattcagcctcatccagcaatatgttcagcgcattgtctttttccgcagtgaggactttttctgcattaatcgcaaccaatgtgcctgtttttacctgcccatcctgaaaaagatgatcgaggaaatgcgacattccacgaaagccccagagactgaggccacggatacggtattttggaatgttattcagtgtcatttttcttccttaacatccgcaatagtggatattttctgcgacgcaggcacattactgatgacaaattttcgaaccagccccacgctttcaaacaaccaatacaacaattttgctaccaccagacacaaaccaaaaatgaggcaaaaaaacaccactcgagaaacaaaagaatccattccttcacgggcaaggacaatgatgttaaaaatcgccccaaaacagaaagcctgcaaaattgccgccttatagcgactaacttcctgttttcccgcttcatagacccagtcaaaccatttgataatcaatccgacaacaatcgcgccaaaggggataaagaatacgccgcccatcaccaccaatgagcctatcaaggttggagaaatagccagaccagagtgattatccagcacatcccacgtaaagtagtttgccgtgttcaatatcagattaggtctgtccggccacatccaacttggaataaaaacatagaaatcacgggcaatcggcgccagtccctgaaaatcaattttatcgtaattatccagcagcaaggcgaggttttcccacggtgagaaagtatccctcgtaagatacaggaacgtataaaatgcttccgaaccgctcacatcaagcccataacgtttcaatgccagccagaacatgccgacaaccccgatgacacccgccaaaagtagcatccacaaagtgatccagccacggacaatcccaataaacaggaataatgcaaaagccagaataatgttagcccgcgttcccccaactatcacataagtcagtatgccaaacccgactgtcgccaccaaaaagcacaaccagcgggttttagtgggtttcaggaaaaacaccaccagcatggcaggaataaaaaagtagaaaaaccgcttgagtgccacgccggaaacttgattggaaaatatctggctatacgactgtagcttaaacagcaagaagccgttctgcataaagaacgagccaactgtaaagatagcaatgctggccaacaacagccacgtcaggttagtttccacccgattcatggtgaacagcggccggcgagacacgacagaagatggtgtgctaaacgaggctgtcttacgggctggcgtcttataactgagacgtgttttataactgacataataaatagcataaaaacagccagaagccagcatcgcgtacaacaatgagtctacagggactatctgcacctcaaaatggaacaccaacgtacaggtcaacgggaagccaaaatagaatgtcagcaaataaagcagtgaaaaaaagatattaaagttaaagcgaacgcgccggaactcttgatatgtcagggttaggataaagaacagcgagatcacgtaaacaacaaataacccgctgaattgcgtcaaagtcattaatactctcccaatgcagccgacagggcggctttccacccttcaatgaaattgggatcaaaaaaggcaatcgcctttttatcgagggacagcatttgacgctgtgcttcctgcacccagtgtttattcagttcatctccatcaaacagtacggggatctgctgttctgtcagatcgtgccagaatggattctgacggctcaggacaaacggaataccaaattgaattaacaggcaaagagttccgactccctgctggcgattgaaaatgaaatagcctaaatcgcattgacgcagtaatgacagatagtcgtcaaaagccattttatttttcaacatatggacgttttccgcccgaaacagcgacaatgcggtgtgctccacacattgtacataggcttgattatcgccgggataacccattggcataatcactcgtacttcatcaccaaattgaccgtgaatcttgtttaacgcttcaatatggcggttagattgatcaccggaattccccagcagaatggtgatcccctctgacgggcatgtcttttccgttacggttagtgatggctccatacgcgttggaaaatagagcagtgttgacggtacattggggttggactggctaaaatactggagatcaccatgcgtggcaaaaacctgccctacccgtttctgtgccaaacgacgaagctgatagaacaaacggaattttagctggcgggagtcttcatataagtcagccccccaagcgtgccaccagaattgatggcgtttgattttgccaaccagtaaagccagccacaaagccgcattgaactggccgtggaaaaagaaacgggtctttctgtctgcctgcgctttctctatcacagcccgtgccaaagcagctttgctgccataaaccgtgatcgccaaggccgggtaattagatagccatgtgtggtctttggacaccaccataaaacacggtttagctggaaaaatcatttcctgagccaagacgtcattaaagaaacgcaataacgtttgattgtgatgtggaatatccgatcccaagacgtgaattagggttgtcatgctcgcctgcgataaataataaatacactacaacaaaggatgaaataaataatgtaagttgccatgtatgactgcgccgcccccaacgctccattttcgggtatcagccaatgagagaagcctgtcagcagcagaaattgactgatttcagtcagtacataaaaacgcagcgccgctttcgctatcaccagataaccaaaaacataagcgccaactttcaaaacgtcgcccaccagctgccatgcgaatagatcccgcatcgcggtgaatttatctgaaaacagcagccaaatcacaaaatcacgcaacagccaaactgaaaagctggctgcggcaacggcaggtaacacaaacttcagcgccttgacgatttcgccagtaatttcttgcttactttccaatcgggaaagtgtcggcaacaaatagacggtgaaagaggcggtgataaactgcaaataggcatccgaaatgctgctcacaccctgccagattccgacttcctcccagctataacgctctgccatcagatttcgcatcatgatataagccactggtagcgtcatagaagtcagaagcgccatcagcgtgaatttccccagatggctggcaatcacgcgatcccacatgggctttaatgctgaaaacgtaatcaccttactgcgcaggatcatcaaccccgctggcagaaccaccaaagccggtaccaaagccaagcccgctagcgcgccttcatagcctcccagccaataacagaggccataggcaatcattcctgtcaggctacccagaataatcgacagtgcgttgccctgagcatccctgaaaccttttaggatggccagaaaatagttggcgtaagcaatacccatttggataaatgcgagcgcctgtacaactgttttgtagttattgtgaccaaacaggccgatactgatggcgtcagtgaacaagagaaaaataaccgccaacagggtggaaaaccccagaataatcgaagacgaagtacccagtatcgccctgagtttttccggctgctgatggtgttccgctacatatttggtgacaccgttaaaaatccccgcaccagacagcacgcccagtacggtaatcagttggcgaaagttgcccgcctgcccaacacccgctgggccgaaggacaccgccagaagtttaatgaccagcagccccacaccgattttgattagtgtggaacccgccgtccatacagaagctttagcaagtgacatatcaggcaaaaaattccttgatacggttgataactacctgctgctcttcatcagtaatgttgtaaaacattggcaaacgcaccaaccgctcactatcgctggtcgtaaaacgatcttctccatggaaacgaccacatttttcgccagccgggctcgtatgcaatgctacgtaatggaacactgtcagaatatttgcttcttgcatgtagcggttgaatgcgccgcgctcctcgacaccttttagtttgatgtagaacatatgagcattatgttccagaccctccggcacaactggcaaggtcagatgtcccgcttctgcgaatggctgcaaggcctgataatagttatcccacagggataagcggcgctggttgatattctcagcaatttcaagctgcccccaaaggtatgcagcttgcagatcagacagcaaataactggagccaatatcacgccacgtgtatttatccacctgtccacggaagaattggctacggttggttcctttttcacgaataatttcggcacgggcaatcatcgattcatcgttgattaatatcgcaccaccttcaccgccggaagagtagttcttggtttcgtggaagctgaaacaaccgatatggccaatagtaccgagtgcgcggcctttataggtggacatcacgccttgggcggcatcttccaccacatacaggttatatttttccgccagcgccatgatgacatccatttcacaggcaacacccgcataatgcactggcgcaatggcacgggttttgtctgtaatggctgcttcaatcttggtttcatccatattcatcgtgtctgggcggatatccacgaaaacgatggttgcaccacgcaggacgaaggcgttggaggtcgaaacaaaggtgtagctcggcatgatgatttcatcacccggctggatattcaacaaaatggccgccatttccaatgctgctgtacaagagggcgtcagcaacaccttcagacagttaaaatgctgctccatccattcttcacagcgtttagtgaagtggccatcgccgcataatttgccactgcccatcgcctgttgcatatattccagttccgtgccgactactggtggtttgttaaatggaatcatctcatcctctgtataaccaatatgcggtgctctcaatggttgcaccactacgtgtataaagacgcaaggcagtgatgttgctgatttgtgttgccactctcagccgctgtatctggtggttttcacaccaccgctgcgccgccgacattaattttttaccaatgccccggtgataattgcccggaagggctgccagtaagccaatacgggcttcatggctaccgatatctctcagggtgacaaagccgataatttgaccgtactcatcgttgacgagcaagcattcatggtcaaaagtacccaaaactgctttttcaacccaagccgcataaaaccggccgctatcatcaggctgataccaaggtgcccgaaagcggctggccttgaatacactggctgctgctgccgtcaatacaggtatatcctgcggtgttgcggaaatcagcgcttgtttcgactgaattccggtcgcattcctacaacgcatcgcgccagaatccaccggcagcaaaaaatctgcttcaccttccaccaatgaaaaccccaaggcagataaaccgtcaatggtgtccatctgctgggcagggactttcgcctgcaccagtgcatactcatctaactgagccgtcgtcagcactgatgcctgcagtgaaaagttcaaacgggcagtgggcaaaccgaaaaattggctatcccatgccagtgattcaatattagcgcgaatagacatggagcaagtccatcagatatttaccgtaacccgtttttgccaagttggcagcagcggcttttaactgttcatcattcaaccaaccgtgacgccatgcgatctcttctagacaggcaattttgaatccctgtcgtttttcgacggtctgcacaaaagtactggcttcaatcaggctgtcatgggtgccggtatccagccacgcaaacccgcgtcccaatagttcaacgttcaattcgccgcattccagatacatctggttaatactggtgatttccagctcaccacggacagaaggcttcacttgtttagctaaatccaccactttgttgtcgtagaaatagagcccggtgactgcccagtttgatttcggctgggctggtttttcctcaatcgagagtacgcggtattgctcatcaaactccacgacaccaaaccgttcaggatccatcacttggtaaccgaataccgttgctccagtctgacgggcaacgacactttgcagtttcggactaaacgcctgaccaaagtagatattatctccgagcaccagacagcaggcatcattgccaatgaattcttcaccaatgataaatgcctgtgccaaaccatcgggagaaggctgcacggcatagctcaggcgaataccaaactgttcaccactgcccaataagcgtttgaaagcaggcaagtcttccggcgtggaaataatcaggatatcgcgtatccctgccagcattaagactgacagtggatagtagatcatcggcttatcataaatgggcaataactgctttgagacgccgcgtgttattggatacagacgggtgccggagcctcccgcgagtataattcctttcatactatcccccagacaggtttattcattcgccagaccaagacgttcacccgcataagaaccgtcctgaactctccgccaccaattctcattctccagataccattgcacggtcttgcgaataccggattcgaaggtttcctgcggagtccagcccaattcgcgctcaattttcgccgcatcaatggcataacgcatatcatgccccggacgatcagccacatgagtaatcaggtcacggtaacagacaatacctgcgggttttataggacgcagctcttccagcagttcacagatggtctctacgacatcaatgtttctgcgctcgttatgaccaccaatgttataagtttcacccggttctgccgtggtagcgacgagatgcagcgcgcgcgcgtggtcttccacatacaaccagtcacggatctgctctcccttgccatagacaggcaatggctttcctgccaatgcattcaagatgatcagagggatcaatttttccggaaagtgataaggaccatagttattcgaacagttggtgatcacggtcggtaagccataagtacgacgccaggccctaactaaatggtcactggatgctttcgacgcggaataagggctacttggtgcataaggcgtattttctgtgaagaaaccctcgtcgccatgcaaatcgccatacacttcatcggttgaaatgtgatggaaacggaatgcagcctgcttttcctgatccagttgctgccagaatgcgcgggatgcttccagcaaaacataggtaccaatgatattggtttcgataaaggcagcaggcccatcaatggagcgatccacatgactttcggccgcaaggtgcatgacggcatccggttgatactgctgaaatacacgatctaatgcatcacgctggcagatatcaacctgctcaaaggcatagcgtggatgatcaaccaccgatgacagtgactcaagattacccgcataagtcaaactatcaaccacaacaacgctgtcttcggtatgattgataatatggcgaacaacagcagaaccaatgaaacctgcaccacccgtaatcagaatacgtttcaacgccaaactccttttgtatcaacaacccatttttgttttatttctctgccggcaattgccttgaactggctgtgatccaccagcatcaaaacaacgtcagcttcattcaatgcttgttgtatatcaactaattccacacgatctttcagcgaattaggcaattgatgaacattcggttcaaccgctacagtttgaccaacatgccactgtgccaccatcttcgtgatataaacagccgggctttcccgtaagtcatcaatgtttggtttaaaagccagaccaaaacaggctattttaatttcatccgcccgtttaccgctctccaccagacagtccgcgactgcggctttcacttggtcaaccacccaaagcggcttgccatcattaaccagacgcgcggtatgaatcaagcgagattgtgccgggttctgggatacgataaaccacggatctaccgcgatacagtgcccgcctacgccagggccgggttgcaggatattgacgcgtggatggcggtttgccagactgattagttcccagacattgatcccctgttcggcacagatcagggaaagttcgttggcaaaggcaatattgacatcacggaaactgttttcagtcaatttgcacatttctgccgttttggcattagtgacaacgcactcgccttcaaggaaaattttgtacagctcgctcgccctacgggacgattttagtgtcatgccgcccactacgcgatcgttcttgatcaattccaccatgacttgacccggtaaaacacgctcaggacagtacgcgatatcaatgtctgcattttcgcctgcctgctgtgggaatgagagctcaggacgtgccgctgctagccattctgccatctgttcggtcgcaccaacaggagaagtggattccaaaatgatcaaatccccttttttcaaaactggcgctatcgattctgccgcagaacgcacataggccatgtcaggctcatgctcgcccttaaacggcgttggtactgcaatcaggaaagcatccgcaggctgcggacaagtcacggccttcaggtaaccgccttcaacagcggttttcaccactttgtccagatcaggttcaacaatatgaatcgcaccacggttaattgtctctaccgcatgttggttgacatccacaccgatgacgttttttttgcgggaagcgaatgccgcagcagttggcaaaccgatataaccaaggccgatcacagaaattgtttcaaagctcataatgtcacctgatttttcctcaatgcttcaagaattcgctggcaagcctgaccatcaccataagggttatgagcgcggctcatttgctgataagcgatgtcatccgttaataggcgcgtgacttcctcaacgatggtctgcgtttttgttcccaccagccgcactgtacccgcatcaacggcttctggccgctccgtggtgtcgcgcatgaccagaacgggtttacctagagaaggggcttcttcctgaataccaccagagtctgtcagaatcatgtaggcatgattcattaagtagacaaatggcagatagtcctgtggattaatgagaataacgttatcaatgtcatgcagaatacgtttaacaggctcactcacattcgggttcaagtgaacaggataaacgacctgaacttcacggtgcgctctggctacctgtgccaacgcttcacaaatacgttcaaacccacccccaaagctctcacggcggtgacctgtcaccagaatcatttttttattcgggtcaataaaggggtaaagtttagcaagctgaccactcagcgcgtcatcactcacaatgcgatcacgtacccacagcagagcgtcaataaccgtattgcccgtcacaaaaatagagcttccggcaatggattctttcaagaggttattttgagagttttctgtcggtgcaaaatgatacatcgccagatgacctgcgattttacggttggcctcctccggccacggggagtaaagatcgccggttctcaagcccgcttcaatatggcctaccggaatgcgctgatagaaagcggccaagctggtcgccattgtagtcgcggtatcaccatgcaccaacactacatctggtttgaactcttctaatactggcttcatgccttcaagaatacgacacgtgatatccgtgagatcctgcccttttttcatgatattgaggtcaaaatctggcgtgatctcaaacaaatgcagtacctgatccaacatctcccgatgctgtgcagtcacacacacttttgcgtcaaaggcagcatccttggccaatgcgtgtaccaaaggagccattttgatagcttccggccgagtaccaaacacagtcaacactttcacagtggctctcttattttgtcaatcattactgatgcttccaggaaagggcgttctttaccgccatttctatccctgcttccgatatatgtgtatgtagaatacagaccatcggaaacagtcattaatttatatttccctgaataaaacttatttgagctgattttatgtgtgcgaacgccttgtcagcgcgactccagctccaactaacagaccaatagctccccacataatcatcatgaatacacggcggggggtgtctcggttgacaggcacctcaggggttctgaggtaacggtaggtctggaaagtattttgcagagtcgggccaacattcaatgtagccaacatcgctatgttttgatcataatcgatgctgtaattaggcccagtgacttccaaggtttcaatttgtgattgcagtaatggcgcccccatcataaacatctgggattcaggtaattcttcaatgggagtgtctgtttgattacggttgatgccttgtttttcagctattttcaatgattgctgcaagacattcaatttgcggctgtacatcgccttggcgaccatttcctgacgcttgaccagcgctttcatcgactggatacgggttgcccacgcacctttaatctcattgttcaggtgagtactcgcacgttgattagcaaacgccatatactctcgcaggaactgattggcattcactgccgtttctgccgtcaattttatgacttcattcggtaattttttatcatcacgccgtaacacttgaatcgtattaattaactcttccagcaataccgcatctgctttctcattaccttccctgtactgtttgtaataatcagactgaagccagaattcgcggcgggtatcatacgccaccacctgtgtgatgaattctttgtatgcaccatctgaaatagtcggcagttgtgcctctggagaggcattgatgtgggtatccaggttgcgcagaaattgttgttgtgaataataactccccagatcattggtcgtcggtaaatccacaatcgcggttgcgctccatttctgctgcatcaggtacgatgcacctaaagcaacggcagcgaaaatcattgccagtgcgataatccatatctttccgcgccacagagcatgacacagtgcacgaatatccaactcatgctctataacagattgatcctgcttagatttcgtttctgagtttatcactgcccaaaacctctttgataagtcaaatgtttttagtgatggctgactgcccggcgcatacgacgcttgcaccgtttaataaaacgggccactcgccatgctcgtttgatgcaatagccatacaacataaatgcaagcaaaaacaatgccaacatgacccactcgggcacaaaactcagttgttcaccaatgatccctatcgatgccaataaagcagcggccacagtaattaagataaatgcctgacgggaagtgaaacccgcacgcatgatcaagtggtgaatatgctggcgatcgggcgaaaacggactcatgcccttgcgcagtcggcgatacataatggcaaccatatccattaatgggatcgcgataatccacaatgcagtcactggattaaccgaactgtgttcgccctgagtcgtttcggtcagcaaccagataatggtaaagccgatcagagtgcttcccgcatctcccataaatactttgaagcgcttccctagtagccccagattgagaaaaatatacggtaatatccccgcgataaacgcaaaacaccagaatgccagtgccgtattaccgtttgcatatagcaaaattcccaatgccccgaaagaaacactggacagacctcccaacaagccatcaatcccatcgaccatgttaaaggcgttaatggcagcccagacagcaaacagagtaacaacgtagctgaatgggcccaatgtcatttcccatgggccaaaagcactgcccaaactttcaattttgagatcagcaaaatacatcatgctgatcccaaccagtgcctgaattgctgcccgaattttcacactgatatcaaaacggtcatctaacgcgccgacaaaaaccaatattcccgcacaagccagatataaccatttatgaggtataaattcttttgttatagcaaaagcaaaacaaacgccaaaaaagacagagataccacctaccagagggattaatccatggtggcgcttgcggtaattcggcttatcaacaaggccgataatttttgccaccttgcgtgccagaaacagaaacacggatgaaaatataaatatgcaaaaaatttcgacactcatactgggaatattcacaataacaactctctgtaaaaataatgatggatcatctattattcattgacttatggatgttccattcgacaccaaatccataagctccctattaaaaagaagacattctgctatgtataaaaataaagcaaatagacaatgtaggctgtagagcgtgattaataatggtttcctaagcatttgtaaatggcttcgcccagaaaacactcacttaatctgatgaaaaagatgcaaaatatgtaccatttcaggcgaacaagttaatcccttgataaaaaaaacgccacaagaatgtggcgttttgacgaaatgactatttatcatttacaaactatgaacgtttcataaagtcgaagaattcttcgtttgtttttgtcatagccagtttgttgataaggaattccatcgcatcagcttcgcccatcggatggatgattttacgcaagatccacattttttgcagttcatcctgcgtagtgagcaattcttctttacgtgtaccagagcggttgtagtcaatggcagggaagacgcgtttttcagcgatcttacgggacaggtgcagttccatgttacctgtacctttaaattcttcgtaaataacttcgtccatcttggaacccgtatcaaccagcgcagttgcgatgatggtcaggctgccaccttcttcaacgttacgggccgcaccaaagaaacgctttgggcgatgcagtgcattagcatccacaccaccggtcagtaccttaccggaagcaggaactacagtgttatacgcacgagccagacgggtaatggaatccagcaggataataacgtcttttttgtgctcaaccagacgttttgctttttcgatgaccatttcagccacttgtacgtgacgggaagcaggttcatcaaaggttgaagcaatcacttcaccttttaccagacgctgcatttcagtaacttcttctggacgttcatcgatcagcagaaccatcaagacgcagtctgggtagttgttggcaatgttagccgcaatgttttgcagcagcatggttttacccgcttttggcggagcaacaatcaggccacgctgaccacggccaataggtgctgccaaatccagaacacgggcagtcaaatcctcagtagaaccattgccacgctccatgcgcagacgattgttggcatgaagtggagtcaggttctcaaacaggattttattacgggcgttttcaggcttgtcaaagttaacttcgttaaccttcaacagggcaaaatagcgttcaccttcttttggtgggcgaattttacctgaaatggtatcaccagtacggaggttaaaacggcggatttggctaggagaaacgtagatatcatcgggacctgcaaggtaggagctgtctccggaacggaggaaaccaaatccatcctgcaatatctccagtaccccatctccgaaaatatcttctccactcttcgcatgctgtttgagaatagaaaaaataatgtcttgcttgcgcatacgagccaggttttccagccccatattttcgccgagagtaatcaactcagataccggcgtattctttaattcggtaagattcataatggtgggttctttaactcggggtatatctcgaactatgaacgtgaatggtatggcagcgttatcggtgcctgtttatttgtaccagaaacgaataaaaccttttaacatattaactaatattacaaggcaatagtttgaagtactcagattgatttcaaaataaggctgacaaactgtcaaaacactgctgagataatagtaacgaaacgtggttaatttcaaatataagaactatctcatcataaaaactatcttatcgtaagcattatctcagtgtgagtactgtctcagtaaacacaacttcagcaaatactatctcaataacgattgagatataaaaaagcgcgacataaagatgcttaacatagagacgctgtcagcaccaagctatataccgaatgattcccgtatatatgctctcaaatactttgccaaatgcgatatgccatcagatacttcagatgaaccagagataacagatttatcagacactacagattgtttagtatgtaacacgcttaatgtcaattctttatataaattgaagaatccactgatgcaatgcttcatacaagcacatgactgctaacttaccacgcttcgttgcagacgtctagcggtcagtaagataaatcactttatccgctaaacgcccgtgattactgtgatcagactctaaattagatatgtgagtctaaaaacgctttcagttgcgtttttgacaaagcacctacttgcgttgcggccttttcaccatctttaaacaagatcagtgttggaataccgcgaataccatgagcttttggtgcttgttcgtgatcatcaacgttcagtttggcaactgtcagcttgcctgcgtattcttcggaaacttcgtccaaaataggggcaatcattttacagggaccacaccattcagcccagaattcgacgagaactgcgccttttacgtttaatttttttgcatcaaaatccgcatcagccaaatggatgatacgatcacttataatcttctcgttcattatttttgctccaaagtaaaattttttacggtcccagtgtacattaaccaacataaacgtgtctttatttcagcggatacactttcttaaagcaatagttaactgatattctaccacactatgagcaaaacacatttgacagaaaagaagttttccgacttcgcattgcaccccaaggtcattgaagcccttgataaaaagggcttttccaactgcacgccaatacaggcgctaactttgccttttactgtcgaaggccgagatgttgcggggcaggcacaaaccggaacgggcaagacgctagcatttctgacgtctacttttcattatttactgacccatcctgctgcggcagatcacaaaaccaatcagccaagggcgctgattatggcccccacccgcgaattagccgtccagatttactctgacgcggaggagttggcagaagccacgggactgaaaatggggctcgcctacggtggcgacggctatgataagcagcttaaggttctggaatctggcgtcgatatcgtgattggcacaaccggtcgtttaatcgattacaccaaacaaggatatgtcaatcttaatgcggttcaggttgtggtactggatgaagcagatcgcatgtacgatttgggctttatcaaagatatccgctggctgttccgccggatgcctgttgccgctcagcgaatgaatctgctgttttccgctaccctgtcttatcgagtgcgtgaactcgcctttgaacagatgaatagccctgaatatgtagaagtggagcccttgcagaaaacggggcatcgcattcaggaagagctgttttatccttccaatgaagaaaagatgcgtctgttacagaccctgctggaagaagagtggccagatcgctgcatcatttttgccaataccaaacaccgctgcgaagatatctgggcgcatctggctgccgatgggcatcgtgttggtctgctgacgggtgatgttgcgcagaaaaaacgtctgcgtattctggaagagttcagtctgggaaatctggatattctagtcgccactgatgttgctgcccgcggtctgcatattcctttggtaacccatgtatttaactatgatctgccggacgactgtgaagattacgtccaccgcattggccgtacgggtcgtgcaggagagagcgggcattcaatcagtctggcatgtgaagagtacgctctgaatctaacgtcgatcgaagagtatatccagcatcagatcccggtaagcaaatataacagtgatgcactgctgatggatttacctgtacccaagcgccgtaaccgcgctcgttcaggaggacacccacgccgcaccaatatgtcgcgccgtggaaatccaactcgcaaccgtaaacatccaggctgaataatactatgctgagttcttcttcgctctatgccgctatcgatttaggctcaaacagttttcacatgctggttgtccgtgaagtgtctggtagcattcaagtggtcacccgcatcaagcgcaaggtcaggctggccaccgggttggataaaaataatcatttatcacaacaggcaatggagcggggatggcagtgccttcgcctattttccgaatatttacaggatatccctgcctcgcagatccgcgttgtcgctacggcaacattgcgattggctgtaaattcggctgattttgtcgggaaagcctctgaaatattggggagtccagtcaaagtcatcagtggtgaagaagaagctcggctgatttatcaaggtgttgcccacacgacaggtgggtctgaaaagcgtcttgtggtggatattggtggtggcagtacagaattggttacaggcaccggagcaaaagccaatcagttgttcagccttgaagtgggctgtgtcacttggctggaacgctacttcaatgatcgcagcctgacagaagaaaactttgcacaggcagaatccgctgcccatcatattctcgcccctatcaccacaaccctgcttaagcagggttggcagatttgtgttggtgcctccggtacagtacaggcgttgcaggaaatcatgattgcacaggggatggatgaacttatcaccctgccgaagctacagcagcttaaatacaaggcgattgagtgcggcaagctggaagagcttgaaatcgacgggctgacattggaacgggcattagttttccctagcgggctggcaattttaattgccatctttcaggcactgaacatcgaaagcatgatccttgcggggggcgcactgcgtgaggggctggtttatgggatgctggatttacccattgagcaggatatccgtacaagaactctgtgcaatattcaacaccgttttcaactggatattgaacaagctctgcgcgtcaaacaactggccgaacatttttgtcagcaggtcgccacggtatggaatctggatgcacgatgtcgcgatttgttgaccagcgcctgtctacttcatgaaatcggcctgtgtgtcgattttcgccaaggcccggctcattcagcgtatctcatcagtcatttggatcttcccggttatacccccgctcaaaaacgattgctggcaacgctgttgaacaatcaaagcggccctgtcgatctggcctcactcagtcagcaaaatgccttgccaccgttacaggcacagcaattatgccgcttgttgcgtctagccattatttttgccagccgtcggcaagacgatactttgccggccttgcggctgcgggttgaaaatgagacgctcaccatcaccctgccctatcagtggcaaatgcagcatccactcagggctgaagccttacatcaggaaatccagtggcaaagttatattcagtggacattgttccttgaagagcagaataactcccatctcggataatctacctatccctgtattcaacgcgaatacagggtattcatcagattttatttatcgctgtttttctgaccaagccccaaacgggatttgatatccgcaagacgcgattgcccttgcttcattcgatcttccgcactgatcatctttttgcctctcggccagtgcaaatcatcctgcggcaactccagcaaaaatcggctcggttcaggccgaatcagctcaccatactgacgacgctctttgctgagggtaaaaaatagctctcgtcgtgctcgggtaatcccgacataagccagacgtcgctcttcgtcgatattattttcatcaatgctgctttgatgcggcaacaaaccttcttccatgcccaccaaaaaaacataagggaactccagccccttggatgcatgcaatgtcatcagctgaacctgatccaattcctcatcgttctccccacgttccagcatgtctcgcagggtaaaacgcgccacaacttgcgacagggtcatcggttcattcagatcatccccttcaaacatttcactcatccaagtaaaaagctgattgacgtttttcatccgcatttcagccgcttttgggctaggtgacgtttcatacagccagctttcatagtccataccgcgcagcaaatcccgtactgccagcaatggctcacgctcggcctggcgggaaatttcatccatccagtgggtaaagtgctgtagggcagccaacccgcgccctgtaagactctgctccagaccgagatcgaaactggcgtgatacaagcttttgttacgctgatttgcccactcgcccaatttctggattgtcaccgcgccgatttctcgacgtggggtattgacgatccgtagaaatgcactgtcatcgtcgggattggtcaacacccgcagataagagagtaagtcctttatttcagggcgggaaaagaatgaagttcccccagaaatgcgataaggaatacggttttgcatcagcattttttcaaaaatacgagactggtgattgcctctatatagaatggcgtaatctttatattcggttttattaataaagtgatgagcaatcaattctcccaccactcgctctgcttcatgatcttcattattcgcttcgatcaccctgagcggatcgccatagcccagttctgaaaacagtttcttctcaaatacgtggggattattggcaatcagaatattcgcggccttcaatatccgccctgatgaacgataattctgttccagtttgatcacgttcaactgaggaaaatcctcattcagcaggatcaagttttgtgggcgagcaccacgccatgaatagatggattggtcatcatcacccaccacagtaaaacgcgcccgattgcccaccaataatttcaccaattgatactggctggtgttggtatcctgatattcatccaccagcagataacgaattttattttgccagcgttcccgaacctcttcattctgcattaacagcaacgtaggtttggtaatcaagtcatcaaagtcgagaacgttgcaactgttcaaatgcagatcataacggcgataacactccgcaaattgatgctcctgcgccgaacgagcctgtctaatcacctgctctggtgacatcagatcatttttccagttggaaatgctggagttcagtttttgcagtagatctttatcttcttccagtaaatccgccgtcagatctttcagcaataccctctgatcctgatcatcgaacagcgagaagttactcttcatgcccagcgctttatattcacgcttgatgatttccaggcccagagtatggaaagtcgaaatcatcagccctctggtttccttacgccccaaagtctgagcgacacgttctttcatttcccgtgccgccttgttggtgaaagtcactgcggcaatatgacgcgcctgataaccacaggcacggatcaggtgggcaattttattggtgatcactctggtcttgccggagcctgcacctgccagaaccagacaaggccctgtgacaaattcaaccgcttgttgttgactaggatttaatcgcatactctttagagggctatatcaggataaacatcaggggtaagaagtgtagcagaaaggaagtttcctttacataaattggttatcacgagataaaataattaagtcattctattttttaaccctaatttatatgaaaaattgtttttcaaattatatttaaagaaaaaacaataaacgtttttcataataaaccattaacaaattaaatattgatttttattattaacttaacaaagccaaatgagctaaaatagaatatttacagatacttatcatacataaatacgcgccagtcttttttaaaattatttattctatttcagtaactatattattaagaaaaaataaatttttacggcattctgtttgcattaatattattcttcatcttaatattaataaacaccaaccataaccttagcgataacaatttatatcctattgttatttaacacttattatttaacacttattatttaacacccgtacatattagcgaaaaaaacatcctgattatatattattcattaccttgtcaaatcatgataataaatatttatttcaatgtttttatttaaaaatcaataaattaattaatacaaaaaattttatatttagtaacaattttaattagtcacgtaatcattattatttataatttaattttgtgataaagattaaagttatttctataaaaatagatttattcccttcttctatgcaatagtgaacctctatttacagtaacacataatatctgtttaacttaattagcactataatcttattatcatcgaatcaataaaatgggtgcaatatgctacgtaaaactggttttttctttgatgaactctgtttctggcacaatacgggttcccaacatacctccatatttcccgtaggtggatggatacagccaccgtgcggggcaggacatgccgaatcaccagaaaccaaacgcagaatgaaaagcttaatggatgtttccggtttaagtcactcattagagctaatgagtgcagagcctattgatgaagcaacgttaaggctcgttcacacagaatcttatttacagcgctttaagtacctgagcgataacggtggcggtacattggggtctgaagcgtcactgggtgcaggcagttatgaaattgccaaactgtccgcggggctaacctatgcagcagtaaaagccgtcttgcaggatgagctggataatgcctacagtctttctcgtccccccggccatcattgcctacccgatcaagccatgggcttctgtttcctcgccaatatttctcttgcgattgaaaaagcaaaagagcaacttggccttggccgagtagcagtcgtcgactgggatgtgcaccacggcaatggaacacaacatatcttttggcaacgggataatgtactgacaatttcactgcatcaggatcgctgctatccggcaggttacagcggcgaaagcgatatcggtgaaggtccgggtgaagggttcaatatcaatattccactgatggctggggcgggtcatgacagctacatgtatgccatggatcaaattgtgataccggcactgcgacgctaccagcctgagttgattatcattgcctgtggctatgatgccaatggctttgatccgctggcacggatgcaactgcatagtgacagtttccgcgagatgacccgcaagatgcagcaaatggcggatgaactctgtcatggcaagctggtgatggtgcacgaaggcggttattccgaagcttatgtgcctttctgtggcttggccgtaatggaagaattgtctggcgttcgcactgaagtcattgatccggctcttgccatgatggaattgcagcagccgagagcacattttgaaactttacagcgtcaggcaatcgatgatctgaaacaacagcttagtctgtaaacccccataaaataacgcccgatagaatttcatcgggcgttattttatgggggttcatctctatcaaatcggcctgataagcaaattatccacccactgcaatgcgttgcatatcggtcatataaccacgcagagtacgaccaatagtctcaatcggatggtgacgaatcgcttcgttaacatcacgtaattgggcattgtcgatactgctgtctaccacgggtttacccatgtcccctgcctgcaaggtagccataaatttctctttcagtaatggaaccgcaacgtgagagaacagataattaccatattccgccgtatcggaaatcaccacattcatttcatacagacgcttacgagcaatggtattcgcaatcaatggcagttcatgcagcgattcataataggctgattcctcaataatgccggcatccaccatagtttcaaacgccagctccaccccagctttgaccatcgctatcatcagcacgccatgatcaaagtattcctgctcgctgatattgccgctgtgatccgggtagttttcgaatggtgtctggcctgtttctgcacgccaagtcagcaggtttttatcgtcatttgcccagtctgccatcatggtagaagaaaacgttccagaaatgatgtcatccatatgtttctggaacagcggtgctaaaataaccttcaactgctcggaaagggcataagcacgcagttttgctgagttggacaagcgatccatcatcaatgttataccgccttgcttcaatgcttccgtgatggtttcccagccaaattgaatcagcttaccggcataacccggctctgttccctctgccaccagcttgtcataacaaagcagagaccccgcctgtaacataccgcataaaatggtctgttcgcccatcaagtctgatttcacttcagccacgaaagaagattccagcacaccagcgcgatgaccccccgttgcggcagcccatgctttcgcgatggccatgccttcacctttcacatcgttttctggatgcacggcaatcaaagtagggacaccgaaaccacgtttatattcttcgcgaacttccgtacctgggcatttaggcgcaaccatcacgacggtgatgtctttacgaacctgctcgcccacttccacgatattaaaaccgtgagaatatcccagtgctgcaccttctttcatcaaaggctgaactgcctgaaccaccgcagaatgctgtttgtctggcgtcaggttaatgaccaaatcggcctgtgggatcaactcttcataggtgccgaccttgaagccgttttccgttgccttacgccatgatgcacgtttttcttcaatcgctgcttgacgcaatgcatagacaatatccaaaccagaatcacgcatgtttagaccctgattaagcccttgcgcaccacagccgacaatgaccactttcttgccttttaaatatcctgcttcgtcagcaaattcttcccgcaccataaaacgacatttgcctaactgcgctaattgctggcgcaggttcaacgtatcaaaataattagccatgggtgactccgatgttattgttgtgaggtcgtttgcatcgttccaatatatgccatgaaagccattgcttaaattgatatattaacaagactatgttgcattttatgcaacattaaacttgtcacggtaagaaggccagaactcgatggatatacgcgatttaaaactgtttttacatcttgcagaaagttgtcactttggacgcacggccaaagctatacacgtcagtccatccacactttcacgccaaatccaacgacttgaagaactattagggcatccgttatttctgcgggataaccggacagtcaagctcactttcgcaggtgaacagctaaaacaatttgcccaacagacgcttctgcaatatcagcagttacgccattcattaaatcaccagagtccctcattgagcggtgaattacgcctgttctgttcagttacggcggcttatagccatctcccgcaggtgctggataaatttcgggcagagcaccctttggtagaaataaagctgacaacgggagatgccgctggtgccgtcgataggatccaatctgaccaagccgatttaggcattgcaggcaaaccggagaaactgccccataatgtcagttttaccaagataggcgaaatccctttggtattgattgccccttccctgccttgtgctgtgagaacacttgccacacaggaacaacctgactggaattccattccttttattctgccggaacatgggccttcacgtacacgcatcgaactgtggttccgccggaataaaatccctaatcctttgatttacgctaccgtttcaggccatgaagccattgtttcgatggtcgcgttaggttgcggtatcgcgctgatcccggcggttgtcgtcgaaaatagcccagaacctgtacgcaatcgtatatccctattagagaatattgcgctggtcgaaccatttgaattaggcgtctgtacgctgagtaagcgcttacaggaaccattggttaaagcattttgggggatgttgtgaacaattctttattctgaaaatagcacctgccaaggtgctattttttatgccgatgatcaaagaatcctatttcaacaataagttaaaagaaggattattcgtttcatcatggtattcataacccaaatcatcaagatggcgatcaaaacgcacttccgcacctgaaagttcaaaggcagccaatacgcgaccgtaatccatcccatggctgcggtaatggaatagtgtgatattccagtgtgttcccagtgtctgcaaaaactttaataaagctcccggcgattcaggaaattcgaaactgtatagccgttcctgtaatggcttggcaggacggccaccgatcatgtaacgaacatgcagttttgccatttcatcatcggtaaagtcagcgacctgataacccgatgctttcaactcattgatgatttcaagacgttctgcattgccacgattcagccgtacaccaacaaaaatacaggcttcagcagggttagtcgcatccgaataacggtaactaaattcggtcacaacacgcgttcccaacgtctggcaaaagttcaagaaacttcccttttgctcaggtattgtgacagccagtaatgcttcgcgctgttctcctagttcgcagcgttcagaaacgtaacgcagaccatgaaaattcacgttggcacctgagagaatatgcgccagcctttctccctgaatctgatgctgctgtacatatttcttcaaacccgccagtgccagagcaccggaaggttcggcaatcgccctaacatcctcaaaaatatctttcatggcggcacagatggcatcactatccaccgtaatgacatcatcgacatactgctggcataaacggaatgtttcatcaccgatacgcttgactgcaacgccttccgcaaacagccccactctcggtaagtcaaccgggcgccctgcttccagtgccgctttcagacacgcagaatcttcggcctccactccgatgactttcatttccggtacaagttgtttgatcagtactgcaacacccgcaatcaaaccgccaccaccaaccggcacaaaaatgcgatcaaggtggacatcctgctgtaaaagttccattgccagtgttgcctgccccgcgatcacggcagggtgatcaaacggcggtacaaaggtataaccgtgctcttttgccaccgagatggcttttgctttagcttcatcaaaattagcaccgtataacaggacttcaccaccaaaactgcggactgcatcaactttgatatctgctgtagcaatcggcatgacgatgatggctctggtacccactttgctggcagaaagtgccaccccctgcgcatgattgcccgcagaagcggtaatcacgcctttagctttctgctcctcagtcaaacccgcgatcatcgtgtatgcaccgcgcagtttgaaactgtgtactaactgacgatcttcccgtttaactaaaatggtattcgctaaacgggcagagattttttccatttcttgcagcggggtgacctgggcgacatcataaaccggtgcactcaaggcggctttgaggtattccgctccctttggctcagcattaagaggataaactgccacagtcagccccctaattttgctttatcgcgcacagcgcctttatcggcactggtcgccagtaaagcataagcacgcagggcaaaagagacctgacgatcgcgggatttaggtgtccatgcctgatctccacgagatagttcagcctgtgtacgtactgccagttctgtttcgttaacatccagatggattttacggttcggaatatcaatgtcgatgatatcgccatcataaaccaacccaatcacaccaccactggccgcttcaggggaaacatgcccaatcgacaaccctgatgttccgcctgaaaaacgaccatcagtgataagagcacagcttttacccagtcccatcgatttcaaataggtggttggatagagcatttcctgcataccgggaccgcctttcgggccttcatagcggataaccacaacatcacccgcaacgactttgcctcccagaatcgcctctactgcatcatcctgactttcataaaccttggctgggccacgaaaagtcaggcttccttcatccaccccagcggtttttacgatacagccattagccgcgacgttaccagacagcactgccaaaccaccatcttggctataagcatgagtgcgttcacggatacacccttccttgcgatctgtgtccaatgacggccaacggcaatcctgcgaaaaggctttagtggttcgaatacctgctggccccgcagaatacatgctcttaacaccttcatcctgtgtcagcatgatgtcgtactgagccaacgtttgcggcagatccagccccaaaacatttttcacatcacgattcaaaagctccgcacgatccagttcaccgaggatcccgatgactccccctgcgcgatgtacgtcttccatatgatatttctgggtgcttggtgccactttacacaaatgaggtactagacgagataaacgatcaatgtccgccatagtgaaatcaacgtcgccttcctgcgccgccgccagcagatgcagtaccgtgttggtcgacccgcccatcgcaatatccagtatcatcgcattttcaaaggcagctttggtcgcgatgttacgaggcaaagcgctatcatcattttgctcataatagcgtttggtcagctcgacgatgcgtttgcccgcatttaaaaacagcgctttgcgatccgcatgagtggcgagcagtgaaccattacccggctgcgaaagccccaatgcttcagtcagacaattcatggagttagccgtaaacatgcctgagcaggaaccgcacgtcggacaagctgaacgttctatctgattgctttcttcatcactgacattgggattggctccctgaatcatcgcatcaatcagatccagtttgatgatctgatcagacaggcgggttttaccggcttccatcgggccgccagaaacaaaaataaccggaatattcaggcgcattgatgccatcaacatgcccggcgtgattttgtcacagttggagatacacaccatcgcatccgcgcagtgggcattgaccatatattccacagaatcagcaatcaactcacgcgaaggcaaggaatagagcattccgccatgccccatcgcaataccatcatcaactgcaatcgtgttgaactctttcgcaacgcctcctgatgcctcaatctgttctgctaccagttttcctaaatccctcaggtgaacatgcccgggcacgaactgagtaaatgagttcacaaccgcaataataggttttccaaaatcctcatcggtcatacccgtcgcacgccataaggctcgtgctcccgccatattacggccatgagttgtcgtggcagaacggtatttaggcattgttttcactcccgtgtcttatctaattagtatcagcaatcaaaacaggcagggaacgagccgcctgttacattttgtcttttttattaaggattaacggcgtccagccagccccatttatcttctgtcgtaccatcaaataagccaaagaaggcattctggatttttttagtgattggcccacatttaccaatacccacctgaatgccatcaacactacgaaccggcgtgatttctgccgctgtccccgtcataaatacttcatcagccaaataaagcgattcacgggtaagtatttgttcacgaacttccagaccaagatcctgcgccagcttgataatggcatcacgggtaatccccggcagcgctgatgacgcaaatggaggcgtaaacagcaccccatctttcacttcaaacaggttttcccccgcaccttctgaaatatagccatgaacatccagtgcaataccttcctgatagccatggcgtcgtgcttcactgcccaccagcagagaggaaagatagttaccacctgcttttgcccctgttgggatcgtatttgctgccacacgattccatgaagaaaccatcgcatcaataccctgatccagcgcctcttctcctaaataagccccccatggaaaagccgcaataatgatatctgttttataaccgtctggaggattgacccccattccaacatcaccaataaaaaccaatgggcgaatgtaagcgctgactaatttatttttacggagtgtttcacgacaggcttccattaattcatcaacactctggctcacgggcatacggtaaatcttggctgagtcatgcaaacgccgcatatgttcacgatgacgaaaaacaactggccctttgtgagagttatagcaacgaacgccctcaaatacggaagttccgtaatgcagggcgtgagacataacgtggactttcgcatcggcccaaggaaccatttcaccgttgaaccaaatataatcagcttgctttgtcattcttcaatttccttcaattgcgccttatgcgcttattaattgtgattctttgtttcggatctcaacaccagcaacatcgactaatttcatcagttgagaaaaaagtaaatttacagagcgttggctggcgactgtgagttcaatgcttacattatcactatctgttgtatgatccatattcaaagcacatatctgaaatccacgatgacgggcaactctcagaattcgttccaaaatctcaggacaaaaccgggcctgaatagcaagttgatgctgcatcataatgacttctccaacatggttgcattgcttgagcctggtggaaccaatggccagacattctctaattcgtcaatggatacatgtaataaatacggaccttcgctgctgaacaaagcatccagtgctgcattgatttgggtttcatcagtgatttgctgaccaggaatatcaaaagcttttgccaaggtaataaaatcaggattatcgtttaagatcgtttcgctataacgtttgtcaaaaaacagttcttgccactgccgaaccatgcccagacgctggttatccaataaaataatcttgatcggtaactgcttacgtttgatggtacctaactcctgtacattcatcatgaaagaaccatcaccggatatgcagagcaccatatcttccggacgagccatctgggcgccaatcgccgctggaatgccaaagcccatcgtgcctaatccactggaagtaatgaaattttccggcccatcaaatgtcatatgctgcgctgtccacatctgatgctgcccaacgtcagttgtgattaccgcgttggatggcttgcgttcagacacctgttttaatagtgatggcgcataaatacttacgccttgatagtcataacgccatgtatgttcgttttttaattttttgacttcctgttgccaggattcgatcgataaaggttgctgtaagtggggcaacaatgtttttaaattccccagtaatgaaacatgtgcctgacgtaatttattgaattcaacaggatcgatatctacatggatcactttggcatggggggcaaaagtatttaatttccctgtaacgcgatcatcaaaacgggctccaacggcaatcaataaatcacaggattggacagcaagattggcagcctttgtgccatgcatccccaacatccccaaataacattcatgctcggcatccgcagctcccaagcctttcagcgtagaaacaacgggtaatcctgtttcggtaacaaaacgtcgcagctcaggtactgcatcagccatgccaataccaccacctacatacaaaatgggtttttgggccatgggcatcatgtaacgagcctgttccaattcttgttcagggaggaaagattcggacacaacaggtatcaggtaaggcgctaaatcgctttgagctaactgaatatctttcggtaaatcaatcagtacagggccggggcggccacttgttgctatggtaaaggcttcagctatgacctggggtaatttatccagcgaatcgaccagaaaactgtgttttgtacaagcaagggaaagccccaacatatcgatttcctgaaaggcatcagtgccaatcaattcagaactcacctgaccagtgatagccacaactgggacagaatccagcagcgcatccgccaatccggtgattaagtttgttgcccctggccctgatgtcgcgatgcaaaccccgggtttaccattcgcccttgcatagccgattgctgccatcaccgctccctgttcatgacgacacaacaagtgttcaattcccccgtcatacagcgcatcataaaccggcatgattgctccaccaggataaccaaaaaccttttcaactccctgtgttcgtaatgcttgtacaacccattgcgccccgttcattgtcattcccctgttgtatttagcttgtaaatggcttgctgtgatgttgttttgttatgcgtttctacgtgtcaaaaaaaacccccgcgcctttcggtgcgggggtctttgtgaaatctggctatttttctgtttaagccttccttcgtccaagtgcagccccgcacggtgggataataatcaccaccacgctcacgataattaggctaatcactaggacaaatgtgttcataatttttttcgttttaactcgtatgctcaacgtatctttaagagttatcattttccatgattattgacaacgattaattttatttttttcacaaaaaaatattttaattatatttttcatatagataaatatttaaacagataaatacactggcatttatactttttgctatcagaaaacattgccatctgtatgtttaataaaataattaatataggaaataataaaaactcgacttaatcacctttctatagggggtaacatccaagcagatattttttatctatgcccattattatgaacaaatgggacaacagacaattcattaatataaattatatataataactgacgaataatatcatacagatttcattcactctctttataaaaagcacctaaaaatattaaattattcatatataacaaaatgttaattagaaaaaccaaatagtgaatgaatttcgaaataccaatagcagtaaatatatttacgagcctcttcgcaaaataacaacaaaatactttttattattttttatcaattcatgatagcgactttcttgctaaggagagcaccatgacactcgccgtcatttatactcgagcaacaataggcgttgattcccccattgtcacgatagaagcacatatcagtaatggcctgcctggcttaacgcttgttggtctacctgaaaccaccgtcaaggaagcgagagatcgggtcagaagcgcgttgctcaacagcggttttacttatccaccaaaaaggatcaccgtcaatctggcgcctgccgatctccctaaagagggaggaagatatgatttacctatcgccatcgcgattttggcagcatcagaacagataccgacagataagctgcataattatgaatttttaggggagttagcactgtctggcgaaatacgccgagtcatgggtgccatccccgccgcactgagtgcgaaaagagcaggaagacaattgattttgtccatagaaaatcaagctgaactggctatcttatcccagaatgaaacattggtggccaatcacttacttcaagtctgccacttcctgcgaggagaaaccgccattttatcctccccacctcccattacgttacaggctgaccctcttgttttagatatacgggatattatcgggcaagagcaagccaagcgtgcactggaaattaccgccgctggaggtcataatcttcttctacttggccctcctggtacaggtaaaactatgctggccagccgattgtgtggcttactaccacccttaacgcatctagaggctctagacgtcgctgcaatcaacagcctaacgggtaactcggttaatcctcaaaaatggcatacacgcccatttagagcgcctcatcacagttcatcaatggcagctctcgttggtggaggttcaattcctaaaccaggggaaatttcccttgcgcataatggtatattatttttggatgaattgcctgaattcagccgaggtgccctggatgcgctacgtgagccattagaatccggcgaaatagtcatatcccgtgcaagagcgaaagtctgtttccctgctcaagtccaactaattgctgccatgaacccaagcccaacgggatatcaccaaggattgcacaatcgcagtagcccacagcaaatattacgctatctctccaaattatcaggtccttttctagatcgttttgatctctcaattgaagttcccttacttcctccaggtatcttaagccagtcatcagaaaaacatggcgaaagtagctatgaagtcaaaaaacgggtactaatcgccagaaaagtgcaaatagaacgatgtggacatgtgaatgcttatctcaatcgcaaacaaactgacagcgcctgtaaacttaagatggaagattcaatttttctggaagatacactactgaaattaggcttatctgttcgtgcctggcaccgaatactcaaagtttcacgcacgattgcagacctgaaagaacaaaaaagaatagaaagaccagatattatggaagcactcagctaccggagcatagataggttacttattcaactacagaaacaagcagggtaatctagaagagggactatttcgcccctcttgatggatcattactatcaatgatgatattaatcatcagtatcggtatagtcctctgcagaatctatctgcggttttccgccggaaagagtatgaaaacgttttggacggctgatttttgccaaatactttatccatactttttcctctgtcgttgcaggggcacgctcacctcggcaaacggcaacaaacagtttttcttcttctgtttgaggttcacgtttaccaagatccaattcattgaacgcatggccataacgttctagcaattgggcctctttgatggtgaaatcaccatgacgggaaaatccgcgtggataatttctattatcaaaaaaacgattagtcgtgatgaagctttcagccatctgacacactcctaactctactgtcatactaattatggcgcggagtattaggtaggcttgacattctgtaaaacaaaatatttaaatcttaacgacaaaaactattggagatacatgtggacactgaattactgaaaacctttttggaagtcagtaagactcgccactttggtcgggcagctgaatcactctatctaacacaatccgctgttagctttcggatccgccaattagaaaatcagctgggtaccaatttatttacacggcatcgcaataatattcgcctgacagccgcaggggaacgtcttttaccctatgcagaatcactaatgaatacttggcagttagcaaagaaagaaatcagttatgtctcacagcatacagaactctctatcggtgctactgcgtccctatgggagggctacctgatatcttggctgaatactttttatcagcatcatcaagggatgagagttgaatctcgcgtttctacacgccaaattctagtcaaacagctacactcccgtgaattagatctcttaatcacgacagaaccgcctaagatggatgaattccaaagtcaattgatcggtaacatccagctcgttttattgacaacgcaacataatcttaaacaaggcgtagaaaattacatcaagttggagtggggagctgattttcaccagcaagagcaacagatcttaaaaaatgactatccgccgatcattacaaccacatcagcacatattgcccgagaattgctaaatagcgtaaatgctgcagcctttctgcctattcattggcaggaagattatcctaagctggtgacgtcacctaatagagaacaaatcaaacgcccattatatgcggtatggttacaaaacagtgatcaacaaacatttattcagcagttgttaaaaattcctgtcgaaaaagcgcctataacaagctaagaaccatataagaaccatattgtgaaaataattgggattttaaagagaatttctacaagtagacaatgaacacgaggtaaattacaaacaagaaaaaacccagctaaatttagctgggctattaatctgaaagctatatcaattattacttagttgttaactggcaggggcggagagactcgaactcccaacacccggttttggagaccggtgctctaccaattgaactacgcccctaaatacggtggcggtgcggacgggactcgaacccgcgacccccggcgtgacaggccggtattctaaccaactgaactaccgcaccaccgaatttcttttatccatttgactggaacttcagtcggcttctgcttatgagccggactggctaaataggtgtctggcagtgccctactctcacatggggagaccccacactaccatcggcgctacggcgtttcactgctgagttcggcatgggatcaggtgggaccaccgcgctatggccgccagacaaattctgttttcaatcccgaacaagctgctgtctttcatctgaaactccgtctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccgggcagtgccattggcatgacaacccgaacaccagtggtgcgtccactccggtcctctcgtactaggagcagcccctttcaatcttccaacgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgagctgtcactctcgcagtcaagctagcttatgccattgcactaacctcacgatgtccgaccgtgattagctaaccttcgtgctcctccgttacgctttgggaggagaccgccccagtcaaactacccaccagacactgtccgcgacccggatgacgggcctgcgttagaacatcaaacattcaagggtggtatttcaaggatggctccgtgcagactggcgtccacacttcacagcctcccacctatcctacacatcaaggttcaaggttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaagagcttcgcgttgccgctaaccccatcaattaaccttccagcaccgggcaggcgtcacaccgtatacgtccactttcgtgtttgcacagtgctgtgtttttattaaacagttgcagccagctggtatctgcgactggcttcggctccgggcgcatgtcccttcacctaatgccagcgtgccttctcccgaagttacggcaccattttgcctagttccttcacccgagttctctcaagcgcctgagtattctctacctgaccacctgtgtcggtttggggtacgattcactgttacctgatgcttagaggcttttcctggaagcagggcatcaaccacttcagcaccgtagtgcctcgttatcacgcctcagtgttcacagaagaacggatttaccaattcttcccacctacacgcttgaaccgggacaaccgtcgcccggccggtctagccttctccgtccccccttcgcagtaacaccgagtacgggaatattaacccgtttcccatcgactacgcctttcggcctcgccttaggggtcgactcaccctgccccgattaacgttggacaggaacccttggtcttccggcgagcgggtttttcacccgctttatcgttacttatgtcagcattcgcacttctgatacctccagcatgcctcacagcacaccttcgcaggcttacagaacgctcccctacccaacaacatcgaaatgttgctgccgcagcttcggtgcatggtttagccccgttacatcttccgcgcaggccgactcgaccagtgagctattacgctttctttaaatgatggctgcttctaagccaaccatcctggctgtctgagccttcccacttcgtttcccacttaaccatgacttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16877 - DNA, 986 bp, Xenorhabdus bovienii
  unsure (1)..(986): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccggaccctatgaattcaggccaggatagtgcaacggattgcactgggtttccccattcgggtatcgtcggttataatgcttcatatcagcttaccgacgcttatcgcagattagcacgcccttcatcgcctctgactgcctaggcatccaccgtgtacgcttagtcgcttaacctcacaacccgaaggtgtcttcgggtgtgcgttttgagagactcaccagtcctgtcattgacagcactgattgtttcaaattttcagcttgttccagattgttaaagagcaaaaatttcacaacacacgggcgtgttccccatgggttctgaaattattcgtatggtggagctaagcgggatcgaaccgctgacctcctgcgtgcaaggcaggcgctctcccagctgagctatagccccatacagtgttatcaccggtacgtcagacgactggacagaccgtttccccgcccgccgtttcaaggcagaaacaccgctgcatccgcaccgggtaaccctggaaagggccaggagtcaacgtgtctggtaggcctgagtggacttgaaccaccgacctcacccttatcaggggtgcgctctaaccacctgagctacaagcctataccgtgatactctatttttatcagacaatctgtgtggacactgcacaatcactatcattcaggtaaggaggnnnnnnnnnnnnnnnnnnnnnnnnnnnn

SEQ ID NO: 16878 - DNA, 586 bp, Xenorhabdus bovienii
  unsure (1)..(586): unsure at all n locations
tggtagtagcctcggtaacaggcttgtacaagatacgtgtcgtgagtatgaaataattagtatttttaaggatgcattagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggngcgcacaaaaggnggctcaatacaaagatacatctggccgtggatgcgcatggtatgccgatcagagcgcttattacaagcg

SEQ ID NO: 16879 - DNA, 930 bp, Xenorhabdus bovienii
agcatatcttgcatgcctgcaggtcttgttttttggttttaaggtatatggggagggattttagtgtcaaatcgttgggactaggtattgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaagcctccattgatttaacactcatcaatggcggtagaactattaaagttatttttacgcgaaaagatacacgattatgggcgtatagacatttgggattaggttttaattttaagggggtat

SEQ ID NO: 16880 - DNA, 16009 bp, Xenorhabdus bovienii
  unsure (1)..(16009): unsure at all n locations
tgagcccggattggttaagctgaaaaccattgagagatattgcatcatgaacgtccagatttcaatctttatacttgatatcgacagcgatttggggatggtttgagggattctgggaagagtgctgggggtaaaacggtgagggaaaaaatggcgaatacggaaaaagaaaaatttgcccagattaacctcggccaacggctagaagggttgaaccatttgtcgcggatcagggcaatatactggggtgacgatgaaaaagagttaaaccggttttttgctgatatgcgcgacaaaaaggacagttattacgaagagaacaagcgggcattatccgccattttttatttggcaaatattccgcgtgtacgccacgagagtgagcttgaacattttacccaagaggaaaaacaggctctgatcaaagcaatgaatcatattaaagtcgttgtcagtcagtttccgaagtacttgaagttatctaagtaatcacattttttgaacacatttttgtacaaatggcatgagtacgtcaggcactcgcacatccttaatatggtggaattgatgaatagtggttttatcactactgaacataacggtgattatcctattgccaaaggcagacagtctggcctgtttcagccaggcataccgcagggtgtgtcaatggctgaacgtttattatgggaagtcaacgcggaagatcaccaatggcgccaccagtatatcgggcagatgccggattttctggcaaagtatttcagccgccgttatgttggcatctttaaccattcaggccgccgcgatgcgaacgcctttctgagaagaacggttggacaaaatgtcttgccacggttgcagttggttaaggcaagatattcattcacccatcatatatcaggcataacaccttttccttttattgagcaattggaaaaggtggtgacatgcgatcgcaaacagcttttgaaactcgctcatgaaatatctatttttattgcaggcaactatgagcattattccttgcagtcttctcaacaatatcaagctgcgccggttgacagtgaaagtgaattgttcccccgtgtcgctaagttataccaattactggcgaagctgactttgcaatgtggtacaaatcctccttactggcagcgttttaatcatggacgtaaagtaccgtctgttgatcaactttgtgctggtatgttgcggatgatgtctgcccgctggtggtattttcggttaaaacgtctgcgtgaaatccagtctgagcatatggcaattgcggttgggcaagtacaaaaagccgcatcgccttatgtttcgaactatgccttgcgtgaatggttggaacagaaacgccgtaaccgtgagtttttcaaacattttgatttggaaaatgagaacggagaacggatttcgctggcggaaacggtggttcatagtaatgcgaatcccgctattcgacgttgtgaattgatggtcagaatgcgcggttttgaagatgtcgccaacaaaatgggatgtgttggtgaattctataccatcacggcgccggcaaaataccatgcggttcagcatcagggcgggtttgtcagacattggaatggcgcgacgccccgcgatactcaacgctacctgtgtggcatatgggcaaaagcccgtgccgcaatcgcccgtgccggcattaatctatttggtttcagagtggtggaaccgcaccatgacggcactcctcattggcatattctgctgtttatgctgccggaacatcagtggcaggtcagggcgatccttgagcattacgcttgccaggaagagaaagctgaattgcagcgcgatgatgccaaaaaagcgcgttttgattacagaacgatagatcctaataaagggagtgcgacaggctatatcgctaagtatatatccaaaaatattgatggttatgcgctggaagatgaaaaagatcatcaaaccggggcacctctgcgcgatatggcgaaatcggtgacggcatgggcgagtcgctggcgcattcgccaatttcagcaaatcggtggagcgccggtttccgtttggcgagaactgcgtcgtcttggggaagtgcgtttaacggataacaaagtcaatgcggttttgcaggcagccgatgaaggcaattgggcagcttatattcaggcacagggtgggccgtgggttgctcgtcgtgatctagttattcgtttgtcttataaacacatcccgtttggtagcccttatggagaagatgtttacaccatacaaggagtgacatcaccatttctatcatgtgtggaatttatctgcacacgtattcaccaatggactattgtaccgaaatttgatgctgctccgacatcaggacatattgtctataaaagaaacactaaatggccctcttggagttctgtcaataactgtacggatggacaggtagataggtcaatgaagaggtatgtaaactaccggattgatgaggatgataaaataatcaatatggcaaatatttctgcaaaaacagtacataataggtattaactatcacatttagtcactagaaaaggtaaaaacttctttaatttttcacccattacgtgtactgtatatgcatacagtttttatatggaggcgggtatatcagtggactctcttatggaatcattggtagcgcaacgtattaattttattgccagaatggcaacaagttgcgaatgcaatcatgcggaagacaaagaactggcgttggtctggatagctgagttatctgcacctcatgaaaatcgacttaatgtccatagaagtgacttagaaaataatttattgatcgagaaagcgttaagaaattcaggttcaacagacgaataaattttgcaggtgaaaatgatgagagtggagatacttttcgataaacgagctaatgtttctgaatcagtgatgtctgcacttgaaagtgaactgaaaaaaagaattttaccgcagtatcccgatacgcattttagaattgcagttagcagcagtagctccgtaagagtgacaggaaccaaagacagtagtgaacatgaccagatgatggaacttattcaaagcgtctgggaagatgatagctggctgccagattaaacccgacagagtgttgatatccttcaatggatggcaaattattataatggattatgtagcacgggggcaggaaattattacctgcccccgtgctatttaatatgtgtttacaacatccgtcgatgttcatttgtactattttcccaacaatgccacttcattgaggtatttctctgattattcgatcataactctccgatttactgattattttctgcaaagaaaaggagagtgtatgcaagttatcgcacaacaaaatgagacggttgatgccctgtgctggcgtcattatggccgaacgctggggatgacggaacgtgtgctgttgtcaaaccccggattggctgcttttggcgcggtattgcctcatggaacgaaagttgaaatgccggagttcatgcccgctgccaccaagccgattatccagctttgggattaaggggtttgcatggataaatacagtcacgcaacttatgcctgcgccagtatcacagccattttttctggcctttctttatatgagtggagttttctgctcggggcgttcgccagcatttccctcggtatcctgacttatcgacttaaccgtcgggagcagatgaaacgtaccttgattctgaaaaatatcctgaaaaacatcctggaaaatctggatatcgagtctgcgtcgaaatcagccaagatagtcagcgagctgatacatcacgcaccaagagagctgtgatatgcaggatatcaaaaccagactcagtcgggtggttattggtcttattattggtggcgccagttcttctgtcattctttcgcagtttttggatgagaaagaaggcaatcgactgtctgcctatcaggatggcggcggcatctggacaatatgtcgcggcgtgacgcgcattgatggcaaagtggtatataaaggaatgaaactagcgcctgaacaatgtgatgttttgaaccggatcgaagccgacagggcgattgattgggtgaaaaagaacgtccacgtcccgctgactgagccgcaaattgccggtattgccagtttctgcccgtataacatcggccccggaaaatgtttttcttccaccttttatcgcaagctcaacgccggcgataaaaaaggcgcatgtgcagagatcaaacgctgggtctatgacggcggacgtgactgtcgaaaaacccaaggacagccgaatggctgttatggccaggttctgcggcgtgatcaggaggctgaactggtttgctggggattaaatcgatgaagaaagtacctttacttgtcagccttgtcattgggggatgttttggctggtggggacaccgttcactgttcctcagtgaagtgacgggtttgaaacagcaacatgctgctcaaattgttactatcagtcagaaagcacattcggagacgttggccgccatccaacagatgaagaatgcacagagccgggttgcgcaattggatgattattattcaggaaaattaacctatgttaccgaagaaaatgccgctttacgcgctgacattgccgctggtcatcgtcgggtgcaaatcgccgccgccaaccttgctacctgtcagctcacccaaaaccgagataccggctcccgcagcgtgggcgatgaaacccaagtcgaactcactgcaaaagctggacgtgctatttacgatatccgagccggaatcatcagcgatcaggccaaattagattacctgcaacagtatgtacttgaagtcgttcgtcaatgtaaaccgtaaatattgtccttcacttaaacatcgttcagcagaccccaaaagctttttttacgttggaaaaaggcttttattctattgattttacgtgttttttaaacggggtttgtatgacatttcctacaaatcccgtttaatgtctgcccggttttttcatggcattcttacgtcatgaacacacaactcactgaactgctgcgcttaatgcgcaacctgatccgaaccggcgtcatcacccaagtggacaccacaaagggtatgtgccgggttgcaacaggcaaccttgaaaccaactggctgaactggttgacatccagggcgggaaactcccgcacttggtgggcacccagtatcggtgagcaggttttattactgtccataggcggagaactgaccaccgcctttgtattgcctgcgattttttcagatgagtttccggcgccatcgacatcatcagaagcgacgcatatccagtttccggatggtgcagtgatggaatatgaaccgcaatcaggcgcattgactgtgaccggcatcaaaaccgcgacagtgactgcttcggattccgtccatattaccgcaccggaaatcacctgtgtcgccagtaccagaatcacactggatacaccggaagtcatctgtacacagctaatgagcacggggaatttgatcgtgcgcaatggcggcaaaatgacgggcaatattgaacacaccggcggcacattcagttccaacggcgtggtcgtggattcccataaacacaccggcgtcaggtcaggcggtgacacatcaggaggccccgtatgatgtatctgggaatgaatcggcagacgggccgagaactgacagatctggctcacgtccggcaatccgtcagcgatattttattaacttccgtgggcagccgcatagcacgccgtacttacggttcgttgctgccagaactgatcgattggccacagaacccggcgctccggcttcaggtcatggcggccagctataccgctatcagccgttgggagccacgtgtgatgcttacgtcaatcacaatggagacccggcagaacggtgaaatggtggtggatattgcgggaacttatcatcaatccgccaaagaattttcactttctattccggtgagccattcccggtgaggtaagtcatgccaacaatcgatttaagccagttgccaccaccggatgtggtggaaccactagattatgaacaactgctggaagagcgcaaagaaggattgatctcgctctatccagaagaacagcaggatgcgattgcacgaactctgcaactggaatcagaacctttggtcaaattgctggaagagaacgtttatcgcgaattgctcttgcgtcaacgcgtcaacgaagccgcccgtgcggtgatggtggcctattcgacaggtagcgatctggatcaattaggtgtgaacaataacgtagcccgaatggttttgagccctgcggataactccaccgtaccaccgacaccagcgctaatggaatctgacaacgactaccgtgttcgcatcccacaggcttttgaaggtttgagtgtggctgggccagttggttcctatgaattccatgcccgcagtgcggacggtcgggttgctgatgcttcggctatcagcccgtcaccagccaatgtcaccgtgaccattatgtcccgtgaagataaaggcgtggcatcgaaagagctgctggataaagtcgaaaaagcgctgaacgacgaaaacgtacgtccggtggcggatcgcctgcaagtccagtcggcgagtattgtggaatatgaaattgatgcggtgctgtatatcttcccgacaccggaatcagaaccgatccgcaaagcggctgagcagaagctgaaatactacgttgaagcacagcatcgtctggggcgtgacattcgcttgtcggcaatttatgccgcattgcatgtggaaggcatccagcgtgtggagttgaaagccccgctgaaagatgtggtgctggataaaactcaggtgtcttactgcaccaaaaccacactgatgatgggaggttcagatgaatgatcgccttctgccgatgggctcaacccagctagaacttgctgcggccaaagcctgtgccgagttgcagaagattaaagtgccgctgcgtgaactgtggaacccagacacctgtccggcaacgttgctgccttatctggcatgggcgtggtcagtggatcgctgggacgaacactggtcggagagcatcaaaagagaagtgatcaaaagctcgctattcctgcataaacataaaggaacgattggtgcaattcggcgggtcgttgaaccgctggggtatctcattcgcgtaaaggaatggtggcagaccaatgatgtaccaggcaccttccggctggatattggtgtattggaaaacggcatcacccatgaaatgttcgaagaactggaaaaactgatttctgatgccaagccagtcagccgacatttgattggattagacatcaatctggatacacgcggtgagtattactactcggcagccagttacagcggtgacgagctgacggtttacccctatttcccagaacaagtaacagtatccggctcagacgttgtgggtatgggcatacatattattgatgacatgaggattagaccatgagtaccaaatattttgcgctgctgacgcagctaggcgcagataagttggcgaatgctgcggcattgggtacaaaaattgaaatcacccatatggccgtcggtgatggtggtggcagcctgccaacaccagatactaagcagaccaaactgattaatgaaaagcgtcgtgcagcgatcaatacgttgagcatcgatcccaaaaacactaaccagatcatctctgaacaggttattcctgaaagcgaaggtggctggtggatccgtgaaatcggcctgtttgacaaagatggcattctgattgctgtcgggaactgcgcggaaagctacaaaccacaattacaggaaggttccggccgtacccagacaatccgcatgattttgattgtcagtagtaccgagtcggtgaccttgaaagttgacccgtctgtggttctggcaactcgcgaatatgttgatgactccattcagaagcattcgaacagccgtaatcatcctgacgcgacactgaaagagaagggatttgtcatcctgagcagcgcagtggatagcaacagcgaaacccatgcggcaacaccgaaagcggtgaaggcggcatatgactttgctaatgcggcgaataataatgccaacggtcgagtgccatctggtcgcaaggtgaatgggaaagcattgtcggaagacatccgtcttaaggcttctgatgtagatgcatataacaaaactgaaaccgatgcacgggtgaatgatgccaaagcgcaggcgaaagctgcgaatgataatgccgatggccgcgttccaacggggcgtaaggttaatggtaaggcgctgaatgcggatatttcgctgaattctggggatgtgggtgcatattccaaaggcgagacagatattcgggttgatggagctaaagagcaggctaaagcagcaaatgaaaatgccaatggccgtgtgcctgcgggacgtaaggttaatggtaaggcattaaatgcggatatttcgctgaattcggcagatgttggtgcatatagcaaagacgaaacagatacgcgggttgatgaagcgaaagcgttggctaatgctcgtctggagaaaaaccagaatggcgcggatattccgaacaagccgaagtttgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaaggctccattgatttaacactcatcaatggcggtagaactattaaagttatttttacgcgaaaagatacacgattatggcgtatagacatttgggattaggtttaaatattagggtgttatagccctatattccttaaacctacctgtagtttgtctttttgaatgattttatacgcagcctatgtcacccttgtttcaccatgctgacccacgacaatattccatggccggagcagccgaagtaaatacaggggctatgtgatctgcaccccaaaagttggacgctatacttcaacttaagggatgctttttatgaagaagaaaagatattctcagacattcaagctgaaagtggttctgcactacttatcacacccagattgcggataccctaaccatggttcgtcgatttgattgtgttgtcgcagaagttgtttgaagtttaggtcgagactcaggtatgctacaagtagcaattaacggggttttatatatgatggattcaaaaaaaatactatttgttggttacgatatgcctggatttggcggaaaggaaactgtttgtaaaaatgtatactatatgatgatggataaaaatccttcaatcaatattgaatttttatttatacaagattttcgacaaggccctgatgaaattagtgatgaatggttaggcgatatttcatttagccgaatatcatctggggtttataacactaagataaggcgtattcatttttcttacaaattcgcaaaatttttaaagaaaaaaaaacctgatattatcatcagtatagatccattaagttgttatgtaacaagcttgggaaaaaaactcgccatggtaaaaattcctatatattcatggattcattcatctttggatcaactatataaaagcacttattctctaaacgctgactaccaccttgctatcagttcaggaataaaatcacaatttatccgaaggggtgtcagtgcagataatatttttacaatatttaatcccataaaaagaagtagtgaaataatgactcgacctagcgatatcattacatttctctatgttgggcggctaactgatgatgataaaaatattagtgaaatgtttactgccctatctaaggtaaatggaaattttgaattacatattgtgggtagtgggcgagatgaaaatgaattgaaaaatttagctaataaacttaaattacaaaataatattatttggcatggttggaagaaaaaaccatgggaatttattgaaagtaatataaaagaaataacaacactattgttaacctctaattttgaggggtttccaatggttttaggtgaggctatctccagagggatttattgcataagctcaaattgcattactggccctgaagatattattatcgatggtataaatggtgagctttacccattaaacagtgttaactgtttggttgaaaagctccaatatataattgatggaaaacaattgcctaataatattattataaaagagtcaattgaagatctttatgaagaaaaatacattgaaaatgtattttacgcattagaaaacagcaacaaaaagtaaggctataaatatgataacattatcaataatagtaactgcacataatttagaaaaattaatactacaatgtttattgagcatcaaaaattgtatagaaaaaaacacaaatagagatatagaggtattattagtagatgattgctcatctgacgacactagttgcctaatgaatgatttcgctaatttacatgatggctatacatatataagaacagaatatggtaacataggaaaagtcagaaactatgctataaatatagcaaatggaaaatatatcactttcatagatggtgatgatacaatccctaattttagcattaaaaatttactttgtttcttgaaaaataaagagccggatttattattatcaaaaatgcatgaggttcgaaatgaaaaagataaaattattttatccaatttaaataaacctaaaataatggataaggataaagctatagttgaatttcttcttcataagaaatttcaagctcatttatggggtaaattttttaaaaaagaattatttaaaaacaaaacgataccacctctaacatgttatgaagactcatatattttccctgaattattgaatgatagcactaaaatattctatacagattctgttatgtataattatattaaaagagaaaatagtttatccgctaagatagataatgtaaaagcagagataaaagttgatataataaatcatatgaatacaattttcagtaaaagaaaatactacaatttaatcatttgccacgccatcgatttactcttaaagaatagagaagtactgtctatacagaaacaaaaagagctaaaaagcctcataaaaaacacgagaaaaataaaatttcttttagatagaaacataaggtttagtttcaaaaagaaactgttgaaatgctaatttcaaggctatgcattgcatagccttggggtagttgttctattctttaggcgcttagtcttttacccaaacatatcccattgaccacgacgaatcttgacaatatcagaactaagtgtaaaaaggatcctgtttacgattttgtgatgcaacacgaggctgttcctgtgattgtttcagtcaatatgtagtaataaatgcgaagaaacctgctgtctcacctttatttacaaagacattttctaaataattaattcagataaataaactccattagcactgccatatctagaatcaaccatcgtcaactgtttaccatcaggagacacaataaaatcccaccacgattcagacgccattgaatatccgaatctaatccctgctattggtggaacattgattccatggtaagtttcatcccctttatccctttgaacaaaaattaactttcccaatatattttcagctaatgtggccgaaatgtcatactgaccaccaaaatcaccaatctttctccatctttgccccgtacttcgcatttgataacgactatcagattccgacttagtatagatttctcctctaaccgcataattccccgcaggctgataatttccggcgggttggtagttacccgcaggttggtaattcccacgaggctggtatctaccgcctgattcttctttcgtatagctctccccgcgaatagcgtaattacctgcgggttgtgcccctatgtcacccgcttgcaagcttacgtcacctgttagcgattttccgttaattttcctgctattgggcacggcatttttaacctgatcgacggtttccgctaaaccgacctattttggaaatttacttcgtcgaagatggctacatgatcgcgatagttgccagtattttgctgtttttagactttctgtggcagatatggcagtcttcgataaagaattactgcaggctgcataggtgatgttgcacttgaaagttggatccgccaacaacacttgcatctatgatgagaatacgttgctttcttaatgtaaattgggaataattcaacctaatataataactatgtatccactaaagttgctaagtaacccaataactagaattgtgatttttgtcacgataagtaattcattaattaggtgcggaatgacggttacagactataagcgttgataatttctgtaaaaaattgttagagccgacattcagaactcaattcagaaataaaaagactcatagcattgccccaatattttcagtaacgcattttaatagggttgcattcccgtcaccatccagcgttcctggaattcgaaggaattagcaccttcgaaagtcaaaaaaaaccaactgtccgtagggattcagtcggttgatttttcatatccgaataaaatgcggcgttttgttttagcccagtacggattatgctctagggcggcataaaccattaggttacacgtcatgaccatcaataaggcttttattcgttctggttttttcaggtacagggaggacgtcagaaattcagggcttttcagaaactggaagccacgctccaccttttgctgagctttgtaattggcgagtaacgccccatatcaagcaattcattgtcaatttcattggtggaaaaatgaacatacccaccttgggcttagcataagcagctttatcctgttggctgtaagtccggcctgagagctgataatgaacttgaggttgcttatctttccccagacgtccacggccttcataagtggtgatttcctctgccccaggagtatcaataccgataaactggcatccggactcaaaatcacgcaacgcttgcaaggcatccgcctgacaggcaaatgcttttttgcacagtttttcaattctttttcagtcgacttgagcgtgttttcctcaaaagcctgcccctcacgttagtctgcagcttcactgcaaactaacaaccatcgttgtggaacaccgccataacatgactccatccaaccgcctgcataaccgccgctaaacgcgtgtagctagttggaattcatcgtcaaaagctgctgttttgcttccctgatggttaaggcacacgagtaataagtttttgttgttactgatgaaatgacgctattgatgcttcagtataaagagcggcatcggcaacaaagtaacggctgttttgagccgctcttaggcaccgaatatggtttttggtcacttcagcgaaggcttttgcctcattggtattcccgctcatcgcctgcatgtaaaaaccaccgtcagagaaggtggtttttactaatattggggtgtattagagctaatctaaatgtatctattctactcgaaaccatcccattaacataatatacgaattggttatattgatagccgaattactaccagaatttcccgttgtacctgaaattgaatgagtatgcgctccaatgtgtactgtatgagtatgagcaccatcagtgctggttttatacttataattatcgttatcagtttcgcctgaacctatattatttctcgtgttatcataagttccatatcgggcaccttctgcaaatgcttccccccagccactatcatgaaaatgatttccattagaattagtagtcttagctccataatcaaaactgctggtagttgcgttaatctggtgattgtgagatggaatttgtgcacctgtgagtgttattgaatcatttccaccgacagagagcacatcggaaccgttttggttagctaaacgaatggttttattttcaccgatatatttccattgcgttttaggaaaaagagtatttggatttttattctgagcaaaccatacaactattcctacaggatatagcatatctgcaatatcatcttccgttaatattctcttttttccttgaaatttaccatttttatcaaatgcataagtagatatgccgaatccatttgaatcacttccataggaaaaagaaatacctcttgcatgttgaggtccttctacacttggatgagcaacatgaattgctaagtctccaaggttatccatcccattaggccgtaaaaaaccagaacgccctaaatgacgtgaattagtgtcttccagataatttgcagtcttagataagatataaccggatgtttttgtattaacatttgagcgaataaaacgattgtctgattcaggtttggtatagctttcatcagtaaatgccagttctctaacaggggagttggcgttacctgaattatttcctgctactacttttacgcgagcagtagaatagtcaacagagagcgatgcataagtatcactagctttcaatagaacacccacaccatatgtgaatgtatattttgaaggagtagaatttctgaaaaattcagggctagcattatttctacgtacccatgctaaaaaatcattgtcatttttgctaagaactgtcccaccatctccaccaaatccaaaactgcctttcggcactgcgttttttgcccgatccacggtttccgctaaaccgaggttttctacaaacttcggcttgttcggaatatccgcgccattctggtttttctccagacgagcattagccaacgctttcgcttcatcaacccgcgtatctgtttcgtctttgctatatgcaccaacatctgccgaattcagcgaaatatccgcatttaatgccttaccattaaccttacgtcccgcaggcacacggccattggcattttcatttgctgctttagcctgctctttagctccatcaacccgaatatctgtctcgcctttggaatatgcacccacatccccagaattcagcgaaatatccgcattcagcgccttaccattaaccttacgccccgttggaacgcggccatcggcattatcattcgcagctttcgcctgcgctttggcatcattcacccgtgcatcggtttcagttttgttatatgcatctacatcagaagccttaagacggatgtcttccgacaagctttcccattcacctgcgaccagatggacctgcaggncagcacagaataggcaaaatgaaaaaaacc

SEQ ID NO: 16881 - DNA, 138386 bp, Xenorhabdus bovienii
taaatgtattcttttggatgactgatatcaattaattgagggattttaacaccatttgagcagctaagagccgtgctttttagagagccaataatgcccttattgacaactctcaccgttagactaacggcaatgtgtgtctgtagagcatcaatgatatgatttgctatagaatcatctgaacagtttaaaccttctttaggctctacccacaattctgactgttcccgatctagtactacagccgtactggcattttaataaaacatctacttcatacaacagattgaagtcatataagttctcagtttatcgcgtatctgataatacattgattttgcaatctttacggatgtagtactaggatggtcaaacgcatcccagctcctgctaaccatagtaaaaagaggttcacaagagttctggctgaccaaaatccttgtgcttctgtgtgctttgcatacattgtcttaccattacgttatgagttaatagaagcggctttttctcactgtttttagatcacttgcatctcacgaaatgacgcaatttcgtcgtcattaaaaccaaggtaattttttaatagattacctgtgtgttggccgtgttcgggagctggagtgcgaacagcatcaaagtcagggaaagcacttaagtgcatgggttgacctaccaatgtcaaattacctaagtatgggtgattaataggacacttcatgttcaagtagttcatttgtggatcggacatcgcttgtgcaatgtcataaacataaccgcttggtattccacccgcatttaacatttgtatcagttgcttactctcatacttgatcgtcgcggcttcaatttcgctcatgagctgttttctgtgtattgagcgactgtggatatctgagtattgagaatttgaataaataatcggtatatcaataagatggcatagtattttaaacttatcatcttctgcggctgcgatatttatctcaccatctttagtttttacgatcccagtaggcattaacgtagggtggtcgtttcccatcaattcaggtgtttttccatccgcaagccagcgagcgacttgaaagtccataatcgtcaatgttgattcaagaagaaatgtgtatacccactgcccttcacctattttttctcggtgatagagtgcgagtagtactgcttgtgcgaggttcattccagcacgacatccgctttgcgaaccaaacgctggagaatctgctgaccttgctctgttttcagattgactgataagctttttttatttcggtgaaggttttgatagtcaaatccttcacgggaacctcccatactgtcaccttgatcggtaggtgcctcaattttgataatttcagctccccagttacccagtaatcgggatgtcactggacccgctcgatgccatgttaaatcaataacaacaatgcccgacaagggtaaaaaatccatcttagtcctcacttgattgtgtgggcctgatatttaaattggatatacaattgaatcagtaatgatgtctggtgtacaaatacagagacgttccttaaataaggcaacattatcttggtattcgatgatgtcctgcgtagtaccactgaccaataacttattgtcctgaccgcaaatattttcatgaatggcaaatattgtcattacgtgggcgagtatcttgttcccaccacgctcaactttcgtcagcaatatgttagaaactattcgctgctgtactctgtctctaaaataaatagaacccgataaagcggatgcccggtcttttgccatatttttaccttcacaataaacaaaacagagatcccatccgttaatctctcttcactaatgtcacattagataatttcttcatttttttattctcaataaatacatttgtgtgtagtaccgttttgcaagatagatgactttagatgcattgttaattatttaattgtcattattattttttttcttggtgtggttcacatatttcacattaatacggaattgactattttgtttttctaatgtaatgaaatttaatcaattgatttattttttattctgacattttttatatatttgtgggtatatgtcgcgaatttatttattaacattaagtaatggtttttatatgtaacttaattgatgagatattggtattattttatataaaaatagtttaatttgtttatttactttgattcatggagagtaaacttacagatataattaaataaaattggaattattggtctaatccagtaaatgttattaattatagcgtctatggctattataaaaaataaaataatatagagtttctttgacgataatgggaatattggtatttatatatttatatatttatatatttatatatttatatatttatatatttatatatttatatatttattagtcaataatgcagagtatacctatatcctggaacagctctatacgtgtaatcttggcttttatagagacattatgctgggtaagcagaagctgaagaggagaatagcatatgcaaaaagtcaccatcattacgggtggctcccgtggtatcggtaaggcaacggcgctttgtctggcacaacaggggcaccatgtctgtattggttatcgcagccgcgaagatgaggctgatgaagtcgtggatattctgcgtggcttcggtcagtcggctatggcagtgcgggtggatgtgactgatgaaaagcagattatggagctgttccaacggacggaaaaagaattgggttatatttccgggttagtgaacaatgctggggtcttaaaacctcaggcgaccatcgaacagttaacggcagaacggttaaatacaattttcacgaccaatgtaacaggctattttctctgtgcccgtgaagcggtaaaaagaatggcttttcgtcatggtgggcgagggggagcgattgtgaatgtttcatcggcggctgcaagattgggttctcctcatgaatatatagattatgcggcatcgaaaggggctgttgatacgttgacaattggattggctcaagaagtcgcagcacaaggaattagggtgaatgcagttcgtcctgggttcatctataccggcatgcatgcagatggaggggaacctgatcggattgagcgaatcaaagattctttgcccatgaaacggggtggacagccggaagaagtcgcgcaagctattgcgtggctgctgtctgataaggcatcgtacgtgacgggaaatttcatcgatctggcgggtggaaagtagattgcctgaatgattttgaatggtgctaaagagctgtgagtatgaatagccggaaagaatcttaaggatatttccggcttattaatgggcatgggttcttaatctaacgattccgtcaatttgggtttaagaataaccttgccaggtgccacttcaatattgatgggctgctccactaactgactgctcgtcagccaatcaccagcaatataaagctcaccgttttcacgaatgttgtcgataccttgatctgcatgatcttccacttcatggatcaaactgacaagatcaacatcaggatcaacgagagagataattatctcattggaaaattgtgagatatgaaataacgcatccgcactaaatccagcattgctgagtgtgctgccattaagcattaattcgggaatatcagtatggcgaaatgaaacatggaggctcatttgtacgttccttgtgttatttaggcatattgcgatactttatcagtacttcgccgatactgcactgcgaattcatacgtgttttcaaattcatgcgtgtttgatttgtaccgcatgtgttgattaattcaatatctacacactagcgcttagatgaacgatatgctatcgataatgttggtctttgcgaagcaactcgcaaaaaatcactggatatttatccatgccgacatactcgtctgagttaaaaaataaaaatagaggaaaaagctattaaagacccaataggctgacattatctagataatgtctcagtgaaataaaaataaataaaatgaattttttcattagttcaattttttattctttttattgtgaattagtcttttttaaattttttagaaaaatgtattttttcattgtgattgaatgtgatgatggcgtttttatttattatttttcataaaaggtataattattattaatactatattttaaaagcaggtttatttttattcaaaataattctgatatgtcattatttttaagagcattatagacaggggaatgtcattgttgtataagtacatgttgtatagattaattagttttaggttaatatatgagttgtcagttgatgttattcagaaggtcttttcaagcttattctaatattcattatcatattttaaatccttttcctatctaatcaattctctctttttttatagagattttctttaaacattgcactttgatgtaacaaggtttctgtaatatttctccggaaattgtcagaacattgttcacattatgcaatatggccaactattgtcttattttcgagtaggaaaattaaaatgaaaagaattcctgagcccttccgtattaaaatggtagaaaatatccgcatgacaaccgcagccgaacgtgaagcggcattggaggaggctgggtataatccattcctgctgccttcagatatggtttacattgatctgctgactgattctggtacgggttcgatgagtgatcgccagtgggcaggtatgatgatgggggatgaagcttatgcgggttcccgcaactattatcatctggagagtaaagtcaaggagttgattggctacgaatatacgatccccactcatcagggacgcggggctgagcagattttatttcccgctctgatcgccaacaaaaaagccaaaggcggtgctgaaaagccggtgtttatttctaatttccattttgatacgacagcagcacatgtggaattaaatggtgcatgtgctatcaatattgttaccccgaaagcgtttgatacaacaacctattatgactggaaaggtaattttgatcttgatgcgctcaagaataccatcaaggaacatggggcggataatattgtcgctatcattactactgtcacttgtaatagcacgggagggcagccagtttctctcgctaatatgaaggccgtatatgatattgcgaaacagcatgatatccctgtcgtaattgattcagctcgtttttgtgagaacgcctggtttattaaacagagggagaaaggttacgaaaataaatccatcaaagaaatcgtcaaggaaatgtatcaatatggcgatatgctcactatgtcagcgaaaaaagatcctatggtaaatattgggggtctttgttgtttccgtgatgatgaagcgttgtttaacgaagtacgtattcgctgtgttcctatggaagggtttgtaacttatggcgggcttgctggccgtgatatggcggcgctggcgattgggcttgaggaaggaatggatgaagatttcctatcttaccgtattaatcaagtaaagtatttgggcgaaaaattacgggaagctggtattcctgtacagtaccctattggtggtcatgccgtctttgttgatgccaaattgctcctgcctcatattcccagcgatcaattccccgctcacgcactgaataatgaattatatctggaagcagggatcagaagcgtggaaattggttctctattattgggtcgagatccacaaaccgggcaacaaaaaccctcaccgatggaactcatgagactggctattccccgtcgtgtttataccaatgatcatatggattatattgtgggagcttttatcgccttaaaacagcgtgctacacaaatcaagggattaacgtttacttatgagccgcctgtattgcgtcatttcgtatcgagattaaaaccgattgataacgataaataatcagaaaacgatagctttatttctcgtaccggagagccgttatcgcgccagcaattctataaaattattaggaacacaagtatcaaagcagaaattgcgatttgcgcgaatccgcatatgttgcgtcattcgtgtggttatgcgttagcggataatggcgtcgatacacgattgattcaggactatttaggtcatcgcaatattcgccatacagtcagatataccgcgagtaacgcaggtcgctttgatggaatttggagagcaagagggaagagaaaaggggttacatttagtgccaaactgttaactaccgatgaattctctggttcagagctgtcctgaaaattgtctttgaatagtcatgtttatcagtaataacttgccaaaaaaccccgccgatattaccaagcagggttttttcatcatggtgtaactatattaaattgttataccgtgctggatagcaagggcagacaagccgccggcaaaaccctgacctacggctttgaatttccattctgtattgtggcgatacagttcaccgaaaatcatagctgtttctgttgacgcatcttcagacaggtcgaaacgggcaatttcctgatcgttgtcgttgttgactacgcggataaagctgttgcttaccatcccgaaattctgtttattgttgtctgcgtcataaatagtgactgcaaacaccacttttttcacgtcagcaggcacttttgccagatcgattttaatctgctcgtcatcgccggcgccttcacccgtacggttatccccttgatggctgactgagccacaagggctgactttattgttgaagaagacaaagtggccgtctgacagaactttgccatcttccccaaccatgaaaactgaggcatcaagatcgaatgccgctccgtcagtggcacgcatatcccagccaagacccaccagcgcaatattcatcgcaggggcttcttttgtcagtgatacattgccgcctttaaccagagatacacccatttttattctccaaatagtattttaaggtatcgggcaggcgcgcctgcccaatcatgaattaagtgatggctgaatgatcaggaagcgttaatgccatactgagcacaaacagatgccagaccacccgcatagccttgaccaacagcacggaatttccactctgtattgtggcgatacagttcaccaaacagcatcgctgtttccgttgaagcatcttcagtcaggtcgtagcgggcaacttcaacttgagtatcatcgttaaccaatcggatgaaggcaccggaaacttgtccgaagctctgatgacgggtttgtgcgtcatggatagtcacaacaaacaccactttttccacatcggccggaacctgatccagtttgattttcagtgattcatcatcgccatctccctcaccggtacggttgtcgccagtatgcatgatggaaccatcagcagatttcaggttgttgtagaaaatgaaatcggcatcaccgcgtactttgccgtttgctgacagtagaaatgcagaagcatcaaggtcaaaatcttgtccatcggtggcacgggcatcccagccaagaccgatcagaacatttttcatcgttggcgcttctttgctcagagaaacgttaccgcctttagaaagagatacacccattattatttcctcacttattaagtcgcatacccttcatcttttaagttgctgctttgtgggctgcaacttgaaatctattgggtatattgattaatcgtattcattttaattgcaggatttaactttcattttcttctttttggggaaacagcaggctgacaataatgccgacagtcagtaccccaatcaccacgaacaagctggttgtcgccgaaattgaataaccgtggtggaacatatgttcagatgcgttcaggccgagtttgatggcaataaagaacagcaggacgataaccgctttttccaagtgaaccagatactttttcagtgcttcaagcacgaagtaaagcgtacgcaggcctaagatagcaaacatcatggcactgtaaacgattaaaggctcccggctgacagcaataaccgcaggtacagagtcaaaggcaaacatcacatctgacagctcaaccaccgccagacatagcatcagtggtgtggcataaagcgctgctttgcccgtacgacccactttcacatctgcgttttccggtttggcaagttcggcattcacttccttttgattcaacatgaaagcgtggccgcgcagttttggccaaatagggaaaaagcgcttcaccagacggtaggcaaggtgctgtgaataatcctcgattccatcgctatcatcaccgcttttcagcatcatgaccgcagtccagcccacgatgatggcaaaaaccatttcgacccaagggccgagcatcagcaggctcgttccgatggcgacaaagatgccacggaagacgattgcaccgataatgccccagtaaaggacacgatggcggtagcgatcaggaacggcgaaccaggagaaaatcgccatgatgacaaacaggttatcgacagacagcactttttccagtgcataaccggtaacaaacaggctcgcggtttcagcaccgtgatggacaaacaggaatccggcgaaaacaaaggcaatagcgatccagaagacggaccagagagcagcgctgcgcagcgaaatcggcttatcatgacgatgcataaagaggtcgataaagagcgcaccaaccgacagaataatgaatacagcaacggtttccatcggaaaacctatgtgcgtggataccatgaagtgagcctcttaaagttatctgcgattacagttcgaaatctgcgggtgtaaagcccagagttgtacaaatttcacgggcagccgttttttcgtcgttatcaaaatcgccatcacttttggcgacggcaatacctacgcgcaaggcaagctgtgccgcttccggctgcggtttcagcaccatgatgaatttcatggcttcacctttgccaatgtcagcatcaaattcatagctgctgaccagcttgttgaagaattcgataatttcagtggtatcgaagactttcagttcaggggagtttttgatgaaccccaccattttctgtttttcttctgagctgacgccgttgcttgccatcgcaatgtgcgcacacacggctacggtgccttccatgaacttgcggttcttgaagcggccgacttgattggtcagctcttcacggcccgcgctgaaagccgtcttgattttgtttaaaaaggacatagttctctccgattgtctaaaatgtgaagggttatttactgcctgcgacccagcgaaagccccaaccgaatgctcggtccatctccttatgcccgctgaagtactggttgatgcgttctactttgattgcaccgttttcattgacaaggcggccgaccgcacacatacgtttctggttattgccttccgtcatgcgggtttcgataggggcttggccactgatatggattgtaaccacgccgtctgtattgtcccaactgggaacgccttcgtagatcaaggcataaaccaacacttcattgatgtttttccattcgaggccattaatgtggagccattcaccatcacggacggcaccggttcgatcatcaccctgcaattttacgtagggttcccgatgataatccccaaagcttttgcctatcgcctgaacgacataacgttctccgtcatgcagccgaatgaatgcgccgagatccagatccacgcctttgttggcgctgaatataccctgcaatacccctttttttgccggggacgctgcctgattccagttcagattgacgcgaatttcaccgaaattgtcacgtttgctcaggctaatcgccggtttttctttggtgagagaaaccttgcttaaattaacactatttgatgcgggagcaggaggcggcgcaggcgttttggctggcgcatcatcaacgatattcacaccaaaatgttccgccagtggtttaaggccaccattaaaaccttgggcaataaagcggaatttccattcactgttgcggcgatataactcaccgaggatcagagcggattctgtccgaccctgaacgtcaacactgccctgtagaaccgtgtttccgtttagttctacctgaatagaaagagtccgcaggctggaaatggtctggttgccgtcgcaggtcgccgtaaacgccactttttggacatcttgacgcagggctggcaagttaacaaagaacgaagtattaacgttgccccctgccagacggatggtgttgtcatcattgaccggctggccgtaaaacaccatgtcgggatcgccctgaactttgccatcggcatacaggcagaaggcggatacatctactgccgtgcctgaaaggactctcacagtgagagtctggttggatacgggggcatttccccccggtgtcaggttcattagcgcaccaccgtttcaacgatttgaggatacatatcctcaatggtacgcccacggcaagcggcaccatgtgccgtgaaatcccattgacccttattgcggcgcagggaagagatgataacgccggtatgggcaccctgctcgtttagctggtagcgagccagctctttgccgctttggtcaacgacacggcagaaggcattttcaacatcattgaaggtttggccgcggaaactgttaacggtaaaaaccaagtattcgatattggcaggaagattgacgagatcgacgctgatgacttcatcatccccgtcaccttcacccgtcctgttatcgccactgtgtgccacggaaccacatagtgagtccagttggccgaaccacaccgtgtcgatagtcttgccagcgttatcgagcagtatgcagcttgcatccagatcaatttcgtcactgccaccgccgaacatacgagccataaagcctttgttcttggaaactggatcccaccctaggccaaaatcaactttagccagtgaagagctctgcttggcgagcgaaactgactgatttttgtttaacgaaaccattaataacacctctttttttgtcggtgaatcgtggtaattccacttatggaaaaaatcataatatgacagaaatgtggcgaaattctgtcatattatgattcccataaacagcatgtcttgtgtttaagtccatgatagaaaacaatctgatttctttttttatgatttcttttccaagcccaaaagtcaaacaaattttgtgctaaaaaatcatattatgattgacacgtacttgcccccggttctagactgcggcgcatatttcgcctgagctggaaaggatgttgaaagtgaccattttgactagcggcaatttagcaatggtttccgcgtgaatgataaaatttggtttatgaacggattgttatcgtcttccatcagtcatcccaggctggttgaaattttttaaaaggctccctatgacagcatttaatgatactcagagttatcaaggccaggtttccaaatggaagttgaacagcgggacgttgactgtaacggcagcccgtggcacagcatctctggaaactctgtttgatattgctgagcgccgtaaccccaaaagggcatttttatttgtcagcaaggtattgggacgccacattccggtcagcccatcgatcatgcgctcggtttaccggcagttatctgaacagtttccgacccatcttcccggccctgtgctgtatatcggtatggctgaaacggcagttgggctggcagcaggggtttttcaagaaacccgggaaaaggttgaagctccggtatttctgacgtcgacacgccaccccgttgagggggacttgctgtgtgaatttaaggaaaatcacagtcatgccacggatcacctgatttactggccggaagaaaacagattgcgccaacgggtggttgatgcccgtacccttattttgatcgatgatgaagcgaccacgggaaatactttcctcaatctactcaatgcactgagtcatgccggccttaatcagattgaacatatcgtcactgtgacgttaacggattggagtggcaaagctgttatagaacgttgtccgctgccagtctctacggtttctttgatcgagggaaactggcattgggatgcggatatttccgccccgatccccgtcatgccgcaagtcaatgtcacggcgcggggagatgtcagcattattggtaagcagagttggggacggctcggattggatgacattcagtgtgatatcggcacggaaattcatgctatagcgggtgaaaaagtgctggtgctgggttccagtgagtttgtctggcaaccattcttgctggctgaacggctggagcaggaaggcgcacaggtgaaatttggttccacaacccgctctcccatttcctgcggtcatgctattcagtcagtgatgtcttttatggataattacggattgggcatcccgaattttctctacaatgtggcacaccagcaatttgatcgcatactgctctgccttgaaacgcctaaaaccgccgtcgatccggcactgataacgcaacttgcccgtgtttccccgattgtcgagattgtctcctatgattaagcccgtttttttgactgatcttgatgacacgttatttcaaacgcgtcggaagataaagaaagcaccgggtattgagtcttgtcgtgtgggcgcattggatcgagaatattctccttgcagctacatgaccgaagagcagtcaatgttgattgactggttgctggcttatgcggaggttatccctgtgacggccagaaatacagagcaacttagccgggtgaaaatcccttttaattcatggcggattgcgacacatggcgcagtgatcttgacaccagaaagcacggtggataaggaatggcaggcacatattctggcagcactgacgccttaccgtgatcagtttcgggaactggatcacttgagtcatcgcttgatcgctgctcatggtatggaagcatgggcgcgtattgattatgaatatggcgatgttcccgtctatctggttattaagcacagagactgtaatcggctggaagagcttgatgtgcttgctgaaaatattacccaagaaatggctgatatttttgattctggtggtttttatcttcatcaaaataataacaacctgactttgttgccaaagtgcgttgacaagggattggcaacccgtcaccttttgacaaagcttcgtactgagagaggcgtttttcctattattggtctgggggatagcctgagtgaccaccgtttcatgaaactgtgcaattggttcggtatgccccagcacagccagtttgctaacaccttgatgacctctttattcggaactgtaaataatgaatagctttccccttttttctggttcatatgatcccgatgatgtccagtttctgctaaaacccgttcagattgagatgacacccgttgatatcaaagagcagcttattcagtctggcgttcgtcactattcagagatgttgagtcaagagccagagccaacgccttatcatcttgatttatttgacagggcgcttgaacagggcgcagttcgcttggcgactgaagtggtgatgctcgctaatgcgttgatatcacgctttggtgatacgccgatagtgctggtcagtctggtcagggcaggggttcctctgggggtgatgttgcaccagacactcagaaaaatgggtaagcaatcttatcactatggcatcagcatcatacgggatcgcggtatcgacagtacggcgctgtcgtatattgagcagcaacatggtacggatgggctggtgtttgtggatggctggacaggtaaaggcgcaattacggctgagttatcccgttctctggcgggtcggtctggctattcaggcattccccgtctggtggtactggccgatccttgtggatgttcatggctggcggccagtgacgatgattggctcattccctttggcatcatgggcgcaccggtatcgggtctgatatcgcgttcgatctggcgtgaagaagggatgcatggctgtgtgcaatgtgatcacctgagtgagtttgaatgcagtcgtctgctggtggataccgttgctgattgtcgcgatcgcttggagctgaatgcgataccggtggtggattggcagccgcaggaaaaaatatccttgctggaattgagcaaaactgtgatctcaacccttgccgaaacgtaccagatcgacagtattaatcgcatcaagccgggcattgcagaagcaacccgtgcggtattgcggcgcgttccagaacatgtactggttcgatctcaagatgatcctgatgttgctctgctggttcatctggcacgtcagaaaaacgtcgttattactgaagtcggcgatctgataggacaatatcgcgccgtgactatcattaagaaggtagcttgatgaaaccgatcccttccccgcatcaacttggtgcaacgctgtacatcccggccactcgtcaaggtattgcagaaattgtgctgcataataaaattcccggtctgcgttctctggtgatctgcctggaggatgccgtcagtgatcaggatattcccgacgctattgaaaatcttggttgtgtactgcaagcactggcgggagctgatatctcttcttcccatacagagcgtcattaccccctgatttttatccgcccccgcaatgaagagatggggcgttatctggtagacaacgttaacctcagcgccgttgatgggctggttctaccgaaatttacctgtgcttcactggctggctggtgggatattgtgggttcgacccatctcagcatgatgccaacactggagaccgaagaggtctttgatgcccggcagatgaatcagcttgcggacagtcttaaaacccatccttgttatgagcgtattatcgccctgcgcattggcggtaatgatctgatgaatgtgatatccctgcggcgttcgcgtgacttcaccttatatgaggggccgatgggatatgtgataaaaatgctggtgactgtgtttgctgcgcggggtttctccctgacggcacctgtttgcgagcatatcgatgatttgcggttgcttgagaaagaactgatattggatattgcacatggccttgtggggaaaacggccatccacccggggcagattgaatatattcagcgggcgttgatggtcaatgggcatgattatgcggatgctctgcgtatcctcaattccagtcaggccgtattcaagtctcaggggacgatgtgtgagcctgctacccatcgacgttgggctgtgaatatcctcgaccgggcgaaatactatggcattgcgcctgaattcaatgaagaaacctgtaaaacttttaatgtgttttgatattgatttacttgtgataggagctatgctggacgctatgcctatgattaacattagggattttttgtttagttatccctgacttggtaatttaaacgatgttacttagccccaagcaatttagaaatttcaggttgaccttattactgtcgcatgagaaacccgttagcaaagtgagaatgattcgagagctgaattgttcagaaccgacactgacccgcgcattgagggaactacgcgatctctattgtgctgatatccggttcagcaaaatggggaatacctatcaattggtcgataaaggcacactgactaaaaaggatgtacgcagaattgaagagttgctcatccagaataatagtctcaaggccgaagaagctatcagccatgttttccttgataaggagaagaagaagcctgtttctctctccttgaggatgtccgtcattcgaaaaattgacgggctggccaatcggcttgagacaacccgaagtgatgtggttgaaatggtggtggacaggtttatggagacgctacagaaagaggccatggacgtgggttcgcagaagagatgaatcatcgttatgccagttgactgtgatcaactggcatcaggggaataagatgaggtatctgattgaaggggcgtttagtgcttgtggcgggtaagcttatcgagatagcccatcacaaatgcggacatcacaaaagtcagatggataatgacataccacatcagtttattgtccggaatatttttggcatccataaagatacgcagcaagtgaatggatgagatagcaacaattgaggccgctactttatttttgagagaagtggcatccattttccccagccagctcaatttctctttgtgttcgtagatatccagagttgaaacaaagttttcataaccagaaaacatgaccatcaccagcagcccgccaaccaacgccatatcaatcagagaaagtagtgtcaggatcaggtcggattcagcaatggaaaagatatgcggcaggatatgaataatttcctgaaagaacttaacggcaagggcaagcagtgccagtgacaaaccaaaataaacgggggcaagtagccagcgagaggcatacattatgttttcgagaaagcgttccatggtgtttttgtctgttaaaaaaggggcgatagtatagatcaagaatatgacagctacgaaatacatatcgcggttatctggattccacctgttgtacaggtggtttttttattatttaactagttatgaagagagtactttaccgcgaagaaggaacagatggcattagcaacccgcagttacgttactgttatgaccatatcccaggcagtagggcgctggaaacggtttagactttatctggcaatcttctgttttttcgacctcgcagggggcgttttggggaggtggttatccagacccagttttgtcaaatcaatatcaccgattttttcactggtaagcagcccgttttgccagaagcgctcaaatactcccgttgccagccattcctgaaaacgacgatgggcactacttgaagaacagaaacctgtcacattcagggcattccacggacatcccgttcgtaacacatgaaagatggcattcatggctgcccagttatccactcgatggcggtgacatcctaagggatggtgggttttaggcacgggtagtaagggttccattttttgccacagttcatcagaaatgagccattgtgttgttgtcttcttgttcattaatttatcaccatcataaaagcatagaccttaatatttattaataaaacctatcgagataggtttaaatatcaactcatttttagtaaacgttgacagtttttttacctaatacgcaaatcataaaagccattgatattaaaattgtttttatgaaactagcgtgataaaaaacgcagtattattaaccttgcgaagcttatagtcgcgccaattattaacttatttatgatttggcatgcattcttataggccgttagagctaacaaaagcaagtacagcatggagctagatcaggtattaaggcccttacttaagggcggtagcgtttttagaggaaaagtttaggagattgaacaggcatccagaaaagggttgagtgtgggttcgaacgtcaataatctcgttctctaacgtaaagagacagaacaaaatctgctcattgatctagcgattactactgttttgatggtaaagaaagtaccccactttcttttatacgcattaagaggcttcatccattccatccttcatctgatatacattctgcttcgttaccctaatgactccggtattaacaagcgaactaaaaccgttaatatagcgattaaaatacttactttttccccaatcaaaaaacttagccattggtgctcctccccgtagtcgcgtgacgtgatgggaaaagaggtattttcgtcatttatctatggcttgactgaagttgtcagattcgaatgaatattggaagaagcagttaggatacttaataatttaaatttttctaaatcctgatttaaataattttaaaaggagatataaattgaaaatatcaattattggcgcaggcgtgatgggattagatactgcgatggtatgcgcagcctatgatcatgatgtattactgatagataaagatcctcatgtattagaaaacattgcatcgcgaatttctagtgaattccgtttataccgtatgctcgaacctacattaaaatctgttgacatctcaaagctaaaggaacgaattcgcattactcagtgctatgaagagatagaaggcagtgattgggtcatcgagaatgttaaagaggactggtctgctaagaaaagcgtttatgaaaaattaaccccttatttaaacgcaaaaacttatgtggcagcgaacactagctgtatatcaattactaaaatcgctgcaagtcttccatttcctcaacaagttattggtttgcatttcatgaacccagtgctgataaagaaatgtgtagaagtcatcaaaggcttccacacatctgaacagacactcgattctgcaaaacagtttttagctagcctcaaaaagaatgctgtggtggttgaggatttccctgggtttgtctccaaccggctatctcatttattcatgaatgaagcggcttttctcgtgcaggatggtgtagcgactccccaagacatcgatcgaatttttaaagatggctatggtcattcaatggggccattggaaaccgcagatttgatcgggctagacaccgtcgttaattcattacatgtactttatgaaagttaccaagatccaaaataccgctgctgccctcttttaaagaaaatggttgaagccggcaatctcggcagaaaaaacggtaaaggtttcttcaattacaaaaattagaactgcgagttatttatggacgatttaatagaaaaaatagaactcaataaaaagcccgtcaaatgtgtcatctgggatttagataatacaatatggacgggtatcctatcagaacaagatgatctgaaattaaaaaatgggatagaacagttaatcgaccaattagataaaatgggaattttacaatctattgcgagtaggaatgatgccagtgacgcactagatatgttgaaaaaattcaatttagaacagtatttcgtttaccctcaaattaactggggccctaaatcttcatcaattaaaaaaattcagaagagtctgaatatttctgccgatacatttattttcgttgatgatcagattttagaaagagatgaggttaattcaaaattccctgaagttacctgcattgacgctttagaatatgaatcaatattaagtttaccgcgtattgctaatatggaggtatcagacgatgcaaaattaagaaggcaacgttatcaagacgatatacttcgtaaagaagaagaagagacatttgtcggtgcttctgaagaatttctcagccaacttgatatgaaattctatatttccaaagccgagcccgaagatctgctcagagcagaggaactcactcagcgtacgaatcaacttaattctaccggtataacctatagccgcgagcaattgagtcaactcatgaactcggaagaatatgcgcttttcgtgtttgaactggtcgataaatatggttcttatggaaaaataggtttggctttagtccactataaagataataccgactatatcaaactcctgttgatgtcttgtagaacactttcgcgaggggtgggtagtatcgcgttaacttttattatgcaacaggcgaaagaacacggccgtaaattgcatgctgagtttaaacggactccgcgcaaccgccagatgtttgtcacttaccaattttcaggatttaaagaaatagagaagcatcctgacgatactattatattttataatgatctagagcaagttcctgatttaccacactatgttgatgtcattataaagtaattggagataacaatgaaagattcagacgtaatatctaaagagatccgtgaatttattgaaaataatatgacagtgtttgatgatgatattgaattgttagatgacacgaatatatttgaaaatggtttggtaaactcgcttttttccatgcgtttactttgttttattgaagataaattttccatctcaattccagatgaatatatagaacgggaaaattttgtttctataaataaaatgctggaattagttaataaagtaagaggatgagatttacgatatggaatatgatattcaccctttagtcggaatagccaagaaattttcagatgaagtactgcgaccatcagcaggtttatttgatgagcaaggcgaagtaccgcgggaaatcatgcgtgagatggccgatcttggtttgctcggttctatcctccctaaagaatacggtggacaaggaatagatcctctctcttatggttatttaacagaagagataggtaaaggctgtaactcgactcgtgctctattgaccgttcacaccagtctggtcggggaaacgctggtaaagcttgggacacaagagcaaaaagagaaatacttacccgcaatggcaaaaggtgaaaaaatcgcttgttttgctttatcggagccagaagcgggcacagatgccaatgcaattagcaccatgtacgagccaactgaaaatgggtttgtcattaatggtcataaaaaatggatcacctattcaggcgttgctgatttattcctggtatttgcgaagcacgatgaaaaagtcagtgcttttatcgttgagatgggaactcaaggattaacgcgtaagccaatgcgtggtttgatggcaagccggggagcccatttgtccgagctgcattttgataacgtagaagtgccaaaggacagtttgattggccgtgagggcacgggatttagcttcgtagcgaacgctgcactgttttatggccgctatagcattgcttgggctggtgtggctatcgcacatgcggcgctggaagaaatggtcacttatgcccgaaaaagagagcaatttggcaaaaaaattggccagcatcaattaattcaagggctgatcgccgactcaacaacggcattttatgcagccaaatcggcttgcgaaaaaattggttatctgaggaatcaaggtgatcataattcgcttatggaaattaacatagcgaaatactatagctcatcggttgcgatgttggttgcaaataacgcggttcaggttcttggcggaaatggaatatctaatcgcttcccggttgaaagattatatcgcgaagcaaaagtattagaaattatcgaaggaaccaaccaaattcaacaaatactcatatcacaacatgctttgagaaaatttttccgcaaagactctatcgttgcatagaaataagagaacagcgcggatactgagagattcatgtaccgttctgtaagaggctatggggaaggttcccatggcctactcaccataaacttcactgtaaaatacaaggcacttggtaattacgctatagggattattaattttaatatttcgctacctactgactataattaaaggttaaatatgggaaataattttactgggcttgaggttgccataattggaatggcaggtcagtttcctggtgctgacaatattcgtgactattgggaaatgctccgagatggaaaagagggtgttagcagattcacaaatgaaatactaaaaagcaatggcgtatcagaagaatattatttaaacaaaaattacattccagctaaaggcgtcattaataagccatttcatttcgccgcagattatttcggtataaatcattcggacgccaagaaaacggatccacaaatccgtttaatgatagagagctgctggcaagcgctaaaacacgcaaatattgatactgagacttaccccggacaaattggcgtgtatgccggagcaagtagtcagtggtcatggtttaaagcattaaacacggaatttaattcttccgcagagcagtttcacgttgcaacgctaaatgatctttctttttgtactcggatttcctatctgcttaatttacgcgggccgtctataacgatccaaacggcgtgttctacctctttagttgcggtacatacagcatgccaggcacttcaagcgggtgaatgcgatgttgcattagccggtggtgtcagcataacccatccccatcaaagtggttatttgtaccaagaggggatgattaatagcccggatggtaaaacaagagtattcgatgcaaatgcatgtggcaccgtcttcagcaatggtgtgggtgttgtcgtgcttaaaaggctgagtgatgccattgaagataacgacaaaatttacgccgttattaaaggcagtgctgtcaacaacgatggtagtgataaaataagctttactgcaccaagcgtcttaggacaacaaaatgttattcgatccgcactcgattttgctgaggttacgcctgatcaaataagctatatagaagcacatggcacgggaactttactgggcgatcccattgaaatttccgcgcttaacgcggttttcaaaaatagccaatcttgtgctatcggctctgtaaaatcgaatgtgggtcactgtgatgcagcggcagggattttatcactgataaaatcagcgctttgcgtttactttaaaaccttggtgccttcgattcattttgaaaaggcgaatgcaaaattagaactggaaaacacgccattttatgtcaacacagagactaaaccttggcacagcagtgataacgagctgatatgcgccggtgtcagtgcatttggcgtcggaggaaccaatgcgcacgttgttttgcaagagtttccaatgcgcactgaaatggtttcggtcgaagacttagaatacgaagaactccccaatagaattgaatttaaacctacaatagccgctgaaaccacggacgttttacatgcagaagtagaaagtgacagtgtgtttgttgacgatgaaattgatattgaaggtttaccacagaatttattaaagatttttcaggaatatttctccaatcaaaagatctcacaaaatgataactttttcgatattggcgccagttctttagatattgtccaactacacgaaaaaattaataacacttattcggtaaatttatctatcagcgatttttatcgttacaccaattgccagaagatgactgaaaagttactcggcatgatcggtaataaatctcaagggcagccaaaaaaatcgaaaataactaaaaagcgcaaggtactgaataacaaaaacagaacttatcaagattatccagagcatgccatcgcggtagtcggtatgagtggacgctttccgggaagtaaaaatatacaagaatattggaataacctgctacagggtaaagaaggtatttccttttttactgacgatgaattgattgatgccggaatctctgctcacacgttaaaggcgaaaaactatattaaggcaaagggaattgttgcagattcactgagttttgatccgaccgcgttcggctatactgcacgtgagtcacaatatatggatcctcagtttcgcttgctccatgaagtgacatggcaagtgctggatgatgctggatacggaaactcaaaatatcgcccggttactggcttgtttgcttcttcaggttcaaatcatgcatggttagatttactaaaagaagaaatacaagacaccacagagcaatttggcgttgcactcttaaatgatcgcgaattcctcaccacgagaatcgcctataagttaaatctcacggggccggctgtcacggtacaaagtgcctgttcgagttcggcacttgccatcactcttgcctgtcaaagtttacagatcaatcaatgtgatttagccttggctggcggtgtttctgtcgtgacaccgataaaaagtggttatacctatgctaagggcatggtgaatagtgcagacggccattgccgacctttcacccaagatgccagtggaaccgttttcagcgatggtatcggcatggtcgcattaaaaaggctggatgatgcaattagagataatgatcatatctatggcgtcattgcgggttatggtgttaataatgatggccatgaaaaagctggattcacagcacctaacgcagacggtcaggcggcctgtgttaagcaatcattaaaaatggcagcaattcaggcgagtgatgttgaatacctggaggcacacggtacagcaacacaggttggcgatgaagtcgagctggaaggcatcaaagacgccttaggtgtcacggaaataaatgccagagattgttttattggcagcgtgaaatccaatattggtcacacgaatacggcatcgggtgttgcgagttttattaaaacactgctcgcgttgaaacatcaaaagataccgccatcgtgtcatggcacagaaaacaaacatacgtctctcgaaaacacgcgattccgtttaaccgatgttgctgccgattgggtaagtcatggccgtgtcagaacggcgggcgttagttcgtttggtataggtggaacaaatgttcacatcactgtgcagtcaattgaagagcaacccgccagcagtcagtgtcaagctgaactgattacgttgtcgagtaagagccgcgaaggtttggttaagaccatggcgagactaggcgacttcttagacgaagagcagcactcgtattctctgagtgatattgcctacacacttcaggttggcagaggtgactatgactaccggacttcacttgtcgtcgagaatgtcgaagcactcaaagatgcgctgcatagcctcaaagattcgaacacgttgccggaagctctgccagatcaaacgtcgggtatcgtattcatgttccccggccaaggttctcaatatgtcaatatggcaaaagatttataccaagagctagagatctttaagatcctccttgatgaatgtcacgaacgactaagcagtcaatttagtatcgatctcattgggttactttattccggggacagtgaagaggattctgaaaaactccagaatacgcagattacccaacccgtcattttcgctatttcctattcattagccaagactctcgaattattggggatcgaagctaaggcaatgattggccacagcatcggtgaatatgtggcggcgacaatggccggcgtcatgacgttagatgaggggcttaagcttgtcgctacccgcggcattatcatgcaggaatgtgagcctggcgtgatgctaagtgttgctgcgggtagagatgatctcgaaccgtttttgacggataaagtggcgttagcgacggtgaattcaccgaactcctgtgtcatagcgggttcacaagctgatattgagaaggtacaacagcgtttagttgacaaaaacttccgtactcgccttttgaagacgtcccacgcattccatactccgatgatgaagccaggggcggaaaaattcaaagccgcgttggctgaggtcaattggcagaaaccgactaaagcctatatctctaacgtaacgggccagtggattacgctaagtcaggctaactcagtggattactgggttgaacacttgtgtcaggccgtcgagtttcacgcaggcatcatgacttgtctggaaaagccggggctcaatgtatttttagaagtcggtccgggaagaacgctgtcaacgtttgtcaaacagattgcggcaagcgatgccaatatcttgacattcaatatgatgcgacatcctttggaagcagaaaatgatagaaattatttgctgaaattggttggtcaactttggatgagaggcatttccgttaattggccattactctatcaaaacacccacccgaaacggatcagcttacccggatatcaatttgctggtgagaacatggtaatgggcgcctctgttttagctgcaaagggtgttgaaaaagcgtcagaaacgaaaatccaaaagaatgaaatctcggagtggctatatacggaagcatgggaagatatctccttgccggatgaagcgactcagtcggatatcagagtcgcgttgtgttttgtgcccgatataacgtggtgtcaaccgctttgtaacagtctgaaactagacgaaaaatcaataaaatttgtgttacccgctgatgcttatacctctgctgagaatgtcatcacgcttgttccgggagataaaagacatttcggcaaactgattgatgaattgaagcaagacgcactgctgcctgattcagttatatttgcctggcctctgtctggacagagtgatctagaaacatcgtggttttctgttatcacgctcatacaatcctggacaacttcaggaagtatgacggatttccgcttattgctggcaaacacgaaacaacctgaacatactatgctcaatgggcttgttaaggtcatcacgcaagaagtcagcaaatgccatcctcggttagtccaaatctctcctttagaatccattgaaagacaatgtgaaatactcactgaagagctgttagcgactgatgaacgttttattgtcaatcgaacgcaaacgggtcgctcaacgctggcatatcacaaactgagagctggtttattaaaagagaacacgctgctcaaaaatgagggtgtatatctgatcaccggtggactgggtgatttaggtttactgtttgcggaatatctgattaaggaatacggcgcgaaggttatattatctggtcgacgggtacttccgggtaaacatgaatggaagcaattagcctctatcgataattctgaagcggaaattctgcaacgccttgatgaactctcagagctaggtaaaggggaggtggcctactattcttcaaatgtgagcgataagcatgaaatgcaggttttattagatgcgattgaagaacagtatggttgtttgcacggcattatctgtgcagctggggtgacccgtggcaactctttccaagggatcaacaaactaacgctagaagattgcactcctcagattgagactaaagttgaggcttataagattttagctgaactgacagaaaacaaacccttagatttttgtctactctgctcctcaattgcctcagtactcggaggattgagcttctcagcctatagctcggtcagttcgtttgccgacgcttttgcaaagcaacaaaatagtcagggcaagccttggatcagcgtcaactgggacgggtgggtgttcgaacgcaatgacgcaggagatccaatcggttcatctcttgaccagcttttaatcgagcctgatgaaggtctgaaaatcctggagtgtgctttacagtctcctctgagaggccagcttattatttctacaggggatttagataaacgatttgagcaatgggttggcgggcatttaaaaccgttcaaactcaatgaatttaatcattctcaaagagccgtcgtctcaaaagagcaaatagtcggtaccatcgtctctgtttggcaggactttttaaaggtcacaaatattagccgtgacgataacttctttgagctaggtgcaaactctctggatatggttcaggtcaacaagcgactgacagatgctctggatatggatttttcagttgtcgatatgtttagctatccgacctctgaattgcttgctgactttatcgtgaaccagtatgggatcacccatgatactggcgagcaggcagaacattcagacaccttaaatcagcaccgcgacccgtcagcacaacttaatcagtccagtaccccgattgacagacaaattgctatcgtaggtttagccggcacttttccgggtgcagagaacattcatgagttttgggagaatttgacgtttggcaaggagtcagtcaccactttcagtaaggaagaattaagtgaggaagggattgattcaggcttgctggaaaatcctaactatatccgtgctaaaggcgtcttcccaaatgcaggcgaatttgatgctgaattctttggctataccccttatgaagcccgccagatggacccacaagtcagagccttacatacttgttgctggcaagcattgcaggatgccaggatagcaacgaaagacaaccgcgcaaaaattggactgtatgcctcagcatcggggaatttgcaatggttggcacaagcgatggctacagcggaagggagtgcgggtcaatacagcgcgatgaccgtcgcggacaaagattatatgtcaaccatcgtgtcatataaactgaatctcactgggccaagcatggtgctttcaacggcatgctcatcctcgctggtggcggtcaatgaagcggttaagtcattgcgtgcaggtgaatgcgatattgcgttagctggcggtgtttctatcactttgccaataaaggcgggatatgtctttgaagagggcatgattcactcaaaagatggaaaatgtcgcgcctttgatattcaggccagtggcacggtatttggtgatggcatcggtatcgtagtcctgaaacctttaaaacaggcgttagccgacaacgacaacatttacgccacgataatcggaacggcgattaataacgatggcggaatgaaagtgggttataccgcaccgagcaccaaggggcaggtcgaagtcattcaatccgcactacgtgacgcgaatgttatggcagaaagcattcattttgtcgaagcacatgggacgggaacaacgttaggtgatcccatcgagtttaacgccctgaaacaggctttttcgacagacaaaaagaactattgcagaatcggcagtgtgaagtcgaacattgggcaccttaattccgcggcggggatcgcaggcctgattaaagccacattggccgtcaaaaacagaatcttaccccccacgctacattatgcccggcctaataaagaaattgatgtcacaaacagcccgtttatcgtcaacaatcaatatactgaacttaacgacacgagaaacccgatccgggcaggtgttagctcctttgggattggcggcacgaatgtccacgttgtgcttgaagaagcccaagtcaacaaagataagtcattcaataaaaaggtcgataaccgactgcccatcgtgctatcggctccagatgacaaatccttgcaatgttacaagcaacaactaaaaacctttgtcgagaacaaccaacagcaaatgagtgtgagtgacatcgcttacagtctgatgcaaagagagcctatggcatctcagtttgtggcttctgcatgtgactatgacgcattgatcaaggcgctatcttctggcgagaaagataacgttaaggtgaaacccggtacgacgaaaagaaaagtcgtatttttgttcccgggacaaggggcacaatacgtcacgatggggcatgagctataccacagcaatgggttgtttaaggaatggtgtgataaaggatttacccttgctgataaatactgctcaatcgatttgaaatctctgtttcatagccgggatgaagatcgaaacctgtacaataccgagtttgctcaaccattactctttattatcgagtatgcgctggcacaggtactcaaatcctacggtgttacaccggacgcaatgataggccatagcttgggtgaatacgttgcagccgctcttgcagaagtgttctctttcgaagacgccatcaaaatgatctgtgtgcgtggcaaactcatgcaatctaccgaagatgcagtcatgctttctgtcatgtcttcttcagagagtgttaaagaaatactgacaggcagccttgaaattgctctggataacagcagtgatctctgtgtcgtcgcgggatctgatagtgatatatcgagttttgaaagcgattgtgaagcgaagtcgatcaagacaaaacgcctgagagtcaataaagccttccatactcgctatatggaacctgtcttaggcgattatgccggcattatcagagaaatagcctttaacaaaccgcaaattgctttcatttcaaacgtgacgggcaaatgggcagagacagacaaagtggtcgaatatgactattgggtgaaccatattcgccaacctgttcgtttcaaagaatcgattactgaagtgctaaaagaaggcaattgtttgtttatcgaggttggccctgggcatggactttctaccttggctgaaaaccactcagactatcatgctaatcatatctgcatttcctgtttcgatcgcaaaaatgaagaaatcaacaaacacagtgaactggtacaaaaattagggaaaatggctctgctcaaaattgatgtaaactggcatgccgaaatggcagatttgcaaccccgcttagttcatctcccgccaacccccctacggggcacaaaatatccgacggatattaaaaggttacaggcgctattctcaggtaataaaaatcttggatatcaagccgataagcccgaagagccggttagccagtctaaagcaggcagcaatccacatccaaaggcaaagcgtagcgtgattgatgagttaagcgcgatttggaaacttatccttggggtagacaccattaaagaggatgatgattttatttctatcggcggctcctcactttcagcggtacaagtgattgctaaggcaaaatctgtcaacctgccggtcaacatgagcatgttgctatcagggcaaacgctggttcagatcagcgcatcgttacaaagtgacgatgaaactacgcataagggctggcagttcaatgaacatttttcacctgaaatgtaccctggctctgccagttgcctctattcggctgtccgggaaaagctgaaacatgaacatggcctgacctctgatgatgccatcatgcaggttgtagacggaagcccgctgctcggtatcggggtacaacagttcgaaaatgccactaaaatagtcagcaagcctgtcaactacggcactctgtcaggttggccttcgctacaagaatgctattccttctcttacgataaacagtttttcgaagattatgaggcatatcgccactattgcgaaagtgagctggcactgggtcatttagtgattgtgactggaagcgattattacttacccttttcaccatcatatggcttgccggaatcagaatacatcaagagacctttgttcgagaatattgaattgggtgacgatgatattatcccgcacgctttcgtgcttgttggaaagacaccgtctggatatcagatatacgatggcagctttcaatattttggtgaaatcacggagcaggaatttgagaaaaccgtcataggatttaaaggactcgacttcatgcagtcacatgaagtttataacaagtctcgatccttcatggtgattacagtgacctgtgatggaaaattccataaagataatgatctaaaagagcagactttaaatcggctggtgactgatttccaaacaaagcaggcaatagaaagtaatgaaagtcacttatcttactacgtaggattaacggcgttagataaactcattgaaaaccccgggctgatagcaagtagctcgaattttgacttagcagagatcttctctcgttggtatcagcagatgctcttattgagaaaatttttaaaaatttctaagccagaagtttcaactgaatgtgatcatgcattttctataatcagcgaagagttggacaaagtggttgcctgttgcaaaaacagcagtgacgataaaacgataatagacagtctattattagttaaatctaatctcagcgacatcattaaaaacctatcttaattaaatcaccccatgctaataacggtcaggtatatgaccgttattagcatatttcaattcgagttaaaactccataaatattatttatgaatagcttgtataccaataccaaaatttaaactgggtttgattgataaccaagagtgtaaaaaggaattgtcattgaaaaataacaacgaaatggtaaacaaatccatctttaccgtttacatgaaattatccttcccgatcatattcggtatgtcaattcaagggctttatggtctttttgatgcgatttttattactcgttatattggcacatatgcaatggcaggattctcgatattctttcccgtcttactcattatcagcgcaataggtgtgatgttcggtacaggtacagctgtcctggtttcacgccatttaggtgccagtaataatggtgatgccaatcaagtcgcaataatcagcctgatatcaggattaataatatctctatttttcactttagtcgggttgataaatctagacagtattctttatgcattaggcgcaaccgaagatatcattagctatgcatatgattatgcttatcctctgatactttgtatgccaattttaattattaccattatagcgggtgatctcctcagagctgaagggaaaaccaaacaaatgtttgcaataatgctgactgcatcagtggcaaacattgtatttgacgcattatttatcgttgtacttaaaatgggaataggaggcgctgcaatagcgactatcgttgcaaacctcatcgctttgatatgggcattcctgctatttagatctcatcacacggctatcaatctttcattgataaactttaattttaaaataagtatagtcatttcagtattgatcttgggtatacctacattaatcagcaatctctcttatggcacaatcatattcttagtaaattctcttattaaagaaagtggcttagataatgcgggaagcttactcagtgcatatggtattatatttagaatactcagctttttaatacttccattaattgcaatgatggcagcattacagactttatcaagttataattttggtgccggaaagtacttgagatctttaagtgctttgaaagttgcttgcctaatatcctgtatatattcgattattttaactctctcaatgtttttatctttcgacctggtgtttaaaatttttaccgatgatccttccttgatcaaagaaacaacagacattgcatcatctattttcattggactggcatttttggggcttaccctaatctttatcggcttctttcaaagcatcggtgaagtgaaatatgctacatttatcgttctctctaagctttttgttcagctggccctgctttggtttatatataaaatgtttggtgttgaaaatatggcgttatctttcgttataacagatatttcagtatttgttttatcccttatctatctaagaaataaaataaataaatggcggagaaatactgatatttttctcgaaaatgaaaacagaaacgtcgcattataatcgtattgtcaatctcgtttataagagtatatataaaatgaaatttaagtatctatttatatttttcagttttatattcataaatatttcctatgcagcaactgaatcgaccgggaatgatgccttagaaaagcagctcgttgagtatatgaacgttggcaagatcccagggttgtcaatagttattttagatagcaaaaaagacgcaaaatttattttcctgggcaaagaaaggatgaacgctgataaaaacattgatggaacaaccctgtttgaattagcgtcaaccagtaaggcgtttactgggtttatagcagcaaggttaattgaggagggaaaaataaagggtgatactaaggtttcatcaattttacctgctctgtcattctactatgatagtaaaccggtcgaagttacatttttgcagttattacatcatacatccggtattccattttcaagtatcgattttgtctacggcggtcaagataatacgtctctggcagatatgctcaataagatcgacaagattgaactccagagtgtgcctggaaatagtcactcctactcaaccattaattatggcatcgcagccagaatgatggaaatcgtgacgcaaatgtcttaccaacaactattacagacctatgttttagcgccgttcaacatgaaccagacctctgtagaggcttttgttgaaaacaaatctacaggccatcaaataagttaccttgcacccagaccgtataatgcgccttttgttgtagccaatgttcctgccggatatattcaaactaatgctatagatatggaaaagtggctgcgttttctgagtggtgatgattatccagcattagagcgcgctaaaaaacggatgtttacgccagataaagcggtggtgacaaatgaagggaataacagtcactatgcaatgggatggtatgttgatggagagaagatactccatactggcatgaacccaagcttttctagttttgttggtgttcatgtgggttccggtgccgcagttgctgtcatggccaatgtaaatagcaatgtgacttttgctattggcgagcagatattagatcaactttcttcaaatcaacaaatattaaaattaacttctcccgatgacgttaagttatttgattcatttgatcgtgtttttttaatcataagcctgattattttagcctttattctatttattggttttagaatttatcgaaatattttcgtgaaagaaagagcgagttttcccaagaaaaatcgttttattctaattttattaattattttttgtatgttttgtaccgtactgagtctcattttgccgatggcaatattaaatatttcctggaaaacatttgttatctggatgcctggtagctttttattgatgagtgcacttttaatttccagcttactggtaagtatacttaattgttcaattgtactcgttcgccgcattcagtttgctaaggaataatccagaaataatcatttaacacgttcagacacaatctaaaaaatcaatatgatcatattataaaatccaggtgatatctaaaatttaaaaatcggtcattttaaaaataacgcttcataaatcacatatgaaattttaaatttaaacaaacaaataggttataaaaatgtcttgcggtaataaattatatagtatgacaaggatccagagaggtatatgggctacagaagaaaaataccaagggacgggtatgttcaatattggtggcacctgtagcgtcgaaaagaatctggatttagttaagttacgcgatgcaatcatacaggttattagagaaaaccagtgcttaaattttgttctgaataatgaagttcccccaaagcttgtaacttcagaacgaaccgaatttatgataggaaaattcgattttagcgcgaatgacaagcccgatgacgcatttgatcagtggcgtcatcaagtattgtctgctcaaatgcaaacggattcatcactatatgacttctccgtctacaaggtcactgaaagaaaatatgggtttttgattaagttgcatcatattattgctgatgcgacaaccatgcaaaatatgatcaccagaatttgtgaatgctatgaaaatagcgttaataacaaagaagatgcaaaaattgttgaagacgaccaacagtactttctggacagagaagaaaagtatctttcaagccactctcactctaaagatagcgaatactggcaatcagcgctttctaatctggatgggggtactcactttattctgggaaataaaagcttagccaccgctgcaaagaggaaagtctatgatattcccaatcgagtatccgatcatgtgaaggcgcttgcctccctatgcggttgttcggaaagttcgatatatcttgctgcattgtacctgttactgggaaggttttcggggcaggaaacgttgaccgttggcatgcctttacatggtagaaaaaagactgactctcatcgaaactcaatgacggtatctacaattgccctgcaatgtgaggtcgatgaggagcaatcatttgaggatttgttacaccaagtaagtaaaaacacccgagaagcttaccggcatcagcgattcgattattcagatctgcttaaaactgtcagtaataataatgaaagaagcgaagagatttttgacgtaagttataactactcaaatacaaaatatgaaataacgctggaaaacttacctttgattgtcgaggatatatttcccggtgaacagcaatattctatacagtttctcgttaaagagctgtttaatgaaaagatcacaaaaatatattgtgacttcaaaacaaacgaatattctgaacagcaagtagattctattatcaaccaattcatagtaacctgcgaacaggtctgccaattcccatcgcgtaaactggtcgaattcgatttagtgagtcagagtcaattaaaagaaattgaatcggctaaatataatgctgcgcgtactcatctgactgtcatcgagctatttaatcaaacggcgtgtactaacccagaacgtgtcgcggtgatagagggtgacactgaagttacttatgcagacttgcagtataaaatgaatgcaatcaggaataagcttaaagaatatggcatttcgacagactctcgtgtcgccgtattattaccaaaaagttcgctgcaaattgcagcactgctggccattatgcatattggcgcgacttatgttccgctggaacgggatttaccggacgaaagaatcgcgtacatactcaatgatagtctgtgtagtttagttttatgtccgacagaatgggcatcatccttacctgagcattttcctcatcatgacctgacctcactacagacgagcgacgggattcacccggaaacggtgccctgtgaatgccagagtgaaacagcggcttatttgatatatacatcaggttcaacgggcttgcctaaaggcaccgttattcgtcaggctgaattagttaattattgtcagtgggcggctaagacttattaccctgaaaaatcagatgtcgccgcttactacacaccgctgacgttcgatctgacggtcacctctatcttcccgccattgctggccggtgcaacaattaaaatctatcgggaaagtactaactttgtactgagcgagattattcatgatagcaaagcgacagtcatcaaatgtacgccttcgcatttgcaggccatcaagcatgaaaatatagagcgacactgttctgtgcgccggtttgttgtcggtggagaaagcttaaaagtggaagtggcgagccacactgatacgcagtttcatggaaaagtcgaaatattaaatgaatatgggcctaccgagacagtggttggttgtatgatccacaaatataacccccaccatgacaaggccatctctgttccaattggtattccgatagacaatactcaaatttatattttagacaaacatggcagacattgtacaccgtatatcaaaggtgagattgttatcgcaggtaatggcatatcggcgggatactggaataaagaagaactgaccagagagaaattcgtaacagataaatttcatcctagtcaacggtcttatttatcaggcgatttagcctaccgagatgcgacaggaaacatcatctatatcggaagaatagataagcagataaagattagaggacatcgtattgagctggatgaaatagagagtcggttgttaaagcacgaactcgtcaaagatgccgtggttctggtcgatgaaatcgaaagtggctctgcgatattgaaggcttttatcgtagcggctgataagaaaacggccagcaagcctctgctttctgactatttgtcatcctaccttcccgcttatatggttcctcaatatttcaaatttatcgatgaaatacctttaacatttaatggtaaagtgaataccgatgttttatctcagattaaatttgaggttgaagaaattgatgatgagatagagaacagtgatattgaaagaaatgtactcgatgaatttaagcatattctgcgttgcgaagagctaaccgtaaacagtaatttctatcaatacggtggtgattcgattaaggccattcaattagtcacgcttttacaaagaaaaggcttggtggtaaaagtgaaagatatttttcagttaccgacaccaagagcattatgccgactcattaatgatagaacccctgtatcttgtgaagaggaagacattgaagttaatgagtttgctttaacacccattatgaaatggtttactggtttaggtttagatagaaaagatatctaccatcaaatgttgactctgaaaatatccagtcaactggataattcagatcttgaaaaaatattcaatagacttatctcttctcatccgatattgaatacgtattttgatgaaagtagtcgtaagttattggttaaagacaacgacagcttagtaaaaattgatgtgctggatgtgatttgtttcgaagagaaagagagtattgtacgaaatagattgaatgaaacagaatggcctcaaacacctttatttcaagcggttctgttacggaaagagggcgaacaggagctgatggtttttgcccatcatttggttgtggatggtgtgtcatggagggttttacttgatgatctcaacctattagccagccaacgggttcagggaaaaacgctctctctgccaaaaccaaacaaccgttttgccaagtgggttagtctggttgaagatcattatcgtgatcttgatgctgatgaacagtcttactggcaagcacagagccgttcgacagcgcttgcagacatcgctaaatactcttcagaaaagccggaaataaagtattttaatgccaacctgacgaccagggatcaggggcaatttttgcagttatgttcctcaatgaaaatcaagccgaatgaattattctttgcaatttttacttatgcgctatttaaacagttcgacaaaaataattttgcggttgaattagaaggtattggtcgaagcttacattccagcgatctcgatctaaatagaacggtaggctggtttacctcaatttatcctctggttattgattgcaacaaagatattatcagccatatcaagcaagctaaggaaagattacgtgcagtgaaggataatggtatgggatatcaatctattcgctacagccctacaggaagtcaatacgaatatgaacataagttacccagatttaattatcttggggactttgatcaaagcgaaacaaccgatctgatccaaataaaatcgattcatcccaatatcatctcacatgaagataatctatatacagacctgctggactgtaatatctactgggaaggttcttgcaaactcagcatgagctacctgaatacgcatgtgaatgaaagtgatatcaccaatatcactaataccctgcgagatacgcttgaatctctacttaatctggaagaccaattatatcagcgtgtatatacattgactgacttcccgactatttccttatcatccacagagcttgaagacttagtctctcaattatctatataaaatttggttattaatttatgacagattcatttgatattgccattgttggcatggcttgtaattttcctgatgcaaaaacccccgaagagttttggcaaaatctgatttcaggcaaggaaagtattaaaaaattcccccatgaagagttaataaaaagcggttacaaagaggaggagataaacgatcccaactttgtcgccgctaaagcggtcctcgatgattataagtctttcgataacaatgtattcggctatcttaaagatgaagtggataagatggatccccaatgccggttactgcacgagtgctgttggcatgcattagaggatgcggcctatgctccgagtcatagccgtgaaaggatagggctgtttgccggtgcggcatctaacatcccctggatttcaaacttgcttaaacaaaagcttacgcctgccgaaacgtttgatatcgtaaactggaacctgcctgaatcaatcattaccaggacggcctaccgattaggcctgaatggtcccgtaatggcgattcatacggcgtgttcaacgtcgctagttgccattcatacggcatgtcagtctattctaagtggtgattgtgatttagcgttggcagggggggtatcaattaccctgcctcaagagtctggctatctgtatcagcagggaatggttcgttctgccgacggtcattgccgtccttttgacatcgattcgaatggtacggtgggggggagtggagccggtattctcctgttaaaaccgttagacagggctttggaagacaatgatcacatacacgcgatcataaagggttcggcaatcaataatgatggtcagcgcaaagtcggcttcaccgcacccagcgtagaagggcaggcagaagttatttcgagtgctcaaatgctggcgggagtagaagccgaagacgttagctacattgaatgccacggaacagcaaccgaaattggcgatcctattgaagtttctgccttgtcacgagtgttccgaaattccggcaatgtctgctggttgggggcagtgaaaagtaatattggccatttagatgaggcagcgggtgttgctggcgtgattaagacggtcatgtcactgaagcataagcagctagcaccgactcttcactatcaccagccaaacgataagcttcacatagaagaaacgccgtttaaagtcgtagataaactcatggactggtctgtgtcggctaacgaaaagcgcattgccggcgtgagttctttcgggattggagggactaacgcccatatcgtgctcgctgaagccgataagcaagaagcgcttcatgaagatgaataccctaacgtcttcttgatatccgctgagacacctgctgcgcttaatcataatcaacaaaatatccttactgcgcttcgatcctcacaaaaacacagattgtgtgatattgcctatgtgctacaagaggggagaacccaccaccgttaccgtaaggcttttgtgggttcaaatattcaagagataggtgaagcactggaaaaggtcaccgcgaacccaacgaaagcaaaagattcggaacgtcatattgtatttatgttgccaggacaaggtgcacaatatacaaatatggcgttgtcattgtatgaaaaacatgcggtattccgctcgcaagttgatcgctgcttgacgatagcttcaaggtatcttggtgagtcattgaaagaaaaatggtttcacaatgataaggtcaattatctcagtgaaacgcaatatgcacagccggcaattttcattgttgaatatgcactggctaattgcttaattgaagcgggtatcaagccctcggccttattaggttatagttttggggagctggttgcagccacaattgcagaagtattcacattagaagatgcactaaaatttgtcgttaaacgggggcagctgatgcagagcctgcctaccggtgccatgctgagtattccgcttccggcgtcagaggtattagcactttgctctggtggtatcgttgtcgctgtagataataaagattcctgcattgtttcatccgatgaaaaatcaattgaggaattttcccaggtattaaagaaaaaacgtatcttaacaaccccgatcaagtctaagcacgcagctcattctccggctatggcggcgataaataaacaactgttgcgggtactttcgggtttcacattaggtgaacctaaaactcctattatttcatcagttaccggtgaggaactgaccgccgccgagtcaacatcaattcaatattgggctgaccaggcggaaaaaacagtctgttttattcgtggtctggaaaatattctcaataataaatcttgtgtgttcattgaagtcggagtgggaagagatctcgttaatctcgtccgccgatatgtcccccaagatgcttcacagtcgatcatacaattgctgcctgaggataataaagcgcaaactcagccgtatttattctggtctgggttaggcaaaatatggcaacagggaattcagatacaatggcgaaaagttagcgctgcacaagattgtaggcgtatatcattaccgggttatgcttttgaaaaaagtgttttctggcccaaaaacgccaatttcttgagcttattttctggcattcaacacgtagagaaagatcaactttgtattaaaaagaatgacaatatgtcagattggctttatcaagccgcttggcagcaacatattttgcgatctacaaagccggtggaatgcacaaaatcggcgctaatcttcaagcttggctcttctaatgatcaaagtacaacctttgaaaaagcattattaaatcattatcaaaaagcggttcgagttaaggttggctccgaatgtgagctagaaattgaagcattgagcacccttcgctgcctaaactatggcgactacaaaaatctctttgatttgctcaataataacgaaatctcgatagaagaaatggtcatcgattgtatcaatgttgacttgtctctcaatgagcaactggccgctgtactctatttattaaaatcgcaccgtgcattttccagtcaccctaatttaatgaatgtcacattgctgattcagaatggcgttgtggtatgcaatgaaccggacattaatccatttgctgctgctatgatgtctatcagcacggttattcggcaagaattccatgagttgtgctgtaaggttattgatgtcggtgcgttgaatgattgctctgatgataagttgatccgcgaaatagccgagcgtgacaataaaaatgtcgtttaccgcaacaaccgaagatgggctgaggtgtttttaccttactcaccgatcatgaatgatgagacttctcgattgaaaaaagagggtgtgtatctcctgattggcggacgaggctttatcggacacactttcgcgcaatatcttgccactgaatataacgcaaacctcattattacctcacgatcccggcaaaatatcgatgacaaatggcaacaagtgtccaatgatgccgctaatttagaattcgctcaagtcgatgcgagtgatcgggtcgcgatggaagcatttattcaggataccactgccaaatatggtcgcattgatggtgtattttacttagcgggtttgaccggtgaggcctctctgagatcaatcaatgaaactgagagtgattatattgatagtcatcttacctctaagcaaaaaggaatagaggttttagagcaggtattggaacccgttaattacgatttttgtttaatcctttcttctctggcacctattttgggtggcttaggcttttttgcctatgcagcagccagctcttatttagacgcttttgtattacggcacaaccggcaaaatgacaaaaaatggacattgattaattgggatggctgggaactggctaaaaaaacagaacttaatgcgaaaatcggtagcagcctgtcacaccttctggtgacgaaagaagaggggatctcattattagaagaggtacttaagtatcaggaaaaggatgcggttgtcatttcaaccgcagatatcaatgccagaattgcacaatggtcaaatccttctttaagtaaaaatgaggaggggtctgatgatagcggttattcagcaagacctgatttggactctgagtatgtcgcaccgaacagtgagattgagaaaaaactcgtttcaatttggcaagaatttttaagaattgaatcgataggcatgaaggacgatttctttgatctgggtggaaattctctgaaggcgataacgctattatcaagaatccataaaagctgtcagatcgacgtgtcgttaacgcatttctttaaaaacccgacgattaaagacattgttgctttaaccgattctcaatttggcaaatcggagtatcaggcgatactgccggcagaagagcaagagaactaccccctatcaccaggccagagaagactctatttgcaacaaatattagataaaaattcggtggcctataatgagacagccgcttttagcatctcaggtaaattagacaaagacaaattcaacaaaacactacagtcactggttaaacggcacgactcattgagaacatcatttgtactcattaacggagagccaaggcagaaatgtcatcaagatcttgagatcaatttagaacatgtaaagttgaactcatcaggtttgagcaatgaggaaataaaaagtcaggttcaaagtctcattaaaccctttaacctaaatgagcttccgttaatgaggccgatcttaattgaggtgaaagaagatcaatacattttcttcttagatttgcaccatattatttctgatggcctttctcaggatatttttgtaagagattttttagagatataccaagataagcgactgaaacctttagatgttcaatataaggactacacggtttggcaacataatatggcgaatagttgtcggatacagaaacagcaagaattctggatttcaaatttaaagcaggtatcagaactgcaattaccgactgattatcccagaactgacagccatagccataaaggtcaacgtatctattttacaattaacaaaaatttgagcgatagactggatgaatttgccaatagagaaaatataacgagatttatgctgtttatctcatcatatgctctattccttaaagatatttctggccaagatgcgtttgcagttggcacgcctatattaggtcgtccgcaaagcgagttacaagatataataggtatgtttgtcaacctattacctatcacatttaaacttgacgacgatttatcttttaaatgttttgttaataatgtggctgaaaataccattgcagcatttgaaaattcagattttcaatttgaagatatggtcaaagcgctcaatattaagccaaggttaaatagaacccccatctttgataccgtgttttcgtatatgaacattggaatggcggactttacattaccggatgttaaattcagccgctatgatataagccaggaaagttcacgatttgacttggcgttctttgtcaaagaaacagaaacagggtatgagtttagcttcgaatacaaaagcgagctatttagagatgaaagtattgaacgcttcaaagataaatatattgcactcttagaaggcattgcctctaaacccgatgacagtatcaggctgttattaggcaaaggtgaatgggataaaaataacacgttgcaaacagaagagttgttggactttaatttttaattctatttagtcatcaataaatatcgaacagtggcaggtataacttgtcactgatttccttctggactgaataatcgctgagcatcaataaacagtcagaattaacatcactgtaatacagagtttttatgccaaatctaattaaattaaatacccctaaaaatgcaaaattgaaattataccttttgcatcatgctggtggctcacacatgttatatagagcatggcaacgagaattaccggactggattgaatttaacgctttagaacttcctggcagaggaatgagtttcggggagcgcagcttggaatcaatcgaagacatgattgaactattcctttccaagattgaaactgataagccatttgcattttttggccatagtatgggcgccttgcttgcttatgaattaacgctcagattacaaatgcagtctttataccctatatggcttggcctttctgcttataaaccgccgcatttgagaaatacggaagctgcccgtcgcggcacaatgacagaccctgagcttttagaatatttaaaaacattaggggatgtcagtgagttaatcgcaaatgagcaagtactgaaaatcatgcttaatattatcaggaatgatttcaaggccattgaaaactggaaaatgagtgagtctattatccaccctgaaatattagttagcctatattccggccaagaggataccgcagtcacacctgaaattatgaaagactggggtagatatatttcaggtcaaagtcagataagcgcgtttccgggaggccatttttacctgcaaaaatacacattggatgtcatcaacagcttatctcgtgatatcgctaacattatataggtgcaacaatgaaatatgtcattatctggactttagtttttaacgaaaaatggaatgcacttaatcgttcagagcgtcaacaactccagaacgaatctctgccggaaatactcagtaaatacaaaaattcgattaatatgcgaaccatagacaccgaaggattcacggctgattttcaagattttgccattatcgaaacggaaaaactggatgactactactgtatgttacaggatatgagaaataccagagtactatcggaggggtatttgaaaatatccaaagtatttatgggcatagaaaatgctcatgaaatttatgaatccaattaactaaatttaacgacatgatcgattaggtatgcctgtgaattacaacattgttgccttaagccctttgcaagaagggatgctatatcactccattaaagaagaaagcaaaagtatttacgtcaccaatttcactctagtccttaatggcgatattaatgataaacgattagagaaagcctggaataaagtggtatctgagcatgattctctacgtacgatattaaggtggcgtggtttaagccaacccgtacaaattatatttaaacataagtataatccattatcagttatacatgtaaacccagatcttgttcatgatatcaatagttacaatgatagaattaagttttgtgagactgaaattgatttagaaaccaacccagtaaagttaacactgcataaactaagtacgtataaatcactactccatctacagtatcatcatatatctttagatggttggagccttgggatcctgatcaatcaactttggagttattatgataacgaacacctaagtgatgaagactgcaaccttaattatgaacattatattcaacatttgaataaggtacgcgattgtaagggcaccagagacttctggattaacaaaatagacgttgacgcagcaataagtctgccttcaatcaatgactctgaaacgtatagcatcaagtgcctgactcactccctggataaaatccttttacaatcggttgacaaattctgcaaaagcaatgaagttacgatagcaaccgtattttatacggcctggagtttgatcttatccaaatataatgactctaactctgtttgttttggaaccaccgtgtcaggaagagataacttgttggccggtattgaagatagtattgggctttatattcaaacgcctccactcgttgtggataatctgaatggctctctcagtttaaaaagtctggtaaaaaaactgcataatcaaattctcgaaagagatggctatactgaatatccgatatcagaaatacaacatgttaaccaagtccggcaaaatctcttcgatagtatcgttgtcattgaaaattatccactcgccaagcgattaagtgcgctatcaactcacgttagtgtcgagtcatatgatatttttgaaacaacaaattttgaccttactttggaaattaatttacttgatgatgccctattaaaatttagctttaacagtgccaaatttgataaagagataatggataaagttttgatccatttcagcaagattattgggtatatcgctacacaacccaatttaaccttaagtgaattgaatttactagatgatgaagagtacaagaatattgtctttgattttaatgataatgatattgtttcagataaacctcttcactcagtagacgcttggaataaatctgtagaaaaccatagtaatgaagttgctattcgctcagctaatgacgtatttacctataatgaacttgatagaatagtcaataaaattgcgcaaggcttaatttcaaaagggattacgtctaaagatttagtcgctgttaaatgtaagccgagtgctcatactatttctttatttattgccattaacaaaataggtgcggtatatgttcctttggacatatcaaccccagaagaacgcgtcagtaatattattactcaaggtgttaaatggttaattgaggatacagaactcagaagttttgttgcattaccgacggtagaagcaaaaattccggagcatgatcatcaagaaaatgatttgatgtacacgatatttacttcgggttcaacgggtgaacccaagggagtcatggtcgagcatcaaacagtgatgaactatgtatactgggctatagagaaatatcattacgacagtaaaaaaacagtctatcctttatttacgagtctggcatttgatttaaccgtgacctctatatggtgtccactgatatccggcggcaccattgaaattgtagggaaaaattcactggaatcaatacaggaggtcagtaagctggcggctacgacgcatattaaactcaccccctctcaactcaatctactgagtcaaacaaccgatttctgccatagcaatttatcaaccttcatagtcggtggtgagcaacttgaaacctcattgtgccgtcaggtagcaaattcgttagttaacccatctgggatttttaacgagtacggcccgacagaggcaacggtcgggtgcatgtattatcaatatgatccgcaggcagacaagaaaaagttgtcagtaccgatcggccgcccgattaataacgcgcgtatctatgtgttagatcggttcttacagccacaacctgagggagtacccggcgaactttatatcggggggaaaatactggcacgtggatatctcaataaggatgagttaacctcagagcgctttatttcaaacccgtttatccctaatgaaagaatgtataaaacgggagatttagcggttatcagagccggagggattatcgaatatattggtcgcaatgataatcaagttaaagtaagaggctatagaatagaactagatgaaatagcctctgttattaggtcgtataaagattgccataatgcggcagtattggtgaaagatattcatggcgagagtcagattgtggcatattatgttgctgacgttcatattcctgaaagcgatttaagggcctatatcaacgccagattacccgattacatgacgccaaacatttttattaaactggatcgtatagtattaactagcaatggtaaaattgaccaacacaccttacccgaagtgaccccagaaagacagagtaaatttgtctttaatgacaaatcagaacacaaacaaaaagttattgaggtttttgagaatgttttagctgtatctgatatagatcaaaaccaaagtttcttcgagctaggggcaaactcaattaaaatccttcgtatagccaatatattaaatgaatttttgccacgaaaaattaaaattgtagatttttttacttacaccaatataaataagttagtatcatatattgagcataatacatcggatgatagtgtaataaatattaagtccgcgagtgagacagtttctagacgcgcaaaattagctaaccgtagaaagactcttatagagaaagcgagtttagagcactgacatgttaatatttaaaagatgatatagattttactacatgaaaaatgtgttaaagtacacgataatttattgtcaaagtcatatttaacaggagaagaaaatgagtaataaatattctggtgatataaaattgagaccgattgagattgacagtgatgtacaagcagtagtcgatgtttggtttaatacttcaattgagtgccatgaatttgtatcaaaagacttttggtattcatgtaaaaaagatatgaaagaaatttatattccaaattccgagacggttgtcgcgacgataaacaaggaaatcgtcggttttattagtcttcttgataatattttggcttcaatttttgtacttcctgagtatcaaaaccgagggatcgggttgcaattattaaatcatgcatttgaagtccgtaattctttaacgcttaatgtctatgaaaagaataccaaagccagacagttttatgaaagtcagggctttgaagaaaaagagcagggtatcgatgaacataccggcgagcctgaaattacgatggtatggagccgctcataggttcccgctgagtttttcagatgataaaataattaacactgaaataacttaaacattataatttaattaatttggtatatgtttcggaaaattatttccacatataccattacaaatttaatcttatttaacagccaatcaagcgcaaaataaatagaaatagtcgttctaatacgatattaaatactatttttctataaacgtgtttgctaaaaattaaatagaaataatatagcagagtgtcattatgattaatgaagtagaagagctaaacaaaattcaaaaaaaggaacatttctggagggggtttatcaataactgtaaacacccggagttttctaactactttactaaaagtaacgataattcaggtgtagataagatttacctttcaagtgaaatatctaaaaacttgttatcgatagccaacggatctgataaaagattaagtgcattacttatatctttaatcggatttatccagtcgacaatgcttcgtactaatgaatcggtcattttaaccacgagctatcattgcgaggacgaaagcgctggcatgttgtgtgttccagtaaagcttatctacgagaaaacattgatagatttaataaaatcgacatcaaaaagcatacaggatgttttaccgtacggggttaactcttttacctctatttttgaaggagctgttcagttcacgtcagcagtaatactcaaaaactgccagagcgttaataaagaaatagaggacttttcctgttcacagcttatttttgagcatgacggcgaaaatattttttgtgagattcattcaccctatgatgccaactattataacgaaattataaagatggttgagttgttggttcggcagatacgatctgaaaacccgctttcttcactcaaactatcagaatcctctcacatagacgttaataaaacagtacctgaaatagaaagcggctctacgatccctgctttgtttatgaaaagagtcaagatgcatcccacacggattgctgtaacggatgcgcacgcttctttcagctatgcagagttagatgaactgagtaatctttttgcatttgaaatgttaaaacaaggcgttgcaaaaaatgataccgtcggtatacatatgaaacgctcatgttcggccattatcgtcatgctggctgttttgaaaattggcgccaagtattgcccatttgatgtaaattggccgatcaaacggaagatctatgttaaagatacggccgccattaaatatctgattgtctctcatgacacggcctgtgagctcagtgattgtaatagcattatttacggatcgactgacagcaccaccaatacaaacctagacgctgaatttaacgacgcagaggccggtgattctgcttacgttatcttcacttctggctcaacaggcaatcctaagggagtggaagtttcccacggagccgtcatcaacctggtgcaagggctatacgaacgcgtctataaaaattattcaggctctctgaacgtatcgatgatctcggcattgagctttgacgcatcagtacaacagctttatccatcgctgttactgggacataccctgcatatcgtgcctgatgacatgaggagagatgggcgtaaagtcgttgaattctggaatgaaaataatattcacattgctgattgtacgccaactcatctcagaatgattcatacacaatttaacgagcaggccatttgctgttctgtgaatcaccttatgataggtggtgaattactggaaaaacataactggtataactttgcaaaatgctggcaatctgttcctaacgcatctaatgcgtatggccctaccgagtgttgtgtacaatctacttcgtttgaatttaatgacagccgtcaaattcatacaaccaccattcccattggctttccgatgccaggtgaaaaagtcgttttgattgatgatttcttgagaatattacctgagggcgccattggggaaattgctattgcaggacagggtctcgctaaaggttatatcaataacccagaattaaccgctcaaaagtttgtcatgattgacggagaaaggtattacagaacaggtgacctggctcaatatgttggagacgtgggtttagtctatctcggtcgtttagacaaccaggtaaaaattaacggttatcgcattgaattaggtgaaatagaaatagctattcaacaagtgatgactgaactcagtagcacaaatcaatttgatgcaaagccaatctgcgatgtctttgtaaccgttaactctcaagactcagataataaattcctcgtggcttacctatatagcaatattgaatttattagtgatgatattaaatcagcccttgctgaacggctgccagattatatggttccggcctattttattcagcttgaagcgttcccgcaaaatagcagcggtaaaattgatatcgccagattaccagaccccagtaactttatcgttaacaagagagtaattccttgcagtaatgaaacagaagagaaaatactggggctgtggtccgaaatattaaatacaaaaaaagaaaatataagctcatgtgacaatttctttgacttgggcggttcttcgtttaagttagttcaacttagtctaagtttaggtgaactctttaataaagaaattgaagttgttgatttgttccaatacacaaccataaaacagcaggcagaattaatcgataacaacggagaaaatgacaatattgtcatctcggaagatcactcagttgaacaatttgatgaagctttgaaaatgtttggtaattaacttctttaaacatttattaaaaatagaaatttaacaacttcgccaaccgtttatcagcttagtgttattcaggcatataaacggttgttatcgcattaacagagattaacaaatcatgagtcaacgagaaaatctgaataataagtcacatcaggatctgacaggccttgaaatagctattgttggtgtttcatgccggtttccaaatagcccaacgattgaaagcttttggaaaaactgtctcgagggcaatgattgtatcacccggttttccgacgagattcttgcaaaaaatggggttcccaagcaggattattccagcaataactatgtcaatgccaagggggttatcgataagcccatggcattcgacgcggatttttttaattacaacaaacgagaagccgagtttcttgagcctcagatacgtaaattgcacgaatgtggctttgaagcattaggttctgccggcttggttcctgcggtttacgccggtaaagtgggttgttatttaaccgcgagtgcccagttgcaatggcagatggccgcttatgaggaatgcgaacaagatggtgccagtctgttttcggcatttaatttagttgagaaagattttgcagcaacgcgtttagcctacaagttaggcttaaccgggccagcggtttcattacaaactgcgtgttcttcttcattaaccgccatacatatggcggctcgcgctttgttactcggtgaatgtcaaatggctttggttgcggctgcggcactggtaacaccgaatcaacaggggtatttatatcaggatggcatgatcacgtcgccagaaggcgtttgccggccatttgatgaaaaggccaacggcaccgtgggcggggaggggattggtgcggttgttctgcaaccgttgaaacaggctcttgcagataagcgccccatactggctttgattaaaggtactgcgataaacaatgatggcgcgagaaaagtcggttataccgccccgagtattgaaggacaggccgatgtcattagcagtgcaattaaaatgtctaagattgaccctgagtcgatttcatatattgaggcgcatggtacggcaactaagttaggtgatccgattgaaatttcagcgttaaagaaggcctttcctggctgtccagcgcaaagcattgccataggttcagtaaaatctattgtcgggcatttagatagcgcagcgggtatggcaggtttaataaaaacggctttaatgttgaaaaataaaatgctgtgtgcaaatcagtattttaccaaccctaatcctcagataaagcttgagtcatcccccttttatatcaatcaaaatagccaggaatgggtgagtcaatcaattagaagagcgggagtgagttcttttggtattggggggactaatgcccatatcgtgctggaagaatcattatttcagccttcaggatcggaacccgcggaacgtctgacgctcttacctctatcggcaaaaaatgaatcaagcttggcgatgatggaaaaagcgctgcttgataggctggcagataaaaaagatacattgtctgatatcgcttataccctgcaaaatggcagggaatactttagccataggtcagtattaatttgttcagaaagtcagggatcctactgtgaatctgactttatccgcggaaaagtggaatacaccggcaagaaaatcattttcttatatccggggcagggtacacaatatcagggtatggcttatggtctgtatcagcatgaaaaaacatttaaagatagcgtccatcagtgcctgcatttgttaccagaagaccaacaaaaagagttaactgacttttttatcggcgcttcggaacaaaatgacgcctcttccgaaatcactcagcttgcgatattcgttgttgagtatgcaacaacaagactgcttgagagtaaaggttttaaaccttatgccttactcggacatagtttgggtgagtatgtcgcagcaactgtatctggcgtattttcattagatgatgctctgcatttggtcagccagcgagcaaggttaatgcaaagaatgtcaccgggaacgatgctcagcgtgccattgggaatggagaaactgcaagattacttagatgacacacttgaagtcgcggcaatcaatggaagagaatccatcgtggtatcaggcgctcccgcagatattgaaagactggagtcgctgctgcaaaacgcggggattatttgccgaagattaaagacatcgcatgctttccattccaggacgattgatgagatccaaacggaatacgctgagacattaagtacaatcaacttcagtaaaccctacatccccgtcctttcgaacttaacagggacttggcatagtgaagaagagattatgcagcccgattactggctgtcgcatcaacggcagaaggtggatttcttagggtgcttagaaacactgtctgagtctaatgatctcatttttattgaggtcggccctggaaacaccttatccagtttcactcaaaaatactttcaaagtaaaaacgaaaataaacctctcgtcgttaacgcacttaggcaccctaagttgccagaagatgaccaagaatatttttacggtcaactggcaaaaataggctgcgccagcaatgaaatatattggcaaaatatcaatcagcaaaaaggcaaccttattcatttgcctgtatatcaattctcacagacagaatacagtaagataagagacaggcttatttcaggcccgaataaaaaacgtcattctgtcgatcctgaccaaagctctacctatctgccgggctggcaacgtgaagttaattttcaaacggaagaagttaagcaaagccaaagcgttttcttactttgtcctcgaacggccgaacctaatcgtcgtacattagctaaagtattatggcctgatagcgacgtgttttttattgatgaattagataaattagcctcactcaaggtgacggctgaatgcactttcgtgcttattccagatcaaagagaattcagcaccgatcctattgaacattatttgcaatgggtggatagccttagaactctattatcttcgatacctttgcaatccatgcggtttattctctttacacccgaaattgaaaatgtattgggatatgaacaagctttacccgccatttcattattaaaaggcttggtatggtctattccgcttgaataccaaaaacatcaagcgatgcagatagatttcgctatgcaggatttggctgacaataacaaattgaaggcactaatacggacaattgcaagttcagataaataccgtcaggctgcaatacggcacggtcagttgtggataccggaatttaaaccattaccagcccatcaattagttcatgttaataaatgccatgaattaaatgtgggtggcttggtattcattagcggcgggttaggtggaataggtttaaagatggcagaatctttggccgaccaatataaagcacgcctgattttagcctctcgctctgagttccctgacagatccaaatgggaagccattaaaaatgacccgacaaaagtggaaacggctagcaagatcgcgagcattgagaggatagaacaacttgggggtgaggttcacatccatcaagttgatgtttcctgtaaaacagcccttcatgtgttgctcaccgctattgagagcgaattagggaagtttagcatggtgattcattccgcaggttctgatgccggagcattaatcatgcaacccgatctcgctcttcaccgtgagatcatggcagcgaaagtcacaggggcagacaatctcatctcttattttagcgataaggatctccgttctatgctgttttgctcttctttactgtcatatcacggagcgtcaggacaatcggcttatgtggcggcgaatgcctatctggatgcgcttacagataatcaggaatctccttttagaattcattcaatcgcttgggatcgatggttagaagttgggatggccgctaagaatattcaagatagcaacgaaactataggtttgaccaatcaagagggtcaggcgctatttcttcaggcaatagcttattaccctgaaagaatggcggtgtccgtgttgcctataaacaagcgattgcaggaaagcgaacgttcaaaagtacgggttaaaagcggccccgcagagaaggcaattttagaggctaagacatcagtaaaacaaacaatcttagaggtattgaaacatcaattgggtttatccgaaattgatgagcgtgccagattcttcgatttaggggcaacatcactcgatatagttcaaatcaatgaaagactaaagcaaaaattaaatgccgatattccaattgctatgatgtttacctacagctcggtgattaaacttgaaggggcattgcggcctgtactcaacaaagaggatcatttatcggaagataaaatagacgacctgcaatccgggggaagaaatttggctaaaaatcggatgaataaacgacttaaaagacaggctccattaaagaacgaataaattcagttgctgttcctaattgttcgttgccttgaagtaggcatccccgcgctttaactgtagtgataagcccgtcagaatggcgggcgtgcttccacgttgtaagcgtcatacccgcacacaggccatacttgtaattaaaagccggcagtaacactgcactggcattgcgttgcaactatggctccatatcatgacccgcccctcttctctgctgtttggtcagttgaatcaaatgggggagatactctctcgcatcaccccaatcaccaagaacaactttcctacagaaaaggtgacataagactactatttgttaatggtaagttaaaatatatgtgtaaaaatggataacagattgtggcatgttattaagcatcatcggcagtgctgatgaaatgtattcaaggcagtcaatgtcgcggttttgatcataatccatattcctttttaccgttttagcctgctcctgcttccaggaaacgatccccgcgatggcgttaaccagtcaacgttaacacaggttacgacttgcacttagccagaaaatattagataaaactccgcggtattgtccgtggtcaaccgtttttcctgtgaaaaaaccggtcgctggtggctgtcttacacattgctcataaatgatatttttgcaaattaacaatggatggtaactgagatgaataagcgatacagaatattccagcagactccggttgctgggcgtttgccggtcaaaacccagccacgtgtcctttgccgcgccgtggcctgctgtctggctgccgtcagcgccagtgcatttgcggggagttataatgatcctggtcagttaaataatcctgccagctggcgcaccagtgagttccgtgctgactgggggcttggcgcgattcacgctgaggaggcttatgcccgcggctacaccggtaaggggatcaaactaggaatattcgatcagccggtttataccaaacaccctgaatttatgagcccggataaggtgatcacccttgtcacctcggggatccgtgaatataccgatccctatattaaagtgaaaaaaggggataaatttaattacgatggcacaccaaccaaaggttcatccggtaagctgggggcgcacggcactcacgttggcggtaccgcggccggtatccgggatggcgagaagatgcatggtgtggcctataatgcacaaatcatcagtgccgacaatggcgatcctggccctgaagacggtatcgtattaggtaacgatggcggcgtgtatcaggccggctggaacgcgctgatagagagtggcgcccgtattattaacaatagctgggcgattggaattaccaaaaaatttacagtgggagggtataacccagcctatccgcactttactgtagcagacgcccagaagcagtttgatgaaattaaattgattctagggacaaaaccgggtggtgcgtatcagggcgcaattgatgccgcccgtagggggattgtgacgatttttgctgccggtaacgatggtaatctgaataatccggatgccatgtctggtttggcttggtttgtcccggagatcgcgccgaactggctgacggttgctagcttgcagcaggatcttaagagcactaacagcgtgccttattccatcagcgatttttcttctcgatgcggctataccgccagtttatgtgttagcgcgcccggcagtcagatctacagcgcaatcatcagtggaactggcatagataatctgacgacaggctacgctaactacaacgggacttctatggccgctcctcatgctgccggtagtattgccgtgttgatggaacgtttcccgtacatgacgggtgagcagatcgcgtccgtgcttcgcactactgccaccgacatgggtgaaccgggtattgatgcgctttacggctgggggatgattaatctaggcaaagcgatacacggccccggtatgttctataccgaagaagacattccgcaggctttccgtatccctgatcccaacggcgtggcctatggcaacagccagtttattgcggatatttccggtatcggatctgtacttgataagggcaaaccgaccgagcgtatctgcgatagccagctgtgtgcgcaggatacctggagcaatgatatcagcggtcacggtggactcaccaagcaggggagcggagcgcttattcttaccggtcagaatacctattcagggccaacgttggtcagacaggggctattaggtatcagcggtgaactgacttcctcagtctcagtactggagagcggcgttctcggtggtaatggcacccttggcgcactcagtgtgcaacgcggtggtacggttgcaccgggtaactctgtcggcactctcagcgtttcccgcgacgttgcttttgaagcaggttctcattacgccgttgaaatcgctgctgacggacgcagtgatcatattcaggcggctggcagtgcacagcttcgcggcggtgacgtttccgtttccctcgaaaacagcgctaatcttctttcccgcaatgaggtacgcagtttaattggtcaacagtaccgtatcctcagcgcaaaacagggcatcaacggccgttttgatcaggtcgcaccgaactacttcttccttggtaccagcctgtcgtatcaacctgctgaggtcacgctccatgtcgggcgtaataataccgcctttgcggatgtggctaaaacgccaaacgagcgcgctgtggccgcagcagcggatacactcagtgttggtaatccggtttacgagagtatcctgagctttacttctgcggatcaagctcgtcaggcctttagtcggcttgatgggcagatccatgctgatattgcctcctcgctggtcaatgacagccgttatctgcgtgatactctgaatactcgtctaagccaggccgaaggccgtgcttcatcgtccgatatccgcgaagatgataacggcgcatgggcacgtctgctcggtgcatggaatcacgcctcgggtacggataacagtacgggttatcaggcttccacttacggcgtactgctcggatttgatgcgcctacggatgcttacagtcgcctgggtatcgcgaccggctacacccgtacctctctcgatggtggctacgactccaatgctgacagcaataactaccaccttgccctctacggtgaccgtcagttcggtgatctggcattgcgtgccggcggtggatacacttggcatcgcattgacacccatcgttccgttagctacggcagccagttcgatagtcagagtgctaaatacagtggccgcacggcacagttgttcgcagaagctgcgtacaatctgcccgccggatcagtgaactttgaaccattcgtgaatctcgcctatgtcggcttccgtaatgatggcattaacgagaatggtgcggcagcggcgctccacagtgataaacagcacaccgaggccaagctctccacgctggggctgcgtgcgaaccacagttggcaggcaataggaggaacttcggttgctctacagggtgaattaggctggcagcatcagtatggtgatcgtgaacgggctactagcctggcgtttcgcggcagcgacacaagctttgtgacccgcagtgttccggtttctcgcgatggcatggtgctgaaggctaacgcggagatgacagccagtgataacgtgtcattgaccctgggttacagcgggttgctatccagcagccatcaggataacagcgttcacgcaggctttaactggcggttctgatgatgaaagcggtctaattatgggtatcctgtgtcgatattgtggccgcatcgatcgcctgtctgcaactgtccctactgggaatggaacagtcaattaggttcagtaattttatctaaagcgtttcatatgaaacgcttttttatttgttattcccgccgtgcttattgtgagtgattcaacggttatgggatacctgtcagttagggtgatgttggctcctgttacattctgtaaataatgtattattctggatgttgagagaaaattttctgagtcatctgttttttgattagactctaataaaatgttagaataatacaggtattggatttttatgaataaagtagcttaaaggtactatttttttagattctgatcggttttttaactgtgttttatcaccactgatattttatgttgtatatattatcgatatgttgataattttcattattcaggcggaagatactaaagaaataacatttataaaaatattcatttaatgtattaaaaataatttttttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtttgtaacacactgacattaggtaaagtctcttcgctatacaaatcagaaaatataagtttcgatacagttctaaacattagatacttgcaagatgaaccgcattttcgtgtgcatgaggtaacatccgaaaaccctgaacaattactcgatggtctgtacatatttcacaacccatttgccaaaaacaaattagagatcgatacgtttgataagttggcacaattctctatggatgaatatgggctacatcaaattgacaattatcctctaattgtttctaggtttcacaccaatatgttgtctagctcaataattccaagtataaagactgatgcttttttaagctacaaccctgaatattgtaggcgagaactcaaaaaagagcgcagtcttttaaagcccgctaaaagcgaaagtatcaggcaaaagaaaaaaaggacaaataaaattgcgaaggcttctcgcagaaagaacagataaaaacacttcaatgttagtaatggtttaccaacgctcgctcttcgctcaaatcagacttttggatcttgcgtaccggtagttttgtgccaagagcaggccttgcaaacgcggttgtgtttcaatcaataggtacaggcagcctcggattacgtactaattataataaattaattcaatgaattactattgctctattgatattttttacaatagcgctaggttagacaaccgtaagattgtgagtgggctaaggcgtttacttattgacagatcttcgttcagaagatgctttattagtgaaaaattatgccccggtaattttacttacccaatcttataacacgtttacctatcagaataaaaaggttaaaaaataatggaagaatataaaaaatcttgtgaggacgagcttgattgggtaatcgtgaatcaactccatgaagctacactgcaaatgagcaagagctgttttgagttcaaaaaaatatgtataggacttatcggtgcaactttagcaatattagcaaagcttaccgatggtaaacttgatcattcttatttttatataacacttattctatgttctggtttctggatcgcagatttttctgcatattatttccagaggaaaaccaggatggctatgaatagaaaacttgcggcattggccaataggaattccattaaagactatccatctgataatcttgaggtaacttggcttaaagcagcatttaaccattcaatggttctatactatgtttttgctttcattgaagttagtggatggcttgtttatgtaactataggtaagtagtatgaatatttttgttagctatacgactagagacgataatgttgataaaaccttactagagtccatatctgaaatcgtctcgctttatggtcattgctacatcgacctactacataacaccgaaaaagataaacagcgacatgtcgaatttatgttatcacaagctaatttgttaatcttgattgcatccaattcaatttttacttcaaaatgggtccaatgggaactttctgaagcaaaaagatgctgcattccaattattatcgttgatgctaagtccgatatgagcaatattttgaaaaacttgaagtcaatattgacttccaattcttatttatcatcctaaaaaagttagagtccattaaaaatataatgaatttatttggcattaatatttgtcttctattcatttttgtaagtaaaaaatgaattgttattatttttttgagttaattgtactaaaagtatcaattagtgaattgatttaagtcgatgatgcattggaaatatctgaatcgattgaagtctgagcttgtcagggctgcaacaacaaccctgtgccataacttacgtccgaacaattgaactgcttaaccgtacttaatattttcaactttaatatataaaatatagcgtggctcacaccataggtataccaaatcatcatgctgtctaataatccctcacaaaacatcaacacgccctaaccattaatttatatattgtaaaaataggttgccgatataattcagtcatcggcatcaacacacaatggggcataaatgagttatagaccaagcggccagaacgggtcaccgcgtgaaatgagcattgacagcctgctcccgattaacccaaaaggccatcgtgttcctgacattattttttgtcccgggaaatgaattacccattgacctgatgatttccgtttattagcgtagtcagacttatcgatgatccggtcgcttgtgaggatcaccttcgggcagcgacaataacactcctgtagcctgcaagggagtacacaaccgtgtggtacatctgcgcacctttggaagcagataccgtcagtctgatgacgatgaaggtttcttaatctcatccattatggccaacaggccagtcacccaacggggaacacgtttcccattgggtcaggtgttccccgttgttttatcaggagaataccatgcaacaaaatacaaccccggtcacggtgcacactgtgcccgcgtctgaattatccccttttgctgaaatttttcctcacaccggttcactggaattaatgctgctggaacacacgttcattaaagctgccgccgtgctttgtgacgatgaccgatgtgatcagtggcagtaccggaaagtgtcagacaacatcgcctatgtcgtgccgacacggtcggattcatctgtagtcaacgtcaataccacggactttaaaggcgaggtctccgccgatgccttcggattgatggtgaccctgagcgtgttgggttatctggcggccctgatgaagctggacgggtacgctgaacggttttgcgacctgtgtgaatatgcgctgcaacatcctcaggcttcgtgtatccgggcggctttgggcttaaagggtgcataacaggagaacgtgatgccaaataatgaactgattatgctggacagtcttgcgctgtcggtcgtgtttcccgacaaaaccccgctggaacggttgtttctggggttcctgctggcgaataccgcatcaacgttatgcggcgattatcagcctgaacagtggacaagccgacaggtgtctgaatcgctgacttatatggtgccgacacgggcggaaacgtattccgtttacctgccggttacgcagctgacggtcacgctttccgccgatgccttcgggctggcggtcacggccatcgtatcagcccgtatcgcggtgctggatacacagaataaggatgcgtaccggttctgcacactgcgggaatatgcgcagcagcacccggaaagcggcctgatagcctcggtcatgacactgaaacccagagagggcgttatcagtccgtcacttatccctaacaaaaataatcattattaacgttatcagcccatgaggctgttaacgcttttcttaagcgcctgaccggggaagccaaaacaccttcccggtatcgggcgggtgttttctttcattgacataaaatcaaggaacaacaccatgaaccccatttttttaccggcaccggatgaaaccgataccgcattacgtgaagagctgtttaccgctcaggtcaccggcctgaggcaacacccgaaagcaccacagtcattgcagccggaaaccctgatggtgtgcgaagcctccaccgtcacggaaatggtgctgcggctgaaggtgatccatcttctgggggactggccggtgccggagaggttatctgctcaggttgcgggggctttttttccgctgaccgtcatgatttttgatgcacaggacagaaaagtgctcggtggccggtttgatgaagagattatctgggcgcagccggtcacactgacgtcagaacgcctgtcattggaacagcaacagcagcggttatgtcaggcagcgatgcttgagcagagctggcagaatactccggcggcgtgtgcgttgtggcacaaggtgcatttattgtcactgcatggggtttcctcctgttatcagcagtgccatgaagtgcgggatattctccggtatggcgtctccgtcagtgctttttctgagggggcatgatggccacattacatttaacggtctggcaggtgattgccgcagccctgttgaaacggcattttggcctgagcctgactgacacggcactgtgtgaaaccgacacggtggcggaattgatagcagggggtgtccggccttctgaagccattaacgaattggtggataaatacgacttaacccggctgaatacgcaggttatcccgcgcagtacgccttatctggatatccacgatgaactgacgggtcatttttgacagcggtctggctgaaatgctgttcaggcaaaccaggccgtaacactttttttcaatctacccatcgggggaactgtgctccgaatgggccggttccgcctgtttatttttatcattcaagtgaggaacttaaccatggcagaatggtgcaccaatcaactggaaatcaccggcaaatccgtctgtctcgatgtgatgcaacagtgggtctgcggggaagaagtccctcgttaccgtcaggcggtgttacaaagcctgcggttatttctggcgggttgtgcgggaatactgaaaccgaccaaaccacaaacctacaccccgtacccagcgctggtgcgcggcacggcggtgccaacggcgcagtatctggcctttgagcagtggttgttgttgttacagaataatgtgccgttgaatacggacaatatcaaacgcattgataacctgtatcgtcagtccggtctcagcctgatgtcctgggacaaggtgccggaagcggcgcgtgatattatggcccgtcttctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgatgaacaatacgggatggaatggccgtttggtcaccatgtccgctgggaacgccgcaatgtcagcagcttaaccgtgcggtttgattcctcctgggcaccgccttcggcggagctgatgggggagctgtcattgatgtttgactgtgaaatccgccactggtacagcgaagcatcaggccagctcaaaggctacgattgctatgaccaaggcgagcacgtggacagcggtcacgggcagtcaggacgggaaaaccggccggcactctatctggtcaccggtgagcaggcggaaacggcactggctctgccggctatcgcggttgggcaatagcccttcgtttaacgcagtatccatttatttttacatcaaccgaaaggggaaccggttcccttttcggggcgtgttttccttttttcgctttttgttcagcaaggaaaacacgcaatggcatcccgaaccgatcatcagaaagaattcatttcgctgtttaagcaaacggcccgttatcatacccgttatcaggtcttccgggatttttgcaattgtgctatggcagcgattcacaataaacactgtttcagtgaggagctggagcagtattatctgaaaaccattaacaagtacgaacgggtcgatgttgaccggatcgtacaattgttttcgcatgtggtgctcggactggcgcaggaacccggtgattttctgggtagtgtgtttatgcggctggaactgggtgataaggatcttcagcagttctttaccccctggagtgtggccagaatgatggcacagatgcagttgcaggatgccgccgggctgctgcagacacaaccgtttgtcaccttgtgcgagccgtgctgtggtgcgggctgtataactttggccgccgctgaagtgctgagggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcttgaacgcatttttttaacgatgactattgcgcctttcggggcgctttttttttgtttttaaatggtgttaatacaattggttatggtgaaaattaaggattttgtcagtcagtcaggggatgaaccgggtcagattaattttcatttttgtaaaaagagttgttccttgtttccggccgggattcaccgacactgagccaaatctgaaccgaaagaggaaaaccatgtttcagcgttttaaatcccgttttacccgtgacctttccccgtcacaagaagcgcccggactagcgcctgaaagagtacgcggtgccggaggttatttccgtccacagtcagcagaggtgctgctggtaacttcagagcgtggccagtatctccgccaactgtgggaaaacagtgcgctgcccgccgggttgtatcagcaattctatctggatccgctccggcaattatgcgcccgtgtgcagcatgttcccgcgacacaagagggcatctggtcttatcgcggcggatttatcgatctgaccctgcaatttactgcctgtgccgtgcggctggcaaaagggcacatgttgcctccgggggtggcgccggaacccgacaccaccgcgccctccacctctggcagttcaatgccgttagcggtcaggttgtctttgccgataagaattttgaatggatacgggtcagtgactgtgccattaacaggaacgcgacctaataacgcggtcatggcctgactgcctaccagcgtggtattttcaggcagggtatagaccggggtttcgttcttttccttccgcgcgggttcgttctgccctttttgcccggtggccgattgttcgcttaaaaaagaagtgggatattgcggtgtagattgaccattacccatcgcttgcaacactgtcggtttttcatcagccggattgacccaaataaattcaccctgcccactgactgggctgacggcatacggactgctcaatgcgctttggctttccggtacagacaaaggtgttgaatttaaccgctccgtcagcaaatcaatttgtgccagcaaaccctgttgatcatcctgtaatacgcgctggcgctgttcgtcttcctggcggatggccgcaacggccgcatcgatttggccggcaacatcctgattctgattttttaactggtcattttctttcaggatatcggtattctgctggcttaagcgtttctgctctgcccgcactttattgagggtacctatcagggtacgcagggtatcttccggcgtatcaccaccgacacccaacgcctgtaactcctccggtgacagggtagccagtgcattattttgggttgtattggacgcggtattgtcagttgagctgcaacttttgataccgataaatccaccaataaccagcacggtcggcaccagtattttcaccaatgcattggacttaacctccatgacggcctcccggtttcaccgatgtcggctcagggataaaggtattatccggcagcccttttgtgacgaggtacaacaccgtcgtatcctccggtgaccccgtttcacccaaccaacgatgctggaacgtggcggccacaaactgcccctgtaagatgcgcgggtccagggtgatagtgcgtttggccgtattgcgcagtttcagggccatcactgtgtgattattccatctccagcctgccagcggagagatggctatcggctctgacggatagagtgtcgtgatggatgaggccagatgcagattcaccggctgaattccggtgaccggctcgacggtacgtaacggcgcatacagctgctgcgcggcatagcgggttaaggccaccggcacgggcgcggataattggggtttgctctggtgttgtgatgtttcggttgaagcaggttgtttttcattcggataaataatgcgtaccggctcggtagcatcggtttttccggctgtcacatccagtaagataatttcaccgttttcactgtcctacagttgcaggcgggttggcgggaaggcacggctggctttcagataaaccgccccgcctgtactctgtacccgcaatttatcatggagtgagggcggaaaaccgacacgcacattccggtctgcaaaaacaatccgctcctgtccgaccttgagggtaatgggtaacggaatacgttcccatttcagcagttcatcagctttgacgcccgtactgaacagcaagatactggccagccccagccagacacaacgcgggaaagatggatatcctctcattgaaacacaccctttttctcttccaatggtggcggcatggcttccagccgctgtggtaccccgtcgtaacaatccagtgccagaccgaaaggattacgctctgcatcgccttcccagcgcaccactttcaggggatagcgcaccagtgcccgtttgaccggttcggcgtgataatattcatcggccaccaaatccaaccttaccacccagttatcacggtcacgcaccgtcacgctgcgcgtctcatagccccggccgggaatttcatacaccacccgcacccggccgggcagttcaccactgtcggcccgggttttggcatcttcgcgcagaaaatcctgacacgccggcgtcagataaggcgacagggcataaattttcgctggatagtcctgtgccccgtttttcggccaggcgttcagttgctgaaaaatataaaaggcaaaactgtagacactcggcgcaggtacttcccaccacgggcgagtgctgccactgcgtaaatccggcggattatggatagtgagattacgcggtgaagccatccagccggtcagggtcagcagcagtaccagcaccagaatgccgcatgccactctcagggtcaggacatgctgatccttacttttaatcgcatgacgaaaccggctcatcgcactctcctgctacggtgcgcttgcctgctacgacgtaatgaccagccctgcgcggcaataatcaacgccggatcaccgatgcacagccggcgttttttctcggccagtttcagccagagataattttccggcttacccctcttaagttggacgagccagcgcccgccaaaactaaccagcaataagggcatcattagcatccctgtcggcagcatcacccaaccgactaacaggatcagaggaaggctaacaatcagcccaagtgctacccccgcgattgccgccagtcccatttccggtgtggtgaatccccgaaagacgacaggttcggcgtttaagcgatcgggtaaaaaagggatcgtttgcatattcgctaccttaaaagataatgctggctgatttcgccaacagccagatcaccgcaaccaacagcacaatgccgacaacaatgatggagccaaactgggtccacgtggctttgccatcgcgcacttcggagaaagtttccactgctgccgaagccactttaaagaacgccaccgccgagaggatcaatccgccaatcacaatgccatcctgcgcatagcctttcacctgtcccagtaatcccccgccgccgccacttttgggtggttcgatagcgggcaagtccgcccgggcgggctgacaggaaagaccggacagcaacagaaagacacttattctggttatcaggtttgtactgatacgacggcagtctgtaaaaatttgcttcatgttcaatctattccttttttattgtgttcgttgcattaactggcaaacatccagacagccacaaccagtaataccgccatgcgaatggcaaactgacttatcgtctgattgcgtattttttcattcgcccagccgttccagacatccaccgccgcccaggcggcccacagaaatagcgtggacagaaaaaagccgacacacaccagatacaaaaaagtgatatcaaaatgccctgatgccacttcaaaggcattacgttgtgccggggtcattgcgggtgctcctgacggtaatcgccggagatgggtacgggatcacggggttgatcgcgggaaggcatcaggtagtgatcgatacccactttgatggtgttgagatcagccctgatacgggagtaatcaaagtcataacgagacagtgttgaggtgtcagattgcttttcggcgatgtttgcgcgttccagtgccatctgtacctgatcaattaaacgcctggcactggccagctcatctttctcagccgcatgagccagtggcatacacaatacaatcagccccagcagacaggcagaaccagatatagaaaagcaatcgcgcataaatactcacctcgtcatagcattcaggatgccgaggatgcggtgttttttactgtcggtcagcaataaactctttatgctttggtgaaaattagctaaatagtctgactaatttattcagccaaaacttagcaattaagggagcaagcaatatgctgcggattgatttacacgtccccgatgatgaatatgagaaggtaggcaagctgggggcacactgggatgcggccgaccaaacctggtatatcgacagcagttttgacccggagccatttatgcaatggctgccgttctacaatgtgcatgcggaatactggtatctcgcgcaaacccggacaatctgtccgcactgtcatgaacccaccaccgtcaccgcgtttatgcttcctgccggacaccagctactggaagccgatagcgacgatgaaccctgcacggaaatagactataccgagcaggacagccccgcgtttttgttttatatcgccgatattccgacggttgtgcgcagcgtactgcccggttttcatcacacgctgcgcaaagccgtcagccagcggctgcaccgacaacactggataaatcactgcgaacactgtggcgcacagcaggatgataccgaactgtttgcggaaatcggtggtgcgttttttccggcgaccaaagagcaagcggaagctattcagcttcatcgtattgaacagccattcgtggggtattgtgaagatatttcgcaccatcacgaccgttttgatccgaagcaggattaccatctctgtaacgcgtgtgattggtttgcatccatgacactgattatcaacaatcaatcaacatctcgtcattaattccgggaatgacgagcaagagaatttctgagcacaaggaattttctgaggataaatatgataaaagatacctgttgtcagctaacgagccgctcaggcggcctgtctgcgagcacaggcatcatacttttattgatttctttaatatatgacagaaagttgactttgattctgctttaattggacatcatgcctctgaaacttcagccatactgaaaatgtggcgaccaatatcgtatgcagcctcctgataggcatttgtatcttttaactcaggatgaagcagtaattctgaagtgatgacaggggctccacaataatcaaaaatgccatggtcaatctgggttttcatagcatcccaaaaaccatgttttaaataagtttctctgccagccgcaccaatagcaaccagatgtactggaaggtgctgaagttttttttccagtctgccatcaggatgctcgttataagcccaaccatgacaaaacaccctatcgatccatcctttgagtaaggccggcattgtccaccaatagaccggataaaccaagacaagcgcatcagccaaggcaattcgtgactgctcagcaatcacatcaaccggtggtaaactttctttgtaaaaagccgcaatatccgattcagtaaaccttggatcaaatccttctttagcaagatcagcaagttcgacactattttcggggtttgattgcgtgatgccatcggcaatatattgagccacatgaccactgagagagtcagaaatagggtgtgagataacgataagtgcgtgcaccaaatgtttccttcttgattatgataaaagacaagcgtaatctatataccaaaagtaggttaccattggtaagttatctttggtatataaacatgtcaagcaacaaagcccattcaaaactggctaattcacaaacacgtattcgccttacaagagaagaacgctatcagcaactaactgccattgcctggcagatcattcgaaacgagggaacagaggctctgactctgggcagattggctgagaaagccagcgtgacaaaaccggtcgtgtatgaccattttggtacacgttctggtctattggcagcactgtatattgaatttgataaccgccaaacgataatcatggacactgccattcaacaaagtgaacccattttggaaaaaaaagccgctgtaattgcatcctcttacatcaattgcgtgctttttcagggacgtgaaatacccagtattattgccgccttagccggctcacctgaactcgaaaaaatcaaacgcgaatatgccaaaatttttgtagagaaatgcagggtaatactggtgccctacacccaaagcggaaaaatgaccgctgcaagcctttgggcaatgctgggagccgcagaaacgttatcctatgcagcagctaacggcgatatcactgcaactcaggcagaaatcgagctttctgcaatcatcattgcgatggttgaaagaagtctttgattgccaggctgacgcgccgccgtgcagcgtcatgcgctataaatattttttaaacattgacgttgttatcaccactgtcatacccagaaaaagtaccgctggtagcaatatcaccgtgggatacaccacatccggccagaataaatacagtacacaaggaatggtgcaggccggtttaatcccccgtttggcatgatgataaacaaaactcgattcatatcccgccccgtaacgccgtaagtcccgccgccctaatccatcaaccagcgcgaccaaaaccaccatcacaaacaacggaacagataacagcaaaatcgccagccgaatcagcgtcaccatcgtgataaacacggtagccagacaatattcccgcaaataacccgatacatcctgtaatatggcattgaattcatgcagaaaatcattgcggctattgagctgatattgctgttgtccctgtatccggtgtataaaaccgctgtccacaaataaccattgatacgcctgtcccagcccgtcagaaaccgtttgtgaaggtttggagaacaacagactctgggtaaattccgtggataaaaattgcagctccgttttcatcattgcctggctgtgggaggtgccctgttccggccagaaaaaagtcatcccgacatattccagtaacagactgaatagccatgacatgacaataaagccaatgagttgccacggccattcccataacagtcgatacaacaagccatgcttacgagggggttgggaagattgtcgggattgattttctgactgtgccatgacgtgaaattatcctttctcttcccaccagttttcactggtgcggtagtgccgtcgcatctgctcggcgattttctgcaaattggccggcatcagggcatcatcgtcatcgccggttggcaaaggcatgcgaattttccacaactgcccaccttccagtagtgcaaatgcctgtcctttcggcaggttaatcatctcagcaggcgtcaccaacggcgttttaaccgtgccaaccctgtcctgcgtggacgaagtgaaatcctgcccctgttcaacatccgcaatatccgaatgccctgataccaacgtcttgctgtaaatttccacttcgggcaactggctggtgagtaactcggctgtccggttatcccgtacccgcagcataatcagagtattaaagttaccaatcacctgcgccgttttggccgggctactgatacgggcttcaatatccgatgaggtctgggtataggccgtcacctgcataccggcgccaccgcctttattgatcaacgggataaactcatcccccatcagttcgttgaattcgtcacaatgcaggttaatcgccagccgggttttccccacccgggtcgtacccataactaaggtatgtccgacccgctcccgcagatccataaatacttcggtttcctgtggttcaataccgtggatcatgggattgcccccaaccggtggtaacgggcgtaccggatttaacggggaatctttgcgtaacagagccgacaaccccggccagcggtattcggttcggcgctccagagcacgggcaagctgatatatctggggcggttgcacaaatcgttcgacttccggtcgccgggtatcctgcaaacgctgggtgtgcttctgctgccagcggaatcccttacccagaaacaagcgttgatggctgacagggatttgttttgtgctcatctggtaacgtggcaaacggcgcaggtttctgcgatagtggataacctgaataccctgccatgtgcgtatcatcgctaacacagcaaaaccacctgccatcacataactgactgacggagtaagtgcaatcgcccaaggtgcgcaaatacagataaacgcggcaacggacgacaccaccgcagtattcagctcgacggcaggacgtaacagggcttcaacaacataacggccgctcatggtgatggttgctgagtcagtgcggtttcggtgattagcaccggataatgttgcagttgcaaacggcgcgccaattccgaaccggaagccggtgatagcagcacatccggcgctaatgttcgcagtgactgcaaacccgacatttcactgacattgacaaccagccccacagcgtgccgggccttcagtcgctcggcattctgacttaaccactggcgtgaatcaggatcatcaccaatcagaaacaacgcacccatgcccggcagttgcagtgatcggcgtgtgacctttcccggtgtcagttccggtgttttgactggcaacatttctcacccgccacctcgggtgagaaatgttgtactgatggcggaggttcatcgcttggttgagcattaatgcccgcataaaagggcgaagcatctttgcctcctaaatcggcaatcacgttcagttcagcctgacagatattgatccataacaggccgagcatgggtaagatgctcagacgtttcattgtaatgacgtgatatgccatccctgctctccctgccgtaataataccggcatcagtcccttgccaaaccggagccaataacccgcatcatgattcagtgtgatttgtcggttgcgtacccgttcaacgggaatacggtgtgtcttagcccactgacgtaatatgtcgtcattgctttgactgtctaccaaataaatatcgacaggctggttagccgccagtactccgctcaaacgggtttcacacggcagacaatctttggctttgataaacagtgccagccgaccatttgtctcacgtgatttctccatattgaccggcaacacatcaggaaataaccgctgccaggctgtatccacttcccgctggaaacgcagttctttttcagtacgggcaaattccgccctgacccactgctcggcataacgacggcgttcggcatcgctttcggcttcaatgcctaacgtggtcagcggatcaagccccgttgactgaatgcctcttggccccttcatcaaatgctgataatgctgatattcatcggcacttaacttccactgtttggcctgacttttcagggattgctgttggctttctgtcgcgtgaatctgttgcgaagctaatggtgtcggtgttgctgcccagacagaattactcaacagcaaccacatcaatagaccggatcggtgtgatttcatcaacgccctcctccctgatgagagtgtttagccggagccggtagctgatagccctgtcgcaaatagtggcaaaccacacgctgcacctcatccacttccagttgccaggccggatcggccatcacttgcaacgcagtgcgtaacctgacagggcctaactgagcgtgcactgatggcagcggttggcgatataaaatgtcattcttcttgtcaggcacacagagtgcatagccggactgacgtaatgcataacgcatggcatcggcaacagtgggattctgggacgtggggagatgaatacccatcagctgggaaagtggatcacgttgggccgctgtcgggtcggtacttaccagtaaatagcgcccgtagcggacaacttcgggtatttgataataaatatccgctgaaacagattggatgtttcgtgtcagcgtgacggaagaaaaactattttgggaaggctgaggtagcggttgtttcacgggagccgtgcatcccgtcagtatgaccgcgattaagccgattaacacatttattttcatgccaaataggttcctgctcagtcgtaacataatcctgactatgcaaggaaccctgtgatgtattcaatgaacaactcaattgtgtttgctgaaaataaaaatacggaaacaagcaataatggataaatcctgaacaaatattatcgccctaaactttatggcttatatcagagcattattcatcagctggctgatattcatcgaccgactgacagtctgcaactggttggcgtacttttcgctcaataaaattgccgtagtcatcgaaataacggctgggccagatttcagcagggtccatttccaaacgggtggcgatgatccattcccctttgggccatgggcgggatagagtatttgccagtgtggaagaactgagtcccgattcacgggataaagcggcgagtgtggtaccacgcttgcgtaatgcacaaataatttcggctgggtgccagtcttggtgagagttaatcatacctgcttccccttctgttgattattggtggcgattcaaaacagggattctcaggtaccggagatcaaccaatccggcgaggtcgaaacctcccctgcctgaaccgccattgaaagggcgataacagacacactggcagaaacatcctaccagtgggttgatcttacgaggcctgagattcctcactaccggattttgccgatagcttttttactttaactgattgagttatctaattcaataatcgaatgtgtaagtataatcagtaaaattaagtgattagttacccttataattcagcatcatctctaacaataagtataaccaccaaaagatacgcttcagagaatagtgcgtccgctatcagcgggttatgttaacattgaagacaactgtgttgatgcatagttgaattgatagttacccccttgtctgatactgaaataaagcatttcaaaggaggagatatgacgacatctttggacaagctcacgattaaaggatttaaatcaatccatgagcttaatgaatttgaacttaaaaacttaaacgtgattgttggcgctaacggcgcaggtaaaagtaatttgatctccttttttaaaatgctgcgtgcattaatagacggcacattaaatcgctatgtacgcgatagtggtggtgcaagcgatttactttttaatggcaataaggtcacgcagaaaatggcgtttgatacacgcttcggggaaagaggatttcgttttaaattagtgcctacaccggcagatagctgtgcgattgaagatgaagctcgctattacataaagggtattggcgacggatggtgggaattaggggatagtgacgatggcagatccagaatggttgctgaagtcgagaacaagtactctgatgcaccgtattcaaggcccatctatgatgccatcgcttcctggcagatttatcattttcacgacaccagtgctacggctggaatgcgaaagtatgaaattattcaagataataaaacattacgcacagatgcctctaacattggtgcattcttattaaaactcaaaaacgatgcgtcaaacgaatataaatcgattgtgaatgcaatcaggttagtcacgcctttctttgataacttcattctagaaccgcgtcagagcggtcagaaagaagaagttaacattagttggacgcagaaaggctcagactaccctatgcaaccttatcatttatcagatggttcaatacgctttatttgtctggcaaccgcattattacaaccaaaccctccatcgaccattattattgatgaaccagaactagggctacaccctgcggccattgtgatccttgcagagttaatccaacaggcggctcagcgtacccaagtcattattgccactcaatctcctattttaatcgatcaattctctgctgaagatattgtcatcgtgaatcgtaaaaagggagcttcaagctttgaacgcttaaatgaggaagatttttctcaatggctcgaaaactattcattgggtgagctatgggctaaaaacgtcattgccggagggccgacttatgagtaattacatcgaagtcatggccatcgttgaaggtaaaacagaacaaatatttattgaaaaaatacttcagccttatctggctgagaaaatgattttcatctctgccactcaagtttctaaacccggacaaaaaggtggagatgtgcgtttttcaagagtcaagaaagacattgagatgcatctgaaacaacgtccagatacctatgtcacaacctttattgattattacggcaccaatgaatggccgggattagaaacgttaaatagacagtgggaaccaaagaaaatcgctgaacatctgcatctgtcaacacagaatgaaattcaccaattcctattcgcacagagagccgatgaacgttttattccctacatcgttatgcatgaatttgaagctttactctttagtgacaaagagatactcgccaatgagttaaatatccatgtacaagaggtagagcaggtacttcgagagtgtggagaaccggagtcgattaacaatagcccacaaacggcaccttcaaagcgattggaaaaatggtcagcaaatggaacatttggcaaaacgacaacagggatagctattgccgagaaaacaggcattcctaagatgagagaaaaatgtccgttattcaatgagtggctatgtaggcttgaaatattaatgaccgtttaaatgtgggtgtagaatttagaatcgatttactttcaagttagcgggttcaaatcattctatgaaaaaatgatttatttacccaatattagaaataagccctgtgataacagggcgataggttgaaccacatcaaaatgggatctcatcagaccaatctggttcttctttctcctcttccggtaaagacgaaagttgtgccatttgtgttggtttcctctcctttttagtcggttgagaaggttgtggtttttgtgctgccttagcctgttgaacaggaacccgttttgcatcgccacgactgcccaacacctgcattgtgccattgatattcaccaccacttcggttgaatagcgatcctgtccctgattatcctgccacttgcgggtttgtaactggccttcaatgtaaacctgagtccctttttgcagatactccgccgcgatttctgctaacttgccgaagatcactacccggtgccattcggttttctcccgagtttcgtcggtttgtttatcccgccaactgtctgaagtcgccagtgacaacgttgtcaccgttccacccgttggcaggtaacggatttccggatcttgccccagatgacccactaaaataactttgttgatgccgcgcgaagacatatccatttccccctggttacactgactgacgctgcgtccaatgcccttgtttcagggcaaattccgcctgttcatggcaggcaaaatattccactgactcacgggagcagggttcaccttcatcctgtgtgccgatataaaatccggcacggcttcgcaacacggttaacggtaactgtttatggcaatattgcagtgccagaacaccaatcggggcaatattcatctctgtatcctgttgtctttgataatcacgggactgccctgaaagttcagggcaagtcgatggagtaaaaggaatatcagaatgaattttctgcatattctgcctgtgcaacaccgttctgggggggtgccgaatcagactgttcggcctgatagactttgtcctgaccaattttgatccagtccactttaatcagacgggctttcaggctgacacgctgttcaccggcatgatcgccgcgtttcagggtaaaaatatcggtggacgggttgcttaaggtaaatcccagcaacacttttttatcctcgtccaccgctttctggcaacgacccaccagactggtcgcttctttaccgactaaagtaatatcaaaacgcacatagaccggattatcactcgggccatttaatgcattgatcacacagctcaggaacgtgccactcgcagtgctgacgtggcggatattattcaggtaacccagtcccttaatattcaggttgaaatagtcgtttttggttaacgatgtggtgttctcagacatacgatgttctccatggaggtaaaaatacaatgtgactgagaaaaccctactccctgacgggaatagtttttcccgccgggtgtcaggcatatacgttgctgacgttctgataaagaataatgaaccttcattgccgttagactggcaatatctgcttccaaaggggggcaaatgtaccgccttgaggcactccctttcaggctacgggagttttacagccacccaaaggcgatcgttacaggttcaccgatcatttaagaaacaggttgattcttaaagcatcccgtcaacacgtcaatcaacaaccagatcttcatgtccgttgatttgcccgccgagctttgcgcgattgggtaaccgctttgtcattcagcacccctttacagcccggatagttcacacagccccagaacggcgaagtttttccctgtcgctgccgcatccggctgccacagttcgggcaatccggagttttcggtaacgtcagatgaaagggttgtgctttacctagttccactaaatgcaaaagccattgcacctgtttttgcataaaaacagccagcgacgttttgccctgcgcaatatcatccagcgactgctcccataacgcggtcatgcccggactggtcagtacctccggcaacccggcaaccagttcccgtgccagtggcgttgactgaatcgctttctttttccgctcaatcagccggcgtttaaacaaggtgtccagaatcccggcacgggtcgcttccgtgcccagcccggcactctcccgcaagacctgctttaattgcggatcactgaccagactggccgcatttttcatcgcggcaatcagcgtaccttcagtaaacggggtcggtggtttggtgtgcagtgactgaatgctggcttcaataatctggcaacagtcaccctgttgaaagcgcgggagcggggaatcaacgtctgacttttcctgattttcagtaaacagtgctttccagcccgtggtcacattgacccgccctttcgcccggaagcattgcccgccgatatccagtgtcacttcagtcacatccgtttcctgcatgggcagaaactgcgccagataatgctgacggatcagttgataaatctgtaactcgtcggtcgttaaccgagtgaggtcaaaagcgtgacgtgtgggaataatggcatggtgtgccgtgatttttttgtcattccagacccgtgaaacaagttgctcatccagctggctgataataccggccatcgccggatcggttcgcaccagcgccgtcagcatcaccggaatatccgtctgcatggagacgggcagatacccgcaatccgtgcgtggataggtcgtggctttatgggtttcatacagggactgggcaatcgtcagcacctgactcgcccccatacctattgacggcaaagcttcattattgaattgaaataatgacaataaagtctgggtatcatccgaagcggattgagataaacttttcatttcatttgcgggaggaatggatgtggtttccggtacgacatcaatttcagaatcgaaatctgtttctgttaccggaggcggtgaaatcaccggcttcactaggggcgagtgaacccattcggccgcttcctgaagcaaagcgtcaatcagtgagagagaagagggattgccattcatgtgcagcatcagacaacgccatgcttctggcacggtcatcacccaccggatgaactcttccggtaacaggcgggcggccagcaatagcccctgtggtacaggcagcacattttcgggcgcacgaaagcggaaacgaaacggtttgtcggggatacaaacacccggctgccagtaatgcccgtcttccagttccccttcaagctgccgcaacagcggcaggtgataaaacagtgcggcccagaacacgaccgtctgccataagacactctgtgctgcctgcatttctggtgcgacacccggtggtaacagatgccctttcgctaacagcacggcacaggtggtaaattgcatcgtcaggtcagcaaacccaccacggcctgaccagtcgccctccggggcggcgggtacctgctgaacgctgcccagcaattgcttcaccggtgcaaggtaaaaacgctgatacaagccttcgggtaatgtactgttttgccataattgttgcaggcactgacggcgcaagggcgttgccagcaacgcatcagccgattgtggccggaaatagcccccgttatcacgaacctcgcttgttttttgctctgatgattttttctgtggcgctggcgggcgggtaaaatgcgatttaaaacgcgcaaacatgttgttttcctccttttcaaatttggctcagtgtcggtgaatcccaatctgaaacaaggagaaactctttttgcgaaaatgaaaattaacctgactcgagtcacccattaactgactgaatcagcttaattttcatcataaatcaacatattaatgacatttaaaaactgaaaagcgccccgaaaggcgcaaagagaaaaaaggaaaaaacgtgaaaacgggtttcaggctgcttgttcatattcctgcaaacgttgagaccagttccccagataatgagcgggtgtgtaacgcgtccgttttttaccgccatcatgcagggcatccccaatggtgacagcggccggaatgccggtcagtgaaagctggatgtacgccatcaccgccgccagcggatcaatatcaatcgcagaaacccacagactgcacatcggatcatgcccctgctctctcagcacttcggcggcggccagagtcatacaacccgcaccacacgctggctcgaaaaaagtgacaaacggttgggtctgcaacagcccggcagcgtcgtgcaactgtatttccgccatcattctggccacgccccagggcgtaaagaattgctgaaggcctttattccccagctccagtcgcataaacacactgcccagaaaatcgcagggttcctgagctaatcccagcgtcacatgcgaaaacagctgcacaatccggtcaacatcgtcccgtttatacttgttgatggttttcaggtaatactgctccagctcctcactgaaacagtatttattgtgaatggctgccattgcacagtgacagaaatcccgaaagacctgatgacggttgtggtaacgtgctgtttgtttaaacagcgaaataaattctttttgatggtcagggcgagatgccattgcgtgttttccttataggacaaaaaaggaaaacacgtcccgaaagggaaccggttcccctttcggttgaagtgaagataaatggatgaggcgttaaaccaaaggctattgcccgaccgcgatcgccggcaatacccgcgcggtttcggctttctcaccattgaccagataaagcgccggccggttctcccgtcctgactgcccgtggccgctgtccacatgctcgccctggtcatagcaatcgtagcctttgagctgatttgatgcttcgctgtaccagtggcggatttcacagtcaaacatcaatgacagctcgcccatcaattctgccgagggtggtgcccacggggagtcaaaccgcacggtcagactgctgacattgcggcgctcccagcggacatggtgaccgaacggccattcaatcccatattgttcaccgtaaaactgcgctgtcgtggcaatgcctttcagcagggcgctgttaccgttgatttcggtcgccagatgggttgacataatcatcagcatatcgcagggctgcgccgcctgcggatacgcattcagtttatcccagcacaccccgatatccggcgtgtcagaccagcccaccatcccaaaccagtcggtatactgacgggtcagaagacgagcgataatgtcacgcgccgcttccggcacattgtcccactgcatcagactgagaccggactgacggtacaggttatcgatgcgttttacattgtcattattcaacggcacattattctgcaacagcagcagccactgctcaaacgccagatgctgtacggtcggggcggccgtgccgcgtactaacgccgggtacggggtgtaggtttgcggtttggccggtttcagtatccccgcacagcctgccagaaacagccgcaggctttgtaacactgcctgacggtaacggggcgtttcctcaccacaaatccactgctgcatcacatccagacacacggattttccggtaatttccagttgattggtgcaccattctgccatggttaagttcctcacttgaatgataaaaataaacaggcggaaccggcccattcggagcacagttcccccgatgggtagattgaaaaaaagtgttacggcctggtttgcctgaacagcatttcagccagaccgctgtcaaaaatgaccgtcagctcatcgtggatatccagataaggcgtactgcgcgggataacctgcgtattcagccgggttaggtcgtatttatccaccaattcgttaatggcttcagaaggccggacaccccctgctatcagttccgccaccgtgtcggtttcacacagtgccgtgtcagccaggctcaggccaaaatgccgtttcagcaaggcagccgcaatcacctgccagaccgttaaacgtaacgtggccatcatgccccctcagaaaaagcactgacggagatgccgtgccggagaatatcccgcacttcatggcactgctgataacaggaggaaaccccatgcagtgacaataaatgcgccttgtgccacaacgcccgcgccgccggggtattctgccagctctgctcaagcatcgctgcctgacataaccgctgctgttgctgttccagtgacaggcattctgacgtcagcatgaccggctgcgcccagacaatctccttatcaaaccggccaccgagtacttttctgtcctgtgcatcaaaaatcatgacggtcagcggaaaaaaagcccccgcaacctgagcagataacctctccggcaccggccagtcccccagaagatggatcaccttcagccgctgcaccacttccgtgacggaggaggcttcgcacaccatcaggatttccggctgcaatgactgtggtgctttcgggtgttgcttcaggccggtgacctgagcggtaaacagctcttcacgtaatgcggtatcggtttcatccggtgccggtaaaaaaatggggttcatggtgttgttccttgattttatgtcaatgaaagaaaacacccgcccgataccgggaaggtgttttggcttccccggtcaggcgcttaagaaaagcgttaacagcctcatgggctgataacgttaatgatgattatttttgttatggataagtgacggactgataacgtcctctctgggtttcagtgtcatgatcgatgttatcaggccgctttccgggtgctgctgcgcatacgcctgcaatgcgcagaaccggtacgcctcctcattctgtgtatccggcaccgtgatacgggctgatacgatggccgtgaccgccagcccgaaggcatcggcggaaagagtgaccgtcagctgcgtaaccggcaggtaaacggaatacgtttccgcccgtgtcggcatcatataagtcagcgattcagacacctgtcggcttgtccactgttcaggctgataatcgccgcataacgtcgatgcggtattcgccagcaggaatcccagaaacaaccgttccagcggggttttgtcgggaaacacgaccgacagcgcaagactgtccagcataatcagttcattatttggcatcacgttctcctgttatgcaccctttaagcccaaagcagcccggatacacgaagcatgaggatgttgcagcgcatattcacgcaggtcgcaaaaccgttcagcgtacccgtccagcttcatcagggccgccagatactccaatacgctcagggttaccatcagtccgaaagcatcggcagaaacctcacctttaaagtcggttgtttcaaccctgactcctgaggaatccggccgtaccggtacaatataggcgatagttcctgacactttccggtactgccactgatcacaccggtcatcatcacacagcacggcggcggctttaatgaacgtgtgctccagcagcgtcagctccagtgaactggtgtgcggaaaaatttcagcaaagggggagtgttcagacgcgggcacgatgtccgtgaccggaggtgtattttgttgcatggtattctcctgataaaacaacggggaacacctgacccaatgggaaacgtgttccccgttgggtgactggccggttggccatgatggatgagattaagaaaccttcatcgtcatcagactgacgatatctgcttccaaaggtgcgcagatgtaccacacggttgtgtactcccttgcaggctacaggagtgttgctgtcgctgcccgaaggtgatcctcacaagcgaccggatcatcgataagtctgactacgctaataaacggaaatcatcaggtcaatgggtaattcatttcccgggacaaaaaataatgtcaggaacacaacgggattttgggggagtcagggagaggctgtcaatacgaggtgacccgttctggtcttttgtctaaatcatttatgccccattgtgtgttggtgccgatggctgaattacatcggaaacctatttttacaatacataaatcatgacctaaactatagcggaatcaatataacttgacgcattctacatgctccataaataactcatcaactgaacaccttttttctcctatcgcttttactccggcccatttgtgttcgatggggttcagatccgggctataaggcgggagccattccaattggcatctgctgtcggctatcgcttgtatcgtgtcatgtcgtttatgaaaacgcgcattattcataacgatcacggcgccactcgggagttttggcaataaatcttgggtaacccaagcatgaaaaacatcggcattgatgtttccggtaaacaaacttaaggtgagaaaggtattttttatgatcgcgccaatgacattcacaagaccttgcgcgtgccaatcgtgtgtaccgaagcaccgtaaccctttttttgaatacccgtgcaggcgaggcatggactgggcaaaacctctttcatccagataaacaatgggtttgcccacttgctcatagtcatcaaaccacctattgtttttttacctagggaatccagcttttgggggttgcaatgtccatgtttcaagatctgctgcacataagcgagcgccattaatacggaactcttaccgacgctattcggcccaaacaaaagtgtcaccggtgcaatatcgattgtttgtgtctctttaaaggagcggaaatttgtcagtgatatttgagttattctcattgtgctttgcttccaattcagaccctacagccgtctcttcgtcactagagtttcgatgacagtccctgtcatcatgttgtagtgtccgatttgacccgctttaccgaagatacttcgaaaaacacgaagatatgcttcattggcttcaacctgattctcactcaaggtaaaaatatcctgtagaggatcgccttgattaaggtttcgatcaacgaaatcccggttatacaccatccgctcaagctctgtgccaccttattgcaatcggcaatgctcatggttatgcgcttgataaatcacacagctgatgatggtcttgcctgtgccgttcgcaccaaaaatataattgatgcggcgaagatcactgagccttgctggactcatataagtcgctatgggcggatttatttggatttcgccgatcataccctcttcttagagttcaccagaaaaggctttttggctaatcgacaagaaattgtttctggtagcttcattgccttcgtattggttttcaatcaactttgctacctttactgaaatagattcgtatttcttttgctcattgataggtacaataggaattggcatctccttgatcattcccatgtttaatccatccattattgcacctttagctttctgacctagataacgtctggctattggatgaaccaagaaatatgaatggagaaaacttggtatgcattgatttttatcgagagtaatgcagcagagatgtttagtattgatagctaaaggaatatcatcaggcacaactgcacatcttccacacgtccccatgattgtgattaatacatcacctggattaaccgtgtaacgcttgagttgttcgtacttctcttgagaaataaagcgctcttttccccgtctaaacttgttactaaccgcattgtcaattccaagaaccaagataccctcgtttataaattcactatgctttagatcgctaccaaaaggtcctgttcgcatactgcccttacacttagcagccatattttcaactgttgtgaatttccatcccttagtttcaggatcaccaaacatatccagaaacacggcgcggaggaattcattggcaagctggatggcttgctggcgtttgcggcggatggcaccggctttatcgagaatagcggcaatacgtttttgttctgttaggggtgggagagggatttccagatccttgaacctacctacatccaagttcgaaatatttgtggtttgacggccacaatgcctgattttatgctgcgtagacggactactaatccagtggtaaagatatctgctatcaataaccctctgcttcgtacggactatagagataaatcccccagctgtggcctgataattcagctttggtacgtaactggcctttcccacaagctcccagctattagctgatgaaatcaaaatatctccttcacacagagcctgttcctttctctttactagctccgagggaatagcaatcagatcactttgctcgagtccttcaacctgaacatttttagtacgcataaccacagtagagttggaagataaaggctctaccaggtcatcaggcttgaaggtcactccacgaatgaacgatataacatcgtccaatttagcttgaggccaactcacagcatcccctccagtgcatccagatccgccataatctcgctttccagcgttttcagtttgttcagaatcgtcttcgggtcctcaaaagcttcttcctcatacaccacttccttataacgattgatggagaggtcgaatttgttgtcgacaatatctttggcgtccaccacgaatgctttttgagttttatcgccaaaagctttgttaatatctttggctaaagcgttcctctcaaccaaggcaatatattgcttccacttggcaatagcttcgggcaggtcgttgctgccttcgccttttaacggcgttcttttatcatctaatgaatagccatcagcttgcaggtcatagaaccaaacacgttcagtgttaccacctttagtaaacatcagaatggccgtgctgacaccagcatagggcttaaacacgccactgggcaaactcacaataccttcgagctggttattttccatcaactcctgacgcagttgctggtgggccttggaggagccaaacagtacgccatcgggtacgatgacggctgcgcggccaccgagtttgagggcgcgcaggatatgcgccacaaacagcagctcggtctttttagtttttactagacccagcaggtcagggttagtgtttgtttcgtccaggctgcctttaaacggcgggttggcgaggatgacatcaaagaagttttcttcctgctgcgggaagttttctttaatggatttactcaggctgtcctgatagagaatattggccccattcaccccatgcaaagccatattcatgctgctgacgcgcaacatagtggtgtcgaaatcgaaaccccagaacatctttttgttgatatggtcacggtaaggctctaacaagtcgccggtgtagtgtttgttaccgtcgtcatcttcaagaataccgaactcactggaatgcacgcggttgagatattccatgatgcgggcgagaaatccggctgtaccacaggccgggtcgcagacagtatcaaaaggctgaggattaatcagttcgatcatggtgtcgataatatggcgcggcgtgcggaactggccattgataccggcggtggtgagtttactgagcaagtattcgtaaatatcgccttttacatcgctttgggttagaggcagttcatccaccatctccactgcactgacaagcaccgattcatttttaatttcaagatcggcatcctgcatgtattcaccgatatgccccaaggcttcgatggcactaccgtcgttgcccagaccatcttgttcatcggacttcttgccaagttttgcaaagtaagggaaaacattttgcttaaggtgtttgtgcagttctttgccgctgaggtttttaaagtttttccagcgcaacaattgcccttccggtgtattgggaaacaggcgatcaaactctttacctgtacggttcgctttgcgctcggccatgtcttcctgcatgtcgagcatacgggcgaacatcaggtagctaatttgctcgattacagttaaggggttggtgatgccgccggtccagaatttttcccagagattgtcgatatcgttacgtatttggcctgttagcattgaatagctcgcttaatgattttctgctgtttctgattcgattggcgctgcgcttagcacattgccctgtgccatgttttccaactggcttggctctacctcttaagccaattaatccataggttcgtctgccggatttttcacctgttctttcgtctactcatcaataggctcaacgatcaaggtcaggcgctcggtttcgaagtctatatgtgcagcctccaagtggggcaggcttttactgactttggcagagagttgactgaaccgatccaccttgccatacaagccttgctgtcctaccagcgctttgacggtgctgttgtaatggttgctgacggtactcagggtgccacctaatttacttaaacgctcggctacagtacacactgagttgtatatatcacctgctttttcgctgatttcgcgggcttcggcattgctgcgttcaatcatccacaggttggacactgtgcgcagaatgggaatgagcgtggtatgggagaccagtacaataccttttttgtagccgtattcgaacaggtttttgttatccttgagcgcctcgatataggcgggttcaatgggcatgaacataagcacaaagctggggctacgcataccaacaaggttggtgtaatccttggatgccagatcatcaatgtgcctgcgtaccgctttaacatgttcgctcatggccagctgatattcttccggtgattctgcacccacagcccggtcgtatgcgttcagtgctaccttactgtcgatgatgatgtgcttaccatcaggcagctttatcagatagtctgtctgcttttgcttgccttctgcgtctctgaatgagccttgaacttcatagtgcgcctcttccatcaagccactcatttccagagtgcgacgaagctgtgcctcgccccaggctccgcgcttctgagaatcccctttcagcgcagaagtgaggttattggcttctttgctcatttgcaggccaatttccagtaccttttttatttcggcattgaggctggtattgccttgcagcgaaacatcgtgtacttcgtttatacgcttttggaaaccttcgatctgttcgcggaaaggcttgagcatagtgtcgatactgacctgactggtatgggtaaaggttttgcctttttcctcgaaaattttattggccagactctcaaactctttggtgagcgattgcttggtttcactgagctgctgcatttgctctttaaagtgttcttctttgcgctccagcgtggttttaagctcagtatactcgttactgagcgactgatagtgctcctgaatctgatcataacgctgttgttgatctacaagggtctgtctgacgtctttcagctgctcgcgcgcttcggtattggatgcctctaactctttggcctttttgccttcttgtgccagctcatctttgagttggctcaccagggtgcgttcttgctggacgttctgctcacatttttccagacggtctcgtaaatcctgcgcttgttctttcaacgctcggttatcggattgagcggtttctagttgcttttctgtactatggtgctgccctcgtaactcttccagcgttttctgtaaggatgccagctcgcctttacgctcggctaatgcgtcattcaggcgttgttctgtgacctttgcattggtctgttgcgtctgtagcttgctttccgacaattctttctcgtgcagagtggtaccgagctgcttgagctcatcctggtgtttctggttttgagtgttggccagcttaagggcttgatcagcctgttgcaattgggtgttgagctcggtgttcttatgtcctagcaggaccatagccagcagatagccaaaggcagcgagaaccaggcccgccacagaggcaataatcatgagttcggtcgtccattctagtgattgcatggtcactcctgtgtgctctcaggctgtgagcctgacaatttgggttcagccttgataaaaggttttagtacggtgattaactcacccacgccatcggcggtaaatacgccatcaatgccctcatgcgaaactgaggtgaaaggtgcatcgtacagtttttcgatcctgatcgagccgtgctgggcgatgtagtttttcagtaggttcataaagcgcacctgctgtgctgtaagtgttgggtgggcatgcaagaagctcttgaagtgctcttcgatggcttgcgggtccagcccgataacttcacgcacggtcaggtgtagttggtcggcagtgcggccatagaattcattcagcacctccaaactcacactggggtggctggtgagtatggtcgaggtgagggtttttaattctggttcggcaatagattcgcctttgcggattttctgcaacgtggggttggcagctatcatctgatccagaatatctttgagcctacggcggtagatcatggcctcgttggcacctgcgatttttacctcacgttcttttagttgcaaaccagtgtcacccgtttttgtttctggtatagcgtacaatccaccgctaacggtttggcgatatttcatgatgccccgcaactctttgcgagctttttccagcttatcgatagtcgggttttgccagaactcggcactgcgcacttctgctataaccacatctttctggcgcactgcctgaatgttaacggccagcttattaagttctgccaacagcagctctcgaccatcatcaaaacagctggcttgctctactaggcagcgttctatggtggcgatgagcttatccagataagtcgcatgtttgtcgcgcaatacacgggctgacattaatggagcgatgtgattgaccaactgatgctgagtttttgcatcaaagcgcttcagtagatcggtttgctgtaactggtgtacgacccgcaattcacgttttactgcaatactagtatctggcaggtcgttaatatcggcacgcaataactcaatggcagcatcgaaggcggctgcatggtttcgctgtaaggcggcctgagccagctcaatccgggattcgaaggtagtttgcagcaaagatttgccgccagtgtcttctggctcctgatattcctcttcaaagaaagcgaagttagcgtaatggtcaaaaatcaggaattcggttttgtgtttgccaggcccgaaaagattgtgtcgtaagcgcgtacctcggccaatcatctgccagaatttcacccaacttttcacgggtttggcgaaaacgagattaaccacctcaggcacgtcgatgcctgtatcaagcatgtcgaccgaaatagcgatgcgaaactcgttgtcagcctttttgaactctttgatcaggctttccacatggggaatggcattatggatgaccttgcataccttagtaccgtactgcgggtacagcttgcagaacagttcttccagatgctcagcgtgatcctggcgttgggcaaagatgatagttttaccgaccagggagccagtttcatctttgatgccattgtttatcaggttttccagaataatgcggtcagtatcttcactgaagatcttacggccaatgtctttacctgcaatagtggtattacgggcctcttcctcgcccaaatcttcttcgagttggcgcttctgctcttcggtgaggttattgtagtgaataccatcacgcaggaagtcagtagtaagatctttaacccgaaacggtaccaaatacggtggctcgttgttaatcgctgcatccagcccgaactcaaatgttgggtcagtggattcgcagtcgaacatatcgaacgtattgcgactgataaatttcaccggggtcgcggttaagcccacttgaagggcatcgaagtaatcgaacagatcgcggtatttgttgtagatactgcgatgggattcatcggcaatgatcagatcgaagaagcctacatccaattgagcgaagcggttcatcatgccggggtaagtggcaatatagatacgtgcacttttatcaatcttgttggtttcaccaatcacacaacgcggctcagagggcagattttgcttaaaagcatcgtcggcctgtacccgcagttctttgcgatcacacaaaaacagaacgcgcttggcccagccagtgcgaagtagtaattcagccagtgcaatggcaacacgggtttttcctgtaccggtcgcctgaataatcagcgccttacgacgctgactttgaaagtgtgccgcgactgttttgatagcttcgatctgataagggcggtcagcaatgctgagctctgggttgaatttttccagctcagcggcacggtaatggcgctggtagatcagataatccaggctgtccttactgtaaaagccatacaccggacgataggtgttgtactgatgatcatcccaaatgaaggtttcgtaaccgttggaatagaaaatcaccgggcgctggtagcccatgtgttcaaaggcatcggcatagaggcgagcctgctcacgacctgcttgaaggttggtattgccggattttttcgcttcgataacagcaagcggatgaccgttatcaccccatagcacataatccacataacccttgcctgagggattattgggaaagatcacttcaaattcctggctaatctgatcggggttctggatatcccagccagcttgcaacagcatggcgtcgatcaatagtgcacgggttttggcttcgttccattgcaggctgtcggccactaactggctctgctgccggcgtttttgtcggtcagacttggcggggggctcaagcttgtcgatatttcgggtgcgctcacgttccagctgctcgatcaccctttcgagctcttcctgctgcttttgcaattctttttcgtagcttgaaacggatttttgcagttggctcaaagttgccgtagggtcttttatatcgacaaaagaggggatctgatccttctttttgttgtagtacttaatacccatatacatggccaactggtgcgccgtgcccaatgccatttgagcattacgcaattcgccttctgcaccatgagcggtatcattaccttgaatacgcagtaacgctgccaattatacattttatatcaatgccttgagatatatccatattcatcaaccctgtttccggctctggcatatggaacaacgcctgacggatatcagcggcggtaatatcgtcaccttggcaccatagagctgctcgcagcaatgtggactgcaattcacgcacatttcctcgccaagggcattgaaggataagattttttgcatcaggagaaattttcttatgcctaagcatcgagtcatggatactcatcgctttgaccaagctatctgccagtaatgacagatctccatcacgctccctcaggggcggtagatgtagtactccaacagccacccgatagaacaaatcctccctaaagctaccattggaaaccgcttctatcaggttgcggtgggtcgccgtaatcaagcggacatcgaccttttgctctttggtgccgcccacagggatgaacgtcccctcctgtaatacgcgtaataaacgcacttgtatgctgggttccagttcgccaaattcatccagaaatagagttccaccattagcttgctcgaataaacctgccttgtcggctagagcaccggtgaaggcgcctttcttatgaccaaagaggactgaatcgaccagctcggtcggaatagcaccgcagttaaccggcacaaacggcttgttggctctatgactggcattatgaatagcacgggcaaagagctctttacctgtaccgctctccccatagatcaacactggcacttcacgttctgccagtatttgcgcctgcgctttcagagactgcatgcgggggttacgggtgacaatgttgtcgaaggctgcattgataggggcactggcctctgccagctggctaatctttgcgctgtcaatgcttttagcggcgggcaggtattccgctgaaacctcaaaggggatatccacttgttggacaccctgctctagtgatgattgataaaactgacagggataatgggttttacctaataagatccacacagcctgcatggccggtgttcctgggcttaacaagatggataactcgcagccctctacggtaagcttagatagctgctgattggcctggacatagatttcaccgaagttaacaggtgaagatagcgaaatggcgtgagcacagataggcgtggtaactagctcctgcaaccaagccagataggacctcacctgatcttccgggtagttgtaaagcagttctacggcatcaaacgcttgtgctgtaagagtcgcagcaatcggcccaagcgcctgaccatcagctccggtgctgccggtggctttgaggtcgttccccccaatccagctgaccagtgtacggggcttagccttgcacatccgtgaactccagcatatcagccacctcacattcaaataggcggcaaagtttatccaaagcctcaatgtagatcttttgtgcagattctttgtacatcagcgttacagtattcctgctaagaccggtttcacgcaagacgtcggaaattttcatttttcgctctcccatcaggcgagcgagatggcaacgtatcatggcctgactctacgatgtacacaattaggtctaataatatcccaagattctgaaaaaattaaagattaactgaaatatttacgcgtaacgataaaaaggcgggctatatcgattaatttttgatcgttcgttgtatgcaactagctaactcaactcagtagcagctataagatggctgcggatcttagatatgcctctggtgctgatgtcagaccgctatgaatgctgtcattgatatcatgcagcttacttgttgaacaacactctacagtgatcaaggggtatttatcctaacctgagcttcgcttaagggaagggaactaaagtgcctgaggcacgatcaacgtttttgctaaagaaaacaaaatagtggagaccctcaggcatgtctaatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatatcttacagccgattttcccggattagtcagctatactcgtatcctcaccctgaagaaaagggtgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccgcaggaaaccaggatgatcgtcagccagtcagagcgctgacaaaaggactaacaggatgtttatatggtgataaggggtatttatcccaggctttatgcgatgagttagaagcggaaggcgtcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgagatcgctatctttaaacgaagctgaggttatcctagtactacagccgtaattgctctgtaagccgatgatttccccggcggcgacagtgacattgttgtacccggtattgatgccgtcgtcgccagtctgaccaatgtaaaatctgttcgattgtctttcccgctttttccatcagctttgacagcagcttacggagttccgctacactgagcggaacccggcctaccggtgtttttttctcctgtacccgcaaaaccgccaggactgcatgggccagtaacgacaaggtaatatgccggtgccagctctgccatcgccgcacttcgtagtgatccagcccacattcccctttggtttcctcaaagccactttcgatttcccagcgacaacccgcaacctgaaccagcgtattaagatccacctgttctctcagggcatacaccacatagtaagcccgttcctgtctgctatcccggctgcgccgaactaacaaataatgaccataatgtcgatcctcttcactgagctgtaaacgccataacggcacgacagcccagtcatactcacgctcaccttttgtccccgttcccgctgaccgtgttttccagtcagcggcggtcagggtatcggcaatccggtcagcacggatatactctggccctcgccaccctaagggggtattgcagggaatggctaacacaaagggcgggtatcgggactccagccagactcttagacgacggtcacggccataaacttcatccgcggtcacccagcgacagggaacgccggcatcccatgttcgttccagcatctgccgggctaacgggggtttcgttgcaaaagtgacgctggcggggatacccgcggcttcacagcgggaacgggcatctgtccactggcgaggcaggtataatgcccggtcaacaaaggcatgccctccgttgccggcgtaacaaagaaatacgcctatctggctgttttctacccgtccagcggtcccactattactgacgctgtaccccggcagaatgtgtcccttttttgataaaaccggttttatcaatgatgagaacaccctgttcatcgcccaaatgttcagtgacataatcccgcaggatatcgcgggccatatcgacatcccaatcagcgcgttccagcaaatattgaatcccatcgggggtactttcccccatccattcagccagttgccagctattcttacgttcaacatcactgagcaatccccgaagataggcgaggctgcgttgtcgtgagccggtagagtgaaataagggagccagacgggtatgtaatgcctgtagcgcctgttcccagattttggcaggggatggcatgtgacaccgccttttatttaaggaagaagagccctatcatcgcacatgatggattacggctgtagtactagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaggctttatgtgatgagatgaaaactgaggggatcacactgatcacccatgttcgtcgtaatatgaaagccaaatttttatcactttgggacagagttatgttaagaaagcggtttttgatagagacagtgaatgaccaattgaaaaatatttctcagatagaacattcaagataccggagcgtagtcggctttttactggggattgtatcgggacttattgcttatacattccaacccaaaaagccgagtttaggtttacgtgattctgaaattgggatgcttaaacaaaactgaggtttttcagatagagcattcaaggcatcgcagtcagcttggctttttattggaagttgctgccggccttattgcttatacattccaacctaaaaagccgagcttgaatctacgggataatgaaatcgctatctttaaacgaagctgaggtcaatttagcttactcgtgctctagaacgttcctgttcacgaattcgggcctcaatttcggcgtaaagattggcctcagcgttttctctatccgttgcagtaacaactaaagcatatgattcgtgttgactattgagtggagccccccactcacgatcatttctagttacaactacaaaccacttttcatcaggagagcgacgcttaaaggtccaactaaatgattgcactgtaccgtggtcacgttgttgtgcagtaacagaacgattacttgccgcatcatcattcctggattttgtgccatcctgtacatcatgattaaaatactgctggacatcctgtaacgatgttccttttatgagtctataggatatttgcgtagccgcataatccagcctggtcgttctgacggctggtgaataagctaaagtaatgtgcagttctcgtactgcccgccgagttcttaaaaaggaagcgggtaatggaagctcaaaaaattgatgtttattattcacaatttgttcatcacacatcataacaactacttattctgatgaacggtataaactatcttcctcgactactccatatccaacaacatcccgaataatgctgcggtttcgagttgctgactctgctttataacactcaacaacttcttcagaaaatgtattttccatctgagaagtcaatactgcatggttgaccagcatcgctcgcaacatattggctgacatatctggatattcatttagtaaacgtccagcaagatgcgttatatatggtgcagaaaaactagttccactttgttcagagaaaaatgtgcttccttggaattgatggtggcagcttagaacgccaagtcctttggcatgttctcgccattggcctccgtcattacgcatggggacggcgaaattaccaccatgggctactatttccggtttaaaagctcctttcactgacggcccgtggcgtgtgaatggtgagggttgaaattcccccgcagggcttaaatgactaatttcatccgccctacgttgagcatcaaatgttgcattgtgcctggcataacttcctgtcgtgaggacattgagtgcaggggctggatcgataataacggaactgttatggattaagtaacttgggtactcagcacgccaactttcctgtggaacatcagggtcactacttccgctaaagttacctgcagaaacaacgaacagaatgttgtgacgacgagccagcacatcaagaacataagcaattcccctgatatgcttaccatcatatggtgcatttgcattaccaagtgataagttaaatatacgatatcctaaatctacgaaatactctacagcctcagtcaacgttgtttcgatcgtagaagtatcaaattccccttgagaattaaggagttttccattatatagccacactgatggttgccagaaattactggcatcgcaggcttcaacatcaccatatagcgcaatacctgcaacagctgtaccatgcccgcaatggtcaaattcgtcttcattaaccacaaagctggcgctttcagctatagcactacgcaataatggatgtgcggtattaattccactatcaaggatacaaactttcgcagcgtcaggagatggggaggggatgtgtgcaggaataacgttgatatctctgttcaattttccgtacgaaatcccgcttgaaggaagcaattctaccatacggacatcacgatgggctagtagtttttcagcttgctcgcaatttactcgaacccgatacatcaacaagctatcaagattaattcgatccaaacggtgaatcatattttcctgaagccagttttcaaattcttcgcagatccgctctcgtgaaggatgtcgtgtggtttctatcggccaaagctcaacatccagaccgaatgattctaattcaggaaaaccataatgcctgactgaccagcttttgcgatcctcactagaccaaacatcaacactgtccaatgctgttaggatctgctggtaggtaatatgcccatgtcccaattgtgacaggtgctcctcaaagagggcaattcctcgttcatcagcaaaagcaatacagatcgttttgtcttcttggataacgaactcgataccatgcctgtctagatgagcaatatctaacatcccggtatattgtaatttaagcatgtaccggccatcattatcttttcctggaatttgcggggtagctaattgcgtaatacctcgtaattgctcagacaacatgcttccatgcaggcgcaagtcggcacgtggtgttctcggaatgttaaactgacgtgtgcgtctagggttctgaagagattctttcgcaatactaagatgtttatattgttccgtcatttattatccctgacgagttttatttacattttcccgcaagagtgcattcttaaggtctttcagagttaaaaactcttggctacgtaaaatcattcttttgattgcacgtcttacaatccgttctaaatcggcaccactttttccaataaatagtgagagcacggcatcatcttcaagctcaaactggcgacgtatgccacgaagttttagcttcatcaattctaataattgatgtttgtcggggagtgggaattcgattgcatcgtcaaaccgcctccaaatagcgctatccagaatatgctcatggttcgttgccgcaagaatcaagctttgcccctgatatgcatccatcatctgtagaactgcattcacgacccgtcttaattcgccatgatccccactatcccctcgttctttaccaatagcatcaaactcatcgaaaagtacaaccattggatactgagagataaaatcaaatatttggcgtaggttagcagcagtctcaccaagataagaagaaacaagagtatcaagcctgacgattgccaagggcatatccaactcacaagcaactacttctgctgccagagttttaccgcatcccggaggaccaaaaaagattactttactaacagctttcattccatagctgcgtagcacatcagctctgcgattttcttcaagaatctcttcgattgcatctgaacttgattcgggtagtacgatttcattcagagaacggcttggctgtttaatatccagtaatggtaggcctctctctttatcaacaggcatctggggagctgcaggcacacgggaggtctgtacggtgtgatctccatacaggatatgttcaagatcattcgcaagaagatgatgctgtttttgtcgttctttctcaatgatcacttccgaaacacgacggaaggccgcgacatcacctgtcgccccagcttttataagctgtctgagaaccttaccgtttgccatttctttcccccaacaaaccaatgtgcacaaaatcttgctttcagtttagcatcgccgcatccctataagaagttagctttacctagatttttttgaattgttacaacttttttcggctttttagaaggaacgattgaaacgtcctatatttgagacgttctccccgtagattaatgtgagtaatgtccgcttggcacaatgccgactgttttatatggacgtcccgtaatattcaacttttttcagtgactcagttcgtggctaatttcgcttcacagtcatatatccggcgtctggcgatcattccaatttactgcgccatggtgaagtccgaaccttgcctcctcatcagattaacggattaaaaatcctcaacagtttcaggttcttgcaaggccggataaccgtttagctcatcaactgaagtcaactttattgaaagtgaaacaaatttattcaggcaaaggccttgctcacctgaaacacgtcattattaatcctgattgaccagcatattctggcgcatttgcatttattggcgtaagcgacacacgctttattaaatccccgccggttaaccaaagactgcatccagtcacccagtgcatcgtgccgtaacgttctgcgttgcatggctgctctggcgccatgaattaaaatacaacgcaagtatcgattactatttttggtgattttacctaattgagttttcccaccactacttgcttgtcggggaaccaaccctagccaagccgccagttgcctgccgttattggattgctttcaatcaccgacataagcgataaatgcagaggcgattaggggaccaatgccgggaatagattgtaattgttgccactgtgccgtttgtgatgatagcaatttgagggtttcttctatttcctctgttcgttggagcaatatcagccagtcttcataaagttgtttcaaaatcctacgtgcaatcaccgttaatccattactagcatcctcaagtgcttcatacagcgattgtctcagggcagcagagcgttgcggaaaaacgatgccatattctgccgccagtcctctgatttgattagaggtggcaacgcgtttttgaactaatgactgtcgcacatgatggagagcacaaagatcctgttgagaaaggtttttcactggcacaaaattcatatcaggccgattcgcagcctcacaaattgccagagcgtcattagcatcatttttatggtttttgacgaaggctttaacgtgctgaggggggataaggcaaacctcaaagccaagatgcccaaccatccgtccccaatagtgggcagtgctacaagcctccatcgcaaccaaagtcccggattccatttgtctgacagcatccagtagccgattgcgagtcacttttttattaaagacaacgtgattaccatcgagcaaacagagctgaaagatcgattttgctaaatcaataccaagaattttattacgcatgatggacgctcccgtaaaatgagtatgctatttcattttggtacaattgacgccatgtgggacgtccatctcatcagattaggttgcgctcagatcatcgatagtgtcatatcgagtcttatttggtacaactaactcgcttttgtccagaagcaagttagagataacatgtgaataatcggctaagtgtcaaggttgctttgctcatattccaatgaccaaagcagcagaccgtgtatgagccaatacagcttattcatcctcaatattctggtaatatacctgccgaatataacgcccccgcccatcgccatgtcctaaatccatcgacaccagtgccagcgcttcccgctcactgaatccttgcgctatataatgctctccggattgctgagcggcaataaagcatactgtgtggcgctttattgccgctcagtcctgcacgtctgacaatatagcggtaacggtctatggcctgagtaatcgtcggcttatcaatcagtttgccgctatgtcctgcctgctcttgctccgcataggcaatggcatgttgcagcgctgcccgatccaatatggtcgtctgtcgagaccgtccacctttagtaccgaacaccacccgcacagacgtatgcccgttttccagtgctttcttccaggtcgctaacgatttgtaggcttccaccgcttctttggtacgcagtcccagcacatacgccagttgcatcacagccgcggcactccggtctttttgctccacctactgaaaaatgtcccggaacgcagccggtgccagcgccattttagttcccttgcggctggtatccgcgatacccaatgcccggttactcaggcgagcattatcgggatcagccagcttatgctttcccgcctgcgctaaaatggctcgcagcaccgacatttcattttgcagtgtccggtgactgagattgttggctttgcgctcagccatatagcgctcaatatatttcacctttaggctatccatttgccggagtttgatgccattgtttttcaaataatcaaggaactgccgggccatacgctcacgatccgccaccgtaacaaaacttccgcccacctgtcgggcatgcgtgataaaggcttttctgaactgctcaacctttgaacgtgtcgatccctgcgccattctcgcctctcttgctactttttcatttttagtcgtttttaaaacaattccctgcgtgtcggttcaggttcaccgttccgtggtgcgtcagataatgtgtagcagggcggaattgtgttgagttattgcaggagctcgcgacgtgctcagcacggcgatggcatgctccccgttcagtgcctgaccatgttcaggatgaacgcctcattatcttgacgtgtctcatatctccttttttactgcatcagcctgttgtaaggcagcgggttgaaaaccagaccggacgatcgttcgtcaatcaaacagaatgtcagtcaatggcctatttttagaggtttcactgggtaattcgtggatcaaatcggtcgtaaagccagtctggacgtgctctggacgttggccgcccggcggcgtcacttggtaatcgctgcgcttcaacacaagtgacgccgcgtaattttcgggacgtttaccgtgatgaattaaaaacgagggtgaactttgcgccggttaaaacagtatcgttcagcgtgagacagagaatattccgtcctaattgtgtgggtaagccggtatcacaataaaaccgggaaactttcatcgccagaccagggtttaggtgtctgacaatatgcgaaggcaaaagatctttcccgctacccggcaccacgcattgaacacccggatgccccgataacggcagcacactttgcgcagtggctgaattcgccgccgtccatcacggaaaaagtctgtcaacctgcgggactgggtattatcggacgcgcctggctgccccgccgcacactggcaggcacctatgacgaacaatggctgaaagaacgccatccttatctccccgatgattttagttttcgttactggaataacgcgccggacgaccagcaaattgactttcctgctcctgatatccgtatcagcctgttcaacctgacccgtgacggtgggctgcatgtccagttgccgggacaccggccgctgattctgttgagaatgctcagtggtgaaatgctcccggaacggatgtacgccgatacccttattatcgacagcgaagcgctcacgctcgccatgacttaccgttaccacattgaagcaacatcgcccctccgggtgatggaagcccgttttgaaatggacccggctgcaccgctgataagaattgcatcaccggatgacaaagacgagaaggagatacatatttatggctgataattaccttgcccggacaggcacccagtggatggtcatcggcattttaccggatgtctgtaaaaccccgatgggctcttcaactcccccaatcccttaccccgtgatggccaaactggcagacagttcagtgccggtaaaatccgtgcgcgccaatggcaaacccgttgtggtttttgcacagtcgtttgttccccagacgctgggtgatgaacccggtgtggcgaatggcataaaaagcggcacagtggggggaaaatgccatccgaaagagcaggagcatacaaaaagtgtgcgtgtcggcaataaattgctgttacgccacggtgacaaattctggatgaacggagcataaggacatggcaaaaatcaagaaaatcccgcctaaaccggcgagtgatgaagcattatggaaaaaacgggcacatgacgatgctccgatcggtgagggtaatacgttaggggaaattaccgggcaaccgccgaaatcaacccaggtgcctaaagaagctaatcccgttatcaagccgaatacccagagtgaggaagggttttggggaaaagtcggagatgtgggaaccggtatcctgaaaaatctgggaaatacggccattgatattgctgaagttgtgtataaaggccatcaggctaatgctgcggtggatatgaaactggaagcattagcacataaagcagcgggtaataaagcagaagccaatcggttaacgaataaggctgatgcgctcatggaaaacgcgaatctggatgaatatcgatttaagccagaaggcgcggcagaagaacttggagatacccttgctgacttaaaccccaaaggggtaatcaagaaagcggtgaaaggtatcgctaaaggcgggtcaaaggcaatgtcgatcattactggcaaggaaaaaggcattgcacgaagtaactccagagataaacgacgagaaacccgagctgctgaaaaagataaaacaacaccttccaaagacccagacgaacttaaaaaggaactgaaagaaaaacagccaaataatgggggtaaagtcaaaggagttaagaagactaaggtgccgtgttttgatccttacgacagtaataggtataagtcatttaaaacccctgaagaaagaaaagcatttttggatgagtatgcggatcagttacgcggtcagcaagcagctattaatgatatgtcacctgaagaattccagattgccagacaggcatatgatgcagattctgcaaaagccaaagaaaaaggtgaaaaaggtggggggcgccatgacaaggcagaaggagcacaacgtcgtgcgagaaggaaggctaaaaaacaaataaaacataatatctatcaaaagttacgaaaacaaaatgtgccacattctcaagctaacaaagtagcaacagaaaaagcagataaagccttaaagggattagctgcattacatgaaccagatatggtagctggcggtaaaaataaatatgatcccaaaagatttggagataaggaaattaatagtgccattggaggcagttggaacggtccacgcttagattcgttagataatgcagctaaagatgcaattaaaaatggtctcggtgatgctaaaatgaatgtacaattagaagtatgcagaaaaaagggaaataaatgatgcgtgatgaacattttaataactttattgaagaattcggggaagctactcagcatatagcagtaccttctgaatctatagaaaaatggcgaggaaagttacccgaccaactattacattattggagaacagagggttggaacagctatcagaatgggctatttagcactgtaaatcctgacgattatgagggcattgttgacatgtggctggaagatacgccatttgagtcaatggatgcctaccatgtgatcggtaaaagtggtttcggagatctttgcctatgtggtgaaaatactggaactaatttgacaatatcgtgcgcatttaacactatttattacaataaggaaaatttttataaaaaagataaagaagaagcaaatcttgatattgctactttttttgaaagcaaatcattggattatttcgatcttgaagaagatgacgacgatgatgatataggtattttttccaatgcaatagaaaaatatggcccattaaatgaaaaccaaatatttggttttgagccagccctagttttgggaggagacattgctctaaaaaatataagaaaactagatatgtatattcatttagatattctacgtcaattttcttcacctcaaataactgaagtttaatataacctgtattagtcgtaacctgatctggcagtgatcctttatttatggaatgtgccagatcaagcccaatttaacgcatttccactaccgaccacacgcaaacgccaaatgatgccaggcattgcgcatccagctatccgattctgcccaaaatacccatttagcctgggcttctgaaaaacctgaactggcggtgaggtaatccgtggaggtcacataaaattcccttgcccaaccatcataaagataaaaattgccccattcctcatagagctgttccagcgcatatttggaggcaatccggctgccgagtgatttgcaaagttgctttgcttctgagtaaaacgctttcgtcaggccagagcgctcaaaccaggtatgaaccgtcaaagtcagttcgacctgctgcccggtctcatcagtacccgtgaatctgactccgtcaggattttgctgtaccgtcaccacatcacccgataccgtcaccgagggcgagttactctgccaacttacccggcctgtattgcctgccgtgataaggcgaaattttgcaccatgccagagtacggaaggcccccggagaccaaacgatttctggttggcattgccgccctgacggtcaacggcaacggtatcctcaatactcagcggcgagacaaattcgatcaccggcgatgcttgttgctgatcaccgatccgcgcaataatgacaccttttcccggacggtggctgacaacagtcgcagttgcatttccccagtggtctgttcgggtttccacagaaatcatctcgttgaagtcccccgaccactcaacggcctgatccgaaagcccccaaccacggctgtccatcaccgtgacggtgaacgtcacctgctcggtgccatcggctgctgcgcgggttttatccacccgaacagttgacaacaaaacttcctcaaatgtgatcatgggcgctgttacccattcatcaccaacccgaatttgtacctgatgctcacctgtcaatggactactcagcttaacctgtgtttgcccccggctatccgtttctgttcgttctgaagacaacacaccgctatctgtttgccaaatcactggctgatttgctacgggtgatcccagtgagtctttcaccgtggcggtcaacaccacggtatcctggccatcacttttagcccaaactttatccaccgtgatagccgatttcagcaaacgtttaaaagtcatcgaaggagcattgagggtttttcccgccacctctgctttcaccgttgccatccctgcggtgcgactgactaaccgggctgtcgcttctccctggctattggtctgactttgcttatccaacagttgcccgttatccgttgaccattgcactttgctgttagcaacggggcgatctgctgcatcgcgcacgttcaccgtataaaggatgctgtcctgaccatcggcaatagccgtttgtttgtccgactgaagcgtatgcgttaacgaggcggtaaagagaatcggagaagacatcactgtttcactgccaaccgccaccgtcacgtctgcactgcctgatactttgctggttaaatacgccatggcctgccctttcgcatcagtcattaatgaaaatgcggagaactggccaaggctggtttgccagccaacggcctgatttgatacaggttgactaccagcgtttttgacagtaacggtcagcgtcgctattgcttttccatccgccttaatgctgtgtttatcaacagtaatttcgggtatcagcaccgcatcaaactgtactgaaggtgcaacagcaacctctccatccacggaaactcgtaccgcatgcagtccctgctgacggctgcgcagcacgaccgatgcctgcccttgcgcatccgtgttctgtcgggtttgggacaattcgcctttatcatttgaccagataacagcctgattagggataggagcaccttcctgatcggtgacaaggacggtatagatcacactgtcatgaccatcggcttttgcctgcgttttattcgctaacacctgccatcgtttttcggtcagtaaactcactatcatgatttctgcccgattggagcggttaccccggctgtcgatggcgatccccgaaagccgaacggggtttttcgtggttttcggcaaccgcaacgtcactttatctggttgctgataaagtatttttccgcctgcctgctgtaattcagccgtatccagttctaaacgtgccagcggatatttcgcgtggataacgggaataaaagtcacttcctttccttcatagccattgcggatgtcggcaaggccagtgtcagcagcgtttgcttctgataatccagcaccatatcgcggcgccggtttacaaaatcagactgactggaactcaggtagcgcagcggcgcaaccgcattcggatcaagctgttggttaaacggcacaccaaaccgataattgagattcagggtaaaacggttttcactagcactttgtttaccctgccgaagatcggcacccagggtcactaacggcactggcgtgtaagtcaacccggcggtgatgctgtacggatttttctggcgttctgattcaccgaataacgcgacctgccgcccgtaatagtgctcatacttcaactgcccgccccagtgaggaaaagcaggcaaccaggcttcggcctgaatatcccagccattggcgggtcttgcgtcaaaatccgtaaggcgggagggcttccaatgggataaacgctggtaaaggttggcagagagtttgacgttatcataccaggcttctaacccaagactataacggtgatactgctccggccacaatgtatcccagaaggcattgagaccccataaccaattatcggcgacatagcgatagccaaatccgaccgccgttgttgtctgaccgtgatgggtttttaccccgagctgactgaatgcagtacccgaaaccggttgataaaaaggcaacaaccaatcaaatgaaatgtcttttaacgaaaaatggctgtcgaaagggagtgtgaggcgggcattgccatattggttaaaccagggtgtcaatgttgatgtcaccgcagacgataactgctgagcggccattgtttttgccgcttcaccgggtgattgcgattgagtaagttgaccccattgtgcggtgatttcggccagtgtgtgctcatgttgatccgggttttgaacttctgacatggcctgaccgggaaaactgagtgacaggcttaacaggccgacaatcgaagattttcccctgctgaaccgacgagattggacgttttgcaccacggattgagaccctttttattaatgatgaaagggataacatgcagaaaaagcgcgttaaatactgtggttaattctttttctgatcgagaaaattatctgctcgttataaaataatttcactaaattatttatcagagatatcggcaatgttgtcatcattcacgaatacgctagatcgtaccttaaacacccccataacttcagacgaagaagcggaacaatatacacctgaacaactcctttcatgggcacaaggctgtatgcttgaaggattacctgatgactttaatgaagcatacgtagaatgcctgcaacaacagcatcttgatgggaaaagggaagtaaaaataacgcatcagtttaaacttaatgccgattccgcctatgaaacctttacacccgcagattatctctaccctacacagtgcatagagagggttctggcaggaaaggactggaagaaagctaagctgacatttaacccaagaaaggcaacatttttctgggaataagtctctcatagagcctgtagtgtattttgtggaaatacaatacaggttcatccgagacttttggaacgacacaatcaaacccgtaatccccgcgcaatatccatttttctggccaccaacatcgcggcttccaattcactgcactgatgttcccgcattaacgcccgccgctcggccttttcttctttttccgtcatccccagcgccagatacaggctcggtggcacaacccgaaacagcgcttcgatttttttcgccagcaccaccccttcggtataacaacgtgggagtttactggcagagagcaataccgctttttgttcttcattgagttttttgaaccgggcaatttgttccacctcatccgggggcatggtaagacacagccaccattccgccatattcagcatcttttcagcggtatccggataatcggcaaggttttgcgtggacagccacagccaggcacccagtttacgccacattttcacgaccttagtcatatagggggacaacagcgggttggtggtggtgatatgcccttcgtctatcaccagttgcagttccctgtcctgatactggtcgcgtctgccagattattcactgtgttaatcagcgagaccatcgccagtgccatctgagccgagtagttttcacgtgccagtgtgcctaaatcaattaacgtcacatccacttccggccacggtgtgccgggctggttgaatagttcaccttcaaaaccttgggtaaacatcgacatggccccggccatttcatccgcccgtgcccgacggtgtgccgtaattaatggctgaccatgcttatcctgctggtgaatgcgggcaatggcatagagcgcattctgtaagtctgaggccaccatctgacgccctgcctcataactggtgtgtgccgccatcataatggcttcgcggattaatccccgatccgagcgggtcaggcgctcttcctcttttttctcaccgccggtgatcatcagccgggcggcaatttccatctcgcccagaatatcgcgctgttcatcgccgtcatcctgcggttcatccgtatccggaatatcggcttcatgaatccgtaattgtttagggctgagttgcagcagttgatgcgcatcggcaaacagggccagactgacgccacaacccggcttgatgccaattttattgacggtcagccccagactggcgtagtaatctgccaacagcccaaaactgttccctgcttcgacaataaacaagcgaggtcggtggatcgccatcagttgcaccagggaggaacacagggtggcagatttacctgcgccggtcgggccaaacagcaataaatgcgcgttctgggtgcgatcctgcttgttcattggatcaaaggtcagcggtgcaccaccgcggttaaagaaactgaagcccggatgtccggagccggttgaacgtccggtgaccggcaatagtcccgccagatgctgtacccaggtcaggcggctatgccagtgttttttgtctttctgtggattgaaacacatcggcaacgcccgtaaatagacattcagcggggaaacactgaattccggccggacaggctgtaaccctgccatcaataatgtggaagataactgatgaacccgatgattcagattacccaaatccttgccgcgcaccagaaaggtcagcgcactgcggtacagtttatgccgtcgccccagtaattccttcacttcctgtacatcctgccggacacgtagtgattcggtattttcccccacggcatttttcgccagtcgggtaaaactttcttccagtgtatcctgtgcctgtgtcacgatggtcagcgtgaccacggtgccttccggcatcatatccatcagggcattgatattgtcaccccgtttcatttcccctgtcagcgtgcccggctctgatgggcggcgcaggcgctcaaccggaaccgctttatgtggcagcccatcaaaccaccagatcccgttttcgggatcagacacctgcggggtaaaccacaggctttcggcaaaatcattgtgaaccgggagatcggaaggtgtaggtgtttcataacttaccgtgcggtaaaaatcggcttttgccataccccagtccggcgcgggattaaaatgacgcagcaaccagctgtggatctgctcaccatcttgctgggttgccaaaatacctgctgatgccagtgatgatatcagtcgttcgcagacctgattaagtgctgccactgacgatacagtttgatagtaagctttcgatttatgagcaggcaaccaacgataaacgaccatgcgggtctggcgctgctgcccccgccacggctgtccggtaattaagctgtcctgaaatatcccatcaggctgggcgatgcttttcaggtgacgttccgattctgccagaaaagcgtcggtaaatgccgtgccctgcgcccacggtttcacatagtcccgcaaggtagtgagataactggaaggatcatcttcatcctgacaaaaaaactgcaccacccacggcgaaatgtcatcctcttccagactgtcctgaatggcatcttccagttgatcgcggatttcaattaatcgctcaagaggacgcccttcggtggcgatcggttcgatacggtagaccgcaccgacagacacgccatcatccagcaataaacattgcccgtcttccagatattccacccagggcagataatcgatgatggacggatttgcccggtaaatcgcgacttcctcggattcactcagcctgccggggcggttcagtggcttgggattggtcattaccgtgcctccgtgcgttcacccggcagggcatactgcacctgctgataaaacgggaacaccgtgctataacccagtatcggggtcttaccggcgaccagatgcggatagacatacatcaccatatcgggattggggaggcggggaaactgctggctgatttcattcgcagccgaacggctgtaatggtgaggctcctccagtgctcggttccgttcggcagaagttaacgtccggcgtagagtgtgtctggcctgcacagtggagtaacctgccttgtttccctgccacatcgccaacacggtctgttctccggctgggagcaacgtatctttcgaggtcgaacagcctgccatcagccctgtcagacataacacgacagcgtattttatttttcgcatccctgagcctccgtggcaccaatgacggtaaaggtggcaaattccgggtgtaccgccagttccgataaggtaaagggcaggcgttcccactgttcaggctcagtcccatcgtgactttcaacaaccgcctgccactgggattccgtcagacgaaagacggtaaaatcgccctcacccagctcccggcattccctgccggcagacagatataaccggcacgcttttttacggttcgagccagcaaagctgaaccggcatgggttcaggaggtggcgtcatgttgatttgcaggcaataaggctggctggcgcgaaacagccattgataagaagtcgttttcattaatctaaggcttcctgatgataacgttggtctggctcactaaaaccgtaacgcaccttacgtcctgtcgtttcgtaatcaatcgccagcggttgggtgatatgcaccacaacacgggcaccgggcgggacgtaaaccgcatcgaatgtctggctgtaacgttgtttgagccattcgctcaggtctttcattccccctgacagggctttgccgagtgccgcttgtcccgcattaccggttaacgctgacgtgatgccgccggtgccattggtttgtgccgtgtgctggcttacgttcagagcatcgccagcggaattcatggctgacagggcaaacagtgtcggcagataggtgctggcattggatttacgttcaccgctgagacagggaatgccgttttcatcggacagccagccgataccctgctggttttgccctgcgcccggcaaagtgcgcacggtgccatcctgaaaaacaaaggtgatggaattgacctgaccacgcacacaagaaagtgtccagtcaccactggcggaaacacaggccgcacaaagtctgctgtggcaggcggtggtgttctgggcggcgctgttttaccacctgcctctgctgcggcaactggaaggggaactggaagacgggcatcactggcagccgggattgtggatacctgaacgtcgtttccgcttccggtttcaggcaccgcggcctgagctgccagtcctttataaaacgttgctggctgcccgtttgttaccggaggaagcggtgacctggttgtctttagtgcccggtgcgtggcagtgcctgatgtggtcatgctcccaatagttagattattgtagtaaactttccattttttattactggtgagatatggctaaagttgatgtggtttgtcgttattgtcacaaagcagaggaggtcaaagggcatggaaaaggaagcagtgggcacccgcgttatcactgttatgcctgccgtaaaaccttccaactgaattacacctaccaagcctgcaaacccggagtgaaagaacaaatcactgatatggcgataaataacggcgggatcagagacactgcacgtgttttgaacgtcgggatcaataccgtgcttcgcacgttaaaaaacttgaacccagacaagtaacaacacggcctctggcaggaagtgagattcacattatctgtgaaattgatgagcaggggtcatttgtcggcaacaagaagaatcaacgcgggctctggtatgcgtgggaaccaaaccagaagcaaatcatcgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaactattgggagcatgaccgcctgatgttgcatcttggcggacatccgtcttctgtcccgttgacggactcactgcttcagtctgccgctgagcaggtgcagtcaccgctgctgaatcccgttgaatctgctaaaccggctaccgatactaggttgtcatcatcagaacccgatccggttattccgcctgtcacaccgggaacagtccctgcgcccgacaccaccgaggatacccggagattactgtcattgtttcaggcagaggaatgaaattttgatgagaaagaatgcaaatggtaacgataacgattcgaaattgtccgaacgcaccgcatcagcgccggaaggccttgtttctgcaatgtacaaaaggtcattatatgaaaaataaaataattcaacgtgttaattaatctttcagtttattaacgggacatttctgtaccgggacacaatattacacactaaggaaacaacaatatgttaaataatgaggaaaaaatgggctgggatgcgttactggatgagtattttttttcgcggatgttacggccggcaaccgaatggagttatcgcaaggtggtgcgggtctttatccggtatatgggggaaacggggttgccggagagcgtgactcaccgggatgtcctgtgctggcggcgtcatctgctgatggaaaaaaatcagtccggctatacgtggaacaataaggtggcgcacctgcgggccatttttaatttcgggatggaaagaaaactgttgtcacaccccaaaaatccgtttaatgacgcggcagtcaaaaaagagaagaaacaaaagaaaaccctgagtaaggcgcagataaccgggatgtacctgcggatgcagcagtatgaagaggaagaacgtttacagaccgccccgcggggcggacgctgtgccttatacccgacggggtactggctgaccgtactggataccttccggctgacgggcatgcgcctgaaccagctgctgcatctgcggttacgggatattaatctggacaacagttacattgagttgcgtgtggaaggcagtaaaaaccacagtgagtggcgggtgccgatgatcccgcagctgaaaccccggctggcgcagttgattgaacaggcaaaagcctgtggcgcgaaagaggatgatccgctgtttgatttaacccgcctgcgtttttgtcatcacggacgccatgttagtcaccagtatcatcatgacagagaaaagcaacatctccgttctttctttaaccgcctgtctaaagaatgtggttttgctgtctccccccaccgcttccgtcatacgctggcgacagagctgatgaaagcccccgaccgcaatttgcagctggtcaggtgtttgctgggacaccgcagtgtggcgaccacgatggagtatattgatatcgatatggaaatcgcgggtaaaactctggcgaatgaactggcgttttatctggatcttgctgtgtaatccgttaacgtgaggtaaaaaaaacagggcaagatatcagcgggattgccctgactgtgtcactgaattatgggatggtttggaggtggagacacaaaacgaagaaaccgggaagtgtgctcaaagagcaattctgacaatcacctgacttggcatcagaatcaattactgaaatcattactttcaacgcaaaaaggtgagcacaaactgtgttcacctgacttcgtatagagtggctgtttttagtttattaacttacccaaagtaatagattatattcattaacatttgcttaacagcacttatttctgactcacgtgttaagttattgatatcacttcaacaaacgagttttaaaattggtgcccggactcggaatcgaaccaaggacacggggattttcaatcccctgctctaccgactgagctatccgggctaacggggcgcattaaaccgcattcagctaaatccgtcaatgactttctgcgaaaaaaaccgtgaaaaacggttggttgctgtattttcatcccaatttagtgtggttattcagattgggctgttttttattaactgaatgcgccattttttcggcattttgcaatggtcagaatatcctgtgccagcaattttgccgttattacatcttcaagttctctttttactaatagtttgctgagacatccctcaaggatcagttccatttgtttggcaacccgttcactgttttcgatctcaagttgttgtaataactctatggtataatgaaaagaattttgtttttgcagctctgccaattggtggatcggatgctctgtatcagtgaagacactgcaagctgcaatgaatagacaacccggataacgctgtttctgtactttttccttgagggtgtcgtaacgtgccagtaatttctgctcagggctcaaaacctcatctagcaggatctggcgctgccagatttcaatctgctgactgtgatagcgcaggcaatcgtacagcaaggcttctcgatcaggccagaaatgctttatttgattgatatcaacctctaggggagttaaaagcgtctccaatgttgctgacaggccatgctgctcaagtaaatttagggcatgactaagaacatattcacgttgcacaattgctctccttttaaattatttttgtagatgctgtaaatggcggctaaagcgccctgcatccatgaaaccactgactcgtgaatcgggtagctcttttccatgagcatcaaaaaacaagatagtgggaagccccaataccttcaatttatccagtaattctttctgttttgagccattctccgtgacatttgcttgtaatacgaggaattggcttaattgcgcctgcacttgtggatcggggaaggtatatttttcaaactccttacacgcgacacaccagtccgcataaaggtccagcataattggttgatggcggttctcggccagaatctggcttagttcctgccagtcactgacttgctgaaacttcagcgatggttgctgttgtgtcgtagtcggatttccccacacccaatcctgtaaggggcgtgaggtgatgagtgtcagtaccagtaagatgagttgcagggtgcgcagccagccttttttgctgtttaaggtcaatgcgaaagcccagccaaggaaagcgactgccagcaaactccatagccttatgccccacgtatcaccaagtacacgctccagtaggaatacggggagcgccaggataatgaatccgaaggcttctttaacgtactgcatccacgggcctctgcggggcaggagtttgtgtccgaatagcgtgacggcaataagtggcaggcccatgccaagagcatagaggtaaagggtcagcccgccaagcagggtattaccgctttgggcgatataaagcaaaatggcactgaggggagcggtagtacagggggaggcgatcagccccgcaaggattcccatgacgaatacgccaatgtaagagccgcttttttgttggttgctccagtcaactaaacgagtctggacagaagaggggagctgtaatgagtacatcccaaacatggacaaggccagcaaaataaacagaattgatagccccaccagaatgtaagggttctgcaacgcggcctgaaactgcaatccggcagcggcaacgatcaatcctaacacggtataagtgagtgccattccctgcacgtaactcattgccaaccagaaaatgcgttttaagctatcgggtcgccgctgccctagaataataccggagatcagcggatacatgggtagaacgcaaggtgtaaaggcaatgccaatcccaatcagcaatgcccataatggtgaaaatggcacgtcagatacgttgggaggggattcttcctgcggcaatgatgccttctgagatgtcgttatgtcaggttgttttgcggcttcattggctgagggaatcgaggcaataacggctgacaatggcacagttattgtctctggagcatagcagaaccccgcttccgcacaaccttggtacgtgacttgcagattggagtcattggaggcagaaaggatagggatgttaatccgtgctgaaccaaaatgaacctcagtcttgccaaaaaactcatcttcgtgatctaccgatttggagaaatcgaaatgacccaacgttgcttttatcggggtgatgatgaactgttttcgatagaggtaataaccgggtttgatatcccagtttagtgtgagttgattgtctttctgctgaaaatcaaacacgaatgcttgagctacaggaagatagcgattttgtcccggcggttcaaacagcgcattggccttgataggagaaatagctatgccgctcaacagcagaagcaatatgagaatacgtttcatcataagataatctttgacctgcctgtatcttggttcataaaatttgccagagttagcatgatatctgagttagaactataactgatgaaactcatggcagaaagcgacttgcctaatattaaggcaataagcgggtcattttaaggaaagggtttgaggcgggaatatttcaggggtgtttaaacccctaaaataacatgctgaaaatttggataattacaggatcataccaccaaccaggaaaccgaatgtcacggctaacgcaacagcaatggtgcccggaatgaagaatgggtggttgaatacaaaacgcccaatacgagtggtgccggtatcatccatctgcacagctgcaaccagagtcggataagttggcaggataaataggccagaaaccgcagggaaagaggcgagtgctgtcagtggtgtgacatgcagcgccagtaccatgggcatcagggccttcgcggttgctgcttgcgaatagagcagagcagagcagaagaagaatatcacagccagcagccacggttgagcatgaatcaaactacccgcagtttctttaatccaacccatgttagcttgaacaaatgtatctcctaaccatgcgacacccataatacagatacacgcgctcataccggctttaaaggtgcttgaatttaaaatagcatcggtattaacagagcagataaccgttgtgagggtggcgatgcttaacatgataatcagtatcgcgctggtggtattcatcagtggtttttcaactaaaccaaggcttgggctgttaataatcgcgtaaataacgatcccaactacccctaacagaaacagcagtacagagagtttagcttttggcttgatatcaactttatgactgccgcgtagttcaatgaggccatctgcaaggcgtttttggtagacaggatcgtcagatagtttggagtcaaaaaaccatgagacgatgaatgacatcaaaataattgcagcaaacgatgagggaatgatgaccatcaacatctgaatatagctgacaccttgcccttccatgacagaagacatataaactacggctgcggatattggcgaggaagtaagtccaatttgtgcggctacgacagcggttgatagtggtcggcagggtttaatgccttgttcttttgcgacttcggcaatgacaggttgtgttgccagagagatatttcctgttccggctaatagcgtcaagcaataagtgacaatgggtgcgaggatagtgatgtattttggatttctgcgcagtagtttttctgtttgttgaactagataatctagcccgccagctatttgcatgacagaaatagcggcgatgactcccataatgattgaaataacgtcaaatgggatgcttcccggtttgactccgattgtggccagtattaaaacaccaagtcctcccgcaaatccaattccgattccccctagtcgtgctcccaaaaaaatggccagcagaacgataactaattctacggctagcatgttatgtactccttagtttatttaatgttgtgaaaatttattgttaaatttttgtattgcggatgaaaataaaaggcactcaatcccgctgagtgagtggattgattactaaaaatcttgtatttcattaagtcatcatcaaaacattttactttatatactggatatttttcgttattaagtaatttaataaagattacatcattacactttgttttaacacaaacttttcgcgtttttagaagtgtaaattatatttaatttttgatataaaagtgagttacgactcataattaggaatagcataaatcatgctatctatagcgttaggcattaaattacgataagtaattttaatgtgaatgctgtgctgctgttaatgtataaaacgttttaatgtgatacttattaatctaaatgttcactaaatcaccttgaggctgtcaaatagcaagagatatgccgtatttttggtagttataatgaaaagtatattataattacctgtattatattttttacgcctatataaatataaatctattatgacttattaatttaaagtaaagtattgccaattataattataaaaatatgcacggtaataacgtaagtaatagtgcttaatatgatgaaaatagcgaatatttaaggggggtatattgcgattaattacaatatacacgatattatcagccataggtgtggctaatattaatgttattgcaataagtaaataattgggaggattaatgataaataagatttaaaaatactattctaatttaccttggttattggttttgaatagttcaatgttatatgttttatttatttttatttttgctcttaattttataaaagtaaaggtggaatcatttatatgatgaattaaaaaggcacgcttccggttggaattgcgtgcctcagtaattaagacgatttcgttattatcattatttaattagtcgtcaaaacgttttgctttataagttggatgtttcaggttctcaacagagaaaatatcatccaattgtgcttcggtcagcaaaccgcgctctaatacgacttcacgaacacttttgcctgtctctgcacagatcttgcctacgatatcgccattgtggtggccgatgaatgggttcaggtaagtaacgataccaatagagttaaatacaaagctttcgcaaacttctttattggcagtaataccgttaacacatttttcaaccagattacggcatgcattgctcaggatggaaatggattcaaacatcgcttgcccaatggctggctccatcacgttaagctgcaattgacctgcttctgatgccatggtgacacagatatcgttaccgataactttgaagcagacttggttgacgacttctggcaccactgggttgactttggctggcataatggaagaaccggcctgcaattctggcaggttgatctcattcagcccagtgcgagggccggaagaaagcaaacgcaggtcgttacagattttggacatcttgaccgccagacgtttcaatgcgctgtgaaccatcacgtaagcaccgcagtcagacgttgcttcgatgagatcttctgctggcaggcaaggtaaccctgtgacttcagccaatttttcaaccaccagcgtctggtagcctggcgcggtattcaggccagtaccaatagcggtagcaccgaggttcacttccagcagtaattctgctgtgcgggtgatgtttttgatttcttctttcaataacacggagaaggcgcggaactcttggcccagtgtcatcggaaccgcatcctgcaattgggtacggcccattttcaggatgtcagcaaattcaacggattttttgtcgaaaccgacttgcaataactcgatggaggtaatcaatttcatgattgaattatagacagcaatacggaaaccagtaggataagcgtcattggttgactggcttctgttcaggtggtcgttcggattcaggtactcatattcaccttttgggtgccccatcaattcaagaccgatatttgccagtacctcattggtattcatgttcagtgaggtgcctgcaccgccctgaaatacatcaacagggaattgatccaggcatttgcctgtgttgaggacttcatcacacgctttgacaataatgtccgcaatttttccagggatagtatggagttctttgtttgccagtgccgcggctttttttaccaacaccatgccacggatgaattcaggcacatcattgatagtacggtcactgatataaaagttttcaatcgcacgcagagtgtgaataccgtaataggcttcagcagggacttctcgtttacctaacaggtcttcttcgatacgaatgttgtttgacatgagaaccttctttaatttggatacgtttttttactgttctatatacgtttttgttgagaataatgtcgccgtcagcaactgccgtgatattaatcacttatcactggattgctggcgcgatcatatgtggatttaccagaaatgccttgtacctggatcactttatagtgcgaattttattaatgaaataacatatgtgtgattgaagtcacgattacggagatgtaaagtcaaaggcctcaagtattgaaaagcgttattatcatccccacgctatgatttacaaattttgtaatccataactatgtcaataaacggtgaacatgcaaatttaagggttgtttactggccatgtagctctttgctaacaatattcaaggggaatattttcatcccaatgattttatcactcattaatgaaaggagaaccacgtgcgttggctcccatttgtcctgatatgtttgctggtttacatcgaatcagtcttgtttgttcgcattgcctctgaagtcggagttttactgactctgctgctagtcatttttacttcttgtgtcggtgtttccctcgtgcgtaatcagggcatcaagaattttatgtcgatgcagcaaaaaattgctgctggcgaaagccctgcgaaagaggctatcaaaagtgtttctctggtgattgcgggagttctgctaatattgcccggattttttactgactttctcggattgctgttgttactgccacccgcgcagaagctgctgaccgcaaaattgctacctcatatcaccttttaccgtccgaataataatgggcgagatggtcagggcggccatcatgggcagacttttgagggggagtatgagcgcaggcaagatgatgcgtcccatacattggatggtcagaaacgtcacgatgaacatggcaacggacaggacaaaaagtaattgctgcttgctttggctgagatttcagtgggtaagaagaaagtgaaatattttttactgtccgccccttgaagtactgcttgcaagccccaacttgtagcttcatggtactggttttattaggctctagtatcaatcctcttacctgatatggactttatttacaggagatctatcaatgaacattcgtccattacatgaccgcgttatcgtcaagcgtaaagaagttgaatcaaaatctgctggcgggatcgttctgactggctctgcggcgggcaaatctacccgtggagaaattttggcagtcggcaatggtcgtatccttgaaaacggggaaatgaaagcgctggatgtaaaagtgggtgatatcgttatttttaacgaaggttacggtgttaaggcagaaaagatcgacaatgaagaagtgttgatcatgtctgaaagcgacattctggcaattgttgaagcgtaattgaacattttgcgcttagatcttcttaattgaacgaatttaaaggaaagacacaatggcagctaaagacgtaaaatttggtaatgatgctcgcggcaaaatgctgcgcggtgtgaatgtattggctgacgcagttaaagtgactctgggtcctaaaggccgtaacgttgttttagataaatcttttggttcgcctgtaatcactaaagacggcgtatctgtagcgcgtgaaatcgaattagaagataaattcgagaacatgggtgcgcagatggttaaagaagttgcctctaaagccaacgatgcggcaggcgacggtactaccactgcaactgtactggcacagtctatcgtcactgaaggtctgaaagccgttgctgctggcatgaacccgatggatctgaaacgcggtatcgataaagcagttattgcggctgttgaagaactaaaaaaactgtccgtaccttgctctgattccactgccattgcgcaggttggtacaatttctgccaactccgacgaaaccgtaggtaaattgatcgctgaagcgatggataaagtcggtaaagaaggtgtaatcaccgttgaagaaggtactggtctggaagatgaactggatgttgttgaaggtatgcagttcgatcgcggctacctgtctccttatttcatcaataaaccagaagcaggttctatcgagctggaaaacccatacatcctgctggttgacaagaaaatttctaacatccgtgaactgctgccagttctggaaggtgtagccaaggcaagtaagccgctggttatcatcgctgaagacgttgaaggcgaagcgctggcaacgctggttgtcaacaacatgcgtggtatcgtgaaagtggctgcggttaaagcccctggttttggtgatcgccgtaaagcaatgttgcaggatatcgctactctgaccaacggtactgtgatttctgaagagatcggtctggagctggaaaaagcgactctggaagatctgggtcaggcaaaacgcattgttatcaacaaagacaccacaattatcattgatggcgtaggcgaagcagtcgcaattgctgcacgcgttactcaaatccgtcagcaaatcgaagaatcaacttctgactatgaccgtgaaaaactgcaggagcgcgtagcgaaactggcaggcggtgtggcagtgatcaaagtcggtgctgcaactgaagttgaaatgaaagaaaaacgcgctcgcgttgacgatgctctgcatgcgacccgcgcagcagtagaagaaggtgttgttgctggtggtggtgttgcactggttcgcgctgctgctgctatctctgctctgactggtgacaacgaagatcaaaacgtgggtatccgcgttgctctgcgtgcaatggaagcgccaatgcgtcagatcgtagaaaacgcaggtgaagagccatctgtggttgtgaacaacgtgaaagccagccagggtaaccacggttataacgctgcaactgaagagtacggcgatatgatcgagatgggtattctggacccaactaaagtcactcgctctgcactgcaattcgcaggttctatcgctggtctgatgatcacgactgaagcgatgattaccgatctgcctagagacgacaaagctgacttaggtggagctggtggcatgggcggcatgggtggaatgggcggcatgatgtaatgctgttgatcctggtgatggaattgcccatccaaataggataaaaactttgaaggcgagcagaaaaatctgctcgcctttttacttttttgtcttaatggaatacaaaagagtctatttatcatcacggtagaatttccaacaataatggggaaagacatgcgaattaagatcttactcggagcgtcaatcttactgctggctggatgtacaacgaacaatcaattaacggccgcaggttccaatgtacgttttgtggatactcagccgggcagtgaatgccagcgattgggcgaagtgataggtatgcaaagcaattggctcaatggtattggcaatgaaagtagttcaatgcgcaatgcggccaatgacttgcgtaataaagcggcagaattgggtgggaacgtcatttatggcgcaaacagtccacttagccggacagaaaacttgttgggcagttttgtgccactcgatagcaaaatggtaggtcaggtttataagtgtccataagtatcgacaaaagacagaggcttccctgtactgtaaatccttattgcgtgaagatagatcatttacagtgttattgtttgatttaataaacagtcagttagggcagcagccagaaaaacgtgacagagcatggttagctctgtgtacgttttagtttctggcgttgtccgttcctgaacgtgtctaatgacgacgcttgccaacattatcaattgatcaattgttttgcttcaatcccaaatccagaggggttttgctcggctcaccgccaatttctcttgtcaggcacggaactaaataaccggatattttagtcagtaattcccgcatgatagcttttgcttcttcatcgcctaccagaaagtgtgcggcaccttgcaccttatccaatatatggatgtagtaaggcaagatacctgcatcaaataatgtattacttaaatctgccagagtatctgcgctgtcatttacattacgcagcatcacactttggttcagtagcgttacgccagcctgttttagccacatcattttgtcgcgaaacgtattatcaatttcatttgcatggttaatatgagttaccataactatttgcaagtgtgattgtgcgaaacgattacacaatgaaagtgtgatcctatcagggatcaccacgggcaaacgggtatgaatgcgtagccgcttgatgtgtgaaatggattcaaggcgagttatcagccagtccagttcgtgatctttcgccatgagaggatcaccgccggagaagatgatctcatcaagctcagggtgctgttcgatgtaatccagtgcgagttgccagttgtttttgttgcctttgttatcctcataggggaaatggcgccggaaacagtaacggcaattaaccgcgcatccccctttgaccagcagcagggcacgattgcggtatttgtgcagtaacccgggaaccgcactgcgttgttcatctagcggatcggttaaaaaaccagggtgagtttcaaattcttcccgtgcggtcaggacttgcaataacaatggatcatgaggatcgccttttttcatccgtgctgcaaacgctcttggcacacgcaggggaaacaaacgcttcgcttcattgccttctttcagcatggcgtgcgtatttaaggataataattgcagtagctcattaggatcagtaatgacatctgcaagttgttttagccagacttctctggcagggggaatatgggttataatgtgtgccattttttggctaagccattttgttaaaaattagaggatctccatggctacttatagtaccaacgaattccgttcaggtcttaaaatcatgtttgatggcgagccgtgcgctattctagaaagcgaatttgttaaaccaggtaaagggcaggcatttgcccgtgtgcgtcttcgtaaactgatctccggcaaactgctagagaaaaccttcaaatcaacggattccgttgaaagtgccgatgtcgtggatatgaacctgacctatctatataacgatggtgagttctggcacttcatgaacaacgagacttttgaacagttggctgcggatgaaaaatctgtcggtgacagcactaaatggctgatcgatcaggctgaatgcattctgaccctgtgggatggacgtcctatttctgtgactccaccaaactttgttgaactggaaattactgagacagatccaggtctgaaaggggatactgcaggtactggtggtaaaccagcaaccctgagcactggcgctgtcgtgaaagttcctctgttcgtacaggttggtgaagtgattaaagttgatactcgttccggcgaatacgtttctcgcgtgaagtaatcgcatttgctattgaaaaaaccgcagtatcttcgtttagaggctgcggtttttttattggtggtaatcaggcgctatcattgcggctatcagagaggatagctataatccagcggcatttcttattgttttccgggacgacccggacaaatatcatctcatcggggacgaccccattgccattttgataaaaggaaatggtatgtcttggttaattcttctggttgcgggtttgcttgaagttgtgtgggcagtcggccttaaatacactcaggggttttcccgtttgatgcccagcctgataaccatcagcgcgatgatggtcagtatagggttattagcctatgcgatgaaaaatttacccgcaggaaccgcttatgccgtgtggacgggaattggcgctgtaggaacggcaattttcggtatcatggtatttggggagtcagccaattttgccagaatactgagccttggtttgattgttgcaggtattattggtttgaaattaacaagttgattgtttgtaaatgaacccagcgtatgctctgagggatccccacaaattagcgctaataaatcaaaaccatgttttggtagattttggcgagatatttgagtgtgttattaagaacgatttcaaataatattagcggggaatgccgtaatacattctccgctaatgtaagatgagagataactcgccttgatttaatactatttgcctgataattaagatgtattcctttattttcggcataaaaaccaatcagccaaagtacaactgaactcagtgtagcaagtagactcaatactgataaacgaccagtaccgtggctataacttgctctaagaccaaatccaaaacgttcactcttttcatccctaaaattttgctctatttgcattcttcggctgtaaattttcataacctgacgaggtttaaaatcatccatactagtaaaaataagccaaggttccattgctgccgaacgtccatctttgacctgagattttcgtaccattcgatatcgtgattttttgaattttctccctttattcggtcttttatgaagataaaaataaccatcgcaacgtgcatattctgcttttgataatgtgccaaaccctaaaaactgtggggttgtagttgcttttaaagcttgccgtttaaaccaaagctcaccctatttttcaagtcttagttgagtatttcctcgaatgcgtccgacgaaatcccaaccgagcgtttttatctgtttgaaccctgcattttgaaaacctgcatccgtaacaataattactctagctttagggttaacagcactcgctagcatgtcaagaaatgcattttggatggttacattttgttgttcacatgagggaactatttgacttaacaaaggaattgagcgtccatcacaaattcaactcgcacggagtacatgatgttcttgtgagggatatccactccaatcaacagctatgacacacaatgagagtgactcagtcagcatagcaataatattacgaaagatatcaggaatatccctatgaagagcttcattaccgagtagccgatcaatacgtttaattttatgtttgacgtgagcgtttcctggtaaaaagcgcccaatgctggttaacgtaagagaagcaccattaatcaaagcgatagtggcatcgattaatgcattctgacgatatttatgaaatggtgataaagcatctttaaagaagttatgacatatttcacgtacaggcatagcagtgaccttattgacttggtggaacaatcagtagatcacacaacgctatgcctgtctattttctggggattcctcagagcgtatgctgggtctaatttcaattattttttgacgtagcgtgaaggccatatttcttctgg

SEQ ID NO: 16882 - DNA, 2122 bp, Xenorhabdus bovienii
  unsure (1)..(2122): unsure at all n locations
nnnnnnnnnnnnnnnnnnnnnnnnnnnnnnnnnnnnnnnnnnnnnnnnnntgagtgttattgaatcatttccaccgacagagagcacatcggaaccgttttggttagctaaacgaatggttttattttcaccgatatatttccattgcgttttaggaaaaagagtatttggatttttattctgagcaaaccatacaactattcctacaggatatagcatatctgcaatatcatcttccgttaatattctcttttttccttgaaatttaccatttttatcaaatgcataagtagatatgccgaatccatttgaatcacttccataggaaaaagaaatacctcttgcatgttgaggtccttctacacttggatgagcaacatgaattgctaagtctccaaggttatccatcccattaggccgtaaaaaaccagaacgccctaaatgacgtgaattagtgtcttccagataatttgcagtcttagataagatataaccggatgtttttgtattaacatttgagcgaataaaacgattgtctgattcaggtttggtatagctttcatcagtaaatgccagttctctaacaggggagttggcgttacctgaattatttcctgctactacttttacgcgagcagtagaatagtcaacagagagcgatgcataagtatcactagctttcaatagaacacccacaccatatgtgaatgtatattttgaaggagtagaatttctgaaaaattcagggctagcattatttctacgtacccatgctaaaaaatcattgtcatttttgctaagaactgtcccaccatctccaccaaatccaaaactgcctttcggcactgcgttttttgcccgatccacggtttccgctaaaccgaggttttctacaatacctagtcccaacgatttgacactaaaatccctccccatataccttgaaaaccaaaaaacaacgtctcaaataagccacttttggctatcaaaaaataaccaaaatagcaatttgcttataaaaatgtggataagtataaataatgaactgattggcgtgtgaaaagcaatcaatttgagtgtgttatttgagcaatctgaatttctatccaacaacacctgttgaatatcctcaaaaacatcctgaaaattaatatttattcgtttaacaaattgatttaaaacaaagataccaaaacacatttgtatccactaccacacatttcccatcgaatgatttcccccacccaatccgtcaatatagcggcacaccttaacaggagaacgctaaaatggcacaagattatcatcacggcgtccgtgtacaggaaatcaatgaaggtactcgcaccattaccacagttagcacagctatcgtgggtatggtttgtactggtcctgacgcagacgaaaaaacatttccattaaacactccagttttgattactgacgttatgagcgccagtggcaaagcagggaaaaagggaactttgtactcatcactgaaagcgattgctgatcaggctcagcctgtcaccgtcgttgttcgtgtggctgagggcgaatctgaagaagtaaccgtttctaacatcatcggtggtgtcactgatgcaggtaagaaaacgggtatgcaggcactattggcggcgcaaagccagctcggtgttaagcctcgtattctgggtgttccgggtctggattcaaaagcagttgcgattgaactggccagcgttgcccagaaactgaaagcaatggcttatgtcagcgcttatggcagcaaaaatatctctgaagtcatcaaataccgcgacaacttcaatcagcgtgagctgatgctgatttggccggatttcttgagctgggatactgtttccaatagcgagtctatcgcttatgcaaccgctcgtgctctgggcctgcgtgccaaaatcgacgaggaaactggctggcacaaaacactgtccaacgtgggtgttaacggtgtaaccggtctgtctgctgacgtcttctgggatctgcaagataccgcaactgacgctgatctgttgaacaagagtggcatcactacgctgatccgcaaaaacggcttccgtttcnnnnnnnnnnnnnnnnnnnnnnnnnnnnn

SEQ ID NO: 16883 - DNA, 9508 bp, Xenorhabdus bovienii
  unsure (1)..(9508): unsure at all n locations
tctcgtctggtgaacaatataccaaagatctcatattgagatcaagcttttattttgacatcctcagttttgatttcaaaatcatcaattttaagttcgagatccaacgatgttgtaaagccactgtcattaagattgtgggtgactttgatgattgtccagctagtcccattaatttccggcttaaatccttcaatatgaacgggtgtttcagggtaaatgtcagcgcgtccctttgctaaggcgatagaaaactccgcagccccccgctgcatcttttcccaaacagctttggcagcacgttccgcattttccttgttagaatatacacgggagagtgtcagaacattttcctcagctcccaccagatagttttcggactttttctgtacctttgttgtttgatgatgctcagtcgttgatttgctctgcttctcagaagatagacttcccccaatatcgatgttcttttctctatcgatatttctgttatctctgttttttcttttactttctttttgtccctttttaatgtaatcgggcttatcctttacttttgttttgtgacttgttttatggcttttcttcgtcaaatcgatgccttttttcttctccagattgaccacaccagtcttagcaggtttagcggagattacttcacgaggagactcaattttacgatctttttcctttttaaaggttgaggattcttttttctgggcagaatatttctcttttgggataagatttttatcttcttgaacaggaatttcatctttttggacagggtttttgtcttttttagcgtttcccttgcccgatgatttgttctcgctgcttccatattcaataataatttcaactttcccgctctttgattctacccgcttcaatttaaccgtctgcttagtggttgttcgtgtatcctgccattgggcaacaacaccggtataggcttcacggtcagacagagaaaatcgatgactatctcctgattcacgagtaatcagcacaggcagaatattctcaccactcccggtcttattttgtccttggcggataaacaacaactccccatttttgaccgaagcaatcgccccttcttgctttgccacccgtgtcaaaaagctcacgtcagattcattggtctgatcgatgtgcatagagatacccttcaattcctcgctgattttaaatgtcagttggtttctcgcagcaatcgtactcacaatgctctctaaagtgtgttcatggtaagactcttcgcgtttaacattcagatcacctcgaaaatcagcactgcgggcacgaattgtcagccgatcaggcgcaccggtatgttcaatttcatcaacgacaaattttccctttggggttaaggagtcgccatgccaccccaattccaattctagaatatcgcctcgggaaggaaatataagttttccatccgcatcatccaactcaatatcgagctggtctgattccaaaccgcggttatccgtcagcgttaaagacattaaacgcgattggattttccctgtaatatccttcttattagtttccaaccgaaaagctggcgcaccttctttaccagtgaccaaatcaaattggggaatccaatctgtgtttggtatcctctgtttaagatctagcattaggatgctccttaatttcacctatggcctttctcgtaagaccagaaggcttatccagtgatttaggtggtttgccttttatatcagataattgatcctgcaaatcacccaacatttcaaacaaattgttatcaacgcgccgtaaggtcagtgtaaaactgatttttctggccgctccgcccgacataaattccgtttttgtctcatcaatgctttcgataacgaacattccataaattgcgccacttccatcaatgaaagaccatgccttaccgctgtctgccatcaatttcaatgcaaacagtgaaagagaaccgcctgtcagttcaggataaagttcccccgatagcgtgatcgtatcattatctgaaccaataaattgccatgcaggccgtgctcccacacggctattgaaggcatgtctccaactttgtttatattggaaactttggtatggcgttgttttcaacataaaaacaaataaaccaagtgcagccatcatgagaaatcttctcctctatcagaaagtgagctacgcatacgggcttgctgcatacgttcccgttgttccaattcctgcctgaccacacgggcaatatcctgcgcggactgtccctgagcgccatagacatagatgttatattgtggtaccccgctagactgcgggggcaggcttcgttccttcttcgcctgaacagcctcataagtgtgagcaggcagactttgcgcatgcaacggtgcatcctgtgcggcaataggcaaagacattgaactaacggcaaatcccacagcagcgagttttgccgtatttttccggctggttacattggctgggccgctaataatttcagggccacgctcccccacaatgccgaattttccggctgaaatagatccgcctgtatcatgtttagtaacttgtgctgcttgttgcgtagtttcgctattagttatttcctgtgatgcttttacaactacttcctttttatcatcacctgaccaccacgatgtgaatatgtcagtaatagcggaaattttacccttcaaggcttcccatttttcttgaatacccgttaacaagctgtcgatcatatccgaacccgctttctttaatttctctggaatagcttgaacatcactaacaatttcattccatctatctgaaattgattttttgatgctttcccagatttccaaagtattctgtttcacggattcccaagcaccactgatttgggctttgatattttcccaagtggcaagaacgctttgtttaatagattcccatttctcacttaataaggctttaatcgcttcccaaacttctgaagcgctttgtttaatggcatcccagttttggtaaataatgccgatcagtcccccattcatgaaaaagttcttgataccttcccatgcggcactgactatgtctttaattccctgccatgcattgctacagacattcttgatgctttcccacaaggctgtgaattttggccccaacgttccccaattctgccaaatataaatagcagccattgcgataacaccaataatggcaagaatcgggttcgccatcatagcccgaccaatgaacattattgattttcctaatacacggaaagtactacttaaaaaagacaggccttttacaccaacatttgccagaatatttataccattacccaaaacaccaaaaactttttgaccaatattccctaatattcccaggccttttctttggtttccaaaagtatcttgacctcctttgttagatagcaaatcagcaccatcattaagtgagccaaaaactttgtttccggttttaccaaaaaaatccatggcggctcttagcgcttctaaagcctcagttcccaattgtgcgaataccttcaagccatctcttaaattctccatagcctgaatacccacctgcgcaaatttattcagattggctcttaattcttccagagcctgaacaccaacctgagtaaatatatccagactggatttcaatttatccagcgcctgaacgcccagctgagcaaaaaaattgaggctggcttttaactcttccaaagcctgcatacccaatttagcaaatacatccaggggagctgttaatttatccagtgcctgaacacccaactgcacaaatgaatccagtgtggattttaatttatccaacgcctgagttcccagctgcgcaaatacatccaggggagctattaatttattcagagcctgagttcccaactgcacaaatgcatccagtgtggattttaatttatccagcgcctgagttcccagttgcgcaaatatatccaggggtgcggttaatttattcagtgcctgaacacccaactgcacaaatgaatccagtgtggatttcaacttatccagcgcctgagttcccagctgcgcaaatacatccaggggagctgttaatttattcagagcctgagttcccaactgaacaaatgaatccagtgtggattttaatttatccagcgcctgagttcccagttgcgcaaatatatccaggggtgcagttaatttatccagtgcctgaacgcccaactgcacaaatgaatccagtgtggattttaatttatccagcgcctgagttcccagctgcgcaaatacatccaggggtgcggttaatttattcagagcctgaacgcccaactgcacaaatgaatccagtgtggattttaatttatccagcgcctgagttcccagttgcacaaatatatccaggggtgcggttaatttattcagtgcctgaacgcccaactgcacaaatgcatccagtgtggattttaatttatccagcgcctgagttcccagttgcacaaatatatccaggggtgcggttaatttattcagtgcctgaacgcccaactgcacaaatgcatccagtgtggattttaatttatccagcgcctgagttcccagctgcgcaaatacatccaggggagcggttaatttattcagagcctgagttcccgactgcacaaatgaatccagtgtagattttaatttatccagcgcctgagttcccagctgcgcaaatacatccaggggagcggttaatttattcagggcctgaattcccaactgcacaaatgcatccagtgtggattttaatttatccagcgcctgagttcccagttgcgcaaatacatccaggggagcggttaatttattcagggcctgagttcccaactgcacaaatgcatccagtgtggattttaatttatccagcgcctgaacacctaattgtgcaaagaaattcagactggcttttaattcttcaaaagctttaagccccaactgtgcaaatgcatccagactggattttaatttatccagcgcctggattcctaactgtgcaaagaaattcaaactaactcttaaggacaccagagcctgaattcccaactgcgcaaaaatattcagactaacttttaaagatacaaaagcctgaatacccaactgcgtaaatatattcaaactgactctcaaagagtcgaatgtttttataccaacatttccaaatagttgtatataaccaaccaaagtttgaaatactacttttactgcaccagtagttacattcaaaacagcattaattttattcagaatactaaataaaattgttatctttggattgatattaatgaccaacttatctaacaatgtgaaattgttagtcatattccccgttacaccaagattaaattcgctttttttactggatgaattttcctgtttgataatctgggtagtttgaataatattagctgattgactggcagcactaacctgcatcgttcttgtcgaattttgccgcgcagataaagattgtttaattgtttgattataggctttaagatcggtgcgtatacgcgcagtttcctgcgcataacccacgataggctttaagctctcaacggtcttattgagttttttgaactggttatgaattttatcgactgaattttccagctttttattatgccgttgaaaagatttaaaggaaccggtcagctttccaacggtactcagcaccttgtttagctgtgactgtatattactcattttctgcaccacttcttaaaatggcccgatgtcgccaatccaacagttccgacaatgacatttcatctgtcactgccggtgaccagtgaaaaacggtggcgatatccgccaccaattcatcaacggttaattgttctgggaatcggacttgaccgacttcggcaacaaaaaattgaccacctccacactgagattaatcagatcaccaggtgacatcatcattaggtcatttttggtcaatacaggagtggtaacacgcggcaggacaagcagcatagaatccacatccatttccagcagcgcctgtaaacgtgcaccgcgcaacgcaccactggtaggtttgcgtaccatcacttccgtgatttcgccgttacctcgcgccaatggagcttccaattcgatggtgcgcagatcgtcattttgagtgttcagtgtttctgtcatggttcaaccttgtttatccgattaaaaacctgtcccagcaggcatggttcaaactccgatgagacaggaaataagttttaaaaaatctaattgctaaaaaagcgattaaaaaagaccgatattgcggcgatgctgctccaggcgatcttctccgcccactttctcaaccatgttgatggtgtcgatttcaatcagctcttcgccatcccatgtcagtttgaaataagtgtttttcgcggtgattttggtctgagagttatcaccttgtttataagtgccgtgatcaaactcctggaagcgaccacgcatcacaacttcaaccgcaaccacatcaccggtatcttcgcgctcaaaagagccagcaaagcgcaacataacgccatctgctgtcgcaatgccccactgcttatacagttgagattcaataccgcccagagtgaattccgcatccaatgcgccttcatccagacccagatccaccattgcgctgccgttcatgccggcaccacgataagcttccagcttgcggcttaacttaggaagagtcaattcttccacgatcccctgatagttgttgccatcattgaacaaattcaggtatttaagtttgcgaggtaatgccatcagttagccccttatttattgatacttttagcgaaattcatcaggtaactatctgtaatgcgctggcgtaacatcatgttttccagtggcggtacaggtgtatagtcgtaatcgatagtcagtttgcctactttcagcgtgtctttatcgttggctttttcgtcataccagcaacggccatcgatgatgtaaccaccagatttcagttcgcgaaacttggcattaataccttcgataatgtcgcgtaccagtgatggtgtcagtggtttgtcgattgcccacatatgtgcatcagccatggtgtcagccagaacttgagcggtacgggtatagctttcgaactggaacagtgcgtcatcagagcaagtacgggagccccagaaacggaagccgtttttgcggatcagcgtagtgatgccactcttgttcaacagatcagcgtcagttgcggtatcttgcagatcccagaagacgtcagcagacagaccggttacaccgttaacacccacgttggacagtgttttgtgccagccagtttcctcgtcgattttggcacgcaggcccagagcacgagcggttgcataagcgatagactcgctattggaaacagtatcccagctcaagaaatccggccaaatcagcatcagctcacgctgattgaagttgtcgcggtatttgatgacttcagagatatttttgctgccataagcgctgacataagccattgctttcagtttctgggcaacgctggccagttcaatcgcaactgcttttgaatccagacccggaacacccagaatacgaggcttaacaccgagctggctttgcgccgccaatagtgcctgcatacccgttttcttacctgcatcagtgacaccaccgatgatgttagaaacggttacttcttcagattcgccctcagccacacgaacaacgacggtgacaggctgagcctgatcagcaatcgctttcagtgatgagtacaaagttccctttttccctgctttgccactggcgctcataacgtcagtaatcaaaactggagtgtttaatggaaatgttttttcgtctgcgtcaggaccagtacaaaccatacccacgatagctgtgctaactgtggtaatggtgcgagtaccttcattgatttcctgtacacggacgccgtgatgataatcttgtgccattttagcgttctcctgttaaggtgtgccgctatattgacggattgggtgggggaaatcattcgatgggaaatgtgtggtagtggatacaaatgtgttttggtatctttgttttaaatcaatttgttaaacgaataaatattaattttcaggatgtttttgaggatattcaacaggtgttgttggatagaaattcagattgctcaaataacacactcaaattgattgcttttcacacgccaatcagttcattatttatacttatccacatttttataagcaaattgctattttggttattttttgatagccaaaagtggcttatttgagacgttgttttttggttttcaaggtatatggggagggattttagtgtcaaatcgttgggactaggtattgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaaggctccattgatttaacactcatcaatggcggtagaactattaaagttatttttacgcgaaaagatacacgattatggcgtatagacatttgggattaggtttaaatattagggtgttatagccctatattccttaaacctacctgtagtttgtctttttgaatgattttatacgcagcctatgtcacccttgtttcaccatgctgacccacgacaatattccatggccggagcagccgaagtaaatacaggggctatgtatcgcaccccaaaagttggacgctatacttcaacttaagggatgctttttatgaagaagaaaagatattctcagannnnnnnnnnnnnnnnnnnnnnnnnnnnnnnnnnnnnnnnnnnnnnn

SEQ ID NO: 16884 - DNA, 893 bp, Xenorhabdus bovienii
  unsure (1)..(893): unsure at all n locations
tattccaatacctatctaatatcatatggtttcttctatttattccatattcccggattgggaataacatatttgagaaatacgcttaaaataaaaaataatatcatcacattcattaagtagacatatataccatttatatatgttatttacgtatatatagtgccatgctaatatgtgtacacaaatctcactttataatgatatatacccatcgtcattgaagatgcttgattttttattcgtatcagatcaagatcgcgcccatgacaattactctgacagatgcccaaaaagaagccctcgaattgatgcacgatacgactcgtgatgggcgtgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacaaacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgcgggtaaacagcaacactttattgagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccggacctgcaggcatcaagcttcn

SEQ ID NO: 16885 - DNA, 2000 bp, Xenorhabdus bovienii
  unsure (1)..(2000): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccaatcatcgctgctataaaaagcagtcaaaatattattcatttcatcaagatcaccaaaagcacgaatcagataatatgaatcagagttgtgtaatgaattaagtaatcaagagtaattaattgcaaatttagcaccataaccttccaatagagtatttagctcatactccacggtatcctgagtccaagtgataaagcgtcgccagtgatatttggcttgtttccagatgatttcaatcagattcagctctgggctgtaggcaggaagataaaataaaagcaggttgtgttctcgtaaccagcgatttctgatttttttctctatcccatgatggatacgcgcattatccaacactaaaaatgtcaggcggttgtccccttgtttggcgacctgctctaaaaaatcaatcacatcagctcgtgtgatactgcctgacggtgcctggtaaaacagcgtgttgtccgtgtaatttaacgcccccagaactgaccgtctgtcatggtgttgaggctcagtttcatggggtttaccccgtggactccatccatattgcaccggcggagaggcggcaaaaccggcttcatcaaaatagaccagacggtagcggcctgcccgtgcaccggccttaatcttatccagcaagacggattttttagcgaactccgtttcatcgcgttttttttaacgacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16886 - DNA, 920 bp, Xenorhabdus bovienii
  unsure (1)..(920): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataagcggataataagcggataataagcggataataagcggataataagcggataataaggcagataataagcagataataagcagataataagcagataataagcagataataagcagataataagcagataataattaatgttttttggatttaataaatagcagatatgattttatatctactatttattgacgtaataattaaccagaaattaatttttccaataagggtgatctgaatagatgatgaggatcatattgttgcaatgctgcaacggatgaagcccaatgattatcagcaggcaagccatcattaaatgaagccgggatnnnnnnnnnnnnnnnnnnnnn

SEQ ID NO: 16887 - DNA, 96723 bp, Xenorhabdus bovienii
ttgcatgcctgcaggtcctgtcctccgggtcgtgaggctgcgtatcttacgctttcctctccgagtgtcaagcctttatttccgggctgttctctcgctgtccgccgcggcgtgtcttcgctcagcgtcggtcagtggtggcgcattatagggacttttcgccgcctgacaatagtttttttgaattttctttccgttcgtgttttttttcctcaaaacgctgtaacaaccagcaaaaaggctatttttgagactctttttcacatgatatttgcagaaacttcccagaaaagagatcgacctgctcccaatcagtgtattcaatctcttttgttgtatcagtttccccacctgtcatcctcataataaactgaatcatgatgcgatccagccaacgatagcggggataaagcaacgcaccagcaaagacatcacataaatttggcttccaagggcttttcatcaagaacttgcgtatataagcattggtttctggtgttctcttttctggttttctcgccgttagattgacaccgaagaacgccgtcggcatttggttcaattgtttttggtgtcgaatagcgaactgatgtaatacggaattaaaatggccatagcgtatcgacgcccctatcatcactttatgataaggtttcagattaatgtgctttattgtagccagatctcttaagtcacactcagcacccgcgcgacggagattctcagcgatacaagtaataattttcttagtctgtccatcctgggtggaataaagcagtaaataattcataaatacaccttttttaaacaacgactcatcttcacagttattcacgccaaaaagtcggtgtgaacagaactaatagagtgaaaacttccaaacgtccaaacagcatggttacgaccaatatccatttagccgccggattcatggtggtaaagttatcagagacggctcccaacccgggccccaagttattcaatgttgcggctatggcagaaaaagcggaaaattcatcaacacctgttgcaatcagtaacagcatgctaataagaaaaaccagcgcataagcagaaaagaaaccccatactgcttcaataattcgctccggcaatgctctttgtcccaatttaatggtgtatacggcgttcgggtgaaccagacgttttagttcacgggagccttgcaggaacaacaacaagatgcggataactttcaatcccccacctgtcgatcccgcacatcctccgataaatgcagaacataagagaagaaaaggcagaaacagaggccaattggcaaaactgactgttgtaaatcctgctgtggttgccatcgaaaccacttgaaagaaagcatgattcagtgcatctaatcctgattcgtaaacggattgttgccacaatatcagcacacagatcaccagtaatgccaattggatggtaatgaacatgcggaattccgggtcacgccagtaaactttcaaacttcgtccggaaagtacggcgaaatgcaaaccaaaattacagccagagatcagcaggaaaatcgcaataatggtattaatagccgggctattgaaaaaaccgatgctggcatcatgtgtcgaaaacccaccaatcgcgattgtagaaaaactatgggaaatcgcatcgaatatcgacatgcccgccgcccataacgctattgcacaggcaatggtcagcaagacgtagatcagccagagtgtttttgcggtctccgcaatgcgggggcgcattttattgtctttcaacggccccggcatttctgcccgatacagctgcattcccccgacaccgagcaagggcagaatcgcaacagctaatacgatgatccccattcccccaagccattgcagcatttgtcgatagaagaggatagctttcggcagagagtcgagaccaataagcgtggttgcccctgttgtcgtcaagcctgaaaatgattcaaaaaaggcatcagtcactgaaaggttgggtttctctgagaaaatgaaaggcaatgcaccgacacttcccagaactgtccagaacaggacaacgatcaaaaatccctctttcggtttaagatcatgtttttggttccgattaggcacccataacattaaaccaatcacgagagcaaagataaatgtctggctgaatgctctacccgcgccatctcgataaatcaatgccaccaatcccggaataatcattgtgacagagaaaagaatgacaagtagcccgacaatacgggttatggcgcgaaaatgcattcggctggttcctcaaaaatccggtaggacaaaataattatgattttggtgttaaaaacagagcaccacggcttaagtcacgtaatttatcacctatctcccccgcaagggtagctggcagtgaaacttgcaatgtaacgttttcagcatattcactggcaatcacttgccctgagaatttttgtagcaattgttccaccatcgagatatgggcatatccacactgcaattgatacagtttctgcggtactttgtattctgtttccagtaatttcagtgcctgctgcacaccattgccataggcttttaccaatcctcccgtgccaagtttgatgccaccaaaatagcgaactgacacggcagtgatttctcccactccgcttcctattaattgcgcgatcatgggtttaccggcagttcccgtcggttctccatcatctgaaaaacctaattgctgggagtcatccggcgcacctgccacaaaagcccagcaatggtgtcgggcatccgggtattgctccttgatgttctggataaataactttgcctcattcaccccgctggtgtgttccagcagagtgatgaaacgacttttctttatttcttcagtgaaattgactgaagccacagggatcaaataaggcttcattacgacaactgtaaatctctggtcatattttcaatttttccatcgtgaataacgatgttatcttcaatacgaataccaccataaagcttaaacatgtcgatttttttccaatcgaaatgtttgctgtattcattttcacgccacggtgccaataaagtttcaatgaaataaatacccggttcaatggtcaaaaccatcctcggctccaaaatacgtgtacaacgcagataaggatgtaatgtcggcgcggccagatgggttccggtatcatcctgcatgaatccggcagcgtcatgcacctgcaaacccagtggatggcctagcccatgtgggaaaaatggcgttgtcagccctttctcaaccatagtttcttcagtgattccattaatgattccgtgtttttttagcaacttggctatgcgacgatgcatattgatatgataatcggtataccgaatacccgccttgatcgagccaataatcgcttgttgttccccatttaaatctttaatcagtgaagcgaaatcgttgttatgttttgctgcataagttctggtgatatcagcagcgtagccattatattctgcaccagcatcaatcaagaaactgcgaatttcagaaggtacagtctgttgtaatttggtgtaatgcaagaccgccgcattttcattcagggcaataatattattataagggacatctgtatcgcggtgccctgttgccatcaaatagaacatattgatttcgaactcgctcacaccagatgtaaacgcgtcgtatgcggccagatgaccattcacggcagttttctgcgcttcacgcatacaaaccagctcgtaatctgttttatatgagcgatggtaactcaaataatccaagaccattttgggattgatattgtattcgagaatacccaaatcctttgcacgctcagtctgctcaccaatataagctgtattctgttttgataagccactcaattctgctttgatatcatcggcttttgccagatggatcaactcaacttcttcagtccagtggctattgggcaaagcctccacgctatgccaataatccacgggagaataaaaccagagtttaggtttattcacaccatcaatccataaccagcaattgggtactttagtcacaggcacccaagccttgaagtgtgcatttaccttgaaaggataatcgcagtcatccagaaaaacacgtaatgactcgccagagtgaataagtagagcgtcaagctgatttcgtgtcagtatttcgcgggcacgtctttgtaatattttaatatgttcgtggtacagggatgccaacttttccatcttcataaaccttttgattatctggcaggagtataaatcttaccacaattcattatttttggtgtcaccatggggaaatctcaccttagcgcagttgactaacaatatttatatttttcataactataataaaaaatattgtcgtccatcataaatcttccctgtgatccgctctacaaaaaattcatcattggtttgcattcgattaacacactaatcacaatcaaccgtatctggtcataccagatggtatgcactcattgaggagattgacatgctctacctaagtgacactattcaagtaaactggctgaaagatggcattgcagaactgatcttcaatgcaccagctgcaattaataaattagatacaaaaaccgttgcttcattggataaagcggttgccgtccttgagcaacaaactgaattaaaagggctgttactacgttctgaaaaacaagcctttattgttggtgcagacatcacagaattcttatcattattcgatgcaccaaaagaaaaacttcaggaatggctgaagttcgccaatgatattttcaaccgtattgaagatctccctgttcctactatttctgcgatcaacggctatgcacttggcggtggttgtgaggtagtattgtcaactgactttcgtgttgcatccccagatcttcgcatcggattaccagaaactaaattaggcattatgccgggctttggtggttctgttcgcctgccacgtttaattggcccagataacgccctcgaaattattacagcaggcaaagatattggtgcagaagacgcgctaaaaaatggcctggttgatgccgttgtgccgactgaaaagctggtagatgctgctgcttctattctggaacaagccatcaaaggcgatcttgattggcaagccgtccgccaacctaaactttccccactgaacctcaatgatgttgaacgcaccatgagcttcaccgtggcgaaaggaatggtgatgaaagtcgcaggcccacactatccagcgccaattactgctgtaaaaactattgaaaaagcagcgacattgggtcgtgatgaagccttgaaactagaagtagaaagttttgttccactggctcataccactgttgcccgtgccttggtcggcatcttcctaaatgaccaatatgtcaaaggtctggcgaaaaaacatctgaaagaagtcacagtgccacagcatgcaacggtactgggtgcaggtatcatgggtggtggtatcgcctatcaatctgcacgcaaaggcgttcctgttctgatgaaagacattaatcagaaagcgctggatttaggtgtcaatgaagccgctaagttattgcataagcaatttgagcgtggacgtctggatgctatgaaaatggctaagattctgtcatccattcaaccaacactcagttatgcgggcattgagcaatctcagattgttgtcgaagccgttgttgagaatccgaagattaaagctgcggtcttggcagaaacagaatcacatatcaacgatgattgcattctagcctccaatacctccacaatcccaatcaccgaattagcaaaatcactgaaacggccagaaaatttctgtggtatgcattttttcaacccagttcaccgtatgccgctggttgaaatcatccgtggagaaaaaacctcagacaagaccatttctactgttgtggcttacgccagcaaaataggtaaaacgccgattgttgtcaatgattgcccaggctttttcgtcaaccgcgtattgttcccttatctggcaggcttcggcatgttactgcgcgatggcggtgatttccgtcaaatcgacaagatcatggagaaagagtttggctggccgatgggtcctgcgtatctcatcgacgttgttggcattgataccgcccatcatgctcaggcagtcatggcacaaggttttccagagcgcatgactcgcgattatcacgatgccattgatgtattatttgaaaatcagcgttacggccagaaaaatgacgtgggtttctataaatacactcaagacaaaaaaggcaagccgaaaaaagagcaggatgaaaccgtcgatcaactgctggcaggtatcagtcaaccgaaacaggttttctctggcgaagatatcattgcccgtaccatgatcccgatgattaacgaagtcgttcgctgcttggaagaaggtgtcattgccagtcctgcagaagcagatatggcgctggtttatggtttaggcttcccgccattccacggtggtgttttccgctatctggatacgatgggaaccgcagcttatgtgaaactggctgaacgttatgcccacttaggcgcaatgtatcacgttcccgctggcctgaaagcgaaatccgaaagcaatgaaagttactaccctgtcgcagccaaaattgctgttaatccaggtgaaaaagcgtgaggtctgaaaacatggaaaacgtagtcattattgatggtattcgtaccccaatggggcgctcaaaaggtggtgtattccgtcaggtccgtgccgaagatctctccgcacatctgatgaaatcaatactcaagcgcaacccgtcagtacagcctgagcatatcgacgatatctcttggggatgtgtgcaacaaacactggaacaggggttcaatatcgcccgtaattccgcattgctggcaggcattccccattcggtccctgcggtgaccgttaaccgtctgtgtggttcttcaatgcagtcattgcatgacggtgctcgcatgattatgactggcgatgccagtattgcgatgattggcggtgttgagcatatggggcatattcccatgactcacggtgtcgattttcatccgaaattaagccgcaatgttgctaaagccgcaggtgttatgggcttgaccgcagaaatgctggcaaaaatgcacggtatcagccgcgaaatgcaagatgaattcgccctgcgctctcacctactagccgcacaagcgacagaatcaaaaacgttcgctaacgaaatcgcaccaattcatgggcacgatgctgatggcaacctgaagttcatcgattttgatgaagtgattcgtcccgataccaacctgaaaaatctggctgggctgcggcctgtctttgatcctgtcacaggcagtgtcacggcgggtaactcttcagcactttcagatggcgcatctgcgatgctcatcatgagtgaaagcaaagccaacgagttagggttgaaagcacgtgcccgaattcgttctatggcagttgttggctgtgatccttccatcatgggttatggccctgtacctgcaacgcagatggcattgaaaaaagcaggcttgagccttgctgacatcggtcttattgaattaaacgaagcatttgcagcccaatcactggcctgtatgaaaggactgaatctgctggatagtatggacgataggatcaacctaaacggtggtgcaattgctctcggccatccattaggctgttctggcgcacgcatcacaactaccctgcttaacctgatggaacgcaaagatgtacagttcgggctggcaaccatgtgtattgggttagggcaaggtattgctacaattatcgagagagtttagctgttcagtatctgactgattgagatttttaacattttcccttgtctgtcttatctattgcatcactcgaataagttgttgccgtagtttcccgcctgtcaggggcgggtttttttattgttatcgaacagtcggatcaaaaacactcagatcagataaactcaaacgcatcaccatacatgcgatcaatagacgcatcacgttcactacaaaagcgttcacgggcaattttggccatttcaaagcgcccagcaatataaatgtcatggttcgccaaactgccaaaatcttctaagactgcactcaagaccgtacccgttctgccctgccagtattcatcaacctgttcaaccacaggaaccacagccagattgggataacgctcactcaacccctgcaattcacccagatcatagaggtgatgtaattcacgccctccccagtagatcgagatatcacggttcggatttttttccagtgctgacagtaaaatagagcgggtataagagaatccagttcccccggcaatcaataacatcgggttttcactgtcttcacgaaaccatgcctgaccatgtggaatatcgatatcgatcactttctgatccaggatcctgtccatcaccgccattgcatacaggtttaactcagaagccccaatatgcaactcaatcgtctgtttttctgatggtggcgatgccatggagaacggacgcttatctctttcatccataactaccatcaggtattgccccgcacgaaaagaaaaaggcgaatcaggtaataaatgaacccgataaacggtatctgtaatggagtcaaccgatgtgactttacagctcagtgttgtcatgcgttccctcttatcgcttcaaaatttctaattgatcccaaatttcatcgacacgggcgcgaatttcatcactcatgactatcgggcgcccccattccctttgtgtctctcctggccatttattggttgcatccaatcccatttttgagcctaacccagaaaccggtgacgcaaaatcgagatagtcgatcggtgtattttccattaagacagtatctcgctgcgggtccattcgcgtagttatcgcccaaatgacatcattccaatctcgcgcgttgatgtcatcatcacaaacgataataaattttgtgtacataaactgccgtagatatgaccagactcccatcatgacccgcttggcatggcctgcatattgttttttcatcgtaacgacagcaagccgataggagcacccctctggtggcaggtaaaaatcgacaatttcaggaaattgtttttgcagtattggcaccagaacttcattcaacgccacgcccaggacagcaggctcatccggtggacggccagtgtaagtagaatgataaatagcgtcacgacgctgagtgatatgggtgatagtgaatactgggaacatatccacttcattgtaataaccggtgtgatcgccatatggcccttccggtgccatttcgtccggttcaatatacccttcaaggataatttccgcactggcaggaacttccagatcattggacaggcacttaaccacttccgttttatgcccacgcaacaacccagcaaaggcatactcagataaagtatcaggaattggagtcacagcacccaatatcgtggcaggatcagcacccaacgcaacagaaacagggaaacgctctcccggatgagcctggcaccattcctgaaaatcgagcgctccaccacggtgtgataaccaacgcataataagcttgtttttacccagaacctgctgacggtagatacccaaattctggcgctctttatttggccctctggtaacagtaagcccccatgttatcaatggcgcagcatcttctggccagcaatgcataacaggaatacgggtgagatcaacctcatctcccgtccagacttgctcctgacaaggtgcagaattgaggcgcttggttggcatattcagaacttgcttgaacttaggcagcttatcgaccagatcacgaaaaccttttggcggctctggctctttgaggaaagccagtaacttgccgacatcatgcaatgccttgacatcatcctgccccattcccatagcgacccgcttaggtgtcccaaacagattgcacagtactggcattgaatacccttttggattttcaaataataaggcaggaccaccggcacgaagagtacgatccgcgatttctgtcatttccagataaggatcaacctccatacgaattcgttttaattcacctgattgttccaacaaggaaagaaagtctcgtagatcacggtatttcatattattcatttgtgccggtttttaaggaggaagaacattataaaccctcccatgatggttacaaggcaaactcataacttactaaaaataaatgcatttattccgattttgtgagtttaactgctcagatgcagcaaaatggtatccaatcaactaatgcctgtgtatcacattgttcagggaatgttttaccgtgctgaaaaagtttgaatccttcactcatctttcaaattgctgttttgttgactgcgttcattcacttgccactgcgctgcaatttgcaatctattaggtatatacgttaaacacactctgactttattgatgatcctgaagccctggttttgttatgctagacatattgtgtaatggagtcggaatattatgggaaactggtatcttctgtactgtaaacgcgggcaaatttctcgagcaataggaaatttagagagacaggatgttatttgcctgacacctacagccaaaattgaaaaaatcgttcggggtaaaagaactaccgtcactgaacccctttttcccaattacctttttgtgaattttgatccagagattattcataccacgactatcaattcaacacgaggcgtcaatcattttattcgtttcagcacttaccctgctgttgtcccacaaacgttgattgatgaattgatgtccgcaacggaacaggaatatattgcacctgaaaccccaattactggcgataccgtgctgataactgaaggaattttcgaaggtattcaagcaatttataatgagccggatggagaaacccgctcaattctcctgttgaatattctcaataaagaagtatccaaggtattggataataaacaattcattaaaatttaatcagagaaaacgggctattttgcccgtttttattatctgttttttatctattttattaaaaataatcagtatttctgctcatgcaaccattgtgctacacgcttggcaaaataagtcagtacgccatcagcacccgcacgtttgaagcacagcagtgattccataatggctggctgttctttcaaccagccattttggatagcagccatatgcatcgcatattcgccagaaacttgataagcgaatgttggcacaccaaaagtatctttcaccctacggatcacatccagataaggcataccaggtttgaccatgacgctatccgccccttcttgcaaatcctgtgcaatttcctgcaacgcttcatcgctgtttgctgggtccatctgataggtcatcttattgccgcctttcaaattaccgctagagccaattgcatccctgaatggcccatagtaacaggacgcatatttggctgagtaagccataatctgcgtgttaatatggccatcaacctcaagctgatcacgaatggcaccaatacggccatccatcatatcgctcggtgcaacgatttcagccccagcttcagcatgggatagcgcctgcttaaccagaatctctttggtaatatcattgatgacatacccatcctgatcaatgacaccatcctgtccatgcgtggtaaatgggtccagtgccacatctgtcagtaatcccagctcaggaaccgcatctttcaatgcacgaatagagcgctgaatcaaaccatcagggttataggcttccttcgcatccagtgattttttgtctgcttcaatgactgggaacagagacaaaacaggaatacccagtcgggcaatctcttcggcttctttcaacaaaagatcgattgtcagacgatacactcctggcatagaagacacttcttgacgttgattgctcccttccataacaaaaacgggataaatcagatcattgacagtgagttgattttcagcgaccagacggcgggaaaaatcatgacgacgtacacggcgcatacgacgaccaggaaacgtacctggaaatacatagctcattactgatctcctaatgtaaaacccagcgacaatacgctgggttaattttgtcatcgcttcgctgataatcttaacaccatcattcagttagcgataaccatcaatagcagatagctagttatttttctgaattgttacctgcatcatattcagattcgttttctgctctgtctgatttccgtccacccacataaaactgagaaagcagaattcccacttcaaatagcaggtacatcgggatagccagcaaagtttgcgagaaaacatccggtggggttagcaacatgccaaccacaaacgcaccaaccaaaatgtaagggcgttttcttttcagggattcaggcgttacaactccactccaacacaacagaataatggctaccggcacctcaaatgagacaccaaacgccataaatagggccatgacaaaactcaggtaattactgatatctgtcgaaatgaccacccctgctggcacggttttgacaaaaaaaccaaatgcaatgggaaataccacaaagtaagcaaatgccatgcccagataaaacagtacactgctggaaaacagcaggggcatgatcaaacggcgctcgtgtttatataatgctggcgcaataaatgcccatacctgatacaggatcatcggtgccgacacaacgatagacaccataatggtcagtttgattggcgtgaagaaaggcgatgcgacatctgtcgcaatcatatttgctcccttcggtaattgttccattaacggtgcagcaataagccgataaatatcattagaaaaataaaccagtgccagaaaaatcaccagcacggtaatcaagctatttaaaatccgcttacgcagctcaatcaagtgaccgataagaggttgggtatcatccacagacatgttttagtgttcactattggctttttcaggagattgatttttattttgttttgacgccggttctggtactgagtgagatacagaagaatgaaaatgtgtttcatcctcttctaacgctttagcctcttcaggagtcagctgatacgattttttcagcgattcagcagcctcccttaactcgtccatcgatgcctttaattctggggacaatgattgcaaatctgctttttcttccatttttttcaagctgtcctgaagctcttgcacttttagctcctgagcaagttcattctggacattagccgccagcgagcgtaatacccgtatccagccagccacagttttgactgctataggcaagcgttctggccccaaaacaaccagaccaatcaccatcaccagtagcagttcgctaaaaccaatgtcaaacacggtttatacctgctctttatttttgctctctgatttttcagactcggcaacagtggatttttcagcaatacttttggtttcaaaatcagcatcatggctatttttttcaacctgatctggcttttcatcatcacttattgcttttttaaaacctttgattgatgctcccaagtctgaacccaaggagcgaagcttattggtgccaaacagcaatacgacaatgacagcaataatgagtaattgtgggatgcttatcatgactgacctctattcatagggaataataacgactaatattttcattataaaccacgaacttttgttcgaaaataccgcaaccacactattaaagctacggcaaaataacctttacttaagcctgcgccaaccaaatatccacgatatgactgccgcccccatcaaccaccacgatagatgaatctggtcagtcatgaaaaataggctgccacagataaacaatgtcgcaccgatccccagtaaatagagagattttttctggctgacctgttgtttctgtaattgttgcgatatctggtcaatgctcgtctgcaaacgtttatgctgttgaagagcgccataaaccagctcagggaattccggtaatttttcagcccaatatggcgctttttctttaaatgcgcgcacaatcgccggaatgccaacctgatcgtgtaaccagtcttccagaaaaggttttgccgttttccataaatcaagctgaggataaagctggcgccccaggccttcaatatacagcagcgttttttgcagcaaaaccaactgaggttgaaccgccatattaaaacgacgagctgtattgaagagattcaacagaacatgaccaaatgagatttcagccagcggcttttcaaaaatgggttcacagacagtacggatagcaaactcgaaatcttccacattgatatcggctggaacccaaccagaatccacatgaagttcagccactctgcggtaatcacgattgaagaaagcaatgaagttttctgccaaatagcgcttatcgtctttgttcaatgaaccaacaataccataatcaatgccgatataagtcggatcttccggccgttcataactgacaaaaatattgccgggatgcatatccgcatggaaaaaactgtcacgaaatacctgcgtgaagaacacctgaacaccacgttcagcaagcagtttcatatccgtgttccgcgcttccaacgtagcaatgtctgacacgggaatgccataaatacgctccatgaccagtacattctcccgacaataatcaggataaatttctggcacgtaaagcattgagctatcttcaaaattgcggcgaagttggatcgcatttgccgcttcacgcaataaattcagttcatcaagcaacgttttttcatactcacgcacaacttcacgcgggcgaagacgatagccattgggcagtaaaggaaccagatgcgccatacggtacattaaacggacatccgctttaataacaggcaggatatctggacggatcaccttaagaacaacttccttaccattctccttaagccgagcagtatgcacctgtgcaatagaagccgaagccaatggctgtgaatcaaaatcatcaaaccatgtttccagcggtccacccaaagcagtttcaatggatttgcgagccactgcgccatcaaaagaaacgacccgatcctgcaacatcgagagttgatcggcgatagccggaggaaacagatcccgacgggtagagagcatttgaccaaacttgatccacactgggccaagttcttgcaatgccagacgtaaccgctcaccgagtggtttatccttgtgtcgattggggagccagaacagaaaataacgcccgaaacgcaacggccatgtcagacgaatattggggatcagttcatctaagccataggaaagaaagacccgaacaataaagtaaaggcgttttatttcactgggagtcatattttccctccagtgccgccagccgtttttccatatgagacatatcattggcaaccgcattgacttcttcactgaagtaagccacttccagcgggttgggtgccattcgccactcttccgtcaatgattccgtcagataggttttctgccttgtaatcgcattgctggcaaatttaacgccttccttcatcacccgactgaggccttctgccacaatatcgccaacataaggggaaagataatgagcaggatcccactcagacatatccagcagagccgaccattgctgcataacttgcatatccccttcgataacgatttcaccactgttaatcagagatgaaagacactgacgatcccgcaatttgagtaacgcggtgaacgtcgttttcatcgaacagtcggcagactctgaccattggctcaaaacatccacctgtttttcactgaatatcaataccagtggtgttttaatttctttcaattcgatggacagtaccttacctgccagcctcatgcgagcggacttcaatacggtttcacggtacagaagatgattcagagtcgtttccagaaacgcagtcagcaccggaaacaacaccgtagaattcaggttgtcacttaattcgggcgtctccatttcagaatttgaatcctttatgcagtgcaacgatccccccggtcatattggtgtaagaaacttggtcaaagcccgcttcttccatcatggcttttaatgtttcctgatcagggtgcatacggatggattctgtcaggtagcggtaactgtccgcatccttgacaatcatctgcccaattcgaggtaagacatggaacgaataagcatcataaactttgctcaaaggtgctagtacgggtttggagaattccagcactaaaagacgcccgcccggtttaagtactcggcacatagagcgcaaggctttttctttatccgtcacattgcgcaggccaaaagagatggtaatacaatcaaagtaattgtctggaaaaggcaattcttccgcattggcctgaacataattaacattgcccacgatgccgatatcacgtagtttctcacgccctactttcaacatcgattcgttgatatctgccaatacaacttcacctttttcacccacgatgcgggaaaacttcgccgtcagatcccccgttcctcccgcaagatccaacaccttatgaccacggcgaattccacttgcatcgatagtgaaacgtttccagatgcgatgaatgccaaatgacatcaaatcattcatcaagtcgtattttgaagcgacagagtgaaatacctcggccaccataatttgtttttcatctttttctacggtgcggaaaccaaaatctgtagtttttttcgattgatcagccatgttatttgtccgctttttattcaaagaaatttatagcaagtgtaccagcctttctgacaaaaccctatccacacttcactcattaacctgcaatgattggaaagatttatcaataagctgtgaatcaatagggcgcttaacatcaacacctaaatcacggaatccttcagcctggctaatcaggtttccccgcccttcagccagttttttcattgccaaatggtaactctcctgtgctttattgaggctgtgtcccaacccttgcatgtcatccacaaacaaccgcatcttgtcatacattttggttgctttgtccgtaataaggcgtgcattctggctctgatattcatagcgccaaagattattaatcgtacgcacggcaaccagaagtgttgatggactaaccagcataatattatgcttcaatgcttcatccagtaattcaggtgcttgattgagtgccaccagataagccggttctacggggataaacatcagaacataatccagcgaccgtaaaccgggcaattgttgataatctttccggcttagcccccgaatatgtcctttgattgagtttatatgttcctgtaacgcctgtgcctgctgcgtgtcatcatcgctgttaaagtaacgttcataggcgatcagtgacattttggcatcaataatgacatctttttcctgtggcaaatgcacgatgacatcaggctgaaagcgctcaccgttttctgttttaatgttgacctgtgtatgaaattcatacccttcacgtaaaccagaagattccaaaacgcgagccaacaccatttcgccccaatcgccctgcattttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtatcccctttcagggctttcgtcagattaatcgcttcttttgccatttgtgcattaagctgctggagattgcggatttcatgggtcagagtatggcgttcgcgagcttcctgtccgaaactgtcctgtacttgactgcgcaacccgtcaagctgctcgcgaaaaggcatcaggaggtcattaaggctttggcggctgtattcatcggtacggcgccgattctgctcaaaaatacgattggcgagattttcagattgggtattgaggcgttgttcactattgatcaatagacgttgtttttcttctgcggccagcctgctctcttcaagccgcgtgcttaattcacgtaattcaacttcctgtacgctgttgatttcgcgctgcgccagcagttcttgatttaattgctcacactcagtacgccaatagcgggactgttctaacttttcatggctgatagcaagctgactatgcagttcacgcagttccaactctttctgttgaattcgctggtgaacggaaagccagacgaaaatccctccgcccagcaatccacttaaactgccaatcagcaggtataaccactggatatccacctatacgcctcccgcttacttcaccccggttaacttcaccttaatgtaagttaaatagatgctgtatagatgtccagattctttaatgagtttctttcagtttgcaaagcggctcgcagttagcccatccattctgccagccagcgtaaaccaaacgcgcccggagccaaaataccgaaggcccaaatcagcgcagaggcaaaattggcgagctggaaatgacgtttcggcatggcgaaaatacccgctaccagtggtataacagctctcaatgggccaaaaaaccgcccgatgaaaacgccccaaactccccagcgttcaaaaaatcgatggccgcgaactaacgtttgcggatgacgtgacagtggccacatcttgccgacattgtccttgtagtggacaccaaacagataggaaacccaatcgccaaaaaaggctcccgctgccgccgctatccatattggccaaaaatttaacccgctttcaccaatcaacgcccccaatcctaataaaatgatcgtcgcaggcaacaatagggagataaatgccagagattcaccaaaagcaagtaggaaaacaatggggattgcccaatcttcatgggcttttacgaagtctgtgaccagttcgataatttcatgcaagctcaaattagccgttcctgtattaattcattagatgtaccaagttagcacctgatatataaaccaatgctaactcagtatttttattcaagaaaataactttgtaatttttcacgtgctgtcatatccagcccgatatctttttccagccagatatccacactgccataatgctggttaatactatttaaggccgtcagtaaaaactcttcccgcactgaataaacataagcaaatttttcaatcacacggtcactcatgacttttgcatgttcattcaagagatattcccgatatggtgccagcgtaatgttggtgactaaatagtcttccattaccgtatccaaatctgctcccagagcaaacagtaccagcgcagatccaacgccagttctgtctttacccactgcgcaatgctgtacaattccgcctttttctggttgcatcaatagattagccagctgtttgtaagcaggattgttgattggcaataattcgtataaacgcagcatgaatgcttgtgcatcaaactgctccagaagttcctgacccaatttttccagattggcatcaacttccttagagagtggattggccggagcatggtgataattcgccccacgccacactcgatctggcttatcctcaatttcgctgctatcacgataatcaatgatctggaaaaggttttggtccatcaaaaaagtctgatcgttttcagtcaacatgtccagagagccagagcggaataacagccctgatttgattttcgcaccattatgcagcgtcttattaccgaaatcacggaagttaatgccaccatgtaaggggagcaatgaaggatgggatagcaatgttgtggtcatagttactcttgttatgatttaaatagatcgttattgataaaaagcgttatgacattatcagattttagaacgaaagaaagactagtggcgcatctcgcatttaacagccttattcaaagtacttgcaaaccatccggttatagggttaattagcactttgtttaaatgaccattcgatgtacctgttttttgtgtgaaaagtcccggcagtaagcctgagtgtccaccaaaaagaagcgctggaacacatcatcaattctcggatcaatcgttgtgatcatcgccaacgagcgcagctgattttgctctttgcatccggcgtatctaataactgggcagcaaagaaagtcgaattgggcagtaagcaggctgaatgccatcgaatccacggaaagcgctcactcaaatagcggtaactgtcaatattgttgacacccttagttgatttaagctgcctgtttttctcgttctggattcagggttaccgcgccaacaggttgccagttccttgtcttgcctgaccagcgttctcgttctggatgtgataactgggctgcacgataaaccgtatctcgtttcattaatatggccttatcttctcctctgtgtcgttgtgatggggtgacatagcgtatctgctgctcttcctgtgcacttaaccaattatagcgcgcaccggcttccaccgcgctctgcaccccgttgataatgacctgacggtcagcagtacgggtcagtcttcctcgctgtccgtcccgaagtgcgcctgcaatgtctttcgcaggaccagtatcgctgccgcctccgctaacgctttgtccttgcgggccagttcacgtttcagttgtttattctctttctggctctgtttcagcgtcgctttttcatctctgtcgggcacctgtaaaaaggcgtgtttccattgcttaattgctccgggtaaagtcctttcttacggcaatattcagcgtggcttcggatatgccttcaatttgagctacagccgcaacggtcatgttatcaggtggcagtaatttagccagcgcggaggatttacgttctggtgaaatacgtgtcatggtgatttatctccatcaccccatgagtgtttttaatgagggtgacaacaatcctgacagagaaggaccgcttgaaacaaatagtggcgcatgtttttggtgatcgcagccgaaaaacattagacaagctgcttgccctcttatccccctttaatattcggttttactgtacggatgattatgtggtctatgacaagctcccagaagaagaccatcttactgaaaaatgtttacccaacgtataaagaggactaatttaacccatcgtagccgaataaaaagactgaatagaaaaaccatcggttactcaaaatctgaagaaatacacgataaggtgataggaactttcattgagcgcgagcactatttttagcactcaatctaactatttaatacatgaccgccctacaagctatacagttgcagtaaataactctttaaacatattggtatccttaggttattaataataacaaaaatgcgaatcagataataagggactgtcttttatttttcaattttaatgaaactaataaaatttagttcccaagtaataatataaattacattaaaaaagtgagtaaacttgttctggtaaaaacattatgagggttaaaaaatgaattttttaccctcatttttcatgtaaactttgctttacatattctccttaacaggttattagtgtaataatattgcaatctctaaacagacataataaccctatgtgaatggcgctattagccttgttattattggttaactgcatatgattgactgcatatcggctacaagattaatgtagagaagattgcaaattaaggtcgactacattcattctctgctttgttgataaggattgaggctatgctatcaaatattccggctacccctaggtttatccagcaatataaacatgctactagtgaattaaactttctttacaatgtatcaactgagtggcatcaacatccctgtattcaactcagcctatctttacatacacatgaatcgctagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacactatctagccttatcaatacaggatgagactcactccactcgtggttttctgattcgttcaaacgtaatgcataaggtggattcctccaatacctgtagcattacattgcttattgaacctattgatgaacattaccatttatttagccatctcacagagaatgtggaagtaattttgctagagcatgatgatattgtggcagtaacagattatctggttaagtcgtttctttgtggcgaaaaaccagaaacattcactgtttacttgttacttagcccatacctgtcatgccactgtcaatttgataaacgtattttgaaagctgtttcgtttatcgaatcgctatcagtaaagcgggtttcatcccgtcaagtggctgataaaatttacctttctgaaagccgttttttacatcttttccgtgatcaagtgggaattaactttcgggcttacttactatggttacgcttaagtgatgctattgaggagattcatatgactgattccttaactttgattgctaataactgtggtttttctgactctgctcattttagccggacatgtaaaatggcttatgggatacgcccttccgatcttaagcatataattcagcagaatttacagttcaattgccatacgactcagtgcctctataacatcaataaacagataataaatagtattcatcatgaagaagaagctaatctccaaattacgtagatgacaaattcgatctggaaaaccaaagaatcaagattagtgccagaaaaataaaaccgaagagccagaaaatttcgttagcggccagaattaaactctggttggtgatcctcttcgccagaaaaacggttgcttgtaagtcagataatcccaagagcttgatatcctgataagctaaatcgacaagaacgttattttgtgtgatgttctcagtgagctgagaatgatgaaccgcttcacgttgaacccataatgtattggttaacgatgtgcctatcgatatggctaatgttctaaagaagttaaacaaacttccagctgaggcaattttctcctgaggaatattagataaaataatcacattgagtggcatgataaagcaagcaatcgctatcccctgcacaaactgtggccatgctgcactggaaaaatccattccaagctcaaaagtatatgctcgccaaaaaaagcagaaagagaagacaataaagctaagagtaaccaaatagcgcatatcaattttagcaccaaatcggccaatgactagggctagaaaaataggaagaatgccgagaggagctaatgcgagtccagcccaagtggctgtataaccaaaaactgtctgtaacaactgaggttgtaagactaggacaccaatatgcaacagaaatgccaaactaatacaaatcgtaccaaccgtaaaattgcgtgatttaaacaacgataaatcaacaatcgggttatcatcagtcagttcccaaatgataaataggataatccctaccgttgcaataatcgccagcaagatgatctcattggagttaaaccagtcgagttcttttcctctgtctaacatgagttgtaggcaaccaacaccgacaatgagtagaaccaaccccaccttatcaactgggataacctcagtttttgtttcacgcttcttcaataacaagtaagtaataaaaatagcggctagaccgatgggaacattgatcaagaaaatccacccccaatgatagttatcgctaatccatccaccgaggattggaccacaaaccggggcaataatgacggtcatagaccagatggctaaagccatactgtgttgtttcttaggaaaatttgctaaaagcaagctttgtgataaaggtatgatagggcctgcaacagcaccttgtataacccttgaaataattagcatttcaaggctattggatatgccacatagccaggaagaaatgataaaaagcagagtcgaaatgataaacagccgtacttcccctacccgttttgccaaccagccagtcaaaggaatagatattgcattagcaacaccaaatgacgtgataacccaagttccttgtgacacggatgatccaagatcacctgcaatagttgacaatgctacgttagcaatcgtcagatccaatatttgtagaaaagcgataatcgccagagacaggattagccaccagcgttggctggctgataaaagttccatagctgtgtgatcctcaattttcatcacttacgttgctttttatgatttgctcaatgatttcatctatctcattattattgaatgaaaaaacatcagtctgataaataacccgttgtggagttttgtcagccagagttgtgcctgctgtttcactggtatcaaccgttacatgcatagataaaccgatccgcaatggattgagagcgacttgtttcggctctaattcaatacgtacagggaggcgctgaaccactttaatccaattacctgttgcattctgagcgggaaggatagaaaaagcgctgccggttcccatatctatacccgtaatgcgcccctgataagtaacactatcgccataaaaatcgctgattaacttgacgggctgccccagacgcatatcagtgaactgcacttctttaaaatttgcctcaacccatatctggtcaggaggaacgataatcatcaatggtgtagattgattgatttgagatccaacttgaatactgcggcgtgatacgtacccacttactggagcgtagattttggttcgttgcaaagacaaccaagcttcacgtaaattggatgctgccttttctatatttggcagtttgtttagtggcgtacccattagcaaagcctgattgattttatactgctgcatggcgacttttaaatctgccttagcaatgtcaacagctttacgagagtgatccagctcttcaacagcgatgacattgaccttacccaatttttcccgtcgtgccagattactttttaacttgtctaaagtaagctgttttaattccatattggccaggagcttgggattactgaggatggtttcccgtgtttcacgcactgcctgggctaatacatgcttatttttctcgaaggtattctcagcgtcagcactatccaacgttagtaaaaggtcaccttgctgaacaaaatcggtattatcaacataaatatttttcacactgctatgggtttgggacatgacttggatctgattaccgacaacataggcgttatctgttgattggtagaaacgtaatactatataccagtaaaatagataagctaaaccagcaaacaaaaaaagtaatacaaaaaaagaaagtattattttacgttttttcttattatttttttcttgtggttgttcaggcattttttcaatttgattgtttcccatgtttgactccgattaattgaactaataagcatatccaaacatttatactgatatgctaccgccagacagccgtatttgtcttgctacagggttaccactcttctcaaatgagaaagtaactcaactgttatcaccttcttagtttcgccgtttcatatgattaaaatgaaaacaccgttcatagagtgaactccatacttaggaactctacctgccaacacatcaatggtaatcggcataccaactttataacttaacaacgtgattggattgaataatctgactgaggtggtcggaatcaaatgttaatgaatattggtcacgtattcatcccgttgtttctcacgtataatgagagtaaatacgtgagggatcgtgatggcattagttgaagtgaagtgtcggttttgtgaccaaaccacgcctgttaaaaaacacggcaaaggagaaggtgggcatcaacgatattattgccagtcctgtcgtagaaccttccagctcgaatacacttaccgggcttgccattcgggtatgaaagagcaaatcgtcgagcttgccatgaataatgccggtattcgtgatacggcacgggcacttcatgccagcattaacgctgttgtacgcactttaaaaaactcgcgccgcgatgcgtaaccacgctgccactggatacccctgagcttcagcttatctgtgaagtcgatgaaatggggtcattcatcagcaacaaaaaacggcaacgttggctgtggtacgcgtgggagcctcgcttgaaacgtattgtcgctcacgcttttggagcccgtagcaaacagacactcatgacgttgctggaaaagttatccgcttttgatgtggcattttggtgcaccgataatttcggggcatatgacatattggctgatgagaaacatatcaccgataaactttatactcaacgtattgaacgagaaaatctgaacctgcgtaacaggctaaagcgactcaatcgcaagacgctgggttattctaagtcagttgaaatgcatgacaagatcattggcacattcatcgagcgtgagttctattattgatggccaatcaacaggttgaatacacgacctgaaaattaatgtttttataaaagaatagatatggaaaatataccaattatttacagaaggataaaattagctagtttattcaagaaaaataaaaatatcattgttatatttgcgttacttattcgaattacttatttgctatattcttctgatataagtacccattaaacgatggttaaaatcatataataactactaggctgtgtcccttaatgtaaattgatagtattatcatctaacttgttttcaatacgggaaaaagatgatggcacgctacgacattcctgatgacgcatggatagtgatagaaccttgtttacctccggtccattcagagcgggcaggacgtccacatgttgaacaccgccgagtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaaaacctcccgatatcgctgacgatcatgcgctgggtcgctcacgcggtggttatggcaccaaaatccatctggcaaccgacagacggggttttcccctcaacctgcttttgacggcggggcaagcccacgaaagtcgatccgccatccctttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaagggacgcagcctaggatagattacatgttcaaatcaactgagttgtatgaaaaaatcaaggaagtaaatggtgatgccataaaatggttaattacaaacagcagttttctctatcaactttcaagtgaagaacaacaagaactaaaaaacacatgttattagagatgcctttgcatatcattttgaaaataatgtttactatcgtgaacaatgtgaaaagaaaggtgtaaaacccaatgatatccaatgttatgcggacttggtaaatatccctgtcattccagtatccacttttaaatctgaaaatagccatcgtttgttaagtaaacccctttccagcattgagcatgagatgcgttcgactggtactagtggtatccctagtgttgctcgtcgatgtaatgaaacaatggactatactactataggtatctataactcatatcgcgatatgcttaagctctccagtggtgcaggactgtgtttatgtccttctacggaggaaattcctgaaatgggaatgataaaagcatttaattggttgactggattgctggataccaatcgctttatggttagagaagaacgttttattccggaagaagcagtcggtcaattaaaagaatggcaaggaaaatttactcgtcatttgataggacctccgtttcttattcatcgttttatcagtttcttgaaagccacgaacactaaattggaactggacagtgggagtatggtcattacgctcggtggctggaagcgtttcactggtgccatgatttcccgtaccgagtttaatcaagagctggaaacttggttaggaatctctgctagccggattcgtgatatgtatggacttgttgaagctaacttcctggctatagaggatgaattcaatcaaaaacatattccaccttatattcacttctctgttcgtgatccggaaaacctatctcgagaagttgctgatggtgagaccgggcaacttgttatattcgatcccatagcacattctacccccggtatgttgctgaccgaagatatgatctacttacgtactgacaatgacctttcaggtcgtaactctcagcgtatgcaatatgttatgcgggcaccttctgcaacagaattcggctgctgcgccgttaatctggaaagtaaaatgtcagctgatgaacaaagggatacatgccctgttactcagtgaggtcgggtcatgtttaatgaaattatcactgataacttttgtcatcccgattgtcagggaagcctggaaaatccagatattcagcttaaattgggtaatcctgtgtgtggagataaagtgaatattgatttgtcactgaatgaagaaaaacgtatcagtgacgctcgatttcaagcttggggatgcacggcttctttagcgatgtctaatcagttttgtcgccagattcaaggaaaaacactaacagaactcgcccaattaaatatacaggagatcgaccagatgctgggtaagctgcaaccgtcacagcagcattgcctagagatgttgcatgctctttttcagcaggtaaggatgcatatatgactatattgtactttgatttcaatgcgacaacaccaatgagtcataaatcaaagatggcaattcagggcgtgttggatcaatttgctaatccttccagcagatatcgtttgagtaataatttaattacgttaattcatcaggcaaaagagtctgtagctcagttagtgggaggtttgcctgaaaggatcatttttacttccggtggcacagagagtaataatctagctttgcacagtgtatttggccagctcccagctggtcaattatctcgttatcatgccatctgttctgcaattgagcattcttccattctagaacctctgcgttggtatgaaaagcagggcctgaaactgacgatcatcgagccaagtaaaacaggaagaatagatctggacacattgtgtaatgccatcacaccccaaacttgcttcatcgcattgatggcgattaacaatgaaactggtgtcattcaaccttatgatgagcttgcttacaggctgaaaggaaaaggtatccatcttcattgcgatgcaatacaagcggtaggaaaatggcctatccgctgctttgatgatatcccattaactatctctttttcagggcataaattttatggccctaaagggatatcctaatgtacccacctggtctggagtttattatagggttagttgcttgttttaaggcaggagccattgctgctccatctaatgtggttcgagggagccatcatctgcaaagattaacgcagatcttgaatgactcagaagctaaagtgatacttactactttagagttaagcaaaaccttatcgcatgaatttcctaaccagcatgttatgtattactcggaaaatcagacggtagatgggataacacagcttccttcaatatctccaaaacaattagcttttctacagtatacctctggttccactgatactcctaaaggagtaatggttactcacaataacttaattcatagcttgcgggcgatgaataatacttttggcctgcatgaagggttaatcattggaggctggatacctcagttccatgatatggggttggtaggccatattcttctgaccatggcgctaggtgggcaatataatttcatgccacccctctcatttatccagcatccattacgttggttacagttgatgcatgattatggtgctgaattctgttgtgcccctaattttgcttacgacctctgtgccgaccaagactgtgctgggctcaatctggacctgtctcgctggcgttgggcgggtaatggcgcagaaccagtcaggaatgaaactctgatgcatttttatcaggcagttaaagaatatgggtttgtttatcaaagccaaatcccctgttacggtatggctgaagcaacactggtaatcagttcatccaccagtgaagatcctccatttagtttaacactttgtaacagcagtctagagaaaggaaaacttgtcttacaacctgatggggttgtaatgcaagcctgtggtcaagttgcgccgagtcatcgcgtcgtgattgttaacccggacacaaaggcattgtgtcaacccgatgaaattggtgagatttgggttcaaggtccaagcattgctgtggggtattggaataatcaggaacaaactgagcagaatttcaaggcctatactaccactggcgaagggccttttctccgtactggtgacctcggatgtctgtatgaacatcatttgttgatcacggggcgtttgaaagatctgattattatccgtgggcggaatatttatccacaaaacattgaatacgcagctactatgcagtccaccgtgttccgtttaggcaaagcaattgcttttgaactggaacaacaggtcgttgtcgccatagagctacgaaaaaatgtggggcaggaaaataacttcagagaattgagacgaaatgtaatccaggcactccatgcaacattcgatattaatatcgctgaattagtatttattcaggccaataaattacctacaactagcagtggaaaagtacaacgaagactctgtcgtgcactctatttacaagacaaattacttctggccaatgtactgcctgccaccgaaattcaaggagcataatatgactgagctggaactaaaaggctggctactcgagtacttgacaccctatttccaacgccatgaaatttctatcagtgaacacgtttccttcgatagtcttggtctggattctgtgagcagggtaaaactgattagtcagttagaaaaagtattacagcaaaaactggaccctattcttggctatgaataccccactatccacgctttgtctgggcatatactgcaattggagcagaggccatgaaaatcgattgtttaattgttggtgctgggcaagagaaggcaagaaaaaagtggtcaattaccgaaaatatccgtggcatttgatcatcgtggaatattccgacttcagtttctaagtgaaaatcttacgaattctcaaaaacggaaccctcgcctaagtcagcttcatacctcaattgtgaatgttttccagtccatagctgaaaaacatcaaattccgctcagtgaaatacgtgttattcatgaagattcagccaggcagcacattgttcacacactctctcttagagaaatacctgaaaccgtcaaacaacggatggtgtctaaaacccttgctgatagtaagccacagacatcagatgctttgtacgaagagcctactcagaaactcacctgtgctgcaattacaaaagagtattttgaaagagctgcagacgattcccaagacacggatactattctagaagtgttctttgaggactgcgaatggtcgagatctcttgcatatgtgcgcggaatccagctcagtcacatgctcggtgtttccacttccattcgcctcaatcttgttaatgaagctggcggggtgagtcagggcgatatagttagcgcataggatagccaaaataataagaaaataacctttatttttatttgtaaggtaaaaaattatgtataacctgtcccggcctatttatctggataacaacgctacaacggcattagaccctgatgttcttcaatctatgatgccttattttataaacgattacggaaatgcttccagctatggacacgcttttgggtggaaagcgatggaagctgttgatgatgcaagaaaagtgatctcaacatcaataaatgcgaaaagtcattccgatattatattcacatctggttcaactgagtcgattaatcttgcaattgctggctttcaacatcggagcaaaaagggtcatatcatcacatcaatgattgaacataaggcggttcttgattgctgcgctaggcttgaggcaatgggaactgaagtaacctatttacccccacaaagcgatggtatcgtatccccaggctcaatatctcttgcattgagagatgatacctatcttgtttcaattatgacggcaaataacgaaattggctcaatacaaaaaattgaggagataggcgcgatctgtaaagagcatgatattccttttcatacagatgctactcaagcgctcggaaaaatagagtttgatgtacagcgtatgaatattagtcttgcctcattttccgcacacaaaatatatggaccaaaggggatcggcgcactttatatcaactcacgtaataagcatgtcgcactctcacctttgatcgttggaggtggacatgagcgaggtttacgttcaggaactcttaatgttccgggaatcgtagggtttgggcatgctgttgaattatctttgaaaaatttgaccactgaatcgacgaggttgcgttatttacggaatttacttcgacaatatattatcgagaacgtgcctgatgttcgaataaatggtcatctcactgaatgtcttcccggcttgttaaatgtatcctttgatgggatagatgcagattcacttttgttggagctttctgaggttgccttgtcctccggatctgcgtgtacatctgccaacagagcaccatcacatgtactgaaagcaataggagtgagtgatgagctgtctcaagcctgcctgcgctttgggttaggtaggtttaataacgaggatgaaatgcggtatgtttgcttccgcttaaaagaagcagtgaataaactgagagcgatggtaccaaggtcatttgctcactgataatgccgacaataatgaagatggagttttaatcatgcgaacaatgccggctttgtttctgttgttcggaaccctgttcactgcgggtggttatggtgctacctttcttatttctgagtattttcggtcacaagggggaagtgatattgatacaggaacgacccttagcgtggcattgatcggtactttgattggtgttcctttggttggatggttttccgggcaattggaagcatcacgccttgcagctttcgcggcgttgtcaatgtcttgtggttattttcttttcggtggctttggtggtgaactgagctacatacaaaatatcgcagcgcttttgattgggctcggttggggaatgttttatataagtggtcccatggccttgtcggaacgggttactgatacagacagggggcaatggtttactcgtttcagtgcatttcaaatggctggaatttgtggcagccccattctcctcactgtagcggttgaacagggaggtttttcaatccagacaacgtttctcctggttggggttgttggtattctcgcttcactgcttctggcaattttcggggtcagggagccgcttgaacaacggaaatcattattgcggccttgggtgaagaaaataacgaagatctctgcagctagtactatccgcccgattgtaatggttgggctggggggctgtgtattctctggaatgatgtcatttcaggggtcactctagtgcgaatgcaagtacattcttcgctgtacatgcagcgactgtagttgtatcgcgtctttttttggcacgatatttatcgacggtaccctgtatcccactcgtcattacgttgatgtcgtgcttaatcattggccttttgtctttgttaggtataccgattcatcctgtgttccagattgttgcggccatgttaacaggaataggatatggattagtgtatcctgttattcaaacatgggcagtaaatgattctcctcttgaagatcgtcatgcagccctcacctggtttgttgtctcctattttgcgggtatatttggatttccgttgataggtggatggatattagtcgatgcgggaaaaaatctgtttatcctgattctggctgcaattgcttttattgaactggtagtcgcgttgttgggaaaaagtcatctttgttacattaaggggtggcctaagcggggatgaaatcaggtaagaggtactggatagctccgttgttggtgctcaatctctacaacggagctatttcttaatttttcactgctaattgatacaccttagtatcatatttttgcgtttccgggcactgtttacagcccccgctgaggcaagaggaagcgtccacttcctccagtttacccatcatgacaagctgcttgagcatagcttctaccattggcagcggtgctgaaaactgatggctcaatgatcttgcatcggtacacccattgagggcaacagcatctctgattttcagcagattaatcattcatggctccgactagtgccgcattctttaattaatggccttattgtttatttccacgataaagccatttaaaaagtttggctaatacccgattgtaatattcgatatattttaaaatgagtgcccgcaatatctctttgctgctgacgaaaagccgcctgagcaaatgccgggatatcagactgaaccaacattcaatttgatttaaccaggaggcatgtttggagggtaatgtccagtgactcagagggtgtccactcgcctgcggatcttcacacgccactgtcaatatttgagtcacttgctcagcgctgaatttctgcttccgctccggtgcaaatcgctgaacagcgcttcaagggcttttatcaggctatttgagtgagcgctttccgtagattcgatggcattcagcctgtctcgattatccagccagcgttttctccagtatccggcctacttactgcccaattcgactttttttgctgcccggttattagatacgccgaatgcaaagagcaaaatcagctacgctcgttggcgattatcacaacgactgatccgagaattgacgatgtgttccaccgcttctttctggtggacactcaggtttactgccggggctttctacataaaaaacaggtacatcggatggccacttaaacaaagtgctaattaaccctataaccggatggtttgcaagtactttgaataaggctgttaaatgcgagatgcaccactaggtaagcaaaaagatcgggccagcatgttctggcccttaatgaaagcgattacagcaaacggcgagcggcatcaaccacgattcccaaagcgttgctttcggtttttttcaacagttcaacatctggaatttcctgttgcgtacggttgacgatcacccctgccaccataccggcacgcagtccctgacttgcacacatcgtcaacagagtggctgattccatttcataattcatcacccccatttgctgccactcttgcatggagccttggaaacggcggacgacacggccagagtaagtatcgtaacgctcctgtccggggtagaaagtatcggaagaagccgttataccaacgtgggtggccgatcctgatgcttttgccgcttcatacagtgcgttggtacattcaaaatcagccaccgccgggaattccattggcgcgaagtgcaggctggctccatccagacgaactgccgctgtcgtgactaatacatcacccacattaatgtgcggctggatcgcaccggttgtcccgatccgcaggaaagtactcacccccaattgcgccaattcttctacagcaattgacgttgaaggaccaccgatacccgtagagcagacaaccacgggctttccgtcaatttctgcgcgccatgtcgtaaattcacgatgggaggccagatgaacggggttatccatcaattttgcaattttttcaacacggttgggatcgcctggaacaatagccaaagtcgctccttgcagatcgcttttggtgatacctaaatgaaatacatcagacatatcgagctcctaaacggaaataattcaaaaaaacagggatgcctaaatttagtgcctaatctgacactttttagtgataaaaatcatctttaattggaaaaaataaagaaacacatacataattttgtgataataatcacattcataacccaaaacaacggactgagtataagattcaaacaaggctaatacttatcgctccgtcacagagtcagcaagcatcagacggcaaaaccctcggtataacccgccatattttgttctaatcccacagaagtgagatggatctgcaatattatgctaatgtaataattatatcttgaatctatctttatttaataacattgctactgttttattcctgttaacgtacctaaataagtgttttatgtggtttagccaataaatcatcaacaagagggggagttacgatgggcttttttgatcaaatcaccaatatgctgagtgggggtaaaaaccaacaactccagcatatgatggactgggttgaaggtcagggaggaataagcggattaatagaaaagttttcccagcagggactgggtggcacaatccattcgtggatcggctcaggagaaaattccccgattcacgctgaccaaatctcttctgtttttggctcttccacgatccagcaattggcagagaaaatgggtatcgatcccaatgaagcgtcatcattaatctcacagcatttgcccagtttaatcgataaggtcacgccaaacggtgaagttccagaaaatctggatttaaaatctgcgggtatgaatttattgaaagataaattactggagaaataattctttcgcccgccacattttatctgctgtagcgggcgtttttcagcttagttatttacggaagtattgttcacggaagcacgcaggcgtttcgccgcttcgaccatgttcgccagtgcctgacgggtttcagtccagccacgggttttcaggccgcaatccgggttaacccacagacgttccactgggatacggtcagccgctttacgcagcaacgcttcaatccattcgacacttggcacgttaggtgagtgaatatcatacacaccaggcccgatctcattcggatatgaaaaatcttcaaatgaatccaacaattccatatctgagcgagaagtttctatggtgatcacatctgcatccagtgctgcaatggaaggcatgatgtcattaaactcgcaatagcacatatgggtatggatctgagtatcatcctccgcaatcgcggcactcagtttgaaagcatccacagcccattccagatatgcctgccattcttccctgcgtagtggcagaccttcacgcagtgctggttcatcaatctgaatgatgccaatacctgctttttgtaaatcatcaacttcatcacgcaaggccagtgcaatctgtttggcaatcgtttcgcggctaatatcttcccttgggaatgaccagcagaggatagtcaccggccctgttaacattcctttgacaggcttatccgtcagggattgtgcatatgttgcccaatttacagtaatggcttctgggcggctgatatcgccaatgattactggcggcttaacacaacgggaaccgtagctttgtacccagccattttgggtaaagacataaccatcaaaatgttcaccgaaatactcgaccatgtcgttacgttcggcttcaccatgcaccagcacatccagtcccagattttcctgttcattgatcgcctgcttaatatgttcagaaatattggtgcgataatgcgtgttgtccacacgacctttcttgaagtccagacgcaggctacgaatttccgttgtttgtgggaatgatccgatggttgtggttggccacaacggtaagttgtaacgctcacgctggagtttggcccgttctggataaaccagattacgctcgctatcctgtggtttgatcgccgtgatgcgctcagtcaccgtcggattgttcacccttgtagaactacggcgtgcacggattggcgcactgtaagcatccagttcagcctgtttgctgccttccggtgcattcagtgcctgcgccagcaaagacagttctgcgcatttctgtaatgcaaaggcaaaccagctcttaacttcttcatccagcccggtttcatcgttcaggtcaatcgggctatgcagcaatgaacaggacgtgccgatccaaatatcacgcttgcctgccagcggtgccacaagctggtatttcgcactcaaatctgctcgccagacgttgcgcccattgatgacccccaatgaaagcaaccacgtttccggcagagattgatccagttcatcaagggaatccttccctgcaactaagtctacatgcagcccttgtactggcagtgatttgatcgtcgccagattatggctgatgctgtcgaaataagtcgtcagcagtaatttagcctgtccttgcagcgcctgataagccgttgagaaggcttccagccattccttcggcaattccagtaccagtgctggctcatcaatctgcacccattcgatgccccgttttgccaattctgccagtacttgctgatagacagggagaatatccgttaatagggagaggcggtcaaaagctttccccttcaccttgccgagccataaataagttacaggccccagcagaacaggtttgactttgtgtcccaatgccagtgcttcacccacttcatccagtaattgagtccaacccagtttaaattcttgcccctgctgaaattcaggcacgatataatgataatttgtattgaaccatttagtcatttcagaagcggccgctggtgcacctgttggagctcgaccacggccaatacgaaacagcgtatccagatcgatgctaccatcttcattttgatgacgtggaggcacgttgcccaataacaagttagtcgttaatacttggtcataccaagcaaaatcacctaccggaactaaatcaactcccgcctctttttgctgttgccagtgacgtgcacgtaattcacgacctgtttccagcaattcctgttgagaaattttgcctgcccaataattttcttgcgccttttttagctctcttttcaagccgatacgtggaaaacctaatgtatgattcaaaactgtcatgttgtcacccgcaaattttagccgtctagatgtttacacttctataatcaacaggtactgtataaaccacaagcgcaaattattcattatcaacttgaaggtttttcatgatcgaaataaaacatttaaaaacactacaggcattgaaccattgcggttcattggctgcagctgcaaatcatctgcatcagacgcaatctgctctttctcatcagttcagtgaactggagcatcggctggggttcaaactcttcattcgcaaaagccagccattgcgccttacacctcaaggagaagtgctgttaaaactggcggagaaggtactgcctctggtgacggcttccctgcgtgaatgcagtgaaccggaagaaattaacctgcgtattgccattgagtgccatagctgtattcagtggctgacgccagcacttaagcgttttagtgaaagctggccgcaggttagtgtggatttcaaatccggtgtgacgtttgatccgcagcctgcactgcaacagcgggaactggatattgtactgacatcagatattattgcagacagcaagctgaactatacgtcgctgtttgactatgaagtgaaactcgtgcttgccccggatcacccattggcaaataagcgtgatatttatccacaagatctcgctcccgaaacgctgctgatttatcccgtccagcgacaacggtttgatatctggcggcgtttcctccagccagcagctgttaccccaacattgaaaagcgtcgataataccctattactgatccagatggtggcggctcgcttaggcattgccgcattaccccattgggcagtggaaacattcgaaaggcaggggctggttgtgacaaaaacgttgggagaaggattatggagcagattgtatgctgcctgccgagaaggagaacagcaccaacctgccattaatacatttattcgttctgcgcgccagcacgcggtggacaatttgccgcttgtaaagcgggtttcagtatccaacggtgatgcacccaaagagatgcaacaatcaggctgcttcctatggtaaaacccagccaatcaggatgctgctgccaaattacaaaattgaccaacaacccggccggaaccaacatattgttcataattgccagtgttccggtatccacttgggttgcaccatagttccacataaaataaccaatgccagaagcgcctgcacctaaccagatcaggactccccattgtaattgcgttgtcggcaatttatgtggatcaccaaacagcagccagccaatgattgcgaccacacaagcccccagatagaaccacgaaaacgcgatccgctgcggtatcgggtgcacttccatcaagcgcttataaccaatctgacctattgcaaagaaaatattcgccaactgcaccagtatcaaaccaatccaaaaagattcgctcaactggtcatagcgaataatcgctgcaccagccaccgccagcaaagaactcagcgcatagccccaacgcagtcgctgacgccccatcacatcatatatcagtgtgacatataacggagtcatcaccgtaaacagcaaaaattcagcgacagtcaagtagtggtaggcatgaaatacaaacaaatacatcacaccaagctgacaggctcccacggccatatacagtgagatcactttcagcgataacccacgccagcgcaaaaacggcagaaacaccaaagcggccagcactactctgaccagcacggaaaaccagctatcaacctgaccggccagaaaagcaccaatcaggctgaatgaggcagcccacaaaaaagttgtgatcgttaacagccacataatttattgatctttaaccacaagtaacgcttcaagcaaatccagatcatgcagcagcgtttggagtgtttcattactaatcttacgggttgcacgtaggtgatacagctctcccctttcggcccttaatgccgtcagacggaaacgccgttccaactcctcaaccagcaagttatgttcgatttcatctttacctacagtacgacgccgcaaataccccgtgactcgggaagcaatttcactcactacctctgcatccagtttttcttcggtgctggcagacaagcgctcttccattttattcatactgacaatcgcaacttcagccattgctgctttcgccattctgatttcattgatatccgcctgcttatctcccactttcatgccacgcagcaacagtggcaggacaacaacaccgacaaacagggagaacatgatcacgcccgctgcgatgaaaatcaactgataacgcgctgggaatggatcgccatccggcaggaaaagcgggacagataacgcacccgccaacgtaatcgcgccacgaacacccgcaagcgacgccagacacaattcacgtgtagtgtaagaagcaaactccagcggtttcttcttcattaacaccttgctggcatttttcatcaaccataaccagcagaaccgcagcaataccaacgccacataaatgatgccaaccgcagcaaacagcacccacgtttcaacttgcggatcaagttcagcctgctcgacagacgtttcccagatacccggcaattgtagccccagcatgacaaatacaaggccgttaaagacaaaggccagcattccccatacgttatcggcacgcaggcgcatagccaaaggtgcattgcggattacgccagacttactgatagtcatacccgcagcaaccgcggctaaaatacccgatacgccgatatgttcagcaatcatgtaggaagcgaatggcagcagcatcatgaacatgatttgagttgcaggatcatcgccactccagcggctcatcaatcgcaatgatttactatacagccatgtaatggcaataccggacaacagaccaccaatcgcaactttgaaaaactctatcgttgcgccagtgaccgtaaataccatcgttcccatggcaattgccacggcaaatttcagtgcaaccagaccagaagcatcgttcatcaacgcttcaccttccagcacactcatcatgtttttcgggatgcgcccttttccaacaattgatgacaacgcaaccgcatcagttggtgacagcaccgcagccagagcaaaagcagcaataagtggaatacccggcagcaaccagtaaatcaagtagccaataccgacaaccgtcactaataccaagaataaaaccagaatgactatttcacgcccatgttgaaaaaattctctggtcggtgttttccagccatcaacaaataataaaggagggataagtaaaacgaggaataattcagggtcgaaagtaacgtgtaaaccaaaatgaggccaagccagcagtgctcccattgctatttgcactatcggcaagggaatgcggaacgggatcattttagtaagaacacctgaaactgacaccaccaaaatcaagatcaagatagtaaaaaatatttccatattacccttacaaattgccaaaaatccgtcggtgaagagattgtgacttttttttcactctaataacagccgtaataaccagaaatattaaagttattaaagaaaatcaaaaaacaatcacattgtgaatcaatgaccagcaagtcattagtctattttatacttatcggcgggagtgtgctgaaaaattaacacgttttaaaatttatccgacgggaggaagtatgcgcaaaccgtgaccgtctgcacatgatttttttgtttagatagcccaatttccggcataaaatatcactagcacgatagcaataatcaccgtaccgatattcagcttacgccattcaccagagaaaactcgcccgacaaccaaagcactgaaccctagcatgatgccggtgacgatattacaagtcagtacaataaacaccgcacacagtaatcctgacatagcctcgacagaatcatcgaaattcagcttccgcacgttgctcaacatcagtagcccaacatacatcaaagcgggagccgtagcataggccggaaccaggtacgacaacggagaaaggaataaaatcagcaggaacagaataccaaccaccgtagcggttaagcccgtcttgcctccggcggcagtccccgcagcggattcaatatagacagcggcgggagaagaacctatcgcgcctgcaaagatactgcttacggaatcagccgtcagcgctttgcctccattgataatctgaccacctttatccagcagattagcttgccctgctacggctcgaattgtccctgtagcatcaaatatcgcggtcatcaccaacgccaagacacttggcaacaccatcggctgcaaagcccccataatatccatgctaaacatcagagacagcccatcttctcccagcgttggcagtttaaaaaatccttgatatttcactgcgggatcgaaaatcaggccaataattgagatgacgataatcaccaacaaaataccaccgggtactttcttcctttccagaccaataatcgccgccagacctaatagtgccattatcacgggaaatgcagtcaatgagccaaaagcaaccggtaaaccggcatgagggtttttaatcaccatccccacaccatttgccgcaatcagcaacagaaacaacccgataccaataccggttccatgagcaattcccattggcatattgcgtaagatccaagaccgaatccccgtcactgaaatcaccgtaaacaggcatcccatcaggaaaacggcacccagcgccacgggaatactcacctgctggcctaaaaccagactgaacgctgtaaatgcggtcagcgagattgcacagccaatcgccatcggcaggttaacccacaatcccatcaatagtgagccaatacccgttaccaaacatacagaaataaagaccgctgtatgaggaaatccggcttgccccagcatgcccggcacaacgataacggaatagaccatcgccagaaatgtcgtcaatccagccaaaatttcctgacgtaccgtcgttccgcgttcagtaatcttaaaatacttatcgagtttgcattgagttggtgcctgcatgccagacatgtctttcccctgccattatgttgaatttctaacgctatcatctctccactctgcctaacgaaaacgattacgtcgtaagatacttaaaatcggtgctgtactcatgagtgcagccacttctatacgcaatcgtttggcttttcaggtaaaaaatggagagagaattttagacgaatgattatccagtgaataagggatgagaatcaagagataatcataaaatttgttgtgggtaatctccgtatgtacggagaacacaccaatgttggcgtgctgcctccacctccgcccggtttatctccgtatgtacggagaacacactaaaagtatctatttgttttaaaagctctttttaagagcctaaaactctaccaacttttaaagagctaaactagttattaaacataacctaaaaaccagcaaaaatcgcccacaattttgtcaacattcatatttaatcgaaaaatactctttcatataaatatataaatatataaatatataaatatataaatatattataagcatgatttaaatattaattaaaaaataaaaacatagattaattttattaaaacatggataactttaaaaaataacttaatttattatagataacattgattacacacatattaatataaataacattatttattattaaaacaatcagtttaatctaaaaaaatagaaatatgaccagccctctatttacaataataatttatataaaataatgtacaaatataatattaactttatctctcaatgagatttatttcaataaaacctcaacaaggaaaatacactataataactattatcttgagtaatagttataaatgaaaattattttcaataaattcaataagaaacaatattctcttatcataaaataattctatatacgcacaaaacatcaaaccaaataatataaaacactattgcattaatccatcgaatccattactgtctaatatttgacatttaaacactgaatagccgttcaatttaattaatctatatttcttaactttggtaattaatgatgaataacattcatagattttctaacacagatatcaaggcattattcctatttgtagcattcatgttactttatctattaccgggaatttatagtcatactccttggaaacaggatgaaaattatagttttggtatgatccagacaatgtatgaaacaggtaattggctagtccccatcaatgccggtgaacctttcatggaaaagccaccgctatattattggacagccactacatttactcatttattgtctcaatggctgcctatatatgacgccgcaagaacagccactttatttttctccataattaatttttcattcttcattctgctggctcgccgggcatttgatgtacataatttcaccaatagtcgcatatggatcgcctttgcactgtatgcctgtgcccctgggatcgttcgtcatagccacgatatgttcaccgataccgctttgattacaggcacgacgattgggttatatggtttattggggttgattaaaaacgaaaaaaaacgctattccatattatggctggctattggcacagctatcacaatgttatcaaaaggggtgttcatccctgggttattatggatttgcctgctattaacaccggtttttctaaaaaattgtcgggctaaacaatattggctaaatgtttttttcgcggggataattgctctcattttaattttaccgtggccagttatgttattaattgaacacccagacttatttaaagtttggtttttggataacaatatcggccgcttcttagggttttctgttgaagatttaggtgcaagagctgatccaagccgaattccagaagctgtgttattattctcatttccagcaggcctattagcctttatctttattattaaaaacccgataaaaacccttaccaatcaacgttattttattttttcagcatttatattactcggtatcatcttgttacaaatatcagcctccagccgtgcgttgtacttgttaccctttattgccccgatggctatcttagcaacgggcatttttactcaattacccgagaaaatttacagcgctctgagtctctgtttttcaatgctatggtctattctgattctctttgtatgggcaacttattttctatcactctcttctgattacaaacattggttggcacctttaggaaaatggctgccaatgagttatcagatgcacttttccggttttatattcaccagtgccgttattatcaccattatctggctagctaagagcagaatattgtctaaatctcccgccttacgtaccgcacaaaactggaccttagggattgctgttgtttggggattggtatttaccttgtttatcggctggattgattataccaaaggctataaagaagtatttaccgatcttaaacagcatttagcaggagaatataaagccgatgattgcatgtcatcttattttatcggcgaatcagaagcgccaatgctttattacttcgcccatatccttcatcaaagacagaaagattttgctgctccacaaacatgtcgctggcttatcatgttatccgaagatattgaacccgctccgacaggtatgacgttgttttggtctggacaccgaccgaatgataaaaataaaaatttagtggtgtataaaaaagtgatgcctgaaatggctaaatgaatcgattattggatgcgtttttttcatgaacgcatcattaagcatgccaaaaaggaaaacgaggagcgtcttctacaggcgcatcccagaacaggtaaactttccattaggaacgccaaagaaaaataaattctgcgcgttagctcaaaaccttttgctgtaaatgggttaatatttcgtttataaagcgtacataaatcaaatttactttcatacgaaaattaaaacgattaacagaaagagtctgctatgaatacttctttcacctctacagtttttcctgatgattaccgacaaaaaattcgccagatgaaacaagccatgcgcgaacagataggcgatgttgaaggcctgttcgctcaggtatgcgacaaaatagaaaaagagatcgccgccgcccgtgtggatgaaaaaaacatcggtagtgcctggccggaaatacactggagtgatgtggcggaacgcaaagtcacagaacaaaccctacagaagattaaacgtcgtggatgtttggtcgtcagacagaactttccacgagataaagcactggcatgggatcagtccatgcttgattacctcgatatcaataacttcgatcgcgtttatcaagggccgggagataacttcttcgatagccttgaagcatctcgcccagagatttaccccatttactggtctcattcgcagatggaagccagacaaagtgaagaaattgcgcgggtacagtcttttctaaaccgtttgtggaaatttgagtcaaacggcgtaagttggtttgatccgaatatcaacatgatttatcccgaccgcattcgccgccggccaccgggtacaacatcaaaaggactaggcgctcatacagactcgggtactttagagcgctggctgcaacccacctaccaaaaagtgttcaataaaattttcaccaaccgattcgaagaatacgatccttgggatgcagcctaccgtccagaagtgaccgagtacgataatacaacaaaatgttcagtttttcggacatttcagggctggacggcgctgtcttatatgaccctcggtcaaggactcctgcatgttgttcctgtgccagaagcgatggcatacattctgttacggccactgctgaatgatgtccccgaagacggactgtgtggtgttgcccccaataaggctcttcctatctccgagaaatggcatcctcatcttgtccaaggattgtgtagtattccatcattgcaggctggtgattctgtatggtggcactgtgatcttatccactccgttgctcctgtggaaaatcagcaaggctggggcaatgtgatgtatatcccggcggtgccgctgtgtgacagaaatctggcttatgctcaccacgttgcagatgctcttgaacatggcacatctccggcctattttcccaaagaacactatgaaaagaactggaaaggtcgttttacggctgctgatttgaacatcatcggcttgcgtggtcttgggttgaattgagcttaatacaggctctttactattttgtctcggctagctagggaaaatattacttgcgaaattttcttaaaacgctaacccgttttccttgcacctgcggggccgttattttggcgctcagaatctggtgtattcagaactcgctttggggccaatattgtaagggatcttctgacgctattccggcaaatagataaataacatcaggcatggaaaactttggctttcaccagcttacggtaagcaacgggagtcagtttaaagtgttgctcaaatactttactaaagtaatgaggatccttaaagcccactaattgcgctatatacagtaaagtcaggctattatcttgcagaagctgtttggcaattaataaacgctgatcgagcatgtacttatgcggtgagatgcctacctgccccttaaacctacgtatcagggtgctctccgacacaccaacatgagtagcaatgtccttgatcgtgatttgtgaagtcacatgctgcttaatatagctttgtgctatcgacaccatttcatcaaattgcgtgttgcctcccacttgaaaaaacggctctgactgaaaatttgatacttcatgcatgaaatgtttttcaatgatcttagcaatcggtgcactgaaaaactgggcgatcaagtaaacaagtagttcggtttgggagttaatgcttctcacacaataaatgttgtcacaataggtgatacttgccttacgatttagaccaaccgtcggaaactgacgttcaaacttgccatagaaagaccaatgagttgttactgttttttcttcaagcaatcccgctttcgccagccaatataccccggtgccagtcgcaacaataatagcttgattttctttttgccgacgcaaccattcgagaatatcttccctgccagccatagaaggtgacggatttccccacatcggaggtaaaaaaaccaaatcaaaatcgacaggatccgaaaatttatggtgggtatgtagcgtaatctgcgctatgtgttcgttattttccttcgcatcaccaataacagacatatagaagggttcttctctctgctgtacccagcttctcaagctgctggcactgtttaacatatccgatgctaacgttatcccgctttgtaacgctttatcatataagacaaatgctattttcattccttttctccagaattgtgcgcacctcttttttatatcaccaccaatatttagcttcgagatagtcgataaattgtgaccatattctcagctttaatgacagggatataagagttttaatttatcctaactgctagacgatgtcgtcatgagactttcagccaaagaacaaggcaacggatttgcactgcggcaagaaaagacgcgctattttttgcatagcgagtggctataccacgccagcgcttaagatgaaggaaagcattttcaaccaaatggcgaagccgatagagctcacgatcatattctctggcggccttccgatttttccggctagggatctggacttgcatgccttgttgttctgctttttctactattgcgttgctatcatagcccctgtccgccaatagatgctctgcatcgagtcctttaattaaggtctcagcttgtgaacaatctgctgtggtaccgcttgtaataataattctgaccggcataccatgcgcatccacggccaaatgtatcttggtattgagcccccttttgtgagccccatatcctgattaccccctttagcgcctgccgcatcgggatgaaccttaatatggctggcatcaatcattaaccactcgaaatcggggtcattaaccaattgttcgagcagtttttcccatatccctttatctctccagcgacaaaaacggcggtgggtatttttccagtcaccataatcagtatgtaggtctcgccaaggcgcacccgtccgtaaaatccaaaacaccccattgataaaacgccgattatcttcagctacacgcccccaagcgccttgacgtcctggcaaatgaggttcaagcaggctccagacgcgatctgaaatatcgtggcggcggtgtgcaggtgtactcatggttaatcaactcttatgatggaatggtggggcattattattgcacgaattttttcatgacgacaccatctagacttcaagaaaaatcttttcggagttcgtaatgagtaatttacccgtaattgttggtttgggtggtatcaatgcggccggaagaagttctggattccacagctataaacgcatcgtgtcagacagtctcagcgacgagatcatgcaagatacatggctcgatttatgtcatcgaatgggcattgttaaaaatacagcatcggttacaggcgcccatatcgagagtgccaaaaacggcacactgatcagaaaaataacgcacttcgacacgcaaaaagtatcttctgtaaccagtgcgggtcagttgccggaaggatttgaagttggtgatttatataatgcaaaccatcatccgcgcggtttacgtctgacagtctatggagcctcggatttactcagttcaattggcatttcatggccagatatcgccaaattggtggaacccgatcaaatttctgtttatgccagtagcgctctgggtcagatagaccgattttcattggcaggcttaatcggcaacccacagaatggcacacgcattagttccaaaatgctagcgctttcccttgctgacatgccggcaaattttattaatagctacattatcaacagcatcggcaacacatcagctaatctaggtgcctgtgcaagctttctgtataacctcaaacaaggcgtcaatgatatcaaacaaggtaaggcaaaaatcagtttagtcggatgctctgaagcagctatcgtccctgaaattatcgaagggtttcgagttatgggcgctctcgcagaagaccatcaactatgtaaactggatggaaccgatatcgttaacaaccgccgtgctacccgaccattttcaactaatgttggatttaccattgccgaatctgcgcaattcgtattactcatgagtgacgatcttgctttacagtgtggcgccaacatccttggcgctgtgcctgatgttttcgttaatgcggatgccaataaaaaatcaatatcctcacccggaattggtaactacattaccatgatgaaagcagcttccctcgctgaccatctgctggatggtaaattgcagtattcttacgttcaggcgcatggtactggaacaccacagaacagagtcactgaaagtcatatcattaatgaagttgccaaagtttttggactcaattgctgggatgtcaccgccataaaatcgtatgtaggacattccattgccgcctctgcgggcgatcaattagcctgtacattgggggtttggcagtacggatggatccctggtattaaaaccatcgatcacattgccgaggatgtacatgcaacaaatctgaatatcttgatgcagaataagtttgcaggcgagcacggtgaggagatgcgtgccacaatcatcaataccaaaggattcggtggcaataacgccagtgcagttattttatctccacagcaaaccatgcagatgctgaacaaaaaacacggtagctccgcggtctacacatatcatcagcgtaatcaaattgttaaacgtataagtgaagatcaggatcgagcaatttgtcgtggtgaagaatcggttgtttacaatttcggcaacgcagtgatgcaatcatcagatataaaactttcacgtcaggaagtgaaattatcaggatttaaacactctataaagctgccgaatgcagaggaattcagcgcattcttgtgagaaagccatagggaatagccaagtacagtgcagtattcaagcgttattttatggctttactgcctgacatataaaactgcgcctcaaatcataataaattaacgatgccctgtgtatttcagggcatgtctttagtattcattgaaaatcaatctaatcttctatggaatttttaaccaatccactgttttagcatgagataatccatcaaatgccatttttcatgtttatccataaagtcccaaataagttgctttattaggagacagaaactttgtcttataaataatgcaaatgaatttccaatcctatgatggaagtaattccaatagtgcgatctaactccatctatcacaacaagccatatacatccccccagcatccaactatactcccccccactatctaggagatgcttgtttatgccccactcgccagaagagaaaaaacgtgttctcactcgggtcaggaaaatcaaaggccagattgaagccctagaatccgcccttcaacaacaggctgactgcggccctgtgttacagcaaattgccgctattcgtggtgccgtcaatggactaatggctggtgtccttgaaagccatttacgtgaagagctgacaaataccgagcaaacaccagaagcacagaaagcctcgatcgaagatgccgtttctctgatccgaacttatcttcgctgataccccaattagctttattaatccatatccgcgaacgtataacactgcctattcaaaaggagagtttatgaaatcacgagccgctgttgcattcgggccgggccagccccttgaaattgttgaaattgatgttgcaccgcctcaggccggagaagttctggttaaaatcagccataccggtgtgtgtcatacagatgccttcaccctgtcaggggatgatccggaaggcgtatttcccgccatactcgggcatgaaggcgcaggcgtagtcgttgaggtgggtgaaggcgtcaccagcgtcaaacccggtgatcatgttatccctctttataccgcagaatgcggagaatgcctgttctgcaaatccggaaaaaccaacctgtgtgtcgccgtacgggcaactcaaggaaaaggtgtcatgcccgatggcacaacccgcttttcttacaacgggcagcctatttatcactatatgggatgctcaacattcagcgaatacaccgttgtcgccgaagtatcactggcaaaaatcaatccagaagccaaccatgaagaagtgtgtctgctgggttgcggtgtcactaccggcattggcgctgtgcacaataccgcgaaagtgcaatccggtgattcagttgctgtttttggactcggcggtattggcctcgccgtgatccaaggcgctcgtcaggcaaaagcgggcagaatatttgccatcgataccaattcagcaaaatttgaactggctaaacagttcggtgcaaccgactgcctgaacccgaatgattacgacaagcctattcagcaggtcattatcgagatgacagaatggggagtggatcataccttcgagtgtattggtaacatcaatgtcatgcgtgccgcgctcgaaagtgctcaccggggctgggggcaatcagtgattattggtgtagccggtgccggacaggaaatttccacccgaccattccaactggtcaccggccgttcatggcgcggtacggcctttggcggagtgaaaggccgcagtcagttgcctaaaatggtggaagaggcgatgaaaggtgaaattgagttaaaaccttttgtgacccacaccttgccgctcgaacgcatcaatgaagccttcgatctgatgcatgagggaaaatccatacgcaccgtcattcattactaagccgtgttgcagaagttaaaaaccgagctgtgaaaggagtgaacctgtatgttttacagagaggaaaaaatggagaggattgaacgccgcgcttgttttgggggatggcaggatgtttatcagcacgattcagccgtgcttggctgtaccatgaattttgctgtctatcttcctcctcaagctgaacatcagaaattaccggtgctgtactggctctcaggcctaacatgcaatgaacaaaatttcatcactaaagcgggcgctcaacgctatgctgccgaacagggtattatctttgtcgctccagataccagccctcgtggtgagaacgttgcggataatgatgcttatgatttgggtcagggcgctggtttttacctcaatgcaacacaagagccttgggtgccgcactatcgcatgtacgagtatgtggtatcagagttaccagccttgatcgaaacacattttccagtaacagagaatcgcgctattagcggccactctatggggggtcatggcgcactgacaatcgcgctacgcaatccggatcgttatcacagtgtatcggcattctcgcccattgttgccccctctcaagttccttggggagaaaaagcttttcgtgcttatctgggtgatgatcgtgacacatggaaagcctatgataccatcgagctgattgctaatagcgctaagcccttacatttgttgattgatatcggtattgatgatccgtttcttgcagaacagttacgccctgaattgctgaaagaagtatgcgaaaaggccgggcagccttatacactgaatctgcgcacgggttatgatcatagctactactttgtcgccagttttatcggtgagcatatcgcatatcatgctgaggtattgaagggctgttgtgctgataattgatggattactgccagttaagacaaaacgcctcgcaatttagcggggcgttagctaataacatcatttaatattgcattaatacagcgatactttgccaaccagcaccaatcgtccagaaaatcaggaaatcaccacggacaattttttttctttccaacgtttcataaagtgcaacaaatggactattggtcgcagtgtaaccatactcatcaccaataaataatgccttatcctgatccacaccaagttcttcacagagtcgtcgaatgttacttacagaaaattgtgaaaacataaatcccttaatatcagcaggaactaaattatgtcgtgaaagtaacaattggatagattcggatgcggcggtaatacaaatatcatcatcaaagggggtgaatttgacttgtgcggaaacatcatgccggtgaatatttgataatccacatgcagggaaaagtgaattatcgattactgaggtttgtatacgaaattctgagtctataaaaccattgccctgttcagttttatgaagaattaccgctacagcagactctgaaaaacatgagtggtagacgggtgcattactgctgtgagccccaagataatcgctgcctacaaccagtgcaagctggcatgacggatttgccatcatcgccctggaaaccatttctaccgcaactaataaccccgcacaattggcattcatgtcaaatgccagagccctttctccgcctccaatagcatgatgtattttgagcgccgttgaaggaatgagatattctggcgtttgtgaagcaaacacgatgaagtctaaatccttagcctgacatcccagccgctgaatagcatcattagatgccgcaactgacatcgtgagtgttgtatcagatgaatcacggatcaggtaacgatttttatggccaagcgcattcagcaaaccactcatatcaatgccttgggcggcatagtgttctataaaccaattattatcaaccgaagttggaggatgccaaattcctaacgatgcaatcgccactcttgtcatcattgctcctatttataatcgtagtcattggaaatgcctgatttatactgaatagcttcatcggcagggattaagttataagaaaccttaggtatgatcagtttggcctgaagcgattaaatattttgagttacactactaggtaacattggattacttagctgtgtcttatgatcataacaatatacattgcaagaaatgtgctgccatcgaaatagaacagcagtcgcagtggtcgaaggccccattcccataacaattacccagtcagagtcagtcaaatttttattatcctgcatttccataaaaccgaaaaagctctgcgctggccccaagcttccatatttgtgaaaaatagagataattttatctttccctacgcccaacgcttctgcagctgcactggcaacccaatcgctcgggtcatagacgtaaaaagcgctgacctcatttagactaattccgtttgattgacacactttattgcagcactggtaaatcgtctccttcatattattaaatatatattcaccccccttcggtttatagtagacataacgttcaggtacttcattaaattgcaatacatcgtaatgtgcagtactcaaagtatggcaaccagccactgtcataccttgttttcggctaagtactaagcatgcagcaccatcgcttaacaaagttctcgcgggatcgctcattgagaaccaatgcgaataattacacccagcaataacagcaatgttatgaaattcagagttagcaaacatagcagtggcgatttccagtccagttgcaccaccacttgttccgacattgattgacaccaccgggcaagatagctttagttctctggccagtcgtccggcctcatcgcccaaaatgttatcagaccatacctggctaagaatcagataatcaatatctgaaatatccatctgtacctgttttactgctgctaacaaacttactttcattaattcaattaaatcttttttatgctctaaacgccataaagtacgtgatcgagataactgctgttcaccgggtgcgctgaattcattacgtatattatcctctgggtgaataataattttttccggtggcaggatacctgccgccgaaataattgagacgttatttcgcatccaactcctcctttaatttcctgaaagtttcaactctatcaccgagaggagggatctcatatttatcaataaatgcattaattacggcaggtttcttttcttcaattgcatgaataagggcttcacgtaattcttttttattccttacgttataacctgtcgctccaatagactgtccaaataaagcgaagtcaacttgaggtatactgcagtcaagtggcggataacccaatagctcctgcccctgcctacacatattgtaaccggcatcattcatcacaagccagatagcaggtaatccgaatctgactgccgtgcttacttcattcgacatcaggattgagccgtcacctatgataccgattgcacagcgttcttttgatgcagcaagccctaccaacccgcaagcatagtgccccatagcaccataggctgtacttatacgatatctcaatggattcgaaaacttcaggtagcgattagtccagacaaaggaatttcccgcttctgaagcaacataacaatcgaacatatcgatagctatttcctgaaccacactcatcacatcaagcggatggatcacatcttttgcggcatctgaatagcatttatgactgtcatgtggcgctgagatggctttaatatgactgggaggtattactttctcagccatgcaggcatcaatagaagtgagaaatgtttcaatatcgctgtcaatgagaacagtatgcgggggcagattccctttaatttcctgtgcatttagacctatataataaactttaaccttctcaaggttattttgggcataggatgaactcagctcacccaatctgcttcccatgatgataacagctgacaataacggacaatgtaatgttttataaatactttctgtatccgatcctaaaccgctggttccggcataaaggctatgtttttcattaaagatccctttcccccgcggagtagatatgacccgtgaatttgtttttacagcaatctgtgtcaacaacgcagaagcatgccgagcaccaaatcctgcccaaaaaacagcattttcattgacgagcaaatcggctatttcctgtgaatggcgtttcgcattttcgtctaaatcgtcatgagataaggaaagcacctcatcattttcataattgatgatttcttgctgcacttttgctgtcaaaaatataccaaccacgtaaccgtctttcttatttaaccctttccttaattttttctcgacgtcaaagtaatcatccttttggtttatgataatgatttcatcaaaataaccgtgtccatccgggagacacagtccatctatatcttgtactgtagtctcctgcaagttccacttccctgaaggggtaacagacgtgattgatgagatgaaaatgacctttgcaccatctaactttgctgctcttaacccagttaatgcattacttattcccggccccgctgtggcaaaagctacggctggaacctgctgacacaaactgaattcagatgcagaaaaagcgcctcccgactcatgcctacagtgaaatatttttattttttctgattccgttaatgcctgccatataggtgcaataaaccccccggaaaccccaaatgccgctttaacctcacaatcctcaagcaatttaactaaagttttcgcaatattaactgacatgctatatttcgtccttttttaagaataaagcgtattagctatcccaataaaaaataaattcatgatactaatcgctatgattaatgttcactcatagcatgcaatgaaaatctaagtatgcacactaagacaatcccactatttaaattcataatgagatagttacataattatcataataaaaaattttaatgtataattaaaaaacaatccatccagatataattttcatgataatcactcatatattatttattagtcatattacatttaactaagacaaatacaaaattatcagtatatttatttttaagaataatttaaggtattttgtaaagcataaactattatctaaatcggcatcttctattgtagtcattattagatcatgatacgcagataggccacaccttataacttacctattgcaaatatttatttttttctcctgaacccatggaatccgttgacaatcaatacctatattttgatcaccacgatttactcatgaatttaagaaagaagcagctcgacagatcaacgaatgagcttaatcactgagcgatctatcactcgggttctcaccgaggacaataatttattatgggaagtttcagtcaccatccacatgacaccatctttacgccggagggggtattcagttaagaataaaaaaacccagcatatttgctgggttatgaattaattcaaccattaaaaacgcttatttttacacttttaatttatacgtatctgtcaaaaaggaatatcatcatcaaagtccattggcggctcgttgctctgtggagctggagactgtgccggacgagatggagatggttgaccaccaccactgaattgctgagaagcctgtggctgctgaggctgcccccaattaccgccttgcgctggagcatcttgtgacgcgccgccgcgaccgcccagcatctgcattgagccaccaatatttaccacaacttcagtagtgtaacgttcttgaccgccctgatcctgccatttgcgagtctgcaaagagccttcgatataaacctgagagcctttgcgcagatattcaccagcgacctctgccagtttgccgaagatcaccacgcggtgccactcggttttctctctcatctcaccggtttgcttgtcacgccagctctcagacgttgctagagtaatgttggcgactgcaccgccattcggcatatagcgaacttccgggtcctgccccaaattacccactaaaataactttgtttacgcctctgctggccattgggaatactcctgatgaaatgaattttgctaaaaatggatttctctaattataagcaaagtagtttaccatgcgaggactaagtttaaacatagacccgttatattatactttgcgaagtttatcgtactttacactgtaatggttgcagcatgaatatccatctaacactgtatatccattcagcaatatttgtgcaataataacgcgtttatttgttacacactatcaattatctgggaagtcgtacatggataacatcgaagttcggggcgcccgcacccataatctcaagaatatcaatctgataattccccgtgacaaactgatagtcattacagggctatctggctccggtaagtcgtccctggctttcgatacattatatgcagaaggtcaacgtcgttatgtggaatcactctctgcctatgcccgccagtttttgtctctaatggaaaaaccggatgttgatcatatcgaaggcctctctcccgccatttccattgaacagaaatcgacttcccataacccacgttcaactgtcgggacgattaccgaaattcacgattatctccgcctgctgtttgcacgcgtgggtgaaccgcgttgccccgatcatgatattccgctagctgcccaaactatcagccaaatggtagataatgtgctggtattaccagaaggccagcgtctgatgctgctggctcctgtcgtcaaagaacgcaaaggggagcacaccaagctgctggataacctcgccgcacaaggttacatccgcgcccgtattgatggagaagtgtgtgacctgtctgacccaccaaaacttgaattacaaaaaaaacacactattgaagtggtcgtcgatcgcttcaaagtccgtgccgatctggctcaacgactggcggaatcattcgaaaccgcgttagaactttccggcggaacggctgttattgccaatatggatgacgagcaggctgaggagttaatcttctccgctaattttgcctgttccatctgtggttacagtatgagcgaactggagccgcgcctgttttccttcaacaatcccgcgggcgcctgccctacttgtgacggtttgggcgttcagcaatttttcgatcctgagcgagttatccagaatggcgatatttctctcgcgggtggtgcgatccgaggttgggatcgccgtaatttctattacttccagatgcttaagtcattgtcagaccactataaatttgatatcgaagttccattcaatgacttagacccagccatcagaaaaacagttttatacggttcagacaaagaatccatcgagttcaaatacaccaatgatcggggcgataccacggttcgccatcatccgtttgaaggtgtgttgcataatatggagcgccgctataaagagacagaatccaccgcagtgcgggaagaactggcaaaatatatcagtaaccgttcctgcatctcctgtgacggaacccggctgcgcaaagaagcgcgttatgtctttatcgaaagcaccacactgccgcaaatctccgagttcagtatcggtcatgcgatggcgtttttccaaaatatcaaactgagtgggcagcgcgcccaaattgctgaaaaaatcctgaaagagatccgagaccgcctgaaatttctggtgaatgtcggcttgaattatctaaccctttcccggtcagcggaaaccctttccggcggtgaagcacagcgtatccggctggccagccagattggagcgggtctagttggcgtcatgtatgtactggatgagccatctattggcctgcatcaacgtgataatgaacgtttgttagaaaccttgctgcatctgcgcaatttggggaataccgtcatcgtggttgaacatgatgaagatgccattcgtgcggctgatcatgttattgatatcgggccgggagccggtgtgcatggcggcagaattgttgccgaagggactattgaagatatcatgactaacaaggagtctctcactgggaaattcctgagcggtaaatgtaaaattgcgatccctgagcagcgtgttcctgccaatcccgacaaaatactggaattaattggcgccaagggcaataacctgaaaaaagtgacattaaaactgcctgtcggcttgttcacttgtgttacaggtgtttcaggttccggaaaatcgactctgatcaacgatacactattcccaatcgcgcaacgtcagttaaatggagcgaccaatattaatccagcgccttaccttgatgttcaagggctggagcattttgataaggttatcgatatcgaccaaagtccgatcggtagaacgccccgctccaaccctgccacttatactggtgtgtttacgccagtgagggagttattttctggcgtgcctgaatcccgcgcccgtggctatacgccgggacgtttcagtttcaacgtcaagggtgggcgctgtgaagcgtgtcagggtgatggcgtgattaaggttgaaatgcacttcctgcccgatgtttatgtgccttgcgatcactgtaagagtaagcgctataaccgcgaaaccttggaaatcaaatataagggcaaaaatatcaatgaagtgctgaatatgaccattgaagaagcccgtgagttttttgatgcggttcctgctctcgcccgaaaactgcaaaccttgatggatgtcggtctttcctatattcgtctggggcaatcggctaccacgctctcaggtggagaagcccaacgggtcaagctgtcacgcgaattatccaaacgtggtacaggccagacgctgtatattcttgatgaaccaacaactggcctgcatttcgccgatattcagcaattgctgtctgtcctgcatcaattacgggatcagggaaatactatcgtggtgattgagcataatctggatgttatcaaaaccgctgactggattgtcgatcttggccctgaaggtggcaacggtggcggtgaaatattagtgtcaggaacaccagaagaagtggctcaatgtgaagaatcccatacggcacggtttctgaaaccgatacttgagcgtcaataatattctttaacatctcacataaacaaatattctccccactctgtggggagttatgcccatttgttgaccaattttatttttccccatgcaataaagggcatttcctacaatcatttctaatgaaataaattttgcttaatcaatgatcttttattgaactaatattattactgatcacattatcggtgcattaatgccataatgatataacatatgctttaaagtgataatggagattcaacatgtatatgtttttacctttcttaattgcgttagttatcattgccacggttattatcggcaagaaaaaactgacttacattctttggtttgcattattaatcatcacggtattttggtttaaatatcatgcgactgatgcattgaacctttctttctaaccggagaccataatgaataatacaatgtcagcatcccgcagtcttaatcctgcaatggtcttgaatatcctgggtctattcggcatcagtgtcgttttgataatcgcgttctattatcaattggcacgttttgaacttccctgcccattatgtctgttgcaacgtgcaggtatcatcatgattggcttaggttttctattcaatatttatttcggtattaaaaatgctcactacagtctatctttgcttggctgtctcgtgaccggttttatcgctatgcgtcaagtctctctacatatcctgccgggagatacaggatatggctccaccttcttaggcttacatttttatacttgggccgcagtcttatctattcttaccattattgccatcgctgtcattatgcctctgaaagcaggcaacaccgattcatcaaggtacacaccgcccacattaggcaaaatagccatggggctgtttgcgtttttgatcgcagccaatctggtttctactgtgctggagtgtggtagcgggcagtgtgatgataacccaacattttatcagctactgaaaaagtaaccctttttcattggaatagctaagacaggaaggctgatatattctacagccttctctctacagaaatattcagcgactatttatttaacgtcagctctgcttaagaaccgctatttaaaaatcacgtaaattcagactcggctttttaccaaaatccgctgtaaaccctcgatagggcggggagcagtcacagagtaacagtcggatatatcaacctatggaagatttcccaatgatgaaaaaatttgtaatcaatactttggtttttgccacaatcggaacctcttcgttttatgcctcagcacaaaaaacactgacggcgcaacaggtcgcagagattgtcaataatacgcttacaccgctgctcgaaaaacaggatattcccggtatggctgtcgctgtgatttatgacggaaagccgcaattttttaactatggcgtggcggatataaaaactcgacgcccgataacggaaaataccctgtttgaactgggctcggtcagcaagacctttaccgggatcgccgggggatatgccatgcaaaccgataccctaaaccttaatgatccggtgacggcgtacagttctgagctaacgggcagtcagtggcggggggttaaaatgttgcatctggcgacgtacactgcgggggggcttcctcttcagctcccagattcggtcacggaccagaagtcattgtggcagtactaccaacaatggcagccactgtgggcacccgggatgatgcgtaattactccaatgccagcattggcttattcggtgcgctgacggcgaataaaagccagttgacatttgaaacctatatgacgaagtatgttttcctgcctttaaaactgacgcatacttttataaccgtcccggaatcgatgcagtcagattacgcgtggggatataagaatggccagccggtgcgcgtcacaccgggcatgttgagttcagaagcctacggggtaaaatctaccacgcaagatatggtgaaatatatgcaggccaatatggctccggacagcttgcctgccgataacgataaattaaagaaggccatcctcgcggcccagtctcgttattaccgagcgggaaacatgtttcaggggctgggatgggaaatgcataactggcctatcaatccgcagagggtgattgccgacagcggcaatgacatcgccttgcagccgcttaaggttgaggaactgataccgccacgctctgccgtaccggcatcctgggtgcataagaccggcggtaccgacggctttggggcttatattgctttcatcccggaggagaagattggcattgtgatgttggctaacaagaactatccaaatcctgtccgcgtggaagctgcatatcatattcttaaggcattgcgttgagagtgatgctgtgccggataagtgcggtctggtaacaggctgcgcttatccgactgtagaagaccccctcctgtctccgctaagttgggagcatatcaatttgaccggggtttatgtgtggcgtagtcgtgctaggattagggctggaaaattcaggccactgcgtcaactaaaactggcttagcgaatgaaagggaaacgtaatcattgcctgagggcctccacgattttgttttctttgacaaaaactttgatcgtgcctcaggcactttagttcctttccttaagcagagctcacgttatttagcatgacagaatcgatgaaataacagacttcatgtgcctcttcaggcgttggaacttccagcttacaaagcatcctatccatgactttatctggcacaatatattgacgattgctgttctgttgccgccaacgcttataatcttgttcaatgtaaacaattcggactctagcgttgtagctgataaacaacttgatcaactgctgacgtatttgtcctgtaaggttagtggcattccaaataaaactctgctgactgcgtaacttttctctggcctgctgttttacctgctgcacaacccagccattagcgtctttatcttcaggacttatctgattctcccgacgaatagcatccaagctgattacaggcatacctgcataatactgctggataaaatgatcttttcccatacctggcaatccacacaacaaaatcacctgactgccatagtcatcgtaaggttgataatccggttgtttgctctctgtagaaaaataatggaaacgggcttctcctgaaggaaatgaccggggattacgccagcaattctgctcacgacaataaagttcaaacagttcgatacgctctagtaactcttgcgcatcatgacatgttcgccccagaacatccgcttttgccaataaaaccagcaagtgggtgtcgacacgcaatgaagccgccaatagcgccttttggggatcaggtctttccatcaaccacaatggcaacccatgaaagcgcacaagggctgcgatctgttcccgaatttcaaacggtgtgggaatttgctgaaacagaatctgtctggcagtcatttcacctttgcgggcatggccaggggaaacaatccgaccatcccagtcaacccgcgttgtgctgcgcttttccacatcatgcaatagcgccgccgtccagagaatttcctgctcttctggcgtcaacttttgatattccggcaattgcaccaatgccgccaaaaccatttgagtatgaatagcaagatccccttcggcatgatgaatgggatcttgctgaactccgtgcatatcagcaataaaagagtatgttgctgataaattatcccacgatttatttttactgaatacccaactcattttgtatctcctcctgagtggtattcaaaatagagaggcgctctttgccagtgacgtttccagtgaatatcggttttgacatgatttttccgcacgtatttaaaaacgtgatgtggaaaatcaatcaccgaatatgcctctgcatcacggctgacaacgccctccattgaacaggattgtttggtctttgtatcccatgaagaaaaacagctttgctgctttgctgtttcaataatgtttttcataaatacagattcactccgtgtttcaggaatgataatttcaggtacggtcggaaaatcgaataacgcggcataaaatttgacttcttcccagcctaaccacacctctttaatccgcaccgcaaatacaaagaaatactcttcaagctgacgatattcaatagagtgaatggcatacaggttttcgccaaaaatctctatatcatctaaatcacccttgattaattgccagcgttgacggatctgctgtgtccatgcggattgtgtcggagctgcatgagagcgtgcaaatacaccatactgatttagacagttattctctccgtctaacttttctgtatgaatgagatgtttaattttctgtacatcttgccaccagctatgattaatacgatcatcactggtcgtgcctggtgagaacggataatgaaacgttctaccatactttcttgattgcatatccataatgctttgactctttttaaaaattatcctaataaaagcgtatttacacctttacagattaatgttcatcttaaaatcgatgaaagagctcaaaaattggcattacattttctttattcctgattttaatcctttaatatatggaatattaatactgtgtggtaacaaaaatcccctgcctaatactgtaacaagggattatagttatatattcaagggaataaaaattatcaactaaccgccgcaaacgcctcagcaattttctgtacgttttggtgattcacgcccgccatacaaatacgaccagagactaccagatagacgccaaattcttcacgcaagcgatcaacctgttcctgactgaatccggtataactgaacatgccacgctgtttcaacaagtgatcaaaatttttctctggcagcgcacttttcagagcattaaccaaaacagttcgcatttccttaatacgcaaacgcatctgctcaacttctttcaaccacagtgcttttaattcaggatcgctcaataccctggcaacgacctgcgcaccaaaattaggtgggctggaataaatacggcgcacactggctttcaattgtcctaagacacattcacctgcttctacatcattacagacgactgacaacccaccaacgcgctcgccatacagggagaagatttttgagaatgaattacaaaccagacatggcagttccgcattcgccatcgcacggatagcgtaagcatcttcttctacaccatccgcaaatccctgataggcgatatcaaggaatggaatcaattctcgctcttttgcaacctgaaccacttgatcccactggtcactggttaaatcagaaccggttggattatggcagcaaggatgcatcaaaataatactttttgccggcagttgattgaatgttgccaacatttcaccaaattttacccctttagttttgtcatcaaaataagggtaataattcacgttgatccctgctccagcaaaaattgatgcatggttttcccatgtcggatcacagcaccacacttcagagtcagggaaataacggtgtaaaaagtcagcgccgacctttaacgcaccagagcccccaacggtttggatcgttgcaatgcgcttctgccctaataatggatgatctttaccaaacagcaattcctgaattgccgagcgataggcaagcaatccttccatcgggagataaagagaagcagactgcggcagagcactcatttgttcttctgcggttgcaacagcctgcaattgaggtgttataccctgttcatcgtaatacagaccgatgctcaggttgattttttctgcgcggagatcttttttaaatgcttccaccaacgaaaggataggatcacctgcgtaagcatcaatattctggaacactgcgtatactccctgttactgggttatatatacccttcatctttccgattgcagctttgtcggctgcaacgagaaatctattgggtataaggacactgtaacagacaatataatttaacggattattcgtctagatattccatcacaacacgtgaagtcaatttcgtgatcagttcataagcactgatgccggtgtgttccgcaattttttcaacaggtaggatactcccccaaagggtaacttcatccccgactttgtcatgacattctggccccaaatcgacggtaatcatatccattgagacccgcccaaccaaaggaacttcgcgcccattaatcaatacaggcgtacccgatggcgcactacgcggataaccatcaccataccccatggccacaacaccaagagttgtatctcgctcactgatccaagtgccaccgtaaccaaccgattcgtctgccttatgtttacgcacggcaattaagctggatttcaatgtcatcgcagggatcaggttgaagtcagcagcggttttatctgctatcggcgatgcaccgtacatcataatacccggacgaacccaatccaaatgtgcctgtggccacaataaaatgccacccgatgcagcgatggatttttcacccgatttatccgcaataaatgccataaagcgatcaatttgctggggggttgtatccacggtcagctcatctgcacggctaaaatggctgacgatattaaccggctgctcgacgttatggcagcgactcaagcgttgataaaagtcttccgcttcatcaatacgaacgcccagacggtgcattcccgtatccagcttcatccacactttaatgggatgggataagttcgcttgttccagtgcttcgagctgttcaatgctgtggactacggtttcgatatggttgacaaccagaacgggcaaatccgccgcttcaaaaaaaccttccagtaataggatgggcttgacgatccctccactacgcagagccagtgcttctgcaatgcgagcgacaccaaaactatcagcatcttccattgtgtacgctacttctaaaaaaccatgtccataggcgtttgctttcaccactgcaaccagtttgctgtcaggagcttttactctgacctgttgcagattgtgtcgcagagcgcggcggtcgataacagcagttgccgctttcattttgtcccctcgttactattttccggtcagttggttttggtaagtaagattattcgtcgctatagcttggccctacgtaattatcgaaccgtgaccattggccgttaaacgtcagccttatcctaccgatagggccgttacgctgcttaccaaggatgatctctgccacacctttcagttcgctgttatcgtgataaacctcgtcacgatagataaacatgatcaagtcggcatcctgctcgatagagcctgattcacgcaggtctgagttaaccggacgtttatcagcacgctgctccaagccgcggttaagctgagagagtgccacaactggcacttgaagctcttttgccaaggctttcagtgagcgggatatttccgcgatttccagtgtacggttgtcagatagggaaggtacccgcatcaattgtaggtagtcgatcataatcaagctgagtccgccatgttcgcggaaaacccgtcgggcacgagaacgtacttcggtaggggtcaaacccgatgagtcatcaatatacatattacgtttttccagcaagatccccatagtgctggaaatacgtgcccaatcttcatcgtcaagctgacccgtacgaatacgtgtttgatccacacgagaaagcgacgccagcatacgcatcataatctggttgccgggcatctcaagactgaaaatgagtaccggtttatcctgcatcatcgccgcgttttcgcacaagttcatggcgaaagttgttttccccattgaaggacgcgcagcgacaataatcaggtcagatttctgtaacccggcagtttttttatcaagatcttgatatcccgtggaaacccccgttaccccatcatgtggacgctgatagagctgctcaatccgttcgacggtttcttcaaggatctgttcaatgcctttcgggccttcatctttgttcgcccgattttctgcgatctggaatacccgtgattccgccagatccaataaatcttcactggttcgcccttgtggatcataacccgcatccgcaatttcatgggcaaccgcaatcatatctcggacaacagcgcgttcccggacgatatcagcataagcgttaatattcgctgcacttggggtattttttgataactccgccaaataggcgaacccgccaacgctatcaagttgcccgttctgctcaagggattccgataaagtgatcaggtcgatgggttgacccctttcgagcagacgctgcatttcagcaaaaatgcgccgatgtgggcggctgaaaaaatcattgctggagactcgctcggaaacattgtcccagcgttcattatccagcatcaaaccgcccaacacggattgctctgcttccaaagagtgtggtggaagcttcagcccttccacttggcgatcttttggttcagccatactgttgttagttggtttttttccagccatgtataccgcattaatccactaaacaagaacgaaatagcgcatcagtatacgccatgaaaacagccttgagtaattataaatagtctgtaatgatttcgaatacatcaacgccgtttgcggcgatttcatttcaaacgtgcgaagcttttcccaatatttctaaaataatgagaggctgattcatggcaaaacacatcgagttttccacgtcaggcgaccctgaggtgatccaatattgcgaatttacccctaccgaccctgctcctgatgaggtacaggttcagaataaggctatcgggattaattatattgatacctatatgcgcagtggactatatccaacagcaaatctgcccagtggcctcggaaccgaagccgcaggtattgtgaccaagattggctctagcgtgacatccattaaagtcggtgatcgtgtggcttatgctcaagctacccttggtgcttatagtgaagtacataatgtgcttgaaagcaaattagctgtactaccggacgcaatctcattcgaacaggctgctgcatcacttttaaaaggtttaaccgtttattatctgttctataaaacgtataaaattcaaacgggagaaacttttctgttccatgcggcagcgggcggtgtcggattaattgcctgccagtgggcaaaagcattgggcgcaaaattgattgggactgttggttccgatgaaaaagcagcccttgccaaagcggcgggtgcgtggcaaactatcaattacaaccgtgaaaatattgtcgagagcgtcaccgaaattactggcggagaaaaagttggcgtagtttatgattccgtcggtaaggcgacatggctcaattcgctggattgcctgaaacgacaaggtttgatggtcagttttggcaatgcttctggaccagtgactggggtagatttaggcattctcaatcagaaaggttctctgtttgtcacccgtcctgcaattaatggttatatcactacccgtgaagagttaaatgaagccagcaaggcgctgtttgatttaattgccagtggcaaaatcaatgtcgatgtgacagagaaccagaagtttccattaagtgaagctgcaaaggcgcatcgcacactggaaagccgcgccacccacggctccagccttctgattccttaattccacccacaaaaatgacagagcggatcacatccgctctgtcaccatctccagtgctttttccaccaccataatatcagcgccggtcttatgggcattctcactcaagtggcggcgccactgacgcgcaccgggaattccctgaaaaatgcccaagatatggcgggtgatgtgtcccagataggtgccttttgacaattcccgttcaatataaggataaagcgccttaatcgcatcaatggtgttcaccatcgatgccgcttcattaaacaactcacgatcaacatgcgccagaatagatggattttggtaggcttcccgcccaatcatcacgccatccacatactgtaaatgctgctttgcttcttccagtgatttaatgccgccgttaatggaaagcgtcaattgtgggaaatcttttttcaattgatagacccgtggataatccaagggtggaatttcacggttttcctttggactcagaccagatagccacgccttgcgggcatggataatgaaattatcgcaatcactgtttttcacgaccgtatcaatgaaatcacataagaattcgtaactgtcctgttcatcaatgccaatacgggttttaaccgtgacaggaatatccacaacatcctgcatagccttaacgccgtctgccaccaacttggcttcccccatcaagcaagcaccaaagcggccattttgcacacgatcagaaggacaaccaacgttcaaattgatttcatcgtaaccccgctcctccgcgatcttggcacactgcgccaacgcctggggttcactgccgcccaattgcaatgccagcggatgctcctgctcgttataagccagataattccctttaccatgaataatagcacccgttgtcaccatttcggtgtaaagcaatgctttcttactcaacagacgatggaagtaacggcaatgacgatcagtccaatctaacatgggggcaacggagaagcggttgagagggaattcaacctcttttttgctcacatttttagttgtatcaatattttcaatttttttattttgctgcatttttgtactttcaaggcgatattttcattctctgaatcccttgtcgttccctcatttataaggaagctgatacagagaatagggggaaatttatggtctactatagcacagagaagctccagagcgcagacaggaatccatacgaactaaaagcaacgattgtcgttcttagtagaagatttgaagaaggtaaaaaagataattatcaattatttgctcactttatttgatatcaaaatatcatatcactcttgtaacttggcgatggaaaactcaaataatggaaatcaatttgaataaatacattaaacgccaggcataagagaacattacaagctatcttttccacaccaatgccaaatacactggaaaggcgtaagattgaagcactgttcattgcattagacgcgatagtttcagaagggaataatgtttcaatcctgacaattaatcgtaggtatgattttattagatttagccgcacagcgattaaatgttattaaaaaaatacaatctataagatattaccagaggctcgcatagttatatggttttatatacgtaaatatgaaaccactaaatctcacttaaaacaaataataacgaaaagaaaatatcaacaatgaaattaatcacgcgcaaaaaactgtacataaaaacagtattgatattgattaatcttgtgctttaacattagcatctttaatacacagggaagattatttgttaccataaagaaaaaataaatctttcacaaataacatacaaaaatagaaattaccgtttatgactgttttaaaaaaagatagttattgaacttaatagaatatcatgagaataaacaagggaactcaatggacgtatctaaatatcctgaaaaatggcaagagcgctttaagttttttgaacaatatagtagccctgcgtcgaaagaatttaaggtaggtataaaaacataccgcaaaaaaaacgaattctgataaatataaattggcttgcctttatctttggaattttttatttcttagctataggattatggaaaaaaggtttgagcttattcattttttccattttattagctataggcgttacatcaatatctgaaaccctaatatatggaacaatgccgctaacatatattatgtggggttttacagctaactatgcctattatttaaaagaaataaaaggcgatgatggctggaatccctttaaaggcatcttcactaaataacaattgcgttaattccccttacaacatagcggctttttaaagccgctgctattaccaccatacatgcttttttctaccgcccaagaattaaaattttgttttcagcatattttatcgttcttatctaccaattaatttttatttttatcctgaatagccattcttcagtaaacaaagtattgcgtaacagcagaatagttagtcaccttttcactgacgcgtttaaccatcagcgctgtagccgtctgcctggattccacttccagactgaaaaacatgataatattacaactattggcatcatgctgggtgtgaaaggtgtaatgaaaactatcaatccaaaaaaattactgacacaggctaagacaatctgcctatcacgaggagttcgtttaacacctcaacgccttgaaattctgcgtttaatctcaacgcagccaggcgcaatcagcgcctatgatttattggatctgctacgtgaagtcgaaccgcaggcaaaaccgccaacagtctatcgtgggctagaatttttgcttgaacagggttttgtccacaaaatagaatccacaaatagttatgtgatttgccatcattttgaggaacccagccatacgtcagccatgtttatctgtgagaattgtagttcagtgactgaacgggatgccaaggatattgaatccgctattcagcagttagctcaaggcgtagggtttcatttacgacacagcgtgattgaagtccacggtttgtgttccccttgccatgaaatcgattcctgtacagaacgcgatacatgtcagcataatcacaagactgaagagaataaaaagaaataaagcaaaatagccttaagtttgattgaggcggtcatggccgataaacacatttattttcaaactcccgtaaaacttttattgaacgggtactacgaaaaatgaccgccccagaatggcaaagtgcaattatccgcttttacaatcagatccaatccccgttacgaataatgccaactgccaatccttcaatggtaaaactctgctcacttaaatccacaacgataggctcgaattcagggttttcagcaatcagttcaattctgtttcctatttgtctgaaacgttttactgttacttcatcttcaattcgcgccacgatgatttggccgttatgaacatcctgtgttttatgcacagcaagtaaatccccatccataataccgatgtctttcatcgacatcccgctgacgcgcaacaggaaattagcatttggtttgaataatgcaggatcaactttgtaatgactctcgatatgttcctgagccagcaatggttcgccagcagcaacacgaccaatcagcggtaatcccgccgccccttcttcttcaagaagcaaacggagacctctggatgcaccagagataatctctatcacccctttacgcgccaatgcttttaaatgctcttctgccgcgttaggtgaacgaaaaccaagacgtgctgcgatttcagcacgtgttggtggcatacccgtttgcgaaatatggtcacgcaccaagttataaacttgctgctgtctggcagttaatgctttcatttcgccccctgtttgtttatacagtctgcctgtgagtatatacaggtaaattcgaattgggaacctaccagcccgtaaaagccgctaaataacgtgtattgacgaaaaccatgtcatatcagtgcataaaatacgaccaaaggatcattccccagataaacaacgccagaatcattgtcagaaatactgcagctgatcccatgtctttcgccctgcccgataattcatggtattcactgccaatgcgatcaactacagcctcaatggcgctgttgagaatttccacaatgaccaccagcatgactgaaccgatgagcaaaagcctctcggacatgccaaaatcaagggaaaatgcaatgatgatcgctaatatggctacaatgacttcctgccgaaatgccgcttcattttgccacacagccctaatacctttcgccgagtaccctgccgctttaatgatacgaatcaaacctgttgattgatttgccataaaaaattttcttcaattagcataatatttgtaaggtcatataacttttagctcctattattgtcttatttccacagatctcaaaatctgtttctggtatgcttgcgacgcgttgctaacaagaggcttaaagttgttatgtcaagttggcgtaaaatatattataagttattgaattttccactaaaattcttagtaaaaagtaaacttatccccacggatcccattgcagaactgagccttgatacgacacggcctattttgtatgtactgccgtatcactcaaaaacagacttattgaccctgcgtcaacaatgcctggcgcaagatctgccggatccgttgaatcctttggaaatgggtgacactctgcttccaagctatgtctttattgatgatggcccacgtgtgttccgttgctatgcacctaaacatgaatccgtgaagatttttcattcttatctggatctgcatcgcaataatcccgatttggatattcagatggtacctgtttctgtgatgttcggccgctcccctggacgcgaagggcaagaaggaaatacagcgccacagttgcgtttactaaacggtgtacaaaagttttttgcaattctgtggcttggacgggatagttttgtgcgtttttccacacccgtttcattactcagcatggccaatgatcatggcacggatgatatcattgccaataaacttgcccgcgttgcacggatacactattcccgtcagcgtttggctgcggtagggccacgtttgcccgccagacaggatctgttcaacaagctgctggcatccaaagccattgagaaagccattgccgatgaggcacgtagcaaaaaaatctcacccgaaaaggcgaagcaaaacgctatcaatatgttggaggagattgcagcagatttctcttctgaaaccgtacgtttgaccgatcgtgtcttgagctggacgtggaaccgtttgtatcagggcattaatgtccataacgccgagcgggttcgccaactggcgcaggatggtcatgaactggtttatgtcccatgccatcgcagccatatggattatctcctgctctcgtatgtgctttatcaccaagggctggttccaccacacattgctgccggcatcaatcttaatttctggccagccggcccgatattccgccgccttggtgcattctttatccgccgtacttttaaagggaacaaactctattcgacgatattccgtgaatatctgggtgagttgttttctcgtggttattctgttgagtactttgtcgaaggcgggcgttcccgcaccggccgtctgctcgatccgaaaaccggcaccctttcgatgacattacaggcaatgctgcggggagattcccgtccaatcaccatcgtgccaatctatgtcggttatgagcatgtaatggaagtcgcaacttatgctaaagagttacgcggtgcaaccaaggaaaaagaaggtttttttcagatgattaatgggctgcgtaagctgcgtaatctgggacaaggctatgtaaactttggcgaacccattcctctgatacaataccttaaccatcatgttcctgactggcgcgattccatcgatccaatagacgcccagcgtccgtcatggctgacacctactgtcagcaaactggctggcaatattatggtcaacatcaataatgccgcagcagcaaatgccatcaatttatgcactacagccttgttgtcatcacgtcagcgagcacttactcgcgagcaactgattgagcaattgaactgctatctgcaattgctgtgtaatgttccttacgctgacgatatcactgtaccgaacaaaacagctgaagcattgctggatcacgccttgctgatgaacaagtttgaggtcgaaaaagacagtcttggagatataattatcctgccccgtgaaagcgcggtattgatgacttattatcgcaacaatatccagcacttgctgatcctgccatctttgattaccagtattgtgatgcatcatcgccgcattagccgcagtgagctactcaggcaggtagagctgatttatccgctgctcaagcaagaacttttcatgcgttacagtaagaaaactctgcctgcagtggtcaacactctgattgatgagttagtgcgtcaatgcctgatctgcaacaaagaacaggatatgctcgttctgaaccctgagcgcattcgcccactgcaattgctggcagcaggtatccgtgaaactctgcaacgctatgccatcacactttctttattgaatgccactcccgaaatcagccgtggtgtgttggaaaaagagagccggatgctggcacagcgtctgtcggtactgcatggaatcaatgccccagagttctttgacaaggcggtgtttgccagctcagtcaatacgctgcgcgaggaaggttatattcatgataatagtgataaaagcacgaccagcgctcaaaaactctatcaggtgttgagtgaattgatgtcccctgagatccgtctgacgattgaaagtgccagtatgccaccagagcagaatgacactgaacagacaaacaaaaatcaacattaaagcgttacgctggaacttaactaccacctactgaagtaggtgggttagcgcacttcggtgccgacgactgaaagtcgtcgaaccacgcacctcgtaaacgcgcataggtcaaagaattaaagtcaaagtcaccgtctaaagaccgtggttttaaacctttcatatggaaaaataaagctgaacgggcgggttatccgcccgttatgttaaacatagctgaaaagaataccgaggaataagataaaaccgacgtagttattgttcataaatgcttgaaagcagagagccttttttcgaccagaaatcaatttctgctgataaatgaagagcgaacccgccagcaataacgtccagtagtacatcccacctaaattcactatgcaaccaaccgataccagaataccaagcataataaactgcaaaatacccagaatcagtttatcaaaacgcccaaaaagcacggccgtcgattttacaccaactttcaggtcatcatcacgatcaaccatcgcatactgtgtgtcataaattactgaccatattatgttaaccaaaaataacaaccagcattctaatggtaaggactcacttactgcagcaaaagccattggaattgaccaaccataggctgctcccagtacaatctgtggcaagttactgactcgtttgacaaaaggataaacccatgccagtgccaatccaatgaaagataaggcaatcgtcattttgttcagcatcaaaaccagtgcgaaagagatcagccccagtgtaacaaacaagattttgctttctttttcgctgacatcgccactgggaagtggacgagatttggtacgttctacatgcccatcaaattttctatctgcaaaatcattaatgcaacatcccgcagcacgcatggtatacaccccaatagtaaaaactaacaagatgtacaaatctggcataccttttgctgcgatccacaatgcccaatatgtcggccataataataataatacgccaatgggtttattgatacgcattaaacggcaataggcgagccatttattctgcgtcatactggcctccaatctattttcccccttttattttgttcatcttatatacaggtgattccggcaaaaaaacctctgtgagtaacaaggatttacctgataacctcaacaaagaacgccgcgcccagtgctgcccttgctggcctatttgaatataatcccgagtcaaatttttatcactaaaaagatagcgaccaagtggaactgttcctacatcgaccagccgcttatccgtgccagtcagtgtttcctcagggatcacagtacgtcccagcagccacggaatgttatctccatacaagacaatttcacgcagccaatacctttcacttataggtaagtgctcactttcatctcctaattctgctgctgtaataaagcattcccgaaaaggtacaactgatacctgctgacaatgttcttcaaaacggcgcgtcattgaaccgacttccataagccaatctaaaatatcttcaggaatattagaattatctgccgaaaaccagcggataggtgcaggagttaatattgtgtcatctgccatgtcattttcccattgcggggcacatcattttccccgacagcacaacgaatggggagtgaggatatcacgttgcaagtgaataaaataaaaagttgataacaatttatgtaaatcatcattgttatcgcatatttcaacgtgattgaatgggcttatctaaatattaatgagtaaagaacaagcagaatgatgatcgtaatcataagcgcctcacctcaataaccgtgtttattggaggcgaggcaattttattaagtacgataaaaaatcagattagcgccatgttttgaaacgattaatcaggccattggttgaactatcatggctatttaccgcttcatcatcgtgcaattctggcaggatacggttcgccaactgtttaccgagttctacgccccattgatcaaatgagaaaatattcagaatagcgccttgggcaaagattttatgttcatacatggcaatcaatgcgcccaaactgaatggtgtaatttcgcgtaatagaatggagttagtcggacggttgccttcaaaaactttgaatggcacgacattcgccacgccctgtgcattttttccggctgcgacaaattccgcttccacctgttcgcggtttttaccaaaagccagtgcttcagtttgcgcaaagaagttggacagtagcttgctgtgatgatcactgagcggattatgactgattgcgggcgcaataaaatcacatgggatcagtttggttccctgatggataagctgatagaaagcatgctgaccattagtgcccggctcgccccagataatcggcccagtttggtaatctaccggactgccattcctatcaatatatttaccattcgattccatgttgccctgttggaagtaagcggcaaaacgatgcatatattgatcataaggcagaatcgcttcagtttctgcgccaaagaaattgttgtaccagatgccgatcagcgccagcaggactggaatgttctgctcaggagaagtctgctcaaagtgtttatccatagcatgagcgccactcagcaactgttcgaaattctcatagccaatggaaagtgcaatggataaaccaatcgcagaccacagtgaataacggccaccgacccaatcccagaattcaaacatattctgtggatcgataccaaatttactgacttcctgctcattggtcgaaagtgccgcaaaatgcttggcaacatgagcctcaatctccgcactttgcaggaaccaattgcgggcagaatacgcattggtcatagtttcctgtgtggtgaaggtcttggaggcaatcaggaacagcgtcgtttctgggttcaatgtttttaacgtttctgcgatatgggttccatccacattggaaacaaagtgcatattgaggtgatttttatacgctttcagtgcttcagagaccatataagggccgagatcagaaccaccaataccgatattgacagcgtcagtaatggcttgaccggtataccctttccattctccgctgatgatgcgttcactgaatgacttcatttttgccagcaccgcattgacttgcggcatcacatctttcccatccaccacaatcggggtattactgcggttacgcagggcaatgtgcagcacagcacgatcttcagtacagttgattttttcaccggagaacatactgcggatagctccggacagatccgtttctttcgccagtgcctgtaatttctccagtgtttcagcggtaatgcggtttttggaataatccaccaaaatctgctcgtcaaacgtagcggagaatgccgtaaaccgcgctttgtcctgtttaaacagatcccgcaaatggacgtttttcatttgctcaaaatgctgatgcaatgctttccaagcttcggtctggctagggttgatgtttttcatgaataatgctctctatcaactgtagataaataataggaatacacagattgtaacgacttaactctgtgatgcgtctccctttccttttaattactgatattggtcaaaatagtccatgatttccacccctaattgctgatataggtgaaaacattggatatagggaaaaacgataatttcagttccatcatgaaagatattgatgctcaatgcctaaacgttgactcagtgtagctaacccgatatttctaaaaacctattcctcgaacagaaggttatcatccatgtatgctgtttcatctccttacccgcagtatgttgtcgcaaaattcggcggtaccagtgtggcagactttgatgccatgaatcactgtgccgatattattttggcaaacgcagatgtccgcgtggtcgttttgtccgcttctgcgggggtgactaatttgctggtcgcattggcgacgggctgtgatagcgataagcgggagaagtgcctgaaacagatccgtgacattcaatatgcgattattgaccggttaaatgacgtggatgtgatatgcgaagaaattgaacgcctgctggaaaatatcgagatgctgtcagaagccgcatcattggcaacatctgaggcgttaactgatgagttggtcagccacggtgaagtgatgtccacattgctattcgtagaattactgcgtcaacgcaatgcaaatgcagagtggtttgatatccgcaggatcatgcgaacgaatgatcacttcgggcaagcagaaccagacacccttcaactccatatctcggcggttgagcaccttcaacctcgtttgaataatacagttgttatcacacaaggttttatcggcagagaagaaaaaggccgcacaacgacgctgggacgtggtggcagtgattataccgccgccttgctcggcgaagcgctgaatttacagcgtgttgatatttggacggatgttcccggcatctttaccactgatccccgtgttgcgccaacagccaaacgcattgataaaattgcatttgatgaagcagcagagatggcgacatttggtgctaagatacttcacccagctacgttgctacctgccgttcgttgcggtattcctgtttttgttggatcaagtaaagatccgcaggccggcggcacactggtttgtgacaaaatcgaaaacccgcctctgtttcgtgcgctggcattacgccgcaaacagacgttattaaccttgcatagcctaaaaatgttacatgcaaggggctttctggcggaagtttttacgctgcttttacgccataacatttcagtagatttgattaccacctcagaagtcagtgtcgccctaacgctggatacgactggctctaccagcaccaatggcagtttgctgactaatgctctgctgaccgaactttctacattatgtcgtgtagaagttgaagaagatctgacgctggtggcaattatcggtaatgagctttcacaggctaaggggctggggaaagaaatttttggcacactggaatcttttaatatccggatgatcagctatggcgcaagcagtcacaatgtatgtttgctcgttccagggaaagatgcggaatcagtcattcagaaacttcatcagaatttgtttaaggtgtgacagaaaaaaccgctttagcggttttttctgatttcgacaaagaaggtatttaacccaacttaccaatgtttcgccaattcacaccgtgctaatgctgaaagaatcctctgcaactatgatattcgcggtgtgagctgacgtcattaagatgatccatcctcggcctgatgtagataaattggatatctcagagtggctccactcatcggatgtgttttcccccgctttatcatccataataagaaaacgaaaataaattccatttttgctttagcaaaatcagggttgctacacagacactttcagagggcattttatgagtacagccgttgccaacaaacgtaccaaaaaaaccaaaataacggcaaatagtgccgctgcaagcggtcaggttcagtccttgagccgagggcttacacttttggaatatatttccgattcacaagtaggtgttgccttgaccgatctggctatacaagctggtttgcctaactccaccacccatcgccttttgactacattacagcagcatggttttgtccgtcaggtaggcgatttgggattatgggttatcgcttcacatgcctttgttgtcggtagcagttttctgcaaagtcgtaatttgatggtgctggttcacccaatattgcgccagttaatggaagattccggcgaaaccgtcaaccttgccatcctgaatcttgatgaatatgaagccgttattgttgatcaggtgcaatgtaatgcgctgatacggatgtctgcccccattggcggcaagctgccgatgcatgcttccggcgcaggcaaagcgttgctttctacactgtctgaacaaaaacgcctccagttactccataaaaaaggtcttcatacctatacccagcatacttacaccaccgcagcagccctgaaagaaaatcttgaacagatccgcaagcaaggcttttcgctcgatgatgaagaacatgcccttgggttacgctgcattgccgcctgtatttacgatgaacatcatgaagcgtttgccgctatttccatctccggctcaatttcacgtatctctgacgatcgagtcactgaattgggcgcactcgtgatgcgggctgcaaaagagatcagccgggaatatggcggtattaagtaaattgggtctaaatttcccttaaaaggtctatttgaactgtttggttcactgcgaacccaactatcaggctatcgggtgcagaacaaggcgcctgttgcatcacattttaataacagggattttaaatcccttgtatccgaatttggcgagaggaaactgctaatgaataattggaaaataaccgcagaaaatatcctgaccgatggccctgtcgtccctgttattgtgatcagtgagattgaacacgcggttccactggcaaaagcgctgattgccggcgggatacgtgtactggaagtcaccttaagaactgaatgcgcactggaggccatccgtcttatcgccaaagaagtgcctgaagcgattattggcgcaggtacagtcattaatcctgaacaattggccgcagtcaccgaagcaggcgctcagtttgccatcagcccaggattaactgacgcgttattaaaagccgcaactacgggctcaattccattgattccggggatctctacggtttcagaattaatgcttggtatgagttatggggtaaattgcttcaaattttttccagcagaagcgaatggcggcgtgaaagcgctaaaagccattgcaggcccattccctcaagttcgtttctgcccaaccggtggtatttcacccgacaattaccgcgattatctggctctaaatagtgttctgtgtattggtggttcatggctggtgcctggcgatgcgctgaaaaaaggtgattatgcccagattaccgaactggcacatgctgcaattgccggagccaaagcgtaatttaattgattaagtatattgaaatgcggaaattcaacatttccgcattgctaaacccattaatcatgttattcctaacattctctcaaattaattaattccatttttaaatattatttttaataattgagaacttcatcacgattcatttaataaaacgacaaaaacaatattcaatatcattattgattaattgcttttgataatatccatgtacccgtgccattcccccgatctgacagcagtgaagtatacaccttatatacagcaccaggttggtttaccaaccaacaggtatcaagaaaaccaccatgtacattattaaaactgttaagcagacgaatggcatttccctcacggattttgccatcaaattcgttagccgtatctgtaaaaatatgccatattgccgtatcgagggcgttcacgggtctatctgcggtataaacattatagagctcaggagagggtgcatagccacttactctcaaataccctccattgttccgataaaaattcactagaaataccgtatcaccactgtaaatttccgttcctaaacttttactttccgcagataaaatctgccatgaacccgagcctgtatcacgatttgatgaaacagaagtgacaacattatatttttctcccagcgatgcagactgcccataaacatcaagataactaccattttcgtgcctgtttttaatgtgaaggatatcgccgtataaaatgacattagccattattctctccctaaatattgtttaaaatgaataggaatattctttcaatggttgtgattatgattatttaattacggaattacttttattaaaacaaattctatagtaacaaagaggatcatatcattgaaagacaatagatgaatagccagtcatttttaattaatatcattcaatctctaatctttatcattcagtaaaatattattttcatctatgggaaatgtgatatcacgacttgtattttttgtttcctaaatttaattacgctgactgaacctctgtttgcgccgataggcaaaaacatcctccacatgcccatttttaatgcgctcttgtaatgccaaccagtaatccgctttgaataggtcactatggctttcttcaaagtaacgccggacacggttgtcaccacataaaaaatgccgaaattcttctgggaaaacatcgttggcagcaacgctgtaccaaggttcacttgccagttcatcttccggataacgtggtggagggatattccgaaaattcacttcagtcatataacagatttcatcatagtcgtagaaaatcacccgcccatgacgcgtaaccccaaagtttttaaacagcatatcacccggaaatatattcgccgcggccaattgtttaatagcgttcccgtattcttctatcacatctttcaactgcactttgtctacctgttccatataaatattcaacgggatcattttccgttccatataaaggtgttttatcagaactttatcacccagatcctcgagttttgccgggatttctttttgcaattcttccattaattcctggctgatatggcgcttctcaatgacaaagttctcaaattcctgcgtatcggccattcttcccacacgatcatgttctttgaccagacggtagcactcctgaacacgttcttgagagacttctttctgcggagcaaatttatctttgatgactttaaatacacgatcaaatgaaggagaagcgaagaccagcattaccatgcccttcacgcctggagcaatcgaaaactgttcttgagatgcgttaataaacatcagatattcacgatagtattctgttttgccatgtttctggcaaccaatcgccatgtataattcggccgttgattttgtcggcagaatttcacgcagccactcaactaatgctgccggcaaggaggcgtaaaccataaagtaagaacgtgcgaaaccaaaaacaatgctggcatcatcgcggcacgttaggcaggtatcaataaagatgccgccagattcgttatggtggatgggtaataaaaatggataaaccgttgtgcccagcctaatttttcccaccagccacgccgctttattacggtaaaatagttcattagcaatctgaaatgtcgcctgtaataaatcgtgttcagaaaatgttttctgtaagtattgcgtgatgtaatcaatatctcgatccaaatcttcccatttaaggcgcaatggcacatcatttaatatcgttcgcaacattgacgcaatattactgttagaggaaaaatcccgcgacaatggacgtgaaatatggcgaaaacggcaggcgggctgggaagaaaaaataaatagattttctggctttaagttacggtgttgaaacaaacggcaatagactgaattaaaaaaactttccgcaatctcaaaacggggatagtccggcagcaaacgggtataaacggcttttgctttagcaatgtaatcttcgtcatattgcagtgtaccgtgaatgcatttcagctgttccacgactaaaccaacatgatggtcatacaggttgattcgctttttcatggctcgctgtactgcatgccaatccgcctgctcaaaacgttgctgtgcgcctgaagtcacttccagaaatcgaccatattgcgcatcgaatccctgcaaaatggtttgtgcaattaaatgcgcgagatctatctccatcatcgccaccttatctgacgcgtaaaggggaattcctcacagaatcccccacctgataatatcaatgggcatgataaacctaaaattgctgctcttctgtcgagccagtaagggcggtaacagaagacgttcctccctgaataatcgttgtcactttatcaaaataccctgtcccaacttcctgttgatgtgaagagaaagtataaccacgctcaagagctgcgaattcaggtccctgaactttttcgacataatgtttcataccttcaccacgggcatagtcataagccaaatcaaacatgttaaaccacatgctgtggataccagccaatgtaatgaattggaatttatatcccatggcagacaattgctcttgaaagctcgcaatggttttgtcgtccagattctttttccaattgaaggatggagagcagttgtatgccagcaatttgcctgggtattccgcatgaatggcttccgcaaaacggcgagcggcctcaagatccggcgtagaagtttcgcaccaaacaacgtcggcatatggggcataagccaacccacggctgatagcctgatcgataccggctcgggtacagaagaaaccttcagcagttcgcttgccagtaataaattcgctgtcataaggatcacaatcagaagtcagcaaatctgctgcgtcggcatcagtgcgtgcgactaacaaggttgaaactccggatacatcggcagccagacgagcagccaccagtttctgaaccgcttcttgagtcggtacgagtaccttaccccccatgtgcccacattttttcaccgccgccaattgatcttcaaaatgaacagccgctgcgccagcctcaatcatcgctttcatcagttcaaatgcattcagcacaccaccaaaccctgcttcagcatccgcgacaatcggcaggaaatagtcggtgtattcctgactgtccgggccgataccatttgcccattggatctgatctgcacggcggaaactgttattgatgcgtttaatgacattaggtacagaatccactggataaagtgattgatcggggtacatgctggaagcagtatttgcatccgcagcaacctgccaaccagaaaggtaaactgcctcaatacctgccttggcttgctgaagtgcctgaccgccagtcagggcaccaagtgcgttcacatagcctttttttgattttccatgcaacagttcccacaactttttcgctcccatctgcgctaaagtgtgttctgggttaacggaaccacgcaatttaaccacgtcctcagcactgtatgggcgagtaatgccttcccaacgtggttgtttccattcttgttccaactgagcgatctgttgtgttcgggaaatgttcattttcttctacttcctattcttaattaatcggatattgtcgtttttaaattaatcgagtaattgataacccggcaaagtcaggaaatcgattagctcatcctgtgtagtaatccgttccatcagattagaagcctccataaatcgcccttggttgaaattcatctctccaacttcttgtttaatagtgtccagttcttctttcagcatttgcctgaacagttcttttgttacttttttaccgttggaaagtgatttttcatggcggatccattgccaaatagatgttcgggatatttccgcagtggcggcatcttccatcaggccataaatcggtacacatccattacctgaaatccatgcttctatatactgcacagcgacacgaatattcgctcgcattccttcttctgttctctctcctaagcaaggttcaagcaattgttccgctgtgatcgtttcgtcttcttcacgggaaactgccaattggttcggccgctctcctaaggtggtgttgaagactgtcatcgtaatatctgcaagcccagggtgcgctatccatgtaccatcgtgaccgttcttagcttccagttctttgtcagccctgaccttgtccataacccactggttttgttcaatatctttactcggtatgaatgccgacattccccccatcgcaaatgcaccacgtttatggcaggttttaatcagcaagcgagagtaggcactcagaaaaggttgtgtcatcgtgaccgactggcgatcaggcaaaacacgatcagaatggtttttcagtgtcttgatataactgaaaatgtaatcccagcgtccacagttcagcccaacaatgtggtgacgcaggtggtagagaatttcatccatctggaatacagcaggcagtgtttcaatcagaacggtcgctttgatcgtgccttttggcagattgaagcgctcttccgcaaaactgaaaacatcgctccaccattgagcttcgtggtagctctgaattttcggcaaataaaaataggggccgctgccatttgccagcagatttttatgatttagatagaagtaaagtgcaaaatcaaatagaccacccgagatcggttccttcttgtaaagaacgtgtttttctgacagatgcagccccctgacccgtgcaaccagaactgccggttcagatttcaattcataacgcttaccttgctcactggtatatgagatcgtaccgttaactgcgtcccttagattaatttgcccactaatgactttatcccatgaaggagccagtgaatcttcaaaatccgccatgaaaactttaacatttgaattcaaagcgttaatcaccatcttacgttctactggacccgtgatttcaacacggcgatctttaagatcgtcaggaattccctgaactttccagtcaccctctctaatggaaattgtttccgaaataaaattaggtaatgctccatcatctattttttcctgccagtgaattcgctcttccaataattttttacgcctgtcagaaaactcaacaactagatcttctataaaaccaatagattcaggtagtaatatctgattttcagcttcaccaaaaggctttgtaaaggttaaatcagttgttaatgcttgctgtgtcatcccccactcctcgtctttaaaatgcccacttgagtaagagtaatcaatattaaaaataaatcaaaaaccatttccattatttaaaatcaagtaaattagtttaaataaatcaaatgattaaatgaatttattaaaaataaaaacaggaaaataagttccaattaattaggaataaaagtgttaactttttgttatatataagaaataatcggggaaggtaaataattctaaaaaaatagaaaattaaaaaaatgagaaatggctcgcttcagctaattctcatttttatttttttacagattcaatctaaggtaggattcatatacgtcagatcgtatggcgtaatttggtagacatagtaattaagccaatttaaaaacaataagtgaccgtgactacgccaagatgcaactggtttattttcaggatcattattcaggaaataattgaccggtagtgctggctctaaccccgcagccagatcacgccaatactctgccgctaatgtatcaactccatattcaggatgacctgtcacaaataccaaccttttgtctttactggcaaacaaataagcgccagcgtcttctgaacgagccaagatatctaggtcggtatgctcacggatcactgcctctggaaaatccgcaaaacgtgagtgaggtgccaaaaaggactcgtcaaaccctctggtcaataacgcaaaaggatctaaggttatatgggagtaaacaccggataatttagtcgttctcgtatatttaggcaggttataaagaacatttaaggcagcttgaacagcccaacaaacaaagagcgttgaagtgacgtgatttttagcccaattaacaattttttcaatttcggcccaataagtgacatcttcaaattcaaccaaccccaaaggagcccctgttacaattaacccatcgaaattttgatcttttatagactcaaaatcacaataaaagttatccaaatgttcctctggagtatttttacattggcgactatcaatacgcaacaattgaatatcaacctgtaacggtgaattagataataacctgataaagtgattttctgtttctatcttcttcggcatcaggttaagtaacagtactttcaaagggcggatatcctgaatattcgcccgtgttgaggtcataacaaagatgttttcattgcgaagaatattcaccgccggtaattcatccggtacacgaattggcattactgaaacctcgattgttaaatcacttgcatttttagacttctagatagccaaattaaatcaaaagacaagatcaatgtcgagttattgtactcaaattgaaattatttcattttattctatcgaataagaaagggtaataaggaaaatggaaaataataaagcagaaattgagtaaataatagaaaaatacaaacgcaaaaaagccacccggtggggtggcttctctgactaaatacatgtctggcagtgccctactctcacatggggagaccccacactaccatcggcgctacggcgtttcactgctgagttcggcatgggatcaggtgggaccaccgcgctatggccgccagacaaattctgttttcaatcccgaacaagctgctgtctttcatctgaaactccgtctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccgggcagtgccattggcatgacaacccgaacaccagtggtgcgtccactccggtcctctcgtactaggagcagcccctttcaatcttccaacgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgag

SEQ ID NO: 16888 - DNA, 228189 bp, Xenorhabdus bovienii
  unsure (1)..(228189): unsure at all n locations
nnnnncccggcaacttaaccaacgaggtaatggcttcctgttcaatagcagtcacaaattgctgagcagacatccctgacaggatcgccagtgccagcttcggccctacaccattaactttaatcagttcacgaaaaagtgcgcgctcttgcttatcattaaagccgtataataactgagcatcttcacgcacaataaattgagtgaataaaatagcctgttggccgatttcaggcagttcataaaaacaggtcattggcatatgaacttcataaccgacaccattggtttctaataaaactaatggtggctgcttttccaacacggttcctctcaaacgccctatcactgtttaccccctgaaaataaaaataaatcattccgctgcagcttatagcataaaaaaagctggacgtatatccagcatagtttatttcaaacgccctcgcgttaaatttaaccgcacatcacctatacgcaataagttttggttaaaatggcaatgagtaatcgcaatagccagagcatctgcggcatcagcctgcgggtcagcagacaatttaagcatagagcgaaccatatgctgaacctgacttttttctgccgccccagtaccaacaacggtctgtttgacttgacgggctgcatattcaaatacaggaatggattcattgaccgcagccacaatcgctacaccacgagcttgccccagtttcaaggctgaatccgcatttttcgccatgaaaacttgctctatcgcaaaaacatcaggtcggaattgggtaatgatttcggtaacaccggcatagatcctctgcaaacgattgggtaaatcatctacttttgttcgaatacaaccgctaccaatatagataagttgccgtccctgctggcgaatcacgccataccccgtgattctagagccggggtcaataccaagaataatcgccatatcgatttattccacttgtgatatgggataaaaacgttagagaaagtgccctgagataaggaacactttctctacgctgtgaaccctgatggtaattacagctgcgctgcaatttcatcagagatttcaccattgtggtaaacctcttgaacgtcgtcagaatcttcgagcatatcaatcagacggagtaatttaggtgctgtttctgcatccagttccgctttggtggatgggatcatggaaacttccgcagattctgccttgaaacccgccgcatccagtgcatctttaacatcgccaaaagattctggtgtagtataaacgtcaattgcaccatcatcataggtttcgacatcatctgcacccgcttccaaagccgcttccatcaccgcatcttcatccagactcggtgcataggaaattacacctttcttggtaaacaggtaagaaacagagccatctgtacccaagttaccgccagttttggtgaaagcatgacgtacatcagaaacagtacggttgcgattatcgctcaaacattcaaccataactgctgtaccacccggaccgtaaccttcataaatgatggtttccatgttatccgcgtcatcattgccaacaccacgggcaatggcacgattcagcgtatcacgagtcatgttgttggacagcgctttatcgacggctgcacgcagacgtgggttagaagccggatcgcctccgccaagacgtgcagctgttactaattcacggataattttagtaaaaatcttaccgcgttttgaatcctgcgcagctttgcggtgtttcgtattggcccatttactatgacctgccatgaaaatatctccgataaaacgtctagtagactaaataacaaactcttcaattgcctgccgattgctccatgacttcgttaatctggcagcctcttcgaccgccagccattgataagtcaaatgttctgtcagcaggatctcacgctcctcaggtaacgccagcaaaaaccaatgttctttattgcgcgttacacccggagcatatcgataacgtaaatgtgaaaaaatctcataataaagacagcgttgacaatctgtcagttcaaaacccgcattaacaatatcaatgccaatttcttcctgtacttcacgtaacgccgcctcccacggtttttcgttcccttcaaggctaccggttacggattgccagaattcaggatcgtcccgccgctgtaacatcagcacccttttgctggtagccgcataaatcacaaccagtacagactcagggcgcttgtaatccattattcgctcttttttttaacgactgagattgccagttcttccaatgatgcaggattcgcgtaactgggtgcttcagtcatcaaacaggccgccgctgttgttttcgggaatgcaatcacatcgcggatattatcggtatccgtcagcaacatgacgaggcgatccaggccgaaagccagacccgcatgaggaggagttccatatttcagggcattcagcaggaaaccaaatttttcctgctgttcttcctcattgatgcccagaatgcggaataccacctgctgcatctcattgcgatgaatacgaacagaaccgccccccacttcgtagccattgataaccatatcataagcattcgcaatggcagattctgggtcatgttccaattctgtcgccgacatatcacatggagaagtaaatggatggtgcattgcatgcaggccaccttcaccattgtcttcaaacattgggaagtcaatcacccaaagcggtttccagctcgccagatcagtgatgttcaaatcacgtcccagtttcaggcgcagcgctcccattgcatcggtaacaacatttttcttgtcagcaccgaagaacaggatatcgccatcctgtgcattggtacgggacaacaaaccttccaccacttctgctgacaggaatttagcaaccgggctttgcaccccttccagaccggcagcacgattgttaactttcatccatgccagccctttcgcgccataaataccgacgaatttgccatattcatcaatttgcttacggctcagttcagcaccgcccggtacacaaatggtggctacacggccttttggattgttggcaggttcagcaaaaacagcaaattccacgtttttcactaaatcagcaacatccaccagttccagtgggttacgcagatctggtttatctgaaccaaagcggcgcatcgcttctgcaaatgtcatgatggggaagttacccaaatcgacacctcgtgcgtcaagccacaattcacggatcattttttccatgatttcgcgaacttgttccgcggtcataaatgaggtttcaacatcgatttgagtgaattctggctggcgatctgcccgcaggtcttcatcacggaaacatttcacaatttgataataacggtcaaaaccggacatcatcagcaattgtttgaaaagttgtggtgattgaggcaatgcataaaacttgcctttatggacacggcttggaaccagatagtcacgcgcaccttctggagtggccttggtcaacataggggtttccacatcaaggaagcccgcattatccataaaacgacgaacaaaactggtgacttttgcgcgggtcttcaagcgcagtgacatctctgggcgacgcaaatcaagatagcggtatttcaagcgctgttcttcactgttgttctgattgctatccagtggcaatgcctctgaacgattgaaaaccatcaggctatctgcgaaaacttcaacttctccagtggccatttctttattgatctggctgtcaggacgggcgcgcactatccccgtaatttgaatacaaaattcattacgcagttcagaagcctgagcaaatgcttctttttggtctgggtcaaaaaatacctgaacgataccttcgcgatcacgcatatcaataaagatcaggccgcccaaatcacgacgacggtttacccaaccacaaagagttactttttggccttcatgggccaggctcaactgcccacaatagttagtacgcatacaatatccttttactcagctcgttatgcattctgctgcggaaattttggcattgttctttttaggaagaattgtcaaaaaaaggcagtcattatactgaaaattctgaccagagataagggcataacacggttcctggcaagacaattttttgctaactgataatattcatactatttattattaaatactatgatttatagcgacagttttctttttgaggtttatcatcattcggccgttttgggttaggcaatggagttaaaaatggttagctcgctttatatcgttttgggcgcactattattgattaagctgtctctggatgtcgtcaaattaagaacacaatatcgagtcgcctatggcgatggcggtttttacgaattgcagacagccattcgcgtgcatggcaatgctgttgaatatattcctatttcaatgctattgctgttgatgatggagatgaatggagccgccgtatggatgctacatatttgtggcctattgttgctttcgggtagaatattgcactactttggcctgcgtcatcgcgaaatccgctggcgccgtatgggcatgggtgcaacgtatatatcaatgataataatgattatcaccaatatctactacttaccttgggaacaaatattttctttctatgcgtgatttacactcgatatgtataaattacatgcataaatgcaaaccttgatgtacatcatgacacctatgcataagagaagcccatcattaccaagggcggtattcctgccgcctgagggtttctgctgattatccctttctgccttttcccgcattctgttagaatacccacttcttaattgtttccaaaactaatgttgttatgtcaaatcaagatcctcataatcaacgggacagtctgttctctgccccaatcgccaatttaggcgactggagtttcgacgaacgtgttgccgaagtctttcctgatatggtgaaacgttccatacccggttattctaatatcatctccatgataggtatgctggccagtcgcttcgtgacgccaagtagccaaatttatgatctcggttgctcccttggggcggcaactctgtccatccgccgcagtatcaatgctgataattgccggattatagctatcgataattcaccagccatgatcgaacgctgccgccgccatattgattctttcaaagccagtacacccgttgaggtgatcgaacagaatatccttgataccgacattcaaaatgcctcgatggtagttttgaattttacattacaattcctgcaccctgatgatcgccagaaaatattgaagaaaatttacgcaggattaaaaccgggtggggttctggttctgtctgaaaaattcaattttgaagaccagaaaattggcgagttactattcaatatgcaccatgatttcaagcgagccaatggttatagtgagctggaggtcagccaaaagcgcagtatgctggaaaatgtcatgcggacagattctgttgacacccataagtcacgccttaaagaagccggtttccagcatgtagaagtctggttccagtgtttcaatttcggttcattattggcaataaaaggaactgaacaatgatcgatttcggtaatttttatcaattgatcgccaagcacccattaagccattggctggatagcctgccagcacaattgagccactggcaaaaaacatcacagcacgctcagttcagctcatgggtaaaaattctggaaaatttgcctgagatcaagccaagccaccttgacctgaaaaatggtgtcattgcgactcatgagccggatctgtcaaaaggtgaaaaagctcgccttcacaatatactgaaaatattgatgccatggcgaaaaggccctttttcattgtatgacgttgaaattgataccgaatggcgctctgactggaaatgggagcgagtgctgccccatatttctcctttagaaggaaaaaccgtacttgatgtcggctgtggcagtggttatcacatgtggcgcatggttggcgaaggcgctcaattggttgtgggtatcgatccaacccaactttttctctgtcaatttgaagcgatcagaaagttactggggaacaatcaacgagcccaccttctgccattgggcatcgaacaattacccgaactacaagcctttgatacggtattttcaatgggagtgctctaccaccgccgctcacctcttgatcatctgtggcaactgaaaaatcaactggtgtctgatggtgagttagtgctggaaagtttagtgattgagggtgatgaaaatcagtgcctcattccgggtgaacgctatgcacaaatgcggaatgtctattttattccctcggccaagatgctgaaagtctggctggaaaaatgtggttttgtcgatgtcagaattgtcgatcatgcggctacaacacctgatgaacagcgccggacagaatggatgaaaaccgaatcactggtagatttccttgacccatcagatcacagtaaaacaattgaaggctaccctgccccattgcgtgctgtcctcattgcccgcaaaccataatattgaacaaatattaatgagtgaactgtccaatatggcaattcactcattaagttctaagatttcactttccttatgacgcaagcgatatcacatctaccgctcaatcaggctcatcactcccttcatcgactcaactaactcaccatcaacactgtagtgagaatattcatctacatcacgatcgtccgaactcatcgccacccctgcctttcggtacttcatggtagaaggtacaattttacccgccgagctatgaacttccgtcattccggcttccagaaacttactgatattactcaccctgacacccgcgccgggcataattatcggcccacggctggcttgcatcagctcttttaacagcgtcagccccagttcagcattctgctgttggcctgatgttaaaatacgctgcactccaagctctgtcagttgttccaacgcaacatgcggattaaaacacatatcaaaagcgcgatgaaaagtaacagccatatttcccgacagtgacatcaactgccgcatacggagtctgtcaatatggccgttttcgctcaaaatgccaaaaacaatgccggggaaccccatatcacggatacgggcaacgtcatttttcatggcttcaaaatccatgttgttataacagaagtctccccctcttggccgcacaatgggatgcacaggaatagataaccgctgtaacgactgttgtaatgccccaaaactgggtgtcaatccgccttccaacgggcttgcgcttaattcgattcggtcagcgcccgcattttgtgcaaccagcgcacagcttatgctataacagcaaatttccagccttatcattaaaaagccctccgaatacgaattcgtcaacaagtcatcatttaacctaaaactactttattagtgaacttattaactatgacaactaacttatcttaatgacatgttggaaatcacaaggtcagaattttttactggaacagcatgataaaaacgtcatttttgccggctatacctcacttttgacaatttctttgatacaaaaaggatgatatttgatcgtgatttcaccatcagtgacagccaaaatcgggttcggcaaccgttcattttttccttttggatgactctccttcatccgaaaattatctggtaaaggttgaggcaataactttttagcttcacaaataagttgctctggtggtacaggcagcaccagttcgacatgttcccaaccttggtggacatagtgtttttggctgggataaggcaattccacgcaatcaattttccagtcaagtagtactattggctggttcagatcaaataagcagatcggacggccattaatgatactttcagatattaactgaccacattgcagaaagcccttacgccaacgatcggctattttactttcattacaacgcagggaaatatggtctgctgaatattgttcgaagtgtaagccaagatgcccttcaaattgcttaagtttttgctcaaatccggctaaatcagccactaaatcctgtaactcagaaatttttgaaaaatgagacatttcttacccattaaataaaccgtaaaaattgcgttcgactaatgtgatataaatcacaaattgtctatttttgccaaaatatcactcagtaagcgactcattgaagttggcataacgacgaatcacctgaaagacaggctaaaaacaaaaagtaacacaccagaggtggctgatggtagcatgcagaaccccgaatatggtataaaccccgttattttctcataacccacacgcttaaaagtattgcatttccaaaatgcataagctttcgtgcgtaacttaaggtaacacggtgaatatacaggttattctttcagaaaaaatcagcaatgcgctgattgaagctggcgctccaaccgacagtgaagctcacgtccgtcaatctgcaaaagcacaatttggtgactatcaagcgaatggtgtgatggcagccgctaaaaaggtgggaatgcctcctcgacaattggcagaaaaagtcgtcagccaactggatctgcaaggaattgccagcaaagttgaaattgcaggcccgggttttatcaatatttttcttgataaagcgtgggttgcagcaaatatagaaactaccctgaaagatgaaaagctcggtatcaccccagtcgaaccgcaaaccatcgttatcgattattccgcacccaatgtcgccaagcagatgcatgttggacacctgcgctcaaccatcattggcgatgctgcggcacgtacccttgagtttcttgggcataaagtcattcgggccaatcacgttggtgattggggaacccagttcgggatgctgatcgcctatctggaaaagatccagaacgaaaatgccgatgacatggcattagcggatttagaagctttctatcgcgaagcaaagaaacactacgatgaagatgaagagtttgctattcgcgcgcgtaactacgtcgtcaaactgcaaggcggtgatgaatattgccgtaagatgtggcgtaagctggtagatatcaccatgtcccagaatcaggaaacttataaccgcctgaatgtcacattgacagaaaaagacgttatgggtgaaagcctgtataacgatatgctaccgggtatcgttgcagatttaaaacaacgtggaattgccgttaagagtgatggcgcgacagtggtttaccttgatgaattcaagaataaagaaggcgaacctatgggcgttattatccagaaaaaagatggtggctatctttacaccacgacggatatcgcctgcgccaaataccgtcatgaaaccctaaatgccagccgtgtgctttactacatcgattcacgccagcaccagcacctaatgcaagcttgggcaattgtacggaaaacgggttatattccagaatccatgtcactcgaacaccacatgttcggcatgatgctgggcaaagatggtaaaccattcaaaacccgtgccggcggtacagtaagactgtccgatttgctggatgaagcgattgagcgtgcggataccctcattcgtgagaaaaacccagatatgccagaagacgaactgaaaaaagtcgtggaagcggtagggattggcgcggtgaaatatgcagatctttccaagagccgtactacagactatgttttcgactgggataatatgctggcctttgaaggcaacacagcaccttatatgcaatacgcctacacgcgcgtgtcatccatctttaaacgtgcggatatcgatgaaaacagcctgacactgccggtgatgctgaatgaagaacgcgaacaggcattggcaacccgcctgttgcagtttgaagaaacgatcactacagtcgcccgtgaaggtacgccacatgttatgtgtgcatatctgtacgatctggccggtctgttctctggtttctatgagcactgccctatcctgaatgccgatagcgaagaactgcgccagagccgcctgaagttggctttgctgacagcgaaaactttgaagcaaggtcttgatactctgggtattcagactgtagaacgtatgtaataatcctctgcaaagctgaaaactggcgtgatatgattttatcacgccagttttttcctttctccgcctctgctagctcttcctcatctaccgtataaataatatttagctggacttactgtttatatttaattatgaagatatataaacacagaggcagttattatggaaaaatatctggcgattatattattttttctggttatggttgtattaaatttaaagtcgaatatcatttattttattatcaataatccatttaacggttacaagttattatgaataataacactaacttctcacgaattttcttaattaatttttgattatatcaaattcattatttacattaaaattaataatatcaaataatccagataataatttaaaaacgcatatcaaacaataagttacaaacagcaagaagaatgaataatagaataataattaattttatgtcaggaaaatatcaattttcattctttgaattgaaccagaaaggcaagagaaatacgaatactatcattcaataagtgcaaaataaaaaaccgcccaataaaaacttgggcggttgtattgaatgaaattatttattaatcagggaatcactgcaatccccgatgagaaaaatctttcagtctaaatcccatcaaggccagaactgcaaaataactgcctgctcccgcaatcactacgcccattaagcgcagtaggcgcattgccatatttccctgttcccatgctggcataacccacaatactgccaacagcaccccgaccatcacagcaattgccaccaccaatttaaacaggaatatcccccatcccaccaaaggcgtgaaaatatcacgcttacgcagttgccaataaagcatactggcattgaagcaggcagccagaccaatagaaagcgccagacctgcatgtttcaatgggccaacgaaagcaaggttcatcaattgagtcagaatcaaggtcgcaatcgcaatttttactggtgttttgatatcttggcgtgaataaaagcccggagcgagaactttaaccacaatcaaccccatcaagccaaaacagtaggcaattaacgcccgctgagtcatctcagcatcaaaagcagaaaagtgaccatattgaaataatgataccgtcagaggctccgcgagaataccgagagcaactgcacagggtaacgccagcaaaaaacagagacgtagcccccaatccatcagttttcgatattcttcgtgattaccactagaaaaacttttcgccagtgaaggcagcaaaatcgtccctaacgccacacccagtacaccagaaggcaattccattaaacgatcagcgtaatacatccatgaaacagagcctgaaaccagaaatgaggcaaaaattgtattaatgatcaaggaaatctgcccgaccgatacacccagaattgcaggccccatttgacggataacccgccatacggcactgtcacggaaagaaatccgcggcaataccagcatgccgatctttttcagatgaggaagctgataggccaattgcaaaacccctccggcaacaacggcccaacccagcgccagcactggcggattgcaataaggagccacaaacaatgcaaaaacgatcatactgacattgagcagtgtcggagcaaaagcaggcaccgaaaagcggttccatgtattaagaattgcgccagccaaagaagccagcgaaatcaaaaagatataaggaaacgtaattctaagtaaatcacgggttaagacaaacttatccggtgtatccgtaaatcccggcgcagtcacatagatgatccaaggtgcagcaattacacctatcactgagacgatagccagaatcaatgtcaacatacctgagatatacgcaataaaggtacgtgttgcttcatccccttgttgatttttgtattcggcaagaataggaacaaaagcttgcgaaaaagcgccctctgcaaagatacggcgtaacaggttaggtaatttaaaggcaacaaaaaaggcatccgtcgccattcctgcaccaaatatacgagcaataatggcatctcgaataaagcccagcacgcgagaaaacatcgtcattgaactgaccgctgccagtgatttcaataagttcatggtattgttctaaagttgtattcttatggaattaagcataaaaatgtaaagctatcccatcaggcatcataaaaatggcatataaagcaatctggcgggatagcagccgatgtttaaagtctaacagacaaaaaccctgtctacattttctatattacgccccattagccttaccccgagattcataaacccactttgccccatgcatcgtcagtcaatgccgtcagcacatgatcttgccaaacaccatctatcattaaataattcttggcataaccttcctgctcaaatcccaactttttgagcaggttcccactacgatggttatgtggcatgtaattagccataatccggtgcattctctgatagcgctgcatatagcggatcgcaggttgcagcgcttcatacatcaatccttgcccttgcaatttctcagctaaagaataaccaagataacaagaatggaacgcgccgcgtacaacattagtaaaattcgccacacccataatttcacgctcatcagagtccaataatacaaaattaaatgtcgcattctgccgttgtaactcagtgatatagttcaaccgatttgtccatccagagggttgataaaaactaccatccctttttggctcccatggcttcaggaaatctttattttctgaataatactcagccaatcgataagcatcacgttcatataccagacgaacaaccatcctatccgtaataaatcgaattttgggcgatgcagaacgataaccaaacatgccttctcctgatatttgtcttgaaaaaattctggataatttatctcttattaaaataattgcctattaccctacgataaaaaaatatcatctataaccctctaccttaaagatgagattaaggtcagaataataagaacttcatgtttaatcctctcatatctcaatggtgcgcaatgtcgttggtttcacaagcacgtagcttgggtaaatacttcctgctatttgataatttattagttgttttaggtttttttgtcgtttttcccctaatttcaattcgtttcgtcgaacaacttggctgggcggcattgattgttggtttcgctctggggcttcgtcagcttgttcagcaaggcttggggatcttcggtggtgccatcgcagaccgatttggtgccaagccgatgattgttactggcatgttattgcgagcactgggttttgctctgatggcaatggcacatgagccatggatattgctgctttcctgcgttctatcaggattgggaggaacattgtttgatccccccagagcggctttggtcattaagttaacccgtccccatgagcgagggcgtttttattcaatcctgatgatgcaggatagtgcaggtgccgtggttggcgcactcatcggaagctggttgctgcaatatgatttcaatatcgtctgctggattggtgcatccatttttgtgctggccgcattatttaacgcctggctactgcctgcataccgtatttcaactatccgtactcctatcaaagaaggcatgatgcgggttattagagatcgtcggttcctttactatgtgctgacattgacgggttattttgtcctgtcagtacaagtgatgctgatgtttccgattattatccatgaaattaccggcactcctactgccgtcaaatggatgtatgccattgaaaccgttatctccctgacattgctctatcccatcgcacgctggagtgaaaaacatttccgactggagcagcgcttgatggcgggcttatttttgatgaccatctgcatgtttccgatcggctgggtcaatcaattacatacactgtttggcctgctttgcctgttttatttaggtttggtaacagccgatcctgctcgtgaaacgctgagtgcttcactgtctgatccacgggcgcgtggcagttatatgggatttagccgtctgggtttagctctgggtggtgcaataggttacaccggtggagggtggctctatgatactggccgtgacttaaatatgccgcaattaccctggattttgctgggattgtctggtttgattaccatttatgctcttcatcgccaattcaatcagaagaaaattgatcctgtgatgcttggtagacattaatcctattaggaatagtgtaaaatctgcccattgaaaataaaaaggagccaatatgaaaagatttttcttaggggcagcattagtgctggtagggttagtcagcggctgtgatcaatttaaagacttcagcatcaacgaaggtctgatgaatgattatttgctcaaaaaagtgcattatcagaaaaaaatcagcattccaggtattgcgaatgccaatatcacactgggggatttatccagccagataggccgtcaggatcctgaaaaaattgaactatccacgcaagcaaaagttcaacttgcaacactactgggtacgattcaggctgatatgaaactcactatcaaggctaaacccgtatttgatgcagaaaaaggcgctattttcgtgaaagagctggaaatcgtagactaccagacaacaccggaaaaagcagcggctccggttaaggcattgattccttatctgaatacctctttgagtgagtttttcgatactcatccggtttatgttctgaatccagagaaaagcaaggccgaggcagcagcctcacaattcgccaaaaggttggaaattaaacccgggaagttagttattgggttgaccgataaataatttttatcgtcattgaaataataagggcaaattactaatggataatttgcccttttattttatcaattagtgaccgatacactcgcctgttcatagccttcggctgaactattatcgtgacactgtcactcagattctaattcataacgcaatgcctgcaacgcttcacgagtgacaatcgccagcgttcgataaaaaccactggttgcatgagcttcaactttaccgaggaactgcccacaccaaggcaaaagatactcatcaaacaacgtaatttgtgcttggatttcatcttcagctgcctgatcttccagccatgacacagccagcaatagagagccgaattgatcagcaggagtatcagacagtggcattccccgttctgtcaaaaactgacgtacttcactttcttctccgtccgtataatcacatcgacaaacagcaacactcgccgattctccagtaaacagagcgtgataatcggctgccatcactgacaattcactgttttgctgtaaacgatccagccattcatcctgttccaaaggccatgcttgttttagttttccctcagcaatcatggtgattaaaggttgcagaacgggatcttgcggtgcgcggttaaacaatgtgcccaatatgcggcagacaatagaaaattcgttcataacttgattcaatcccaataaattatcaaatagcgttattgtccctaatcgcctgctatgctgtaaagcaacttgttaataaccacgtaccctatcgacgaggccagttggcatttcaccccgtgccatccgccggatattttcacagatgacatccatcgcagcctcaggaacagtgttagcagcaatatggggagtcacattaatacgagggtgagtccagaatgggtgcatatttgacaatggctcttcggcaaacacatcaagggttgctcctgcgatataacctttatcaatagcaacaagcagatcctgttcgacaagctgcgctcctcgcgccagattaatcacatatgaacccgattttagttggctgaataatgacaaattaaggataccacgagtgtcaggagtatcagggagaaggttaatcagcaccttgcagccagaaagaaaatcacccaattgctctttaccgtaaaaactttcaacactatcgagttgtttcgacgtcctgctccaacaacgcacattaaaatcaaattccattaatttcccaatcacacttcgccctaatattccggctcctaaaaccccgataacaaattctttccggttatgcggagccataggggcccaaaggcgctgctcttggtatcgtttatattcatccatgcggcggaaataatgcagcactgaggtaatggcatattcctgcatctgccttcccattcctgtatcttcgaggcggatcaatggaacatcagccggtaacgtaccgggatttttcgattcttgtttgaaaatcgcatcgacaccggcacccagtgcgaatatgccttttagcccctgacgattggctaacatttcataaggtggctgccaaactaatgcatagtctgcgggctcttgatcaccactgacccattgcctcactttggcatcaggcagacgtgcctgaattccttgaatccactcatcggtattaaaggaagggtgaaaaaaaataatgttcatacaatcttattccttattgtttttttgatagggttaaccgattgctaaaatggttgcaagcctctgctggaaagcgaggaatgaaaatattaataatgttacccagttaacatatttaccactgcatattacaaaaagcgcatctgctttagtaaatgactatcgaacattcaaattgttttttatttgtgtaatcagtcaaaaagcctgaaaaaatcgtcataagcctgttgacgcctgccctgcttttccctatagtagcgccccgttgcagcgacgaactcaagtgatatcgctacaacaacaaaatacggtgaggtgtccgagaggctgaaggagcacgcctggaaagtgtgtatacgtgaaaacgtatcgagggttcgaacccctctctcaccgccatattctaagaaagagcctgaacacaatgctcaggcttttttgtggttactcttgatagagcattgaatctagaatttagtaacccttgcggaaagtccctgacaggacgaccgcagaaacaaaacacggtgaggtgtccgagaggctgaaggagcacgcctggaaagtgtgtatacgtgaaaacgtatcgagggttcgaacccctctctcaccgccatctttcaagaaaaagcctgaacttatgttcaggctttttcgcatttatactccccaaagtataggtgaaaaacctcgcaaggattcacctcaacaacctgctctaatgggaatgtcttaaagatttgtggcttaattacaccttgttctaggctaatccaaaggacatacccgaataatatgaccatcgggatcttcagcaaggaaagtacggccaaaaacttcggtatggggttcctctactattttgatctcagggttctttcgccattcttcaaagcaccgatcaacatctttaccggatggcagcataataccaatttcagaaaatcgcggaatagcacgatcaggctttgctcctccactccaaatagcaaacagtacttcaccaccagcaggaaatgcaacataacgggagctggcaaatatcggctcagcattgaaaattgttttataaaaagcgcttgaacgctcgatatcagagacataaacaagctgaagattgggtttgggggatactatctcaacgacagatttcagccttaatacggtttcaaccagatcttgcgtaccttgcttaaagaaactttcggcctgaacagcggaaatatttgcatcaggttcaaatgaaacggtcacctgaatacgacacgccatattgttttcatctgtaataatttgatgtcggaatgttaatattcccatttgcggaaagttaacctgatcggtgaattctttattcacttcgatatttgaaagataaaagcgaatttccggcattccacttaatatcattctgccgtattgacccgttttgacctccccttcaaattgaaaatattcaagatcgacttcccattttttccgcaaatcaaaatcgacataatgcgcccagatatgggatggtttagcgtttaccgatgtagaaaaattgagtgttaacatgacaaaactcccacagttaaatgtatcacattgaagattaagcgagctttttaatacagtagaacagcccgcagagtatcaatggtgagtgacaatttctgtcagtagtctttatttggctaacgagaaattttttccattgctctccattctttgagcaatacttgccttgaacgggggtaacattgtttttcaattttcaaacgcatgattctatctgatctgaaatgacgaaattcctcgcgtaattcacaccatccaatcacaatgctgatattttcaaaatagcctaaggcgaatggccatattgttctttctgatgggatgtcttttatatccaaataagcgaaggtgattttatgccgggtattgatcgcctgacgtatctgctgaatctcgacaacaggctgaacagctgtcgcagcaggcccgatcagtaaggagcttgcctccaacatttgtttcaattctgctgggatcacagccgcaattttgcttattgcattatttgcagattcttttagttgggggtctgcacgtttagccacccaattcgcgcccaatgccaacgcctctatttcattttgtgtaaacatgagcggtggtaacacaaacccaggcctcaaaacgtaccctattcccggctcaccttcgataatcgcgccttgagcttgcaacgatgcaatatcccgatacagtgttcttaagctgatattcaatttctgcgccaacacttttccctgaaccggaaagtgataacggcgcaatatttccatgagagataacaaacgctgtgctctagacaattcgtcccatccattcaagttaaccgactcatcaacctctaataatacgcaactatcataatttaattgattaaaaagatagttttttgatcccttgtacaagatcattgttatctgattgcccttttagattttttattttattaataatgctgataaattgacctctaaaggacttagagaaaaatgaccatatacgatttaaaaccccgtttccaaaacttactgcgtcctatcgtaatttatctgtataaacaagggatcaccgcaaaccaggtcactttaaccgcgctattcctgtcaatctttgccggttcactattgagcctatttccctcgccccacctctattggttgctgcctgtttttcttttcattcgcatggctctgaatgctattgatggcatgctggcacgggaacataaccagaagtctcatctgggcgctatttataatgaattgggggatgtcatttctgatgttgccctctatctccccttctgccttttacctggtgtgaacagcctcagcctgttgattattttattcctcactatcttgaccgaattcatcggcgtactggcacaaacgattggtgcatcacggcgctatgacggcccgataggaaaaagtgaccgtgcttttatcttcggagcttatggattgattattgcgattttcccttcgaccttgggctggagtagctctttgtttgctttcatgatcattttactcttggtgacttgctaccagcgcgttgttaaagccttacgtgaaatccggctggctgaacagtcacactccaaatgaggctctaacatgacaccacaactcgatcaacgtattgctgaagaacattatttcaccacatcagataatgcttctctgttttaccgttactggccacagcaacaggccaatccagacagagcgatcattatttttcaccgtggtcatgagcactcaggacgcatccagcatgtcgttgacggactcgatctgcctgatgttcctatgttcgcgtgggatgcccgtggacacggtaagacagaagggccgcgcggttacagcccatctatgggaacgtcgattcgtgatgttgatgaatttgtcagatttattgccattcagtacggcatcgccatgggaaatatcgtggttatcggccagagtgtcggagcggtattagtctctgcttgggtacacgactatgcgccaaaaatccgcgccatgatcctcgcagcacccgcatttgatattaaattgtatatcccttttgccacgcagggactgcaattgatgcaaaaagcacgaggtattttcttcgtgaactcctatgtgaaagccagatatctgactcacgatgaaacccgaattgcctcttataatagcgatccgttgattacccgggaaatcgccgtcaatattctcttggatctttaccaaaccgccgagcgagtagttaaagatgccgccgccattacactacctaccctgttgtttatttcaggcagcgattatgtagtgaacaaaaaaccacagcatcagttttatcagcagctaaatacccctatcaaagaaaaacatgtgatggatggcttctaccacgatacgttgggtgaaaaagatcgccatctggtttttgacaaaatccgggtctttattgagcgcatttttgcacttccgcgttatcagcacgattacagccgagaagatacctggagtcactctgccgatgaatttcgaacattaagcacatcattaccgtgtctgtgtccgaagaaactcagctatcagttgatgcgtaaggtaatgagtactcgctggggcagaacttccgagggtgtttgcatcggtctcaaaacggggtttgattccggctccacattagattatgtctaccgcaaccaaccgcagggtaagggcattttggggcgaatactcgataagcattatttgaacagcattggctggcgcggtatacggcagcgcaagatccatattgaaatgttgatccgccatgctattcgcagtctacgtgaacagaatatgcctgtgcatatggttgatatcgccgccggacacggacgctatattcttgacgcaatcaacgatttcagcaaagtcgattctattttgttaagggactatagcgaaatcaatgttaatcaagggcaggcttatattgaggagcgcgatctgacggacaaaattcgttttattatcggtgatgcctttaatgctgaaagcatcgcatccattacgccagcgccgacactgggtattgtatccggtctctatgaattgttccctgataataatttactcagaaattcgctacgcggctttgctgatgttatgacagaaaatggttatctggtgtacaccggccaaccgtggcatccacaaattgaggtcatcgcccgtgttctttccagccatcgtgacagtcaaccgtggatcatgcggcgccgtactcaaggggaaatggacgcattagtggaagccgccgggtttgaaaaactgtaccaactgacagataactggggcattttcactgtttcgattgccaagcgtgttcatcgctgatgaataaataaatataagatggaacaccacatgcactcttctctcgatagtcgtcggcgcctatggctgacaggtgttatctggctattgtttctggctccgtttttctttcttacttatggccaggtcaatcagttcacggcacaaagaggcgatgtcggcactgtgatgttcggttgggaacataacatccctttttggtcatggtcgattatcccttactggagtatcgatctgttctacggaatatcgttatttatctgtacccatcgccgtgaacagtggcttcacggctggcgattaatgaccgcatcactgattgcctgtgttggattcttactgttccccctgaaattttcgttctcccgccccaccacagaaggcctatttggctggttatttaatcaactggagttatttgatctgccctataatcaagccccttccctgcacattattctgctgtggttgctctggctgcgctattcagcctacgtgagtggttactggcgtgggttgctgcacatttggtcagtgctgattgcactctcggttctgacgacttggcagcaccattttatcgatgtactaacgggttttgccgttggtgtcatcctcagttacctactgccggtttcataccgctggcgctggcaacctaatcaagatcgctatgcacggaagttattcggctattatctgacaggcagcgctttgttcgcgcttatagcgagtctgctgggggggagtttctggatactgctgtggcctgctgtatcgttactgatgatcgcactgggttacgcaggattaggcagctccgtgtttcaaaaacagccagatggccggatgtcactgtctgcacgctggctactggcgccataccaactgggagcatggctctcttatctctggttccggcgtaaaagcgcacctttcaaccgtataactgaagggattattctcggcagcctgccttgccagcccgttacggcggtcagtgtccttgatataaccgctgagtggcacaggcgatcggatgcccgctcagtaaactatgtttgccagccgcaaatcgacttactaccgctggcacctgaagctctacaatcggcagtttgtacgctggataaactacgccagcagggagatgttttcgttcattgtacgcttggcctgtcacgcagtgcgatggtggtagcagcatggctgctgaaacagcatcctgaatatgatatcaacactgtcgtagcgatcctgcgtaaagccagaccacatgtcacgttcagacaaacacatctcgatgctctgtctcaatgggcaaaaggctacctataacggggaacataacatgcagccggaaaatctgatcagcaaagtgattatcgcaacgttaaaaagctggcgctttatctcggcactatctgctttttctatcctgatcgcgacggcaatgctgattgctgtcttcaacactaccgccttaaacaacattgcactctatgccgtactattattcacaacgctgtactgccaatactattgttggcgcatttggcttgactgccactattttcagatcctcaattcatcccctgaaaaaagcgccgagttcgatcaaacgttattgctgatatttaacaagttaccccaatcacggacacagaatgatcgctttaacggagcaattaaactgttaaaaaaggctacgattggtctgatcctgcaatggatactgtttttcctgtttctgcttaccttgaaatattcagcctgaattcagctttaatctgacaaagtcagaacgtaacgatgctacattttctcgactgtactactattaactaacttttagacctgtaacacctttattgggtgataaaagagatactcttacatattctttttcagcccgtcatgcggacgccttattttttggttttagattaaatgaatactcgtaaaattaatgggatacgcccatttagtgcgtttattgactcatgtctgaaggaatcttactctttcccccgttttatcagagatatcatcgctgggattaccgtgggtgttatcgctatcccattggcaatggctctggcgataggaagcggagttgcaccacagtatggcctgtatactgccgctatcgccggcattgtcatcgccatgaccggaggctcacgttatagcgtttccggcccaacggcggcttttgtggtgatcctttatcctgtttcacagcagtttggtttgagcggcctgctcattgcgacgctgatgtcaggtgtgattttgattgtgatgggattggcacgttttggccggcttatcgaatatattcctatgtctgttacccttggatttacttccggtattgccatcactatcgccaccatgcaggtgcaaaatttctttggcctgaaactggcacatataccggaaaattatattgataaggtagttgcactttatcaagccctgccttcattacaattgagtgatacgcttatcgggctgactacgcttctggtactgattttctggccgaaactgggagtaaagttaccgggtcacttacccgctttgatcgcgggtacagctgttatgggcacgatgcacctgttaagctatgatgtcgccaccattggttcatcttttagttacacactggcggatggctcgcaaggccaaggtattccccccattcttccccaatttgtcctgccatggaatttacccgatacacattctctcaatattagctggaataccgtatcggcattgctgcccgctgcgttttcgatggccatgctgggtgcgattgaatcgttactgtgtgcagtgattctggatggcatgacagggaaaaagcaccattctaacggtgagctgcttggccaggggttgggcaatattgccgcccctttctttggtggcattaccgccacagcggctatcgcccgttcagccgccaatgtgcgggcaggtgcaacttccccgatagccgctgtggtgcattccctgctggtattattaacattgctggttttggctccgatgctctcttatttaccactggcggcaatgtcagccattctgctgattgtcgcgtggaatatgagcgaggcacataaggtagtggatttaatacgccatgcgcctaaagatgacattattgtcatgcttttgtgtctgtcattgactgtcctattcgatatggtcgtcgcgatcactatcggcattgtactggcatcactcctgtttatgcgcaaaattgccaatatgactcgaatcagcacgtcatctttaacaagcgcggagaaagggttattggtcgtacgaattaacggccctttattcttcgctgccgccgaacgtatttttgccgaactgagagaaaaaagtgttgattatcaaaccatcatcatgcagtgggatgccgtacccgttttggacgctggcggattacacgcttttcagggttttgtgcgcgaacttggcaaagaaaaacatatcgtcgtatgtgatattcccttccagccattaaaaacgctggcaagagccaaagttatgccaattgaaggagagctgagtttttatgctaccttacccaaggcactaaaagagatggcagttgattacacgcctgaggtgtgtgcttcttcagaaaagattcaaggttagtaacaacaagtcaccctctgccagcataactggcagagggtgactaatagaagactagcgtaggaatttatttgctggtatccagttccgggaaacttttcacaacatcatcaatcgctttaatttgcatcaggaatgactccagttttgccaatggcaaagcagacgggccatcacatttggcattttctggatctgggtgcgcttcaaggaacagacctgcgatccccacagccatacccgcacgagccagttcagcaacctgcgcgcgacggccaccggaagctgcacctaatgggtcgcggcactgtaatgcatgagtgacatcgaaaataaccggcgcaccttgggtagcttgttgcatgacaccgaagcccagcatgtcaaccaccagattgtcataaccaaagttgctgccacggtcacacaggatcacctggtcattgccgccttctttgaatttttcaacaatattgcccatttgcccagggctaacaaactgtggttttttaacattaatcacagcaccggttttcgccatcgcttcaaccagatcggtctggcgggcgaggaaggctggaagctgaatcacatccaccacatccgcgactggttgagcctgtgcaggctcatgcacatcagtgataattttcacgccgaaggtttgttttagttcctgaaagattttcatcccctcttccagccctggcccacgataagagcggatagaagaacggttagccttatcaaaagacgctttaaaaacataaggaatgcccagtttttgtgtcacggtgacatagtgctcacaaatccgcatggccaaatcccgtgattcaaggacgttcattccaccaaacaatacaaatggcagatcatttgcgaccttgatatcaccaatattaaccactttctgttgcatgcttataccttctcttgttaagggcaaataaatttgcggtatcaataaaaaaaataaacctaatgcaggacaatcaaccgctgttctatggtgttaatttgcatttttatcatttctgagattgggtcctcagggcaatgctcgacaaaataactcaaatccgaaacagcaatatgattgcagtcgagctgggcatagataagcccccgatcgcggatttcataggggtcatcgggatcaaacgtcagcaccacttcgctggccttcagcgccagttccatctttttctcttccatcagagaaactttgatggtgtcagtgattttgcgcacgaggctgacattatcggcttcctgcaaatcctgttttttcagacgaacagttgggccaatattaccttttaaccagacatccagcgtatgttcattcagcgtatccccattcaagggattaatgaaccaagtgggctgatcaagcaaatcaatccgcaatatcagttggattggaaatatgacaggctgtaccgacagccccagcgcctgagcaatatgcgtaaacaccgtacccaatgatacaggtgagccttgacgtgaatggagtaagcgatccagccacagggtatctgacagacaatacaccccattagctccaccaaacttccattcccgataaaaaagtgtcagcagcgaatccaatttcactttggaatcggtaatggaggaaagcctctgccgggcttcttcaaccaatgcagttagctgctcactcaccagagtctgaggaaaatcagggcggataatttttgataccagaataataccgtcaatcaggggagtattattgaattcataattaactatgggtttcatttttattccatcgacctatcgtgatgcgttcattaccgccataatcctgaaaagtcgctatctgttgataacccttctctaaaaataggtttctgacaacggttccctgtttccagccatgttccagcaatagccatccatttggtgacaggaaatggcgcgcctgtcccacaattgcctgcaaatccgccatgccattttgtgcagcgatcaatgcagtggctggttcaaacctgatatccccttcttgtagatgaggatcacgctcatctatatacggaggattgctgacaatcatatcaaattgttggttacccactgctgcaaaccactcactttgcaaaaaattcacattgtgaatggccagttttccggcgtttttttcagcattatgttgcgccagcatcacagcatcagagttgatatcgacccccgtcacataacaatcattccgctcacttgccagtgccagtgcaatcgctcccgtccccgtccccagatccagaatccgggctggagaatcaggcaataattccaatgccttctccaccagacattcagtatcaggacgcgggatcaacgtcgctggtgatacggcaaacggcagtgaccagaattcccgttcaccaataatataagctaccggctctccctgaatgcggcgcaccagcaggctatcaagctgatgcaattcttccgatgagattagcgtttcatcgaaagcaatcagataagtacgggaacgccctgtcacgtatcccaacaagatttccgcatcacgcttagggctgtcactttcagacaactgggtagccgcatgttgtagccagcattggtaattcattaatcctgctctgacagtgcagacagttgatctgcctgatattcgataatgatcggctgaataagcatatccagtttgccttctatcacttcatcaaggcggtataacgtcagattgattcggtgatcagtcacacgcccctgtgggaagttataggtgcggttgcgatctgagcggtcaccagaacccaacaaatttcggcgttcagaggcttccacttcttggcgcttccgcatctcagcagcacggatacgcgctgccaatacggacatcgcttttgctttgtttttgtgctgggaacgctcatcctgacattccactacgatccccgttgggagatgggtaattcgaatcgcagaatcggtggtattgacgtgctgcccacccgcaccggaagagcgaaacgtatctattttcaaatcacctgggctgatgtccggtaattcagcttctggaatttctggcatgacagctacagtacaggcagaagtgtgaatgcgcccctgagattccgtttccggtacacgctggacacgatgaccgcctgattcaaatttcaagtgaccataaacctgatcacccgaaactttggcaatcacttctttgtagccaccatgctcgccttcgttggcgcttataatctctactctccagcggcgggcttccgcatagcggctatacatgcggaacaagtctcccgcaaatatcgcggcttcatcgccaccggttcctgcccggacttcaaggaaacagttgcgctcatcatccggatctttcggcaacagcagtagctgtagctgctgttccagctcttcattacgaatttttgcctccttgagctcttcctgcgccatttcccgcatttcgagatcgtcaagcatcatctccgctgtctgtaaatcctcctgaaccgttttccaggatttgaaacaatgggtcacatcggtgagttgagcatattcctttgacaatgcacggaaacgatcttgatcagcaataacactggcatcaccgaggtgaaccaaaacttcttcatggcgttcttgcaatgcttccagtttagcgacaatagaaggcttcattcgtaatatcagaccttaattcgaatagggttagttatgatccagcccaaggctgtcccgtaagagattcaggcgttccaaatcgccatcactggccgcctgttgaagtgatttagtgggtgtatggagcagacgattcgtcaattggtgagtcagctggttgatgatctgttcagcatcagcaccctgcctgatggacatcaatgcttttgctgtcatttcggccctgactttttctgcctgttcccgatattcccggattgtattgaccgccccttgagagcgcaaccaatccatgaaatagcggctttcctgctgcacaatgccttccgcgacaacagcggcagccttacgttgagccagattttgctgaataatggcctgtaaatcgtcaacactgtatagataaacatcgctcaatttttcaacgtccggttcaatatcgcgaggaacagcgatatcaatcagtaacatcggctggttgcggcggactttcaacgcccgttcgaccatgcctttaccgataatcggcagtgggctggcggtagagctgatcacaatatcggcttctgccagccgggtatcaatttcggacaaggaaataacctccgcattcacttgactggcgagtgtctgcgcccgctctttcgtgcggttggcaatcatcatgtgacgcacacggtgttccttgagatggcgagcaaccaattcaatcgtttcccctgcccccaccagcagaatattcaatttagacagagattcgaaaatctgtcgggcaagcgtacaggcagcaaaagccacagaaaccgcatttgcgccaatttccgtttctgttctgacccgcttggcaactgaaaaagatttctggaacaggcgctccagttcccctgacagggattgataattttgcgactcagcaaaggctttctttacctgccccagaatctgtggctccccaagtaccagcgaatcgagaccactcgccactcgcatcaagtggctgacggcgtcattatccaaatgccaataaaggctggctttcagatcgtcaggattgagctggtgatactcacacaaccaactgattaactgctcttttaaattatcctgctgctcaacgctgagatagagttcggtgcggttgcaggttgacagtacaacgccacctcgcaccagcggctgctggagcaagttatcaagcgcaagcccgattgtgtcaggagaaaatgccacccgctcacgtaaggaaacaggcgcggttttatgattgataccgagtgctaataaagtcattttaactgcgttgagttatcacgggaatcaatctcatgataatattaataaccattctcatgaaactcacacccttcataaggactctcattggatgagcattctacttgatgcatcaattcaataaaagtcaatcggacggctatgccgtaatttattcgagaaatgttgacaaaatttcgctaaattatcaccttgattatagacttggatggcgcattagttacccatcagactattttattgctaagggttactgaatgaaaacatcatcacttttttgcttacttcccctctctgcggttttgctgacagcctgtaccgtcacacagcctcctacaggtacaggttccgccaattctccgcaatggcatacccgtgaacagcaactgcaaaaactgaaaaattaccagacccgaggctcttttgcttatttggcaaatgaaaagaaaatctatgcccgctttttctggcaacagtattcgcctgataactataagctgttgttgcttaatccactaggtacaacagaattggaattattcgtccagccgaatatgattcagcttactgacaataagggtaaaaaatacctcagtgatactcctgaggcattaatttatcagcttaccgatatgaatattcctctgaataatctgaaaaactggattatcggcttacccggcgatgccaaagattttcagttagatgagaattacttgctcaaatcggtgagtagcaagaaaaatggtgagatctggaaaatcaattatcagggttatgatgcttctaccatgccagcgttgcctaatcgattagaactcactcagggcaagaaccgcataaaattgaaaatggataactggacaacccaataatgacgttgacttggccttctccggcaaaattgaatttattcttgtatattactggccaacggcctgatggctaccacgaactgcaaacgctgttccagtttctggactatggcgacgagatcacgattaccccccgtcaggataatcaaatccacctgctgacgcccgttgaaggcgtagcccatgacgataatctgatcgtccgggctgcccgattattgcagaatcatttattacaaaatcagttattgcagaataatagtcagggaaccgaacatctgggcgccgatatccacatcgataaatgcctgccaatggggggaggtctgggtggtggttcttctaatgccgcgaccgtactgattgccttgaattaccactggcaagccaatttgtccgatgatgaactggcacagcttggcatcagccttggcgcggacgttcccgtatttgttaaaggccatgctgcttttgccgaaggcattggggaaaaactccgtccggcatcaccggaagaaaaatggtttctggttgctcatcccggaattgagatttcaactccgacgatcttcacagatcctgaattaaaaagaaattcgccgattcgttctctacccgcattattacaggcaccattcacaaatgattgtgagtcaatcgcaagaaaacgttttcgtgaggttgaacagcttctttcatggctgctagaatacgcaccgtcgcgcctgaccggaaccggtgcgtgtgttttcggcgagttcgaatcagaagcatcggcccgtaaggtgttaaatcaatccccagagtggatgcagggctttgttgcgcatggagtcaacatttcaccattgcatacattccgctctgggatatacatgttattgaaccaatgaacaataatgttcgattggtcaacaatatctctctggacgcaagcctgaggtttttctcgtgcccgatatgaagctttttgctggtaatgccacccctgaactagcacaacgtgttgccaaccgcctgtacactagccttggagacgctgccgtcggtcgttttagcgacggtgaagtcagtgttcaaatcaatgaaaatgtacgcggtggtgatgtattcatcatccagtccacctgtgcaccaaccaatgacaacctgatggaattggtcgttatggtcgatgcgcttcgtcgcgcttctgccggacgtattactgctgttattccttacttcggttatgcccgtcaggatcgccgtgtccgttcagcacgtgtgcctatcactgctaaagtcgttgcggactttttgtccagcgttggggtagaccgcgttcttacggttgacctacacgccgagcagatccaaggtttctttgatgttccggttgataatgtatttggtagcccaatccttctggaagatatgcttcagaaaggcctggaaaacccaattgttgtctctccagacattggtggtgttgttcgcgcccgtgcaatcgccaaactgttgaatgatacggatatggccatcattgataaacgtcgcccacgtgcaaacgtttctcaagtcatgcatatcattggtgacgtcgctggccgtgactgcgttctggttgatgacatgatcgacacaggtggcacactgtgtaaagctgctgaggcattgaaagagcgtggagcgaaacgggtgtttgcttatgcaacccaccctatcttttctggtaatgcagtagaaaacatcaagaactcagtgatagatgaatttatcgtttgtgacaccattcctctgtctgctgagatcaaagcgttgaataaagttcgcactctgacactgtctggcatgcttgctgaagctatccgtcgtatcagcaatgaagagtcaatctctgcgatgtttgagcactaattttaagttttagcacttatcttaagcgctaacttattcaagtgattaaataaatcattgcctgaaaaaacccgttgacgcatccgcagcaacgggttttttccgtcattttaatacacatcgtcaatatttctttgttaattaataacaaatataaataatcacaatgattaaataatcatttttatcaatacgttaatctaaccaacacttatcatccccaacagagtttgcactctgagcatacgttcaagaaaaagacaacatcatatacgaacaataaatcatctggtacgtccagtaccctaactcccgaacaattctggtgtgttattaccgttactgctaatctgccggacaatcggtagcggctattgtgactttttatcgtcatatctgatagtctaaaaagtatgcttttgcatcatattatatataaaaagcccaaagtgatatggaatatagttaacagggaatcatccttaatcaaagacagtagttgtcaataaatcatctgtataacataaatttatttaaagtctttagcacgtcagcgcctctaacttcgcaaaaagaagtatcgcctgaattttgccattgcatggcaataacgctgataaataaaaaattactttttatggagaagagccaatgaaaaaagcatttttattcacacctgctctattagcgctttcaatcagtgccatttccaatgcccatgcttataacaacacctatgtctttggcgatagcttgagtgatagcgggaataatgggcgatataccacagatgggaaaaccagtcagctttatggtgagtatgttgctcaacatattactggtagtaaacccaccgcttccaaagatggtggcaccaactacgcccaaggcggtgctactgctattgaatcattaaaccctaaatataataccgccgaacaagtcaaaaactatctggctgcacataataaccgtgcggatgccaatggcgtatatattcactggataggtggtaatgatctcgcagccgctttgatggctggtcaaaagaatccacttgatgcttataatattgtcaacatgagtgcctctgccgccggagaacagattaatcagttggttaacgccggtgctggcttaatcattgctcctactgctcctgatgttggtattacaccaaagctgctggaaacggtgattgaagatggattaaaaaaagtaggcgcttctgattcgatgatcaaacagacattggaaaaaatccatcaggaaattaatgaaaatcctatccccaataacgagatccgtaatctggctatccaacaagttttccacaaattagcgcaaaaagcagcagaattaaaacctggcctaaatgctgacgaagttgaaaaagagcttaacgtgaaatataaagtagccaatgagggtgccacaaaactaaccaatgactacaataatctggtagatgacaaaatcagccagagcaatggcaatattatgcgtgtcgatgccaacggtctgctgaaggaagtgatcgcaaatcctctgatttacggtattgaaaatactctgggctatgcttgcgcacaaggaaaggaagccaaagaatgctctgccacagacccacaaacagacccacaatatgacaagagcaagccgtttttattcactgacaacttccacccaaccccgcttggccatctcatactgggtcaatatattgaatccatctacaatgcgccatcacaggtcatgaccctgaatcaagtcaaccgtatccccgtcaaaggtgttcgcgcttcccttgatggtcacctgcaacaacttcgcaatggtggcaatgctcagggtaaaattggcatctttggcggctacacaggcagccacaacaacaccttcacactgggtggtgattatcagctcactgataacctgctgctgggtgctgtatattctaactataaggatgaacgcacctctgcctccaatttcacgcatgaaggacgtgctcacgtagtgacaacttacgcgttgtggaacttctatgacaaaggttggttaagtggcgatctccattattcaaacaacaaatacgatagtctgacacgtagcattcagttaggtcaggcgacacgccgggaaaccggttctaccaccggtaaacaatggggtggacgcctcacggcaggctgggatatcgctgtcaccaatcaaatcaccaccagcccgattatccagtatgcgtgggataaaggtgatatcaaaggctaccgtgaatccggcgacaacagcacctccatgcattttgctgatcaagactacacttccaaagtcggcacactgggctggcgtgtggatactcagttaggccgcatcaatccttatgcttctgtccagtttaatcacgaattcggtgacacacgctataaactgcgcagcgccatcaattccactgaaacgtcctttgtacgggaaagtggcaaacagaacactgactggcgtcaatatactgtcggtgtgaatgctaacctgttcaataactggcgcggcttcgcttctgtaacccgtaacgagagtaattctcaagagcataactacaatttcagtctgggcatcaacgccagcttctgatataagcaaaaaggcaaggtggtcatcaataaccgccttgcctagatatcaataataatataaaaaatcatgaggttctgtgttttttacggcgataacgctcgtcataattcttcaaccaccaatacttatcagtaacctgctcacgcccaccgatactggcacccgccaaccaaaccaatgcaccaacaaataaacccatcaatgaaatacctgtggccaatccagactggtctaaactaaacacatgactgagcaatacataagacaagctaatcagcattgccgccatccctaaccccataaaaatgttaccgagaatgaaagcatttttacgtttcatcaccaacctccaatacttttctgaactcaatttacaaatgaaacgaactcaaaagcacgaaagtagatacatccttggttatattatagccttattatctaaaaggttattgcggcggcgatcacaagttgtacaaatctcaacgcatttttacacttcaccgaaaggggattcagcaacaataatttgccccccatgtttaacacattgaacaactattaaggaataacgaaccctccctttcaatatcataatgaattttgtactcaagccttgaggcaggtaaactaaacccctttttttattttattgccaataagcgaaccaagactgtgagtgacataaaattaatcgttggtctggcaaaccctggggctgaatacgcacagaccagacataatgccggagcatggtttgtcgatttgttagcgcaacgccacagacagcccctgaaagaagagagtaaatttttcggctataccgcccgcatcaacctgaatgggcaggatgttcgcctgctggtgccagcaactttcatgaacctcagcggcaaatcagtccttgccctcgccggattctaccgcatccagccggatgaaattctggtcgcgcacgatgaacttgatctgccacccggcgtagcaaaaatgaaactggggggcagtaacggtggccataacggtttgaaagacattcagaacaagttcagtaataaccctaacttccaccgtctgcgcattggcatcggccatccgggtgacaaaaataaagtggtgggttttgtacttggcaagcctcctgccagtgagcaaaagctgatcgatgatgccattgatgaagcactgagctgcacggacattctgatgaaagatggcatgaacaaggccattaaccgtctgcatgcttttaaagccagcgcttaacaggctgtgcatggcgtggctagttattgcgtgtataatagcgccaattttgtataactcaccaacaggcatcttgcccgctggtttataagtgatctgaggtaataaatatatgggattcaaatgcggtatcgttggcctgcctaacgttgggaaatctacattattcaatgcgctgaccaaagcaggtatcgaagcagcaaacttccctttctgcactatcgagccaaacaccggtgttgtgccgatgccagactcacgtcttgaccaattggctgaaattgtcaaaccccagcgcatactaccaaccacgatggaattcgtggatattgcaggtctggtgaaaggcgcctcaaaaggcgaaggtctgggcaaccaattcctgaccaacattcgtgaaacagaggctatcggtcacgttgtgcgctgcttcgaaaacgacaatatcattcacgtttctggtcaggttgatcctgcctcagatatcgaaattatcaataccgagctggcactggcggatctggatacctgtgagcgtgctatccaccgcgttcagaagaaagccaaaggtggcgataaagatgctaaagcagagctggaagcactggaaaaatgtcttcctcaccttgagcaggccggtatgctgcgtgccttagacctgagtgcggaagaaaaagcggcgattcgctacctcagcttcctgactttgaaaccaaccatgtacattgccaacgtcaatgaagatggttttgagaataacccacatcttgataccgttcgcgccattgcagaagcagaaggctctgtcgtggttccggtttgtgctgctattgaatcagacatcgctgagctggaagatggcgaccgtgaagaattcatggctgaactaggtctggaagaaccgggcctgaaccgtgtcattcgcgctggttatcaattactgaacctgcaaacttacttcaccgctggcgtgaaagaagttcgtgcatggacgatcccggttggtgccacagcgccacaggcagcgggtaaaatccacaccgacttcgaaaaaggatttatccgtgcccagaccatcgcgtttgaagatttcatcaattacaaaggtgaacaaggcgcgaaagaagccggcaaaatgcgtgctgaaggtaaagactacatcgttaaagatggcgatgtgatgaacttcttgttcaacgtctgatttattgctcattcctctcagcatcgcatgatggcttagaggaatgattaaaatacctaaaatccgcgtggttgcgcggatttttgtttttactgcgactaactttgtcttaccatcccatcagcatatttaacctcatcaatcgcatcggcaatcgctttcaagctacgttgaatatcatcttcggtggtagcccaagagctgacactcaaacgaatggcctcttgcccctgccatattgtttgcccaaaccagcattcacctgactgctgaactttttgcagcatagctcgctgcaagattatatctggcaaacacgcaaccacctgattgagaacaatttcattaagaactttaaaaccaagtaattctagcccctcagccagcatttttgcgtacaaacagcagcgttcaatcagcacctgaatcccttgtacgccgagttctgaaatcgctgcccacacttcaacagctctcgccctgcgggagaattctggcagcatatctttcgcctaccacatatcttgagtctccacatacgctgccgaagtcgtcatcacttctctcaacgcatgtttatgacgcacgatacacataccacaatcgtatggagtattgagccacttgtgtgcatctaccgcccaagagtcagcttcttcaacgcccttgactaatgcggattgcgcactcgaagctcgcgcccaaagcccaaatgccccatccacatgtacccaactgcctgcttttttagctcggggaataagtgcgtgaaagttatccgagctaccagagttaacattgcccgcctgcaataccagaatcgtattatctgaaaactctgggacggcactctcaatgattcgtccttggctatcgcatggcacaatattcaactgtgaacgaccaaaaccgagcaacctcagcgcctttaaaactgatatgtgaacttcttcagatagtacgactttcaattgaggtgcattttgtaaaccatgttctgcgaagtcatacccttttttctgatacaaatattgccgggcggctgccaaggcacttacatgagccattgttgtgccagtcacaaaaccgacaaacgcctctggcggtaaattcagcagttccaaaacccagcgtccggcaattttttctaattgatcagcaacaggcgaagacgactccatcaacgctatctgatcccacgcactggtcacgatgtttgctcccatagctgccggcgttgaaccaccaacaaccaaaccgaaatatcggcctcctgttgtcgccaccgtcgcgggcgagccgtacctatggagctgcgcaagcacttgttggcaatccgttccatgttggggtaatggcctatcaagattctgtagacccgataaagcgccagaatcgggaaatactcgttggtttctcaccttactgacgtagttatacgcgatttcactcgctaccttaaccgcagacagcgaggcatcacgaataggatctttcattacgttgtttccaatttatcaagaaatattcagttgctttaacaaacaagtaccttacatacaataactgcccaacgcattcatttcagtattcaatcaatccgcgttgtgttttatgattaacccccacaaccaccttatcctccacaatccttgcctaatcctccaatttattattttcactgatataaattttccaattctaacgatatgctaagtaacaataatgagtaaaaattttgtgtgtttatggcaatgaatgagggagtagaaaatgagtgcattacatcaccactccggtgcaacagaaattgaaattcagttacaacaattaatcgggaaagtggccagcttgacgcgacctaatacacatgcagccaaaactgcgatccctgaaatgacattgtgtcatttagaacagccgacggcaccagtaggctggttgtacgaacccagcatcatgatcattgcccaaggaaaaaaacggataactatcggcgggtgctcttattgttgtgatgccagccaatttatggtgacttccaccgatattcccaccattactcaagtttgcaccgcttcgaaagaagaacccttttttgccatgatgttacagtttaatattcaggaagcctcagaattactgatagaaaatcatgttgcgatccggcaggattcgccagaaacatgcgggttagcagttactcccgtaacagcagaactgctggtttgtttcaatcggctactggatttattgaatacaccggaagatatccccgtactttcaccactgattcaaaaagagattgtctatcgtctgttaaaaagtgaattgggtggacgactgcaacaaatggcctcacaggaaagccccagccatcaaatcagcaagaccattaactggctgaaagatcactttgctgaccccatcaaagtcgaacaactcgcacaaatcgcccgaatgagtccttcatcctttcatcaccattttaaggcggtgacttcaatgagcccactccagtatcagaaatggctgcgtttaaatgaagcgagacgaatattattgacgcaacaccataacgtatcagccaccgcatttcaggtgggttatgaaagcccttcccagttcaaccgtgaatacagccgtctatttggtgagccaccctgtcgggatatcaagcggctgcgagtaagatgatgattaaccaatcgccatcaaatgaccttgataaaacgttaaatgcgaaaacaatatctctttggaggatcaggcaacgattggaaataactgggcacccatccggccaaaattggatctaatataattcatgcattatcaataaaataaaacagaggatgattataacccatattttggttattaactcagcaaaagagtttggtgaatcaaaaggagaactgaataacgcgttaacagagatcatcaaggatcatctgacaggaatggggcacgagatccaaataactcatgttgataagggttatgatattcaggcagaagtcgataaatttatttgggcagacagtgttatttaccagatgccgggctggtggatggaagcaccgtggattttgaaaaagtatgttgatgaagtttttagtgccggtgacggtacgttatttcaagatgatgggagaacgcgcagtgatcttaccaaaaaatatggctcaggcggtttatctcagggtaagacttacatgttttcagtaacttggaatgcaccgctggaatcttttgaagaccccgaacagttctttgaaggaaaaggcatcaacaacgtttattacccttttcataaagcaaatcagtttttaggcatgtcacccttaccgacgtttgcttgctatgacgtggtgaaacagccacagattgcacaggatattaagcggttaaaaatgcacttgtctgatcattattgataattagtgctcccacctgccatgcaggtgggtaatgtgatttttatcacggtttaaatttattcatattacctcacataaatcttccttgaatttttaccaaaaaaaaacaaccataacgggtctaataaattgatatatacattttatattacccataacatcctataatggcttatttttatgactctaatagcttatctataccgccaatcttggatattactgcttttatcgacaataagcgcattaattagtggatttgccggtgcatctgtagtaagtacaattagcaaaggaattacagaaacaattgagcttaattcctttctctggagcttttttggtatatgtattatttttttcattactaaaacgctatccgaggttatcctctcgcatttaacccaagcgacaatttattcattacgcctcagtctgagtgctaaaatattacgcgcgccttacaaaaaacttaataaactcgggagacacggcctattagctgttttaactaaagatgtcgatgtatttatacaatcttttatgttagccccaactgcttttggaaatatcacccttattttcgcctgttttggttatttagcgtggatttcctggcaactctttgtcattttgatccttttatgtctggtgatgatgtatattttttatcttctggaaaaacggcctatacgtttaatgactgaaatgcgtgatcaggtggacaggctgtatctcaatttccagagcctgatcgatggaagcaaagagctgcaactcaatacgcagaaaggcgatgcttttattgataaagtcatttctcccggtgccagaaaatttaaagagatttgtattaaagcaaccacgggttatgcgtgggtgctgaatgccagctcaatcgctttttatatgattatcggcatcatggtctttgtcgtaccaatctggttgcctcaagacccggccagtctggtgacagtgacattagttgtgctctttctggctggccctatcagtgaagttgtcggtgccattccagaactgagagaagccgaaatctcgctgaataaaatgcgtcaacttgacagtgacttagacgaagggcaggaaaatcaatcagtgcagggtgacacgccaaacccattcttgagtgaaaaacccctagtacttgagttgaaggatatcgtccatcactatacgactgataaagaagaccgtcagtttatgctcggccctttaagcctgaaaatatctcagggcgaaattgtctttattgtcgggggtaatggtagcggtaagaccacgttagccatgatgctggtcggtttattcgaacaggaatccggttctatctggcttaacggtgtcaagatggatgcatctaacaatgtccactatcgccaattcttttccgctgtattttccaactatcatctatttgatcagctcttaaataccggtacagacgtcacagagaaagcgactcattacattcaggcattaaacatgggtcacaaagtgaagattattgatggtaaattctctacgacagagctttcagccggtcaaagaaagcggctggctttggtcgctgcttatttggaagaccgccctctttatctttttgatgagtgggctgctgaccaagatccggtgtttaaacggctgttctatacagagcttctgccagagttaaggtctcgtggaaaaacggttattgtgattagccatgacgatgcttatttcgatattgctgaacgtgttattaaactggaagatggtaatattaaagaaataaataatcatagtcatgaaaccattacggaactaaaataaataaccaccccgaacaaatgaccatgatatattttttattcattccaagagcctattttaataggctctttttttattaacttacattattaaaattattatgtaatataaattattaacaacgaagatacacattacctgtaataaaattagatacataagtaaaacacagctaaccatgcaaaatacattgatttaatatataattcatcctctcgaatgtcatgaaaaaatcaaagtatattttctgaacaaaatgaaatttgcttatcagtttttttaaaatatgccattctttttctaaggatggcatattttttattattttatacattcacagcatgatttttcttgctgaaaatagatcgttttgacttttttaacccagtttttttagttgtagatttggattctagttttattttttgttttatcagttctcatacttttttattttcatatgcccataaaaaagggagctataaaatgaaccaccctgaaaagttgaagccatttgctttatccgaagcacaaagcagccgttggtttcaatatcaaattaacccaagccaacgtgggcgaaataatggtgcgttttgtgccagagttgaggggttaaacgctcaagatttagaagatgcactcaatcacctgatcaagcgccacccgatgctgcgagccagttttgggctatacgatggcgaattgggatatcgcatagcagagaatagcgaaatcaaagttcagacacatgatgcccggcacctcagcgaagacactcttcagcaacttgtatttgacgattgccggcatgttctcgatctggaaaatccgctgcgcttttatgccagttggtatcaatgcaatgcgcaagaaagtgtcatggtattgacgttcgatcacttagttgtcgatggttggtcttactggctgttgctggaagaactcggcatgattctgacctcacaggaattagaaccgatatcagaacacagttatcaagattatgtttcatggcagcagcaatggttaaacagtaaaagtgcaaaaaaacaacaacaattctggtgcgataatctggctggtaatttgagcgcattatcatggccgatgaaaatcggatcaatacagaacggagcagataacaacgccgcccctccagccacggataagatcacggcgttcggtagaatccctgatgatttagcccttaagctgtgtgctatggcatcggaatatggcaacagcctgttcgctatttttctgtctgcctatcaaatcctgcttaatcgctataccgcgcaggacgatatcgttatcggctcaatgatgccgggtcggagtcaagctaaatggggtaagttggtaggggaatttgtcaatccggtcgctttacggggtcaaatcaacggtaatgtcactgtacaggaacatattcttcaaaccgcgaagactatccgtcaggcgattgaaaaccagagataccctttcaccaaggttctggaacaatttaaattacagcgcactgcggatacgcatccgattttccagactctgatgacctttcaaaaacccagatatgtcagtgaactaccaacattatggatggatgacgattccagcacgacagtgcattggggtggcgcggaattaaggcctttcccgcatcctctttatgccgatacccccgtccccctgatggtgaatatgatggaggtcaatcaacagatccgttgtcatttccattacgatccccaagtgttcgatgctgagttaatcaatcaactcataaaaaatctcatcactttgctcacggcaatggcggataaccaacaacagtctatcgacagcttaccgctgatggatgagcaggaactccggcaggttctctatgatttcaacaagacggataagccttttcctcaacacgctctgattcatcaattattcgaacagcaagtcgaacgcacacctgacgccatcgccctgagttgcggtgataaggcgttaagctataccgaacttaaccaacaagccaatcgattggctcatgccttaattaaagctggtattcgtccggataatcgtgtcgctatctgcatggagcgcagtctggagatggtcattggcctgctgggaatattaaaagccggcgctgcttacgttccgctcgaccctgaatatccgacagatcggctcggccatattctgtcagacagtgaccctgcacttctgctgattcatcacggcctgcaagatcatttaccgatgacaactatgcctgtatgggtattggagagtgaagagtatcgaacaaatatcgccagtcagccgacggataacccggttgccaccgatttaggtctgacgtcccgccatttagcctatgtgctttacacctctggctcaacaggcttaccgaaaggggtcatgaatgagcaccgtggagtcgtcaaccgcttgttgtgggcgcaggatgaatatcaattaactcagcatgatcgggtattgcaaaaaacaccgttcagttttgatgtctcagtctgggagtttttcctgcctctgcttgccggcgctcaattagtcatggcgcgtcccggtggtcataaggaagcgctctatctgctggaagaaatcgaagcgcggggcattactacccttcattttgtgccttccatgctgcaaagttttattcatctgacacccgccggccgttgcccttctttgcgtcagattttgtgcagcggagaagccttgtcgtattccttacaacagcagtgtctggctcattttgctcacagcgaacttcacaacctgtatggcccgacggaagccgcaatcgatgtcacctcttggcgatgtgtacccgatcagcatatcggtctggttcccattggtcaccctatcgacaatacccagatctatatccttgataaacatgatcagcctgttcccattggcgtaatcggggaaatttatatcgcgggtgcgggtgttgcccggggttatctgaataaaccggaattgacagcggaacgctttatccgtgatccgttcagtcagcatcctgacatgcggatgtacaaaaccggcgacatcgggcgttggctagccgatggcagcatcgattatctgggacgcaacgactttcaggtcaagatacggggaaatcgcattgaactgggggaaattgaagcgcgcctggctcagtctgacggcgttcagaatgtgattgttatcgcccgtgaatatgatgccggagatacacggctagtcgcttatctcatccccaagcccggcgtcactctgagcattcccgctctacgggaacaagtgggcggcagtctgcctgattacatgatcccgagtgcatttgtgatgctggatgctttcccactcacgctgaatggcaaattggatcgtaaagcactgcctgcccccgatcactcggccgtcctcacacgggaatatgcggctccacaaggtgaaaccgaagaacaactggccgatatctggcaaaggttactgaaaatcgatcgcgtcgggcgtaatgacaattttttcgagctggggggtcattcgctgctgatgctacagctacagtcaagaataagtgaaaactttgatgtcgaactctctattcaacaattgtttgcacaccccactatttgccaacttgaagaacacattattgatgctcagttactgcaatttgacgctgaatccttgcaagatctctacaaaacaatgggttaattctggtttttaactggctttgaatggtacttaaaaaatgaatgataatgaattaatatctttaccattagcagaacgtaaaagactacttgagttagctaaagcagcaaagctaactcgtcagcagacacaaaaaacagaaatccatgcacaaccccatgatgggaatgtgccattgtcctgggcgcaacagcgcctctggtttttaacgcaattagatcctgcggcacaaacggcataccacatgtcggcagggctgaacctgcaaggtcacctgaatcagaacgcgcttaaagccgcgctggatcagattgtggcacgtcatgaaattctgcgtaccaccatcgtagacgtcgaaggacagccccaacaaatcattggcagtgctgatagtggttttgcgttatctgtacaagatctcagccagttacccaccacagaacagcaggcggcggtagaagaatgcgcccagcgtgaagccctccttcccttcgattttactcaggggcctttgattagggggcgactgctccgtctggcagaagagagccatgttctgttattaactcagcatcacatcatctccgatggctggtcggtcaatatcttgatgcaggaactttccacactttatcaggccttctgtcaagatcaggccgatccattacccgccttgacactccagtatgctgactatgcgctctggcagcggcaatggttacagggtgacgtgctggaaaaacagttagactactggcgcagtgaattgcagggcgcaccggtgattttagagttacccaccgacaaaccgcgtccaacccaacagagttatgccggaagccgagtcgatataacactgccgcctgcattgagtaccgagttaaaggcattcagtcagcgtcacggcattaccttatttatgaccttattggccggatgggcggtattactttcccgtatcagcggacaacacgatctggtgataggctctcccgtcgcgaatcgccaacggcatgagctggagccgctaataggcttttttgtcaatacgttagcgttacggatccaactgggtgacaaccccagcgtcagcgagctgttggcacgggtgaaaaatcatgctctgggggcttatgcacatcaggatctgccattcgagcaattagttgaggcgttaaaaccgccgcgtagcttgggccatagtcctatttttcaagtgatgctggctctggataatacgccgggacagcaatatttcgagctggatgggctgcatctgcatgaactgccacgaacccgagacagtgcctattttgacctgaccttaacactgaatgatactgagcaaggtttagtcggtgatctggaatatgccagtgatctttttgaacatgccagcattgagcggatggtcggttacctgcaaaccaccctgtcagctatggtggccgatgacagcctgcgggtagacgatcttcccctgctgacctcttcacaacgcactcagttattggcgaactttaacgataccgccattccatatccaaaaaatgctctgatccatcagttgttcgaacaacaggtggagcgcactcctgataaaattgccctggtctggggagaaactcaactgagttactccgagctgaatcagcgagccaatcaactggcacacagcataatggcatcgggagtccatccggatgatcgcgtcgcaatttgtgccgagcgcagtctggatatggtcatcggcctcgtagggattttgaaggcgggcgccagttacattccgctggaccccaatcacccgactgaacggctggcttatatgctgtctgacagtcagccagtattaatgctcactcagcagcacctgaaagcccgcctgcctgtcacaaacataccggtatgggcactggatagtgaagaacatcaaacctgtatcgccagtcagccaaaagacaatatcgacgcgtctcagctagggctgacctcacagaatctggcttatgtgttatacacctccggttcgactggcctgcctaaaggcgtcatgatcgaacaccagaatgtggtgcacttaatccattctcagttccagatgtcaaaattgacaccgcatgattgcgtactgcaatttgcctctttcggatttgataactctgttgctgaaattttcccgacatttgctataggggcaacggtcgttttgcggccagaccatatcaaggtgccggatacggaatttattacctttctgcaaaatcagggcatcacagttgtcgatttgcccaccgctttctggcacctgtgggcacaagaaatcagcgccggttatagctggcctcctgagcaattacgttccgtcgcggccggaggagaaaaagccgagcaccgccatctggtcacgtggctatccagtcctggcacacaaaaatgccgctggctcaatacctatggcccgacagaaaccaccgtcaatgcaacctcgatcgttatcgataaagaaaatctctgcacctatgaagatatcccgataggccggcctatcgccaatacccggatctatattctggatcaacgcggtcaacccgtcccgattggcgtaaatggcgaaattcatatcagtggcagcggggttgcgcgcgggtatctgaaccggtctgagctgacagcagaacgttttattcaagatcccttcagtgacatccccggcgctcgcatgtacaaaaccggcgatttaggtcgctggctaccggatggcaccatcagctattcaggccgcaatgactttcaggtcaaaattcgcggcttccgcattgagttgggtgagatagaagctcaactggcaacctgcgcgggcgtcaaagatgccgttgtcatcgtcagagaagataacagcggcgataaacgtctggtggcttacttaatcccacagtctggtgcaaccctgaacgtggctagcctgcgtgaacaactcagtgtcaatctggcagattacatgctgccaagtgcctttgtcacactggaagccttcccgttaaatcagaacggtaagatagaccgctcggccctgcccgcaccggatcgttcggccagcgtcagtcgcgaatatgctgaacctcagggtgagatcgagcaacaactggccgctatctggcaaaatttattgggattggagcgggtcggccgctatgacagtttctttgaactgggtggacattctttattaaccgtccaagtcgcatctcgtttgcgccagtcgctgaatattgaaataacgttgcaggatctgtttactcaaccggtattagcggatttagcccagtcattggtgacagcaacccagtcaacacagccgatgatcctgcccgccaaccgtgaacaaacattacccctatcctggacacagcaacgtctctggtttttggctcagttagatcccgccgcccagacggcatacaacatgtcgggcgggctgcacctgcaaggccacctgaaccagaacgcgcttaaagccgcgttggatcgcatcgttgcccgtcatgaaattctacgcaccaccatcgtgcaggccgaagggaaagcccggcaagtcattggtgatgcagatggcggtttttctttaaccgtccgggatcttagtcagttatcttcatcagcgcagcaggcaaccattgaggaatgcgcccaatttgaagccagccatcctttcgattttgcgcaagagccgttaatccgcgctcaactgcttaaactcggcgagcagcaacatgttctgctattgacccaacatcacattatttccgatggctggtcgcttaatgtattgatgaacgaactttctgcgctgtaccaagccttcggtcaggggcaagctgatccattgcctgcattagccattcaatatgccgactatgcggtttggcaacggcaatggctgcaaggcgaaaggctggaaaaacagttgagttactggcgcaatgagttacaagatgcccccaccttattagaactgcctactgataaagtccgcccgtcagtacagagttatcatggtgatcaggtcacgttcactttatcgccggaattaaattcagggttaagggcattgagccagcgccacggtgcgacgttgttcatgacattactggccggctggggaattttgctgtcacggttaagtggtcagcccgatttagtgattggtactcccgtcgccaaccgccagtacagcgagttggagcctttaatcggcttcttcgccaatacactggtcctgagaatcaagttagaagataacccgaccgtcagcgcattattggcaagagtgaaggctcatgcgctggaagcctacgcccatcaggatctgccatttgaacaattagtcgaagtgctacaaccgccacgcagtttaagtcacagtccgattttccaagtcatgttggctttagataatacatccagtaaacaaagtttcgaattggcggaattgagcctcaatccgctggcgctgaccagaaatagtgcccattttgatctcactctggcactgagtgacaccgaaaatagtctgacatgtgagttggaatatgccagcgatctttttgaacgttccagtatcgagcgcatggcgggttatctgcaaaacctgctggcggcgatggtcgctgatgacaacctgcgagtcgcagatctgccactattaatgccacatgaacgcactcaattactgaccgactttaacgataccgccgtcacctatccgcaggacaaactgctgtcgcagttatttgaacaacaggtagagcacacacctgatgccattgccctaatctgggaagacgctcaactcagttatgccgaactgaaccagcgcgccaaccaactggctcacgccctgattgcctttggcgttcagcccgatgaccgcgtggcgatttgtatcgagcgtaatctcaacatggtgattgggatgctgggcatactcaaagccggtgccggttatgttccgctcgacccggaataccctgccgagcggctggcctatatcctgtcagacagtgcgccaaaattactgctcacccaacagcatttgcaggcacaattgccggtagagaaactcccggtctggcaactggacgatactggccatttaaatagcgtggcacagcaaccgaccgataaccctgatccacgccagttggggctctttccgcatcatctggcctatatcatctatacctccggctctacgggtctgcccaaaggggtgatgattgaacatcacaacgtcgtgaatttcacctactcccaatgccagaccagtgaactcaaacccactgaccgcgtcctgcaatttgcctcggtttcatttgataccgccgtgtctgaaattttcccgacgttgtcagtcggcgcgaccttgatcctgcgtccggcgcatattcgcatcccggatgccaccttcagtcatttcttgcaggagcaggcgatcagcgtcatcgatctgcccaccgccttctggcaccagtgggtacaggagatgaaagccggccgcagtggtttcagctcccatgtacgttcggtcacggtcggcggtgagaaagccgaacaccgtcatttcgtcacttggcaatcaatgccggaaacccggcactgccgctggatcgatacttacgggccaacggaaacgacggtcagtgccactgcgctgacactggatggccctgcttcctatgtaacagaatccttgtcgattggccgtcccctgatcaatacccacgtttatattcttgatacacaggggcagcccgtccccatcggtgtcaccggagaaatctacattggtggcgcaggcgttgcccggggttatctgaaccgccctgaactcaccgccgagcgttttgtgtccgacccattccgtgaacaaccccatgcacggatgtaccggacgggcgatctgggctgctggcgaccggatggcacaattgtctacctcggccgcaatgattttcaggtcaagatccgcggctttcgcattgaactgggcgaaattgagtctcagttggccgcctgtacaggggtcagtgatgccgtggtggtggcacgtgaagagggcagcggcgataaacgtctggtggcgtacctcgtaccgaagtccgatgtcacactggatgccgccagcctgcgcgaacaactgagcacccacttggctgaatatatgttgccgagtgcattcgtgatactggatgccttcccgctgaacccgaacggcaaactggatcgcaaggcgctgcccgcacccgaccacgccgccaccgtcagccgtgaatatcaagctcctcagggagagatggagcagcaactggccgttatctggcaaaccttgctggggctggaacaggtcgggcgtcaggacaatttctttgaattgggtgggcattccctgctggtggtcagcctgattgaacaactgcgccaaagcagtctgaatctggatgtcagcgccgtcttttcttcgccaacactggcggcgatggcggcgcgtctgatagtgaaaacgtctgatggtgctactggcactagcgtacaaaacgtgccgccgaatctcatcaccgacggttgtcagtccattacaccggagatgctgccactggtggcactgacacaggataacattgaccagatcgtcgcccaaattcccggaggtgtctccaatattcaggatatctatccgttggggccattgcaggaaggcattctgttccaccatttactggaaacaaccggtgacacctatctcgacaaccagctgatgacctttgacagccgcccgcgtctggacacgtttttgctggcactacaacaggttatcaaccgtcacgatatcctgcgcagtgcggttcactggaacggcctgccggagccggtacacgtggttcatcgtcaagcccctcttcccattgccgagctgacgctgtcgccggaacacgatgccgaacagcagttgcgcgatgctaccgattctcgctcggtacggatggatctgactcaagccccgttattgtctatcaagcttgccaaagatccgcatagtgaaacctggtttctggctttactgcaccaccatctggtgtgtgatcacctgtcgctggagatgatatttaacgaagtgcaggcaatgctactgggacaggatgactcgttggcaccatcgttgccttaccgcaactttatcgcccagacccgcaccgtgccgcttgaaaaacatcaggactacttccaccagctcttgggtgatatcgatgaacctaccctgccctttggtttactcgatatacaaggcaactctgatgaacagagtgaaatagcagaagccaacttcactttagataacgaactggcccgaaaaatacgtgactgcgcccgtcagcagggcgtcagtgcggcggtattgttccacgtcgcttgggcgcaggtagtggcgcaatgcagcggacgggatgatgtcgttttcggtacggtattactgggaagattacagggaggctcaggtgccgatcaagtcctcggtatgtttatcaataccttgcctgtgcgcgttttattgcaggaacgcacggtgcgacaaaccgttcaggaaacttaccagcagttaagtttattgctggaacacgaacagaccccgctggccatcgcccagcgttgcagccgtgtgcaggcgcctcaacctctctttaacagcctgcttaatttccgccatagccagcgtgacgataaacagtctgcatcaccggcttgggaaggtattcagatcctcagcggtgaagaacgcagtaattatcctctgtcgctggatgtggatgacttcgatgatggctttgccctgaccgcccagtgtaaccgacaggttgatccggcacgcattaacacttttatggataccgtgctgagagagctggtggccgcactgcaaaacgtctctgaacagagtattcaatctctcgccgtcctgccgccagatgaacgcactcggttactggtggactttaacaatacggcggcttcctatccgcaaaatgtcctgctccaccagccattcgaacagcaagtggaacgcacaccggaggccattgccttaatctgggaaggcactcagctcagctacaccgaactgaaccagcgcgctaaccaactggcacatcacctgatttcgtccggcgttcagcccgatgatcgggtggcgatctgtatcgaacgcaatcttgacatggtgattagtatgctgggcatattaaaagccggtgcaggttacgttccgctcgatccggcctaccctgccgaacgtctggcctatatcctgtcagacagtgcgccgaaattactgctcactcagcagcatttgcaggggcgattagccgtagaggatctccccgtctggcgactggacgatgccgaccatttaagtaccgtggcacagcaaccgaccgataaccctgactcacgccgactggagctacagccgcatcatctggcctatatcatctatacctccggctccaccggactgcctaaaggcgtgatgattgagcaccgcaacgtggtgaatttcacctatgcccagtgtcaggtcagtgaactcaaatccactgaccgcgtcctgcaatttgcctcggtttcgtttgatactgccgtgtctgagattttccccacattggccgtcggcgcgaccttaatcctgcgaccggcgcatattcaagtaccggataccacctttagtgatttcctgcgggagcaggcgatcagtatcgtggatctgcccaccgccttctggcaccagtgggtacaggagatgaaagccggccgcagtggtttcagttccctgctgcgttcggtcacggtcggcggtgaaaaagccgaactgcgtcattacctcacttggcaatcgatgccggaaacccggaattgccgctggatcgactcctacgggccaaccgaaacgaccgttatcaccacggcgctggcactggacaacccgaccgccgatgcttcccgtgcgatggaaacgttgtcgattggccgcccgattgctaatacccggatctatattctcgacacgcgggggcagcctgtacccaccggcgtcaccggagaaatctacattggcggcgcgggggttgcccgaggttacctgaaccggcctgaactcaccaccgaacgttttgtatccgatccctacagtgagcaacccaatgcgcggatgtaccggacaggcgatctgggctgctggcaaccggatggcacgatagtctatctcggccgcaatgactttcaggtcaagctccgtggcttccgcattgaactgggtgaaatcgaaacccaactggccgcctgcctgggtgtcaaggatgccgtggtggtggcgcgtgaagaggatgccggtgataagcgtctggtggcttatgtgatcccgcaacccgatgcgtctttggacgcagccagcctgcgtgaacaactgagcacgcacctgacggaatatatgctgccgagtgcgttcgtgatactggatgccttcccgctgacgccgagtggaaaactggatcgcaaagccctgccggcacccggtcgttccgccagcaccagccatgaatatgaagcccctcaaggtgaaattgaaccgcaactggccgctatctggcagaccctgctgggactggagcaggttgggcgccatgataacttctttgagttaggcgggaattcattatccatcatgcggttatccactcacctgcgtgaagaattccaccttgaaattcctattgcagacatttttcatcactcaacactgtataaacttgctgaacttattctatcaagacaaattgaaacctttttagcccaagatatagagtcggtacaaaaagagttggagaacctgtctgaagaagagttgcttgccatgttaaatggagatcaacaatgaacatcaatgaacaaactctggataaattacggcaggcagtgctccagaaaaaaattaaagaacgcatccaaaatagcctgagtactgaaaaatatcagatccagcccagaactgacccacaacaggcgttaccgctatcctgggcgcagcagcgcctatggttccttgctcaattggatcccgccgcacagacggcgtatcacataccggctggccttcatctgcaaggccagctgaaccaaagcgcattacaggccacgctgggtagcctggtggcacgccatgaaattttgcgaaccaccattgcgctggtcgaggggaaagcacagcaaatcattggcgatgcagactgcggctttgctttaaccattcaggatctcagtcagttgcctgaagcagaacaacaaaccactgtcgaagaatatacgcagtctgaagcgagccatccctttgattttgaacatggcccgttgatacggggacgattactcaagctctcgcaggatagccatatcctgctgttaactcagcatcacattatctccgatggctggtcaatcaatgtgttgatgcaggaactctcgacgctttaccacactttcgatcagggtctggcaaacccattaccgccattgacgctccagtatgccgactatgcgctctggcaacggcaatggctgcaaggcgaagtgctggaaaaacaattggattactggtgcaatgcactacaggatgcccctgcgctcttaacactccccacagacagaccccggccgccacagcagagttatgctggtggaagcgttgagatcacgttccctgcgacgctgaatgcacaattaaaaacactcggccaacgtcatgggacaaccttatttatgaccctgttggcgggctgggcagtgttactctcccgcatcagtggacagaaggatctggtaataggcacgcccgtcgcaaatcgccagcatcgtgaactggagcctttgctcggtttctttgtcaatacgttagcgctgcgggtacagttgcatgacaacccaaccgtcagtgagctattggcacaggtgaaagcccataccctgaatgcttacgtgcatcaggatctgccattcgaacagttagttgaagcgttaaaacccccgcgcagcctgagccatagcccgatctttcaggtcatgctgtctcaggaaaatacgccggggcaacaaaacgttgaactaccggggctgacgatcagtgagctggatctacctgaaaacagctcacacttcgacctgtcgttatccctgaatgatagcgaaaacggattggtgggcgcactggaatacgcccgcgatctttttgactcttccagcattgagcgcatggttggttacctgaccaccctgctcaccgccatgacagcggatgacacgctgcgggtggaagcgctgccactcttgatgtcacaagagcgtacccggctattggtggattttaacgaaactaccgtggcctatccgaaagatattctgctccatcagatggttgagcaacaggtcgagcgtacaccgtatgctattgccttaatctgggaagacactcaactcagctacgccgaactgaaccagcgcgccaaccaactggctcacgccctgattgactttggcgttcagcccaatgaccgcgtggcgatttgtgccgagcgtagccccgacatgatcattgggatgctgggcatattaaaagccggggcgggttatattccgctggataccgaataccctgccgagcggctggcctatatcctatcagacagtgcaccaaaattactgcttactcaacagcatttgcaggcacgattagcggtagacggcctgcccgtctggcgactggacgatatcagccatttaaatgcggtggcacagcaatcgacacacaaccctgaactgtgccaagcagggttactgccacatcatctggcctatatcatctatacctctggctccacggggcagcccaaaggcgtgatgattgagcaccgcaacgtggtgaattttgtccactcccaatgccagatcaatgaactcaaatccacggatcgcgttctgcaattttcctcggtctcctttgatacggccgtctctgaagtgttcccgacgttgtcagtcggcgcgaccttgatcctgcgtccggcgcatattcgtataccagatgccgcctttggtcatttcttgcaggaacaacggatcagcatcgcagaactacccaccgccttctggcaccaatgggtacaggagatgaaagccggccgcagtggtttcagttcccacctgcgttcagtcacggtcggcggtgaaaaagccgagcaccggcatttcgtcacctggcagtcgatgccggaaacccagaattgccgctggctcgacacttacgggccaacggaaaccaccgtcattgccactgcgctgacactgaacagccatgccgcccgttctttctgtgcggcggaaaccttgtcgattggccgcccgattgccaatacccagatctatattctcgatacacagggacaacccgtaccgattggtgtcgccggagaaatctatattggcggcgcaggcgttgcccggggttatctgaaccagcctgaactcaccgccgaacgttttgtgtccgacccattcagtgaacagccccatgcgcgtatgtacaggacgggcgatctgggctgctggcgaccggatggcacaattgtctatctcggccgcaatgactttcaggtcaagatccgcggattccgtattgaactgggggaaatcgaagcgcaattggccgactgttccggtgtcagtgatgccgtggtggtagcgcgtgaagaaggtgcaggcgataaacgtctggtggcgtacatcgtgccgaagtctgatgtcacattggatgccgccagcctgcgcgaacaactgagcacccacttggctgaatatatgctgccgagtgcattcgtgatattagatgccttcccactgaacccgaacggaaaactggatcgtaaagcgctgccggtgccagatcgtaccgccataatcagccgtgaatatcaggcacctcaaggggaaaccgagcagcaactggccgcggtttggcaaaatctgttggggttagagcagattggacgtcaagacaacttctttgaactaggcgggcattcactgctggtcgtcagcctgatcgaacaactgcgccaacgcggtctcgccgtgggtgtcagtgcggttttctcagccccgacgctagccgctatggccgcacatttaaccgatgatgccgcatctgatacccgtacgcaggccgttcccccgaacctgatcccggacgattgccaagccatcacgccggagatgttgccactggtcacactgacacaggacaatattgaccagcttgttacccgagtcagcggcggggcggccaacattcaggatatttacccgctggggccattgcaggaaggcattctgttccaccatatgctggaaacaacgggagacacctatctcgacagccagcttatgacctttgacagccgccaacggctggatgcgtttctgctggcgctgcaacaggtgatcgatcgtcatgatatcctgcgtagcgccgtccactggcatgggcagccggagccggtacaggtagtttaccatcaggctcctcttcctgtgatagtgttagccctgtcaccagaggaagacgctgaacagcaattacgccgccatactgattcccgctccatacggatggatatcacccaagcgccgttaatgtcagccaatattgccaaagatccgcatagcgaaacctggctgctgtccctgctgcaccatcatctggtgtgtgatcacctgtcgctggaactgatatttaatgaagtccagacattgctgctgagacaaggtgaacatctacagccagcgttgccctaccgcaatttcatcgctcagacccgaagcgtgccggttgaaaaacatcaggcttattttcaacagttgctaggtgatgttgatgaacccactctgccctttggtttactggatgttcaggcaagtaataatgagatcgcagaagccgttttaacactggatgacgaactggcgcagaggatacgagactgcgcccgtcagcagggagtcagcgccgccgtcctgttccatgtcgcttgggcacaagtgctggcgcaatgcagtaatcgggaagatgtggtcttcggtacggtgttattgggacggttacagggcggtgaggatacgacccgaatactgggtatgtttatcaataccctgcccgttcgtgtcatcttgcaggatcgcagtgttcaacaaacggtacaggaaacttatcagcaactcagtcagttactggcacatgagcaggcgccactggcggttgcccagcgttgcagtgggattcctgtttccctgcccctgtttaacagcctgctcaatttccgtcacagctcagatgatgacgagcaggatctgtcactcgcctgggaaggtatccagaccctcagtggtgaagagcgtagtaattatcctctgtcgctggatgtggacgccttcgatgacggttttgcgctgaccgcgcaatgcagccagcaaattgatcctgcccgcattaacgcttatatggatattgccctgaaagggctggtggcggcgctgcaaaatcagcctgaacaaagtatccagtccgtgactatcttgccaccagcagaacgttctcagttgctggtggactttaacaataccaccgtggcttattcacaggacaagctgctgccgcagttattcgagcaacaggtagagcacacaccggattcaatagccctaatctgggaagatcactctctcagttacaccgaactgaaccagcgtgccaatcaactggctcacgccctgattgcttttggtgttcagcccgatgaccgcgtggcgatttgtattgagcgtaacctcgatatggtgattggtatgctgggcatactcaaagccggcgccggttatgttccgcttgaccctgaataccctgccgaacgtctggcctatatcctgtcagacagtgcgcccaaattactgctcacccagcagcatttgcaggcacgattgccgatagaagatctgaccgtctggcaactggacgaagccagccatttaaatagcgtggcaccgcaaccgaccgataaccctgatccacgccagttggggctgcatccccatcatctggcctatatcatctatacctccggctccaccggtctgcccaaaggggtgatgattgaacaccataacgtggtgaatttcacctatgcccaatgccagaacagtgagctcaaatccactgaccgcgtcctgcaatttgcctcagtttcctttgatacggccgtgtctgaaattttcccgacgctggccgttggcgcaaccctgatcctgcgtccggcgcatattcgcatcccggatgccacctttagtcagttcttgcaggagcaggcgatcagcgtcgccgatctgcccaccgccttctggcaccagtgggtacaggagatgaaagccggccgcagtggtttcagttcccacctgcgttcggtcacggtcggcggtgaaaaagccgaacaccgccatttcatcacttggcaatcgatgccggaaacccggcactgccgctggatcgacacttacgggccaacggaaacgacggtcagtgccactgcgctggcactggatgatccggcttcctatggcatggaaaccctgtcgattggccatcctcttatcaatacctacatttatattcttgatacgcgggggcaacccgtccccatcggtgtcaccggagaaatctatattggtggcgcaggggttgcccggggctatctgaaccggcctgaactcaccgcagaacgttttgtgtccgacccattcagtgaacaacctcatgcgcggatgtaccggacgggcgatctgggctgctggcgaccggatggcaccattgtctacctcggccgcaatgattttcaggtcaaaatccgtggcttccgcattgaactgggtgaaatcgaaaaccagttagccgcctgtgcgggtgtcagtgatgccgtggtggtggcgcgtgaagaaggagcaggcgataaacgtctggtggcttacctcgtgccacagtccgatgtcacgttggatgccgccgatttgcgcgaacaattgagtattcacctggcagaatatatgctgccgagcgcattcgtgatactggatacgttcccgctgaacccgaacggcaaactggatcgcaaggccttgccggctcccgatcacgccgcctccgtcagtcgtgaatttcaggctcctcagggtgaaaccgaacaacaactcgcctctgtctggcagaccctgctgggactggaacaagtcgggcgtcatgacaacttctttgaattgggcggacattcgctgctggtcgtcagcctgattgaacaactgcgccaacgcaatctgactctggatgtcagcagcgtcttctcttcgccgacattggcggcgatggcggttcgtctggccgcgtcagattctgatggttctgccggcataagcgtaccgccgaatctcatcaccgacgattgccaggttattacaccggagatgctgccgctggtggcactgacgcagaccaacattgaccaaatcgttacccaagtctccggcgggatcagtaacattcaggatatctatccgttggggccattgcaggaaggcattctgttccaccatttactggaaacggaaggcgatacttatctggacaacctgttgatgacctttgacagccgccagcgtctggatgcgtttttactcgcgctgcaacaggtattccaccgccacgatattctgcgcagtgcgatcctctgggatgacctgccgcagccggtgcaggtggtttatcgacaggcaccgatccccgtgacagagttaaccctgtcaccggaggaagaagccgaacagcaactgcgtcgccatattgatccgcgctcggtacggatggatatcacccaagcgccgttaatgtccgccagccttgccaaagatccgcagagtgaaacctggtttctggctttactgcaccaccatctggtgtgtgatcaccagtcgctggagatgatatttaacgaagtgcaggcaatcatggtaggccagagcgacaatctgccaccgtcactgccctaccgtaactttatcgcccagacccgcgccgtaccgtttgaaaaacatcaggactatttccgccagcttttgggcgatgtggatgaacccaccctgccctttggcttacaggaagtctatggcgaagatagcaacatcatagaagcggaattcgatctggatgcttcatttgcgcagacactacgggaatgcgcccgtcagcagggagtcagtgccgcagtactgttccacgtcgcctgggcgcaggtactggcgcaatgcagcggacgggatgatgtcgtcttcggtacggtgttattgggacggttacagggtgttgccggtgccgatcagacactggggatgtttatgaatacattacccatacggatcaagctgagtaccttcaatgtacagcaggtcgtccggcagacttatcgtttattgagtgaattactggagcatgagcaggcaccgctggcgatggctcaaaattgcagtggagttaccccgcctctgccattattcagtagcctgttgaattatcgtcacaaccaggacgatacccagcagacaaccctcacggcttgggaaggcatcggactgttaaatgtcgatgagcgcaccaactatcccctgagtttatctgtcgatgacaccgcgcaaggctttacactggtcgcacagtgtgttccggaacttgatcccatgcggattaatcatttcatgaacacggtgttacagggtttagttgaaagcctgaaaaattcgccggaacaaacctgcctgcaactcaacatactgccgcaggaagaacgtacacagcttctgcgaacattcaacaacacccgtgaggcttacccgcaggatcaactgatccaccagctcattgaacaacaagtcgagcgctccccgaccgcaaccgcgctgatttatgatgacaatcaattgagttacgacgaactgaaccgtcgggccaaccaactggcacactatctgattgcgtttggggtacgtccggatgatcgggtcgccatttgtgtagaacgtggtctggagatggtcatcggcttattagcaatcatgaaagccggggcgggttatattcctctcgatccggaatatcccggtgaacgcctgtcttatatgctatcagatagccagcccaccgtattattgactcagcatagccagcaaacccgtttgtctgagactgatacgccaatattgatactggatagtgatgaatatcaggcaaatatcattcatcaacctgagtgcaacctgccagccgccgatttaggtattacatcacgcaatctggcctatgtgctgtatacctccggttcgacgggacgccccaaaggggtcatggttgagcatattggggtagtaaacctgctgctatcaatgaaagaccggctgaaaatctctgtcaatgataccctgctcaccgcaaccacaattggctttgacgttgccgcacttgagctgtatttgcccttatgcaacggcagtacctgcgtcatagcgccatcattgaccgccagagatccagatcaattagcggaattgatcaccgcacgcaacatcaaagtcatgcaggcgactcctacaacttggcgcatgctacttgattccggctggacaggtgccgcgatcaaagccacaagcggaggagaagcattacctcacgaactggcacagcgtttaaaagaaaaagtcagtggattgtggaacctatatgggccgacagaaaccactatctgctcaacggcttccggtaatcttcagacagagccagagagccgctataccacgctccagataacgattggccgcccgattgccaatactcagatctacattcttgataaaaacggccatcccgttccaatgggtgtggccggtgaaattcatatcggcggtattggcgtcacacgtggctattttaaccgtccggatctcacggcagagcgttttgtccctgacccattcagtgacgaagcgggtgcaccggctgatagacgcatgtataaaacgggagacttgggacggtggcttcctgatggcaacattgactatctcggccgtaatgattttcaggtcaaaatccgcggattccgtattgaattaggggagattgaagccagattactcgcctgtgccgatatcaaagaagccgttgtcatggttcgtgaagataccgccaatgataagcgtctggtcgcctatctggtactacagccggaggcatccctgaacccggagaaactccgtgaaacgttacaggccagtttagccagctatatggttcccaatgcctttgtagcgctggattcattcccgcagacaccaaacggtaaattggatcgtcaagcattaccattaccggatgactcagcggtcattgctcaagtcggttatgaagcacctgtcggagggacagaaaatatcattgctgacgtctggcaagaaagcctcggccttgaacgtgtcggcaggcatgatcacttcttcgaattgggtggtcactccttattgacactgcaagttgtcgtgcgcttacgtcaggcgctcggcatggatatcgccatacgcgacctgcttattcatccgacaatcaatgaacttgccgcttatcttcaagcgaaaaatccattgagtccccctctggctcaacagcaaaatatcgtcacaatccgtaaaggaaacggaaaatcatcattgttcttcattcatccggcgggaggtgacgttcagtatgcttacgatcttaccgcttatattgatgataaagaccggtcaatttatgggatcatcgccagtgataccttcggggaggaaaatgcccggttaaccatcagcgaaatcgctaaagaatacgttgcctgtctccgtcagacgcagatacagggaccttatgatctggccggatggtcagttggcggaaccattgcgtatgaaatggcatgccaactgatggctgagggagaagccgtcaattttgtcgggttgtttgattcaggtgccagctatcaggacgcattttctctggaagaaaaacaggcaggtctgccatttaatgaaacagccacattgcttgaagtactgccagaaaatatgccgacctctctgcatgatgagatccagagattagcggaaaaccatgactgcgaggcgatattgatgcttgctcaacagaacgatttattccctgcttctgagaatatcaggcatcaactacacctttatcacaacatttctgtcgctgcttatcactatattccatcgacagccacggttgacgtcaccctgttcagggcaacggaagacaatgatcagagtagtcacgcccttggctgggaagccgttataccgaaggaacggctaactgtcgttccgatcaacggttctcatgaatccatcatggagccaccccgcatccaagatgtcggaaaggcattactttcagccatgacgaccccaagaggacattaatcggtttaaagagcgttcgcgaaagcggacgctttttttatctgcctctctgatgactgatttaactgctgagaaaatatgaaatttcaaacggttaaaatcaaataatctataatccaatttattctatgatgaaaatatatttatatattatttattaaatataaatacaacagaataagataataagataataagataataagattataagattataagattataagattataagattataagattataatacatccgacattccgcaccactttcaggaataaaatgattcatagggttgccccaatattttcagcagttcattttgatacacctgtattcccgtcaccatacggtgttcctgaaactcgaaagtactaatcccttcgaaggtcaaaaacacccaacgcgccgtgggagattgggtgggtttacctttcatatcgggatagaacggggcattttgcttcagtccggtgcggattttatgctccagtgcagcataaaccattaaactgcatgtcattatcattaataacgcttcgatgcgttctggctttttcaaataaatcgctgaagtcagaaactccggacttttcaggaaacggaaaccccgctcgactttttgttgcgctttgtaattagccagcagagtttccatattcagcgccttatcgtccatttcattcgtcgccagaatgaacatgccgactttgaggcgggcataagccactttccccagttggctgtagaccgaggcagaaagctgataatgaacactatcgggatgttgacctttagccgggcggcctcgccccttatgcacctcgattttttgaactttgggggcctcaatgccgataaactggcattctgcttcgaagtcacacaatgcctgcaaagcatcttcaccacagggaaacgactttttgctgagtttctcgaactgtttcagttctttttccgtcgaaatccgcgtatttttcctgaaagtctgatgttcacactgcatcgccgcttcactgttgaccagtaaccagcgctgtggaacgcccccgtagcaagattcaatccaatgaccggcataaccttctgtaaccggttgtaactggtcggtattaaccgtcagcaggtgctgtttcgcctctttaatggttaacggaacccgggtaataaatttttgattttgttgatgaagtgaggccagtgtctcttgggtataaagcgcggcatcggcaatcagataacggctgttttgggccgctttcaggcagccaatgtgatgtttcgtcgtctctgcaaacgctttggtgtcgttggtgtttccgctcatcgcctgcatgtatacggggatccccgcctgattttcacagataagttgcagcacaacctgattcaggtcaggacggtgatcacgactgtaaccacgcaccaaaacgaggcgttttgtctcgtcatcatcggggagtttgtactcaccatccacgtgaaaactcgtgatatcaaggtgaacggaatcggattttaatgccaatttatcaataacccgctcagcgataacctgataaatttcagagacaccgcagtcaaacaaggcgtccagcgtgcggccgagcacatcatcattgaggtgttcagccataattcccaccccaatcaggcgttcaacgggtttgtgcttaaaaaaatcagggcacatatggagcgttcgactgtggaaacccaacccattgaggatcatcgctaaaagagcctcgccatgagaaaccgtatgctctgcatatttaggcaaaatagcatcaatcatgcggggtaaaccgatctcatggcaaaaagcggcgacaaggccgaggtgatcgagacgtttgatggcaggttcagagagagacatgttgggcttccggtaaatagaagtaatagatcaaaaccgaagattgccgtcaatctgatttgaggagtaaatcaacaaagcgtgcggcaaatcacatgatttttaaatcaggaatgggtcatgctcccaatagttagattatccttgcaagatagtattcacgctcaatgaacgttccgatgattttgtcatgcaggatttctgatttagagtagcagatcgttttccgattcagcctttttattcgagtacgcagggtcagattcattctttcgatgcgttgggtaaatttctttcctctgaggtgagttctctcaggaaggcaatcataaacagcataattatcagtacaataatactggatttcaaacgatgccagaagcgccaacagtttttccagcgtttttttactgcgatcgccaaatacatgtgcgatgatttgcttctggtttggttcccacgcataccagagcccgcgttgattcttcttgttgccgacaaatgacccctgctcatcaatttcacagataatgtgaatctcacttcctgccagaggccgtgttgttacttgtctgggttcatgttttttaacgtgcgaagcacggtattgatcccgacgttcaaaacacgtgcagtgtctctgatcccgccgttatttatcgccatatcagtgatttgttctttcactccgggtttgcaggcttgataggtgtaattcagttggaaggttttacggcaggcataacagtgataacgcgggtgcccactgcttccttttccatgccctttgacctcctctgctttgtgacaataacgacaaaccacatcaactttagccatatctcaccagtaataaaaaatggaaagtttactacaataatctaactattgggagcatgacccagtagagagccttataagggaatggtggaaaactgtaatggaagattcgcgagtcatggctagtgaaattttacgctctttcgaaatccatgtcttttccaaaattggtaaattaccccatgatgaagtgatacttcacgtttggcttgctttaatcgaagatgttgctaaacggactccatcaataggagcgcgtatattgacatattctaagagggcacataaatgggctgttcggcgggggatacagtgggcaggttgtgaataatcccaccttatttaaatttgcgcatggagcggggttgatgggggaggcggagccagaggctattctgccattaaaacgagggcctgatggtgctctcggtgttcgtgcagcacaggcggcacgggtaatcaaacgaccatcaaggttgatatcgtagtgcatccagataagaacagtgaagtgaaaacaaccagcggatttgaatcatcggggcaggatattgcgaaatttgtcgatcagcgattcaagtcattactgcataaaagtttaggtcaggggggtgatttaaatgtggccatcaaaggagacagaagatgataaaaacattcgattttcccgcacgagtgggtgccgctggcgagtttgaacccgtggtacgttccgttcagttcggtgatgggtataagcaaacatcaggcgatgggatcaactcacagcgggaaagctggctcctgtcatttgtgggtgtcctgccagaaatagagcccatcatggcttttctgcgtgagcatcagggctggcgttcgtttaaatggcgcaatccgttatctgagctgggactgtatcaggccggaaaattcaatatacaggccaacggggcttatttcactttatccgtcacgttcacccgcgtttatcatccgtagaaggtttatctatgacaatcaatgccactctccagcgtcttgagccggggagcaagattctattgttttcggtcgatggctcggcctttggtgggccagagctgtattttcataatcaccctatcccctacacagaagatgaactggaaaactctgatcagttaccgatgaaatctatctggtggcaaggtcaggagtataaaccgtggcctgtcaaaattgaaggactgggggtcagcagtgatggcagtgcagcctcaccgacactcagtgtggccaatattgacggcactatcagcgccatgtgtctggcatatcagaatatggcgcaggctcgtgtgactgtccatatgacctttgcgcattatctggatgcccgtaattttcccgaaggcaaccccgaagccgatcccacgcaagagaaaatagacgtctactatattgatagtaagacacatgaagacaatacagagattcattttgccttgtcttctccggctgacctgcaagggatacgaattccgacccgtcagattcatagtctgtgtacgtggtgtatgcgtggcttatatcgaaaatccccatgcaactacatgggtgatcgttattttgacgaagacggaaatccgacccatgacccatcacgagattcttgcggtggactgatgagtgattgtaaagcccgacatggtgaggcggcgcaattgccgttcggcggtttccccggttctgcgttactgagaaagtgataaacccactatctgtaaatttcagaaatgtcctcagtgatttaggtcgaatttcagaaagcacaaaaagataaaaaaaggttttctatatccgccttttctctataatgctgcctttgcttttttattacctaaggatttaattatgaaaaaattagttttggcatcattagttgctgcaggaatgtctattgtgtcaatgggagcttgtgcggctggtgaaagcactatttcggcaggatatgcgcagagccatgttaagtctgggggtgataaattaaaagaaaacccaaaaggttttaatatcaaatatcgctatgaatttgataataattggagtgtgattggttcgttagcatatactcatcaagggtatgaatattattacggtggacacaaaacgggtactgttgatttagattattactcattgacagcgggccctgcgtatcgcatcaatgaatatgtgagtgcttacggcttagttggctcgggtcatggtaaagtggaagccaaaaacaagataaatggatcttcacacagcgaaaataaaactgaactcgcctatgctgctggcttacagattaacccgatccctaatatagcgattgacgcatcatatgaatattcaaaacttggtgaagtcaaagtgggcacatggatgattggtgttggttaccgattctaaaaaattaatttaaatataatttaacccgcttatgcgctgagggatccccacaaattagcgctaataaatcaaaaccatgttttggtagattttggcgagatatttgagtgtgttattaagaacgatttcaaataatattagcggggaatgccgtaatacattctccgctaatgtaagatgagagataactcgccttgatttaatactatttgcctgataattaagatgtattcctttattttcggcataaaaaccaatcagccaaagtacaactgaactcagtgtagcaagtagactcaatactgataaacgaccagcaccgtggctataacttgctctaagaccaaatccaaaacgttcactcttttcatccctaaaattttgctctatttgcattcttcggctgtaaattttcataacctgacgaggtttaaaatcatccatactagtaaaaataagccaaggttccattgctgccgaacgtccatctttgacctgagattttcgtaccattcgatatcgtgattttttgaattttctccctttattcggtcttttatgaagataaaaataaccatcgcaacgtgcatattctgcttttgataatgtgccaaaccctagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaaaaactgtggggttgtagttgcttttaaagcttgccgtttaaaccaaagctcaccctatttttcaagtcttagttgagtatttcctcgaatgcgtccgacgaaatcccaaccgagcgtttttatctgtttgaaccctgcattttgaaaacctgcatccgtaacaataattactctagctttagggttaacagcactcgctagcatgtcaagaaatgcattttggatggttacattttgttgttcacatgagggaactatttgacttaacaaaggaattgagcgtccatcacaaattcaactcgcacggagtacatgatgttcttgtgagggatatccactccaatcaacagctatgacacacaatgagagtgactcagtcagcatagcaataatattacgaaagatatcaggaatatccctatgaagagcttcattaccgagtagccgatcaatacgtttaattttatgtttgacgtgagcgtttcctggtaaaaagcgcccaatgctggttaacgtaagagaagcaccattaatcaaagcgatagtggcatcgattaatgcattctgacgatatttatgaaatggtgataaagcatctttaaagaagttatgacatatttcacgtacaggcatagcagtgaccttattgacttggtggaacaatcagtagatcacacaacgctatgcctgtctattttctggggattcctcagagcttatagctggcttattgtctatattcgaaatattcacaaataaaatggataaaaaaatatgacaattaattttcacaaagaaatttgggaaggatttgatgaaaaaacaaatcatggaaagactccttttcttttcgaatcaattcttcctttaaatgagggtttttctaatcatgaaactgttaaaaatgcattttataatttatgcaataaatctaatttactaaaaactgattgccgcttgcgtatctatgatggtgaaaaacgtcgtgatgatcttgttgaaaaattatcctctgaaaccatattatcggatgaaacgttgatacatttcatgcaacgattaagtggaaaagagcgtttcagtttagtgattaataaccttgagcaatcttgtccaaagctagcagctgatttcggtttatttgcgcaatctttctttgcttataaaggtattcctattggtggaatagaacaagcaactttttgtggcaattattctggtaccgcttttggtatacacgaaggttttgaacatgcatttttgtgtcatttaggaccgggtattaagtatttttattgttggtcaagagaactttatttggaaataactggctcacgcgaacccacgttctcagattcagaattgtatgacaaattaatagaaaaaggaacgctttatatacttaagccgggtgatgccttgtatttaccagcatcagtttatcatgtcggtcgtcaagaagaattttcagtatcaattgcgctgccattttatacttatccattgtcgcgttttatggcattaaaaatacttcctgctctcagtaaaaaatcacttccctttgatcaagaaggtatgtcagaattaattaactttgataataatcaatttgatacagaaccactctcaactcttttaacagaaacaataaataaatggctacaacaggatctacctaaatatttacattattactggcatcgacttcgtagtaacggaggatgggaactgcctacggctataaacgcagatccattaaaggaacccgaacatcaaaatgatttaatcattaatcctgattctcaagtatcattacaggctccatttattgtgagttatgagcatgggttagattgttcttctgatgaaattcgcgtatttattgcaacaaaaagtgtaatattacctgccagttctgagactttaaaacttttggatacacttaatactcgacaacccattacaataaattccgaggaaatttacacctcactaaaaacattaatagtcacgggcggtttactttctcattaattaataaggaataaaaaatgtatagaaatttcccagcattagtggatgattatctgaataaaaatattcccactagaaatttaattaatagtattattagtgaaggaaaagcaaaggttgatggaaatgagctgattgataaacatttcgatcctatgattgcaattatttataatcaaattaaagatctcatcaatccatcaaatctcagtaaggaagaagcaaaattatatattggtgagctgtctgtcttcgctcgttacaattccaccatgttattaagagcagccgataatattcgtggtttttgtcctgaatttgctcaagaattaacacggaactttttggaagaaggtggagaacgaggaaaattacctgcccactatgttgtttttagcggagcactcattgcggacttagattttcgagtgaatggctggatgccacgtacttcttcaacacgtgctcttatttccctaatcgacatacttacgtggtctcattgcccttcaacggtactgggcatgtactatgcaaccgaagctattgctatcgcggaaacgctacttttacaagacattaccaatcgtctgggacaaattactggtcaaggaacaggaaattcattaaaaaaacttgatttttattatcgaatgcacttggatgaaactcatagcgctgcaactgataatgtcgcagttgaacgcgggcatcaagaaggtattgctagattcatcagggatgcagatctattccactttcagcaacctcagattgtggatggcttccttcaaatgcttactccttttgttgatcagtgggttgagattcatcatttaacccgaacagatcactgttacagtcattaactttttagggtaattatatgaaaaaagttgaatattccggtgggtgtctttgtggtcatatcagatttatagcgacaggtgaggctggtaatcctcatacatgttcttgctccatgtgccaacaacattctgggggattgactctatgttggattgaatttccgaaagccgcagtccactggaatgggccgggtggcgttccctctgtatttcgttcttccgactattctagtcgtgccttttgctcacaatgtggaagctctctaggagcaatagacgatggcccaacagtcggactgctattaggtaattttgatagtaaaaacaaaaaaaaccttcgcccagtttcacattcatttatatcgtcacgcccccgttggtggaaaatcgatactcaatcctaatagagagaaaagcaaatgttgaattctccaatattatataaagcggcgatgattcgccgcatacgcacttttcttgattctcaggaatttattgaaattatgactcccgttatgcgccgttattctggtgatgactctcgtccacggctctccctacataatggaggttggctaagagaatcttcagcttttgccttgcgctacaatcttcaatactatgatcgtatctatgaaataggccctagtttccggcctgatgcagtggatgatacccacctaccagcatttacaatgcttgatttatataaaaaagattctacccttgatgaaatgcttcaacttgcacaatcaatcatagaaatattttatcaagggaaaataagtgtattgtcgtttgctgatcatcttaaacaacggttttcagttgatttttttgaagatttttccgcttccgaaatatttattgattgtttacgggaaatgtattgtgacaaaacaactcccccgctgaatctaattgatcgctatattattgagaatattgaacctctatcacaacaatgctgtattatcgtaacggattttcctttgctcaccgagatacgagcaaagaaaagaacaggaacaaaaggaatcgtcgagcgtttcgaaattttgattaatgggatcgaaattgttcatggttatactgacgaagatgatgtagagcgttttgaaactcaggctcggaaacgtaacatgtttgggtctgaagatgaggtgatgtgtaccatgatgagaaataaattggtatcgccttccagcgctggatttgctattggtatagaaagattatgtcaagttgcattaggagaaaaacaaatttctgcatttgcaacttcgcgcccgttttctcctttttaatttgcaaataacgaaacatttatcggaaatcattatatggtgacattcaatgaatggtttattatggccttttctatcgcattagttttaatcgttcctgggccaacaaatactttacttttatcagctgggttacaacaagggttaagtaaatctcttattctcgttattgccgaagctataggatatacagtggctattgcaatttggggattttttttgctatctctgacacagacgttgccttggatgtaccagcttgtgaagctattgtctgcgacttatgtgctgtggctagcttttaaattatggatgtatagcttaaaaatggattattttacagataatgaggtgaatttaataaatattttcgcccataaaggtacaaatttcgttgatgttatggtagccacatttttgaatccaaaagccttattattcgtaagtacttttattccaataagcgcttttaagtctgtgaatactttttttcctatgcttggtgtttttttgataatcttagtgccaataggtacattatggatatcttttggaagcttaattcattcctataaatacttacgtagatttactgccatttttctgcggatatcatccgtgattctgatactattttcattctcgttaacttattcaggaatagcaaaggctgaaagttcactggttttgtacaattggcaaagttatacaagtccagagatgctccaaaaattcaaaaaagagcataatatcagcattactctattagaatacaaatcaaatgaagaagcattagaaagcattcagcttggaaaaattgatgctgaccttgctgttgtagcggataattttttgcttcactggataaacgccggacttctgcaacctattgatgctcagtcaatgacaaatttcaagaatattaccccccgctggcgcacatctcctgccgatccgcaacgaacttatggtattccttggtcttggggcattgttggcactgtcgtccatacagatgtttacgatggcgatattaatacatggaaggttgttttagaaccgccaacatcattatttggtactattaatgtgggttcagacatgaatgatcttatttatgcggccattcgctatcatggtggtaaaatatgtgactcaaatcctaaattacttgaaaaagttaagaaaaccttacttgaagcaaaaaaacattgggccgcaatggagtatggtagtgtcaatatgatggcttcgggaaaatttaaagcaggtattgactggaatggtgcagcgttgcgtcaacgtagaattaattctcatattcagtttggcttgccacgtgaaggggtattaatattcagtgataatcttgtcattctcaaaaaatcgaaaaattatgaaaatgccagattatttcttaattttattatgcaacctgagaatgccgcattgaattctgcatttcatggctatgacagtaccatagaaggggctgataaatatttacccttatggatgaaaaatgcgcctgaacttaaaattcctgaacatgtattaaaaaattcagatcattcggtcatgtgctcaccttttgttcaaaaagagtatcttaatatctggcaacagcttttaaaaataagttattagcgcgctaattcttaggactgcgacttaaaagatagaaggcagaacagtaaccgttttagcttgggataatcacaagaattcctgccttcatcacatttctcacccctcgtatttatatttttgtttttattatcacaaattaacaatatatgatgctgaaattatcgatgttatgttgtatacaaattaatgcaaatgttaattgtctgttacacgatatcgagtaatcacactatgactgtcaaaaaagtgacaaaaacaaaactcttactggcaaccctcgctgcaatggctgtcatcatcatagctgttgcaggcaagctggaaaatgccaataaacgtttcctctcagtcgccaccgcttccacgggaggcacttattatccgatgggggtgggtctggctaatatctggagcaaccatctgaaaaatgagcatattcaggtcacggggcagtcttcagccggatcaattgaaaatattgatctgctacagaaagatgaggcgcaactcgccattttgcagagcctgatcgcctttgaagcctatcagggcgtgcgtcatttcgaaaaccgaccgtaccacgatttacgttccatctcggtactttggccgaatgtcgaacatttcgccctgctggaagacaaaatcaaagagggtacgctcaatgatattgccggaacccatttttctgtcgggccacaggccagtggcacagaacaatcaaccctgattattctgcaaggtgtcaatctcagtaagaaagacatccgcccagaatatcttggctatggcgataccgtttccgccatgcgggatggccgtcttgagggtggcgccctgcctgctggtgtacccgcatcggcagttactgatatgtacgccagcggcgtgccttcccgtatcctcaatgttaccgatgaccaactggcaaaaatcaatactatcgccgattcttggtttcgttttgttatcaagccggaaacttacccacgtcaaatccagccggttcataccattgctcaacccaatattctgatgacgacccgtaagattgatgaaaaaaccatttatgaactgacaaaagtgttgttcgaaaatttgaaaaaagttcagcaaatccatagcgcggcaaagtacattacgtcagaaaatgcgctcaaaggtgtctctgtacccttgcatatcggtgcgtatagattttatcgcgagaggggtctggatatccccgacaatcttgtacccccggaagcaaaactcactgcaactcagccataatccccatcacgctacggagtcatcatgagcactgacactttaacgtcatcttccccccacgaactggataaagaagccggttcgggcagccgtcatctgagcggcatttatctgaaactgacagcaatactggctatcgtgatttccctttatgccatttattctaatgcgttatccaatacgcaggagttttaccgcaatgcgacctttcttgggggaattctgatcttgggttttattctgtttcccctttccaaacgttatgccaccccaaaattcaatcgttgggattatctttttatcctgctgacattgctcagttatggctatttttatttcacttacgttgacttacatgtggttcgcaacagtattcccgacacgctggattatgtgatggcggtgatcggaattggcgtcttatttgaagcagccagacgcacaaccggctatttcataccgggactgtctctcttcgctatcatttatgccctgttcggccagtatttcatcgggatctttggccatgccggattttcccttgagcgcctgctattccgcctgtttatgaccagtgaaggcattttcggcatcaccctgtcaaccgcatcaaccgccatcatcgtcttcattttgtttggtgcatttttgagtgtcagcggcgcgacggcgttgttcaacgatttggcattggcaatagctggccgtcgccgtggagggccagcgcaagtcgccgtcatttcttccgctttgacgggatcattaagcggcagtgccgtcgccaatgtcgcgactactggcacttttaccattcccttaatgaaaagtatcggtctgtcaccgcgctttgccggtgctgttgaagcggccgcttcgacgggaggaatgatcatgccgccgattatgggggcggcggcgtttatcatggcgggttttcttggtatctcctacaccacgattgtcatggcggccattattcctgctttgctctattatgccgccctgatcattgccatcgatttagaagcaaaaaaacagggactgcaaggcatcagcaaagagaatattcctcaagtcaaaaccgtactgaaagcccgtggcctgctgttattaccgctatttatcgtaatcggcattctgctgatgggaaaaaccccgatttacgccggttttcttggcattattacgattatcatcgcaagctggatcacaccagatacctcggctcgcatgacaccaaagaaaattgccaaagccttgagtgaagctgcccggggctccattcaagttacgattgcctgtgctgccattggggtcatcatttgtgtcgttacgatgactggcatcggttcgaccctcgctttcaatatcgtttcgctgactgacaatacgctgtggatgatcctgctggtggtgatggtagtttgtatcgtcctcagtatggggctgccttccaccgccttatatattgttgtttccgtgacagtgtcacccatattaattaaagcgggcgtcttgccattagcggcacattttttcgttttctggttcggtgtgctttccaatattacccctcctgtggcgctggccagttacaccgccgccagcattgcccgctccgacccaatacaaacctcatggagtgccgtgcggctggctcttccgggcttcatcattccttttattctggtctataaccccgctttattgatgcaaggcaatgacttaaatgtgctttccattatttatatgatcatgaccgccctgattggcatttattcactctccgtcgctactgctaatttctggatgatcaagactcactggctggaaagaatattcttcgctatcgcggccattctgcttatcaaacccgggatgctgacagatttggccggtgtgatattcatcgctacagcgggcgttgttcatcggttacgttacaaccggcaacgtgctttccctctggagttaataaggaaaaacaataaaaatgtatgacgttattatcattggtgcggggttggtcggccttggtacggctaatgccctgcaagaacatcacccatcattgcgcctgctggtactggataaagaaaatggggcagccgcccaccaaagcgggcataacagcaatgttgttcactccggcatttactaccctcccggcagtttaaaagcccgtctggcaaaacagggaaaccgctcgatatatacgttttgtcagcaacatggcctgtatcatgaccgctgcggtaaaatgattgtggcgacccaaccgaaggaactgcccttattggaaaatctctaccagcgggggttgcagaacggccttgacgtcagccgcctgtcacaagctgaattgaaagagcgcgaaccttatgtcaatggtattgaagcgattttagtgccggatgcggggatcgtaaattatccggaaattgctgcgaaactggccgagatcattcaagccagagggggtgatattcattaccagcaacaagtgcagaatatccgtgaacacaatggctatgttgaagtgcaaacccaacaaacccactatcaggcaaaatggctggtgaattgtgcgggcttgcatagcgatagaattgcgcaactggccggttatgatacgggcatgaaaattgtgccgttccgtggcgaatactatgtgctgaacagcagtaaaaattatctggtcaatcacctgatttatcctgtacctaaccctgattttcctttccttggtgtccattttacgcggatgtacaacggcaagcgggatgttggccccaatgcagtattggcatttaagcgcgaaggatatcgtaaaaccgatttcagcccacgagatttggcagaagtgctcacttacaaagggttttggaagatcgcctcacgctattttggcgaaggagtggccgaaatgcgccgttcattctcgcgccagctttttaccgagaatgcccgccagctcattcctgacctgcaacccgaagatgtcacaccggggccagccggcgtccgcgctcaggcactgacagccgatggcaagctagtggatgattttcactttgtggttggtcgcagatcactgcatgtatgtaatgcaccttcgccggcagcgacagcttcgatggagattggaagggagattgtgaggcggtattttgcggagctttgaagaaggtaatttttaaactgacagataccggaatagaaacggtaactgtcagtttggattagtacgctttatttacaggctatattcgactagttatcccgaaccattacgtctgtatgtagagtataatcgttactcttcatctcatagctcgaattagatggaactaatgttgtcatacctattccatcaccctcatatttgtgtgaatctacagctctatatttatattgttttcccgcataaaaaatactaaccagcattctatattcacctttactattcctaaatagctgttcctaatattgctacacttttgctgtgccatgtttatttcctgggaatgggctaaccgtgttcataaagccacgcacttttctcaataactgccacatataacagcaacaatgattacgtgtaatcgtttcatggagtgctaaccctaatttttcaatatgatttatccatggggaataaatcggttgataaatcaatttgaatttcggattttgggcgagccactcttgtgttttctggcttttgtgaataatgtagttatcgactatcaaggtaatacttttcgcccggcgataggcggctttcagatgcgctaatagtttgataaataatgatgagtctttattgttgccgccaacataactcacttttccggtgccactgtgtaaggcacccgccagataatatttctcgttctgacccggtgtcgtgatacgtttttgttgcccacgtcattgccagtctgcaccgattttaggattcaggtggatatccacttcatcttcgtaaaagaccggatgatcggggctgcatccaggggttacgcatgaaaatatttagtggataattctttcatttttagagggacgctaatgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatagccacggacgtaccgtcagacggcgcggatgggttctgccactgacatcagaaacaaatgagtatggagataagtcttcgggcatgatttttatcgcgggttttctggatagttttttgcattaaacggcgctcattgcgcggtatcgatgctatgattggcataactcagtccgatggatgatttttttggtttggcgattaatcagatcgtccaattcggattgagttccctgcaagtgatctatccgtcattccgcacctcattcctgggtcatgctcccaatagttagattattgtagtaaactttccattttttattactggtgagatatggctaaagttgatgtggtttgtcgttattgtcacaaagcagaggaggtcaaagggcatggaaaaggaagcagtgggcacccgcgttatcactgttatgcctgccgtaaaaccttccaactgaattacacctatcaagcctgcaaacccggagtgaaagaacaaatcactgatatggcgataaataacggcgggatcagagacactgcacgtgttttgaacgtcgggatcaataccgtgcttcgcacgttaaaaaacatgaacccagacaagtaacaacacggcctctggcaggaagtgagattcacattatctgtgaaattgatgagcaggggtcatttgtcggcaacaagaagaatcaacgcgggctctggtatgcgtgggaaccaaaccagaagcaaatcatcgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaactattgggagcatgaccctctactgtcatcgcatttaacgcagactctttacgaacacgtttgactattttaggattacggtgctgttccaattccccgcgataagaagtcactgaatcacgagcatcctttaagctggttgctggatatgtgccaatgtcaattcgatccccttttccatcccaacgataccggaactgaaaaatcacttttccttttggggtaacacgaacagataaaccatccctatcggatttggtaatcattatttcttggggcttaccattgatagaacgtagccatgaatcagtaattgccatatcactttcctcaaaaaacaatacagctttcaatgtagtttaagtacaccgatatgtacatatttcttatgacacaagatgaatacacgtgactactcatgacaggataatgcatataaataaattaaattcgtttaaaatcaataaattattaaaaaatacatgactattaatgaagatcaatgactaatggcagccatttttgatatggatggtctgcttattgattcagagccttactggaagcaaggagaagaaactgtatttggtgaattgggactggacttatctttggcgaataaattgcctgatacactgggattacgcatcgataaggtggttgaactatggtatcaggtatcaccttggcaaggcacctcaaaaaaggaagttgaacagcgcatcatcaaccatgtcatccggttagtcaaagaaaaccgtcccctgcttcccggcggcgaatacgctttaaacctctgccataaacatggccttaaagtcggtctggcttctgcgtccccccataatatgctcgagcaagtacttgaattgtttaacttgagacattacttcaatgttgtagtttctgctgcaaacttaccatacagtaaaccacatcctgaagtgtatttgcagacagctagccaacttgaggttaaccctattaattgccttacactggaagattccttcaacggtatggtagaaaccaaagcagccagaatgcgctctattgtgattcctgccttccaccattttgatgacccccgatggtcattggctgatattaagttaaattcactggaagagttaaccataaaaaacattacttgatagttgctctgcgctgccattttttgatttgtattttccctacacggcagcgcaaatattcatcataatgtactttatcttagctgttctaggtaaaaataaattaaatcttagtgttatatattaataaataacagatttatcttatttaccccctatcatacttgtgaaaaaccctctatactgccccgctgtatgtataaacagcaatcagcataaataatcaatataaatcgttatgacagcagaagggcatctccttttttcagttgccagcctcgtattggctcaccagctagaaattacaccagaaatagcacagggagattggcttcatatgcttcctggcgtacttctggcctcattgttacctgatattgatcatcccagttcaacgttaggtagattattccgttttatatcaattcctattgcacgactatgcgggcatcgtggatttactcacagcttactagctctgatggtaggaattattctcttccaggctgaaataccgtctggttggcccatcccaactgacttttttcatgcaatgattgtgggttatatcagccatctgattgctgatatgcttacacccgcaggcattccactcttatggccactgagaatacgtttctgtatccctattcttagaggaaaggaacgcaaaaaagcggagcgatttattgctgtgctggtggtcgtcattgccattctccttccacatcacattgatttttcgtttatccaccactattttgataaattacaaatcgataagttgcaaattgacaagttacagaacctatataagtagcggattaaatatatccttatcagttcgtgaccccatttcctcaatggggtcattctccaaaacataaataatttttgtttcttgcactttaatcactatgtgtaactctgcaaattatatcgtcaatcagcaaaaatcagacgaaaatcaaatgtaataacataaggccatataaccaattgcactagatagtaagaaatccttatatttaattccatttaattataagtaagacttttcttatgctgataccatgttttcttatctattaaatggtataacgttccgttataccctagcgcgattaaataccatacaaaaaatcatatagttagaaattttggagactagggatgaatttaccactcgtcattaatgtgctggtttttgtagcactacttataatattagcaaaagcgagctcaaataaatggagcctatccaaaaaagttgttgttgccctagtcgtgggtgttgtttttgggctggcattgaacatcatttatggtgcacacaatgtcatcgtgaaagaatcaattaaatggttcaatatcgtcggcaatggctacgtgcagttactgcaaatggtcattatgccattagtcttcgcttctattctgagtgcagtcgcacgtttacataaagcgtctgctttagggaaaatcagtttcctgacaattggaaccttgttgttcaccgctgcaatttcggctttaatcggcatcattatcgccaatgtgtttggtctgactgctgcaggattaattcaaggcacacaagaaacggcgcgcctgtctgctattgaaacaaattatatcggcaaagtttcagatctgggtgtgccacagcttatcctctcttttattcctaaaaatccatttgctgacctcactggagcaagccctacctcaattatcggtgttgtgatttttgccgcgtttctgggtatcgctgcattacaaatgcttaaagatgaccatgaacgtggtgagcgagctcttattgccattgataccctgcaagcatgggcaatgaaactcgtcaggctggttatgcgcctaacaccatacggcgttatggctctgatgactaaagtcgttgccagctccaacattcacgatatcgcacaattgggcaattttgtcgttgcttcctatattgcccttggtttgatgtttgtcgtacatggagggcttttggcacttactggcatcaacccgatcaaattcttcaaaaaagccggcccggctctgacgtttgcatttaccagccgttcaagtgctgccagtattccgttgaatgttgaaacacaaacccgccgccttggtgtaccagaatccattgccagtttttctgcctcttttggtgcgactatcggtcaaaatggctgtgccggtatttatccagctatgttagcggtaatggttgccccaaccgtcggtattgaccctttcgatcccctgtggattgcgactctcgtcggtattgtgacaatcagctctgcaggtgtcgctggtgttggtggtggtgcaacattcgcagcactgattgttttacctgctatggggctacccgtgactttagtcgcactgctgatttctattgaacctattatcgatatgggccgcacggcattaaacgtcaatggtgcaatgacagctggcacaatcactagtcaattgatgggtaaaactaacaaggaaatattagagcaagatgaagaggtaggattaagtcagtcctaatctgcatcagataaaatcccgccccctttgtatctcaataaaaccaaattttgctcaaaagagcgataaaaaagccggaattcataatgaatcccggctttatgtttactgaatatttacttcaggccataacagagcaaatcactatggcattactttatatattcaccactgcgaagggcttcaatacgcttatctaatgggggatgagataagaacaattcactgaagctcttagacttaccattaatacagaatgccatcatacgatcctcttcttgaggctcatagctggttttaagacgttgcaacgcagcaatcattttttcacgcccaaccagtttcgctgatcctgcatctgcgtgaaattcacggtaacgggagaaccgcatggtaataatgcttgccagaataccaaatacaatctccagcaccattgaaagcaccatataaacaattggattaccgttgctgctaccttcattctcattatcattactggacagaaaacttgatgccgcctgtgcgatgatacgcgagataaaaataacgaatgtgttcacaattccttgcaacaacgtcatcgttaccatgtcaccattagcgatatggctgatctcatgagcaataacagcttccgcttcgtcacgactcatattgttcagcaacccagtactgacagcaactaacgaagcgttacgacgtgcacctgtcgcaaatgcattaatatcaggagcatcgtaaatagcaacctgtggcatggtaataccaacctgatctgactgacggcgaacagtttccatcagccacaattccatttcattggaaggtttttcaatgacctgaccaccaacagaacgcaatgccatccatttcgacattaacagagaaatgaacgcaccaccaaaaccaaacaaaccagccataatcatgaggccagctacactacttcgctgaactcctgtaagtgaaagtattatcccaaataccaccatgaccgcgaggttagtgagaaggaacaaggctattcgcatcatataaatttgtttcctttaattatcaaatagttcaactaagagctaaaccataaatatggggattccgcccatattattcaatttttttaagatgttaagcgatagaatcaacataactttacagtgttacaaaaaaggccgactaccaagtcggccttttatctgtaacgaactttaaaatcacttcgtcagagttatttcggctggttgatgtgccaaatctagagcaatttgtaccgattcatctaagtagggatctggccctttgtaatctttcggtaaatcatcaagtgacttgagcggctttttaccctctcgtttaaagcgctcattaatacgattcaacttgattgattcatattccttattctctttctctctctgcgcataattcagagagtaaacgccattacgagcttttattaatttgtaataagcaatatcttgcttgatatatttaaactcaggagcattggcaatacgctggttatgcaattgagtcagtaacggcaccgacgctgaaataacctttgagaagggataagatgctggctgaatactatcccacggtaacgcattgtcctcttggctttcgcctatatcagcaggctcttccgctgttggcataaggatatcaggagttacacctttaagctgagtactgccaccattcacccgataaaatttctgaacagtatattgcactgaaccaatctctggccagtcaggttttaacatctgatcataaatacgatttagagaacggtgattctgaacggtgcctttaccaaaagtaggatcgccaacaattaagcctcggccgtaatcttgcataacagcagcaaaaatttcagatgctgaagcactcctgccatcaactaaaacgactagaggacctttataatatattgcttcatcagtatccgagtcttgttttattctaccggtattatcccggatttgaacaatcggaccagtagaaataaacaaaccagacagcgatacagcttcagttaacgctccaccaccattggatcgtaaatcaatgacaattgaggaaacgccctgtttggtcaatttttgcagctgtattttcacgtcgttagtcaggccaacatagaaactcggtatatcaaggacgccaattttttcttttcctaccgttttcactgacatcttaactgcattatcttcaaggcgaatattctcacgagttaacgtgacgatatgatttttagcccctttcgtgctgggtatgatttcaaggcgaactttacttcctttcggcccttttatcagagtcacaacatcttccagacgccatccgacaacatctacgattggcttcccggcttgcccgaccccaataattttgtccccatctttcagtaaattgctcttcgctgcggggcctcccccaaccagtgaacgaatagcgatatattcatcatcatattgtaagacagcgccaattccttcaagagaaaggctcatttctgaattgaattgctctgtattgctaggtgaaagatagctagtatgagggtctatttcacgcgcaaaagccatcatgataatttgaaaaacgtcctcactcttactttgattaagacgttttagatgagttcgataacgtttggtaagtatttccttgatttctttatcatctttaccagacagtttgagatttatccaatcagatttaatcttggcatcccagagtttatttaattcctcaacgctggtcgaccacggagccttagtacgttcggtttcaaacgtatcattgccatctaaattaacaggctgttccaagcgagaaagaacatattgatagcgttcgaaacggcgcttctgcatcaagttaaacagagcataaggcagccttaaatcaccattttcaagcgctttacctaaaagccctctctgttcagcaaactgtgcaatatctgatgcaagaaaaacattatggccataatctaatgcgttcaggtagcgatcaaagactttccctgaaaaagcaacatccagataaaaatggcggtagtgagaacgcaaaaagcgagaaacaatccgcttactcacggttgaatgttgttgttccggttttaaatctggcaattgactgagggtaataacaggtgcattgttcccattaatggtactgctaccgatgacattagcagtatttgcataccctataccagaaaatgatagacctaaaacgaaagccaaattaatgagtttgttcatgcccaagttggcctccgtatcagaactttaagtgttctgcgcgtacaatcattgccagaccagtaggtaattgcactcttacaccatcttttgcaatttcgagcacagaagcatccattaaacttttacctacatttactttgattgtctgcccgactttcaaagaggatacgtctgtgactgaggttaactcaggttgtgaaattcttggttgtgcaatttttcttgtaacgttatctgctggtttacgtgactgttgcagacgattttgcgaacgaggtgaacgtttttcaccatcacctgatgcttgacgacgaggtgccatctttttattcacaggatgttcgctttttttgtcagatgcgttttcggtttcacgtttcttggcacgttgttcagcccgttgagcctgtactcgcgctttcgcttctgccagttgctgacgcgcatgttcaatgtgctccacttccagctcaccacacgcattaccatcaaggtcaacacgctgggcaccttctttaacaccataaaggtagcgccaactggatgtatacaagcgcaaagcagaacgaagctgtgttttacttaaacattcttcaccctgaatacgttcaacgatatcctgaaagatcccgatctttaaaggacgtgcttcaccttctgctgcgaaacagagcggaaagcgctccgccaagaaagcaatgacttctttactactattcaacttaggttcagtttccatgaaatttcctgattacaacggttttgccaaccagcgcaggcatgaacaggcgacattataatagccttactgataaatgccacgttatacgtatgttaagttacgttctgttgtagatattttggcacgacgcattgccccaaatgcttacaaagcctgataacaagcgctttcaagccatgttcatcattttcatcaaaccgttcaaaaacagtgctgtcgatatccaatacgccaataatttgcccattaatttccaaaggaaggacaatttcagcgttactggcggcatcacaagctatatgaccgggaaaagcatgtacatcagaaatacgctgaatgctattttttgccacagcagttccacataccccttttcctataggaatacgaacacaagcgatcttaccttgaaatggccctaaaactagagtattaccatccaccaaataaaagccgatccaattaacatcatccaaacgatcacttaacaatgcacttgtattggcaagagaagcgattaaatcatattcacctgacaatagagccatcaagctatctgatagctcctgataaaatttatgcttatccatacgcccctattataacgaccaaattaaataacgttattaagacaaaatattaacatcaaagttactgccctgctatctataaactattttgaacaatagtctgtcatcatggcagacatccttctagaataccgtttgtatccctgaattagaattttctttaattatttttaccaatattcacttataaaattcaggtaaatatcacaacttatattaaaaactcgcctgatttgcagtcagatccgtgtccttgttcatattattataataaaacaccttatcaatatactgaaggttgtttgatttctattcacttaatatatatcaggagaaaaaacaatttattgaaaaaagtaaaatttccggcgccatatggtaaaaaaacaaaaaaaggccgagtatactcctctactcggcctatggaaaatggctctatcaaagagccttgcgctaaaaactaccattgagacgtagaacaacctaccacttaaagcgtagttgacatgcagtgatttaccaagttttgtctctcacagactgtgactaggttgcgcttcacactagcagtgtcaacttatagttattttttgtcgcgtgtattgtcacataaagctaatgccgctttttggaatggttcaatactcattttttgattggaatgctcaggatcatctaaaaggatcttatttaacgatgtagcaatgattttattggattccataagctgtgttgcacgatcattcaacgggtactgcattaatgtactggggttaatcacaaatagcgccccatccgagcggcaatcaagcataacttcttcacgggtaaaggcccattgtttcccaaactgcaatttgctgacagtttgtattggtgcggcaatgctctgaaaagagaaaaacaaaaaagctaaaacccaatatactcgtttcattatcattcctctgatagacatatgcgcctgattctaccgatcactttagtgtttatatagccaaatcaacatttatcactcaggaatcatacgggggattccgttgcaaagatggctatacataacagtacggatgttgccagaataatctccaaccagctattcatgatcaaccattcatagctccctttctgatttaacctgggtaccagaatataacgattgatcagcgccagaagcaccatgccagcaaccaaggcaattttcaaccacagcattgattgatactcagaaatggtggtactgaaaactggccagtctgggattaaaatgatgctgctcacaatacccgtgatgatcaccataaaaacggcaaaatgcccgtaattcgaaaatttccgcattgcagctacgctttcaccagatagcttgtctactatataactgctatatgtaccatcacgatataagttagaattcaatgtattcttcagccttaagaattgcaaacacagcaaaaaaggccacaaaccaccaaaccaataaccagcactcagtaaatgaacaatctggttagcctgaagtaacaacccgatattcccctcatgcattgcagcatgaccaatgaaagcatgacttgacagcaaaataacagagcagcccaacaataagaaatttctagttttagtatgaaaaaagaacaaacacgcaacagcaagtgctgcaaccaacagctgccatttccacacttgaccaaaggtcgttcccagcacggccagccaaatatcgaactgataaacatcatgccaaccatcccccattaatcctgcctgtatgataaaccagactattgaggttattaaggccagcacagtgctgattgaaactccgactcttaaccgttctctcatcagtaccgaaaagcggcctgaagcaagcatggcagtaaacaagctaaggccaaacatcagcatgactaccacaaaatgaaagaaacggcagagtacgtataacgcctcaagcgaaatcattattttacggtaaagttataagcgccttttgttttatggccatcgacagagagcacgctccagtcgacgctatattctcctgctgcaagtttatcttcaactggcagaattaatttggtcttagtgtcagaatcaagttctagcttacccgttttgacggttttcttttctgggccaatcagttttactttactgaacccaagctcaatacgctctgaaaagctcaaagttatagcttgtggagcggcttcaactgttgtgttttctgctggcgtctggtctttcaaatgcgcatgagccaaagcctgttggcaagacattccgacaaatagaaccaccagagcagataatttagcccagaatgaacggatactaagaatggacataatagataaccctttaatatacaggtgaattttcatacctaaatagggattctatatcaaaaaactggtttaatctgcgataatctgcggccaaagtcatggcctgtgaaccactacgcaaaaatgaggacaaaaatgaaaagaaccgtaattcctgccacaaaaacaaacgaaaaagcggaaattacggtaaaaaagccagatgagcttattttgcttacctattaggcatgtgctggtacagacaaccctttcagatctttatccagcaagaacagtgatttgccactttcacctaccatacctaatttatccagaatggatttgaacagtttttcttcttcatgttgttcagcaacataccactgtaggaagttaaaagtagagtaatcctgtgtcatcatcgctacatgagccagcttgttgatctcttctgtgatcagtttttcatgctcataggtctgattgaatacatcagagatggagttaaattcaactggaggagcctgaacagcaccgagaacaggcattgctcccgtgtcacctaaataatcaaacaggcgctgcatgtgctgcatttcttcctgtgaatgagctctcagaaatgccgccgcgccttcatatcctttgtcactgcaccatgcactcatttgcaaatataggttggcagaataaaactccagatttaattgctcatttaatttcttgaccatttcttgttttaacatcaacccatactcctagtaacttattaaagttcgcatattatgcctattaaaaatcaacaaaacaaaaataaaataaaaatatttaatcaattgataattaagcatttatttaaaataaataataagaataaatctcattaaatataaaaaataagaatcacttttatttaactaaatatctaattaaaaaaataaacagctaataaaaatgataattgatattattaatgtttagctggttatttttaccacaattaaacaacttgctaaataaagaggactcgattaattttatcccgtaaaaatgaatgttattttttagagaggatatgatggttcataacttagccaagttatctaaagatgaaatggataaggtcaatgttgatttagcggcatcaggagttgcatttaaagaacgctataacatgcctgtcattcctgacacggttgaacaatctcaaccacagcacctgcgagaatatttccagcagagattaaatcattaccgccagcaatcaaggtatttttcacgcttaccttatgaacccagaagccgttagggatgggacgaagaagataaccacccacttaagtgggtggttatctcagctattttccagcaaacttatcagtcgccttgatcaactggtgtaaaatgcctgcttcgtcaaaggaatgaccagcaccttctacaatatgcaactccgcttccggccatgcttttgccagatcccatgcgttctgtaactggcacaccatatcataacgtccatgaataatcgccgcaggaacatgcctgataagatcaatatggtccaataactgctgtgtattatccataaaaccgttattgacgaagtagtgattttcaatacgagcaagtgccagggcaaatttatcttctgagaatgaatttgcattttcagaaggcaataatgttacagtttcaccttcccaaaggctccataaacgggcagcttccaactgtacttctggatcatcactcgtcaagcgcttacggtaagcatccattacatcttcgcgttcttcctcagaaaggatagatatcatgcgttcccatttatctgggaaaaaccgggaagcaccgtcctgataataccaatgcaattcttgggtacgaagtaaaaaaataccccttaacaccagctctgatacacggctcggatgtttctgagcataagccagagacaaagttgtcccccatgaaccgccaaaaaccagccagctatcaacccccatcaaattacgcagacgctcaatatcatcaatcaagtgccatgtggtattattttcaagactggcatggggtttggagcgcccacaaccacgttgatcaaacaacatgacatgatagcactcagggtcaaataactgtcgatgataatttgcgatccctccaccagggcctccatgaatgaataccgcaggtttaccttttggattgccgcacagttcccagtaaacctgatgtccatctccggtatccagatatcccgtttggtacgcgtcataagccggatagagttttcgtagttccaccataaagacctctcactggttaaataaaacgagatacactcccagtatcccgaatacatttaaagttatcatgacaagctatttactttacctcactataattgattgtatctttttgacaatcaattgtgacattgtaacttttgtctctttgggagccacgaacaataagcggaacctgtaacgcatttctatcgccagtcatatcattgacatttacccatgcaatgggttttgaagttcctaattgtttcctgtctttatcccagtgatgaatacgattttgtaagaaatcttgcttgacctgtgctgctatttggtctttggttaagtttttgcaagaaacaaacttcgccacgtgatcattttcagcggctgacgcagtagtcaatgaaacggaaagcagaatgcctgttcccaataacccaatacgatgaataaattggtttgccttcatattacctcctattaccacccaaataatatggattaaatgttggggtaaactaacatgtaatagaaagtaattatgtgagttttgttaaaaatgcgttgcggttatttttcgtcatcctcaaataaaacatggatctgctccttgccctgatgtttctccctcaactcttgagcaacaatagcaatagcttccccactgctcataccttctgaaatgaactgatggatcctttctactgcaacttgctgttcttcatgggataatgccggcatacctgaaaacatgaccataacctcaaatatacgttcacaattaatgacaagcgggattatatacccaataggttttaatagacgcttttatctcaagtcaagggtgagattctgtgataatctccactagttaataagttattttttcgaattacccaacgccaacactggttacatcatgaagattgcattacaaaaacgactgttaccttattctcctgatcttgccacccgatattttgcccctctctcagtatcaccttgggcaatgttgttacattctggaacggctgaacacccccataaccgatttgatattttagttgccgaaccagtaacaacgcttatcacacggggagaatcaacagaaataaactgtaatggtgaagtttctctctctcaggaagatccattcttgttgttgaagaagcatctgcatattcgcaatattgctctgcaattcgatcctgattatccttttcaggggggtgcattaggtttatggggatacgatcttggccgcaagattgaaaaattaccctctattgctgccaatgaactggattttccggatatggccgttgggatttacgactgggctctgatcatcgatcatcaccgacagaaagcaacattactgggttatcacaatctcgataatcgtctggcatggctagaatcgcagcaaaaaaaccgggaaacaaatttctccctgagcagtcaatggcaatccaatatgactgcgcagcaatatcacgaaaaaattgcccagattcatcgctatctgcgtgatggagactgctatcaagtcaatctgtcgcagcgctttcatgccagctatcaaggtgatgagtggcaggccttcacccaactcaatgatagtaatcgcgctcccttttctgcttttatccgtttgcctgaaaactgcattatcagcgtttcgcctgaacgttttttattactggaagataagcaaatccaaacgcgcccaattaagggaacattgccacgattgcaagatccggaagaagattatttacaagccaaaaaattggccaactcccgcaaagatcgcgctgaaaatctgatgattgttgacttattgagaaatgacatcggacgggtagcaacaccaggctctgtcaaggttcctgaattgtttgtcgttgagccctttcccgctgtataccatctggttagtaccattacagcaacattacctgatgaatatcaggccaccgatttactccgagcttgttttccaggtggttcaatcactggcgcacccaaaattcgtgctatggaaatcattgaagagttggaacctcatcgtcggcatggatattgcggtgctattggctatattagtttctgcggtacaatggacagcaatatcaccatacgtaccttactgacagaaaagggaaaaatttactgttgggcaggtggtggtatcgtcgcagatagcattgctgaaaaagagtatcaggaaacatttgataaactggggcgcatcttacctcaattaggggaactccatataccatgacatcgctttctgacttcattcatcggtttcaattgcaacttcctgcgcagccagcagatttggcgaacaaccagcgaaatgctgctgtattgctgccgattatctgtaagccagagccaacacttttattgacccagcgcgctaaaaacctgcgttcacatgccggccagatcgcttttcctggtggagccgccgatcccgaagatcattctctgattgccaccgctttgcgtgaagcagaagaagaagtcagcattccacatcacaaagtacaagtattggggcagctagcccccttagacagcagtgggggctatcgtgttactcccgttgtcgggttagtctctccctctctttcttttcggacaaatccaacagaagtggcaagaatttttgaaattccactttttgatgctctctctcttccccactaccaacatttagatataaaaagccgcaagcgacagcaccgagtctatttttattggtatcgtgaacaaatgatttggggattaactgcggctattatttatcggctggcacaacaagttcaaagatcggtctaacaataatcgcaaagcatcaccaaaatgtgcgtttcttagccacattcatatcaattgctattataattaaaaaaaaactgtaaactcctttatcaacgctactaaataacagtaaagtagcgcgctttaatataaataactatatctctttcttcttaaaggagtctggcgtgattagcgttttcgacatgtttaaggtgggtattggcccatccagctctcatactgttggtcctatgaaagcaggaaaacaatttgtcgatgatcttgtaaaccaaggagtaatgtcctctatcacgcgtgtagctgttgatgtttacggctcactttcattaactgggaaaggtcaccatacggatatcgccatcatcatggggctggcaggtaacatgcccgcgactgttgatattgattcaattcctggttttattcgtgatgttgagcaaactcaacgtttgccgctggcaaatggtttacatgaagtcgattttcctcgtgacggaggtatgaacttccgcaacgataatctgtcactacatgaaaacggtatgcaggttcatgcattcgcaggtgacgaaaaaatttacagcaaaacttactactccatcggtggtgggtttattgttgatgaagaacatttcggcaaaccctctcaagataccaaaccggtttcttatccattcagctctgctgctgacctgctgatgaactgcagcaaaacaggtctgtctgtttctggcttgatgatgaaaaacgagctggatttgcatagtagagaagaaattggcgaatactttgccgatgtatggaataccatgcaagcctgtattgaccgtggtctgaacacggaaggcctattgccaggcccactgcgagtgcctcgccgtgccgcagctctgcaccgtatgctgacatcatcaaataatttctccaatgacccaatgaacgtggttgatttgatcaatatgtttgcattggcggtcaatgaagaaaacgcggcaggtggccgagttgtcacagcgccaaccaatggtgcatgtgggatcgtgccagcggtactggcttattacaaccactgcatcgagccagttacgccaaatctttatatccgctatttccttgcctctggtgcaatcggcatcctgtataagatgaacgcgtctatttctggtgcagaagtaggctgtcagggcgaagttggggttgcctgttcaatggcagcggcaggtcttgctgaattattgggtgcgagccctgagcaagtttgcattgcggcagaaattggcatggagcataacctcggtctgacttgtgacccggttgctgggcaggtgcaggttccatgtatcgaacgtaatgcgattgcttcagtcaaagccatcaatgcatctcgcatggcacttcgccgtaccagcgaaccccgtgtttcgctagataaagtcattgaaactatgtacgaaacaggtaaagacatgaacgcgaaataccgtgaaacatcacgcggtggtttggcgattaaagttcagtgtgactaatcacagatgccgttcatcaacaccctgatgagcggtatttgttatccattattagtatatacgccttatctagaaaaatatccctgccacatggcagggatattttttggctgaaacggatcacttaagtacattattttctcttttccccctaaaacatcacattttttttatacaaacattaataaaatgttaccggaaacagtttaataaaccactaaaatgagaaaacaaagaataaaaaatcacaataaaattaaaaccaaagcgaaaatcttgttttcgtctctcaaaacagtccatcttaatttttctgactgatagcaattttcttaaatgcttcaaatgataatctaacgatatattttcttatgtaacaaaatataaaaccataagaaatgaaatatttgagatagattctcgataggacatgatgtttgcaactatcatattaattaataggaggcgcaatacattagaaatattgagagtaagcttgcagtagacctgagttcaattgctacagaaaggggaaaaacaagtgagtatagccattatgattggcacacatggggctgcggcagagcaactgcttcataccgcagagatgttgattggagaacaggaaaacgtttcttatattgacttcgtacccggtgaaaatgccgatacattgttcgacaaatacaaccagaaactggaatcacttaatacagagcaaggtgtcttatttttcgtggatacctggggtggtagcccattcaatgcagccaaccgtatcgtggttgacaaaagcaactacgaaattatcactggcgtaaacgtccccatgctggttgaagccttcatgtgccgtgacgatgatccatcaatggaagagctggtttctgtggcactggaaacaggaagagaaggtatccgcgcccttaaaacagaacaagctgaagaaacccaaaaacctgaaccagtcaaacccacagcaccaaccattgctcccgcttcatcacctaccgtttctggtggcgggcacatgaaaattgcccttgcgcgcatcgatgaccgccttattcatggtcaagttgcaactcgctggacaaaagaaaccaatgttaaacgcatcattgtggtcagcgatgatgtggcacaagataccatccgctccactttgttgaagcaagtcgcgcctcctggcgtcagcgctcatgtgatagacgttgctaaatgcgttcgtgtttacaacaaccctaaatatgcgggtgagcgtgtcatgctgctattcacaaaccctacagatgtactgcgtattgtcgaaggcggtgtttcacttgaatctatcaatatcggtggcatggctttccgtcagggcaagactcagatcaataacgccatttcggttgatagcgctgacattgaagctttcgagaaattaaattcccgcggtatagaacttgaagctcgtaaagtttccagtgatacccgcttgaatatgattgatctacttaaaaaagcttaaaaaacaaaagacagatgctattttattcaccattactcaataacgaaattctaaccaaattccatttggttacaggagaaaaacaatggaaattaccgttgttcaacttttgttgatattcatcgttgcctgtattgcaggcatggattctattcttgatgaatttcaattccaccgtccgctggttgcctgtacattagtcggcttagtactgggtgatatgaaaaccggcatcatcatcggcggtacactcgagatgattgctcttggctggatgaatatcggtgcggcagtcgcccccgatgcagcattagcctccattatttcaaccattctggttatcgctggcggacaagacgttggtgcaggtatcgcactggctattcctctggctgcgacaggacaagtattgaccattatcgtccgtactctgaccgttggcttccagcacgcggcggacaaagccgcagaaaacggtaatctccgtgcaatcagcgcccttcacatttctgcgttaatgcttcaggcaatgcgtatcgccctgcctgcactggtcgtggcattgtcagtcggtacgtctgaagttcagagcatgctgaacgcgattccacaagttgtgaccagcggcctgaatatcgcagggggcatgatcgtcgttgtcggttacgcaatggtgatcaatatgatgcgcgctggctacttgatgcccttcttctacctcggtttcgtcacagcggcctttactgatttcaaccttgttgcattgggtgtgattggcgttgttatggctatcctgtatatccaacttagccctaaatataaccaatcacagacagccgcttctgcaggcaatacttcaaatgaccttgataacgaattagattaagaggatgaacaacatgtcagatacaacaaacataggtcagaaaaaactgacacaaagtgatatccgtggtgtttttctccgctctaatctatgtcagggttcatggaactttgaacgtatgcaggcattgggtttttgcttctcaatggtgccagtcattcgtcgcctctatcctgaaaatactgaggaacgaaaacaagccataaaacgccatctggaattcttcaacacccatccttatgtggcagcacctatccttggcgtcaccatggcgatggaagaacagcgcgccaatggtgccgatattgataacggtgccatcaacgggatcaaagtcggcttaatggggccactggctggcgtgggcgatccgattttctggggaaccgtgcgtccagtcttcgccgcccttggtgccggaattgctatgagcggtagcatgatggggccaattctatttttcttcctatttaacttagtacgattgctcacccgttaccttggcgtggcttatggctataaaaaaggcttagatatcgttaaagatatgggcggcggcttcttacaaaaaatgacggagggggcatcaattcttggcctgtttgtcatgggcgcgctagtcaataaatggactaaagtgaatattccgctggtagtttctgaagtacctgatcctaccaccggcgtaataaaagtcactaccgttcaaactatccttgaccaattaatgcctggtttgatgccgctattgctgactttcggctgcatgtggctgctgcggaaaaaagtaaacccactgtggatcatcatgggctttttcgttctagggatcgtaggcttccgttttggtttcctcggttaagtttgatttctctgcattatttgcgtatttggggaggtttttcctccccaatttctttattgtaaaaacaaatatgttataaataacccattagctatataaaaaatagggaattaaaatgagcttgaatgatatcatattaatgattttagttttattaatgctcgcttttgcgatttatgatgaatttattattaatcagttcaaaggtaaaacgctattaaatataaaactaaaaagaaaacatcggatcgatgccttaatatttatcgttctgatttctatcgtcatttataataatgttatcgtacagggcaatcagttaactacccacttactgttatttatcattttggttacaatatatttaggttatattcgttcgcctaaacttattttcaaaaaacaaggattttattacgccaaccgtttttttcaatataaaaagataaacacaatgaatctatctgaagacggtattttaatgataagttttgaaaaaaataatatatatatcgctgtaaacaaactggatgatttagagaaaatctatcaattccttgtcaacaacagataatatcattcttcattaatacacatattttaaatgaggccaataattaatattagcttcatttttcaatcaagacagataatgataagcattatcaataataacttttaatatataactaaatattttttgccttttattttaaatctggtattgtcctttccagtcattggggagtagcctgttccaaaacatttttggaaaattcgtatcaacatactcgtttgcaacaaaacgtggtacgaatgcctgaagagcctaataaaaataagctctaaatcggttggcaagaccatagacacatgacaccaccattggttgggtgtgggttatgtgtatatggaatcacccagccgaggctatgttgatgaatctctacgcaacactcattctcgcattcgcgctatccatggatgctttcgctgccgcagtaggaaaaggtgccgttcttcaccgcccacgtttccgtgaggcgatccgcacaggtattatctttggtttggttgaagcctgcacgcctttaatcggttggtttttgggattttatgccagccaatatattatggaatgggatcactggattgcattttcactgctgttcatgcttggctgtcggatggttattgaaagtttgaaaaataatgttcaaactaccgttgaatctactcctcgccgtcatagttcaacgacattagttatcactgcaattgcaactagtctcgatgctatggtgattggtgtcggtctcgctttcttacaggtcgatattttgcataccgccatgacaattggaataataaccatgattatggctacattaggaatgttaatcggacgttatattggaccgttattaggtaaacgagcagaactgattggcggcctgatattaatcatcatcgggttcaatatattattcgagcatcttaaattatttatgtatgcagcatagttatctttccggaatagatatttttccctatctattccgaattaaactatcattatcaaatacgccgataaacttttagcataaaatcagcttcacaattaaacagtttttcagtcatcaaattagttttaacctgttctgatgcccgccaggcaaaaggggtcatctgcaataaattatgagcttgctctccatccaatggcattgcataggccagcatttctgtcgaaattaattcaaatccctcccactgttccttgttttcaggatgtaaattcacttcctgataaatcaattccttcagctgatacaaatgacgtgggccaggtgtaaccgtcaaaacaatgccatgcggttttacaacacgagctaattcagtcgctttgcaaggagcataaatccgcagaattccgtcaagcgaactgtcagcaaatggcaggcggtggctggatgctacgcagaaattgacttttggatagcgtttagccccataacgaaccgctattttcgctacatccagaccatataccgtcatatcccgatggagattcaactgtgcctgtaccgcagccgtataatagccttcaccacaaccaatatccaataacgttccggcgccttctggcaaatacttgtcaagcaactgaatcgttttctgttgtaattcctgatagtagccagaatgtaaaaacgcccttctcgcctgcatcatttcaacactgtcacccggttcttttgagcgtttatgttgaactggcagcaaattaacatagtcttctttcgcacaatcaaactgatgattgttttcacagcgccattgatgatgagtgaacaataatggtgaatgacatagagggcattgataagacataacattccgatgaatagggaaatttagaggcttactataacatgttttttataggactgcgggtgatactggattgactattccaagttctaaatttattgtctttattacatttaacaaacattgtgattacaaaaataatgattatgccatttgacaacttggaaaccgaacgactgctattaagaaaattagcttatgatgacgcccctcaaattcagcaaaaattcccttattgggaggtcgtgaagtatttagacagcaatgcagttccttggccgtatccggataacggtgcagaatactttgtcaatcacattgctatgcctgaaatacaaactggaaaagtatggatatggtcaatcaggatgaaaaataaccctgataaactaattggtgtgattgggttatatgataaaccggataacaaccgaggtttctggctttctccagaatatcatggccgaggattgatgcgggaagccagcgaaagagtcactgattactggtttaatgagttggatcgaaccgtactcagaacactgaaagcctgtattaatgaaaattcgagaaaaatttcattaatacagggaatgcgtttgatcagcaccaataaaaaacaatatgtgtcaggtagatatgattctgaaatgtgggaaataaccaaagatgagtggcttaataaatattctcttccttgatataagttacccataaatatgcattacaatattatatttctgtaaaacaggaggcaatatagttttgtggataagagcatttgcagagaaaatttaacttaaaaaatcaaagccatttaactattatgaactattaccattaaattgtatggcttatgacaataatgttaacgaaaatatgatgacttaaacggtatcgcaatgcccgtaatcaaaaataatgcgatggataaaaaagtatttaatgtattgtcagttacgttgttttttgacactggtgagttttcactagaatcatccaattggtaacagccccgatcaatttgagtaataacgttttttgcctgttcaatatctgaattatgaaccagtaatttaacgccacctaacgcctgtgaatacatatagttgttccatactacgttttcatcaatcaattcagcattgatcccttctgacagcatcctgcctaatacaatacgagcatctaatggtgaaatgaaatttgccaaaaatcgcatatttcctcgatttgtaaaggtattcaacatttgtcacctcagtaattttcagtgtaaaaaaacagtacattaagtcatcgaagcctaacttcaacatctcaccaaaagtacaccactaaattgataactgaaaaattccatcaacctaaagataaaatctgttggtagtatgtactataaagtattttttggcatcgtcaaaaaattcatcgtgggcagaattgatttctacggcatcagagacgatgcaggtgagtgacaggctgatttaattacaataattgtcctataagaaaataagtaaaacttttaagggcgtaaaaagcatgacaccaaatcagtcaaaatgaatcatctaatttatattcaaccaattacgcatttatttttttaatccgcttaggtgacgagattaatattaaaaaatagatctcaagcaatttgaaaatgacaactaaaaacaccagcattataaaacctaactcgtggtttcgcataataacaacaaaaaccattaaaataaaaagaccctgaaatcagggtcttatttattaaatcatcataaaagggcgatatatggaaaagctttggatcattcccactcgatcgtcgctggtggcttaccgctgatatcataaactaccctcgatatgccactgacctcattaatgatcctgttcgacacacgacctaagaaatcatatggcaggtgtgcccaatgagcggtcataaaatcgatggtttcaaccgcacgcagggaaacgacccagtcgtatttacggccatcacccattacgccgacagagcgtactggcaggaatacggtgaatgcctgactgactttattgtacagatccgctttatgcagttcttcaataaaaatagcatctgcacggcgcagcaggtcacaatactctttcttcacttcacctaatacacgcacaccaagacctgggcctgggaatggatggcggtacagcatgtcatatggcagacccagttccagaccaatacggcgaacttcatctttaaacagctctttcagcggttcaaccagacccagtttcatatcgtccggcagaccacccacattgtggtgagattttataacgtgagcattgcctgtcgcagaagcagcggattcaataacatctggataaatcgtgccttgtgccagccatttaacctgagtttgttttgatgcttcttcatcaaatacatcaataaagacatgaccgatggttttacgcttggcttctggctcatcaatgcccgtcaatgcagacaagaagcgctcttctgccttaacatgaacgaggttcaggtcgaatttaccctcaaacatcgccataacctgatcggcttcattcagacgcaacaggccgttgtctacgaaaacacaggtcaggcgtttgccaatggcgcggttcagcagcaatgcggttacggaagaatccacgccaccagacagtgccagaataacgtgatcatcaccaatctgcgtacgtaggcgttctacaatatcgtcgatgatggaagcagatgtccataatgcttcacattgacaaatatccagtacaaaacgttgcaaaatattcaaaccctgatgagtatgagtaacctctgggtggaattgcacgccataaaaacgtttttcatcattgaccataatggcaaacgggcaggtatccgtgctggcaacggtgatgaaaccttctggaacaacagtgactttatcaccatgactcatccatacatccagcaaaggcttaccggattcactcagggcatcctgaataccacggaataattcacagtcacttttgatttcaacttgagcataaccaaattcgcgctcagtggaattacccaccttgccgcccagttgcgtggacatggtttgcataccatagcaaattcccagtaccggcacgcctgcatcaaagacatattccggcgcactcgggctattattctctgttgtactttccggtccacccgaaaggatgataccactcgggttaaattcacggatttgctcttccgtgacattccatgtccaaagttcacaataaacaccaatttcacgaatacggcgggcaattagctgggtatattgcgaaccaaaatcaaggatcagaatgcgatgctggtggatattagttgtcatttgaggtgaattccaaaaacaagtggcaagaaaaataaagaagtcagtggcccgatagcgggccaccctaaataaattacaaacctaaacgatagtttggtgattctttggtgatggtcacgtcatgtacgtgactttcctgaatgcccgcaccactgatacgaacgaattctgctttagttctcagttcgtcaatagtggcacaacctgttaaccccatgcaggaacgcaagccacccatttgctggtgaacgatgcttttcaacaggcctttgtaagccacacggccttcgatgccttctggcaccagtttgtcagccgcgttatcggtctggaaataacggtcagaagagcctttggacatcgcgcccagtgatcccataccacggtaggatttgaaagaacgtccctgatagagttcaatttcccctggggattcgtctgtaccagccagcattgaacccaccatgacgcatgatgcgcccgctgcaatcgctttagcgatgtcaccagagaagcggattccaccgtcagcaatcacaggaatgccagtaccttccagtgcatccacagcatcagcaatcgccgtgatttgagggacaccaacaccagtaacgatacgggtagtacagatagaaccagggccaataccaactttcactgcgttaacgccagcttcaaacagtgccttagcaccttcgccagtcgctacgttaccaccaatgatttgcaaatcaggatatttagcacgagtttcacgaatacgctgcaaaacaccttcagaatggccgtgggatgagtcaataagcaggatatccactcccgcagccaccagcgcatcaacacgttcttcattgccagcgcccgcaccgaccgcagcaccaacccgcagacgaccttcttcatctttacaggcgtttggcttacgttctgctttctggaaatctttcacagtgatcatgccaagcaagtggaagctatcatcaacgaccagtgctttctcaacacgcttttcgtgcattttctgcaacacaacttcgcgcgcttcaccttcttttacgatgactagacgctctttcggcgtcattaccgcagtcactggctgatccagatcagtaacgaaacgtacatcacggccagtaatgatacctaccagttcgttctcttctgtcacgacaggataacccgcgaaaccattacgtttagtcagttcgtgtacttcgcgcaatgtagtttgtggcgttacagtaacaggattagtcacgacaccactttcgtgctttttcacgcgactgacttcttctgcctgacgctcaatgggcatattcttgtgaatgaagccgatgcccccttcctgggccagtgcaattgccagagcagattccgtcacagtatccatggccgctgagagcataggaacgttcagacgaatagtggaagttaattgagtggacagatctgccgtattaggcaggactgtagaatgggcaggaaccaacaaaacgtcatcaaaagttaatgcttcttttttaattcgcaacatgggcaatatctcaccaagctatgggcaataaggcataaaatattgccgcggcattatacaggccgtaatcgattgcctccagcattttttaaaaaaatttcttgattcgtactctgggatgattagtatcagttaattaacctcttgctttgaaatttgatctggctcacatgtcactaccaaccaacaccggaattttttctgttagtcgtctgaatcagactgtccgtcagctattagagctggaaatgggtagaatttggctaagtgctgaaatttctaacttttcccagccttcatcagggcattggtacttcactttaaaagatgagcgggcgcaaattcgtgctgctatgtttcgcagcagtaatctgcgggcaacatttcgtccacaaaatggtcagcaggtgttggtgcgtgcacagattacgctatatgaaccacggggtgactatcaactgattgtggaaagtatccaagctgctggagatggactgctacagcaacaatttgaggtgctgaaacagaaacttacctcagaagggttatttgattcgatccataaaaaaccactgccctcaccagcaaaacgcctcggtgtcattacctccgccagtggcgctgcgctgcatgatattctcaatatcctgaaacgccgcgatccatcactgccaattatcatttatcccactgcggttcagggagctgaagcgccgttacaaattattcgggcgattgagctggcaaatgatcggcaggagtgtgatgttttaattgtcggccgtggcggtggatcactggaagatttgtggtgtttcaatgatgagcaggtagcacgggcgatcttccagagccgtattcctatcgttagcgcagttgggcatgaaaccgatgtcacaattgcagattttatagccgatctgcgcgcacctacgccttctgcggccgctgaactagtcagtcgcaatcaaattgagttgttgaggcaagttcaatctctgcaacaacgactcgaaatggcgatggattacttttttgcccaaaaactgcgtatttttaatacgttgcagcatcagctccagcaacagcgccccgatttacgtctggctcgtcaacagaacaaattagtggaattacgtcaaaagttggtcgatagcttcttgcgttgtttgaagcaacattccctttcacatgagaagctaaatctgcgactcttacaaactaatcctgatcagcaaattcggcatgatagccaacagatccaacaatatgattttcggttgaaacaagcgattgaacgtcaattaggacattatcgggagaaatttgcggtttcctgctcgcagctcaatgccgtcagcccgctggcaacgctgcaacgcggttacagtatcagtgaaacatccgatggcacgttactgaaggaaactaagcaagtgaaagttggggataccctaaacacccgattacaggatggctgggttaaaagtcaggtgattcaagtaaaaagacagaccaagagagaaaaatcacaatagatacaaaaaatagaaatagcggtgatttcttaccgctatttaaattctattagaagcgaacttctgcacccattatgtaggttctgccacgggcggtttgggttctggcattctgttcatccatcatcggtgaagaattcatgcgatttaatgcatcagagtaattcttattcattaaattttgtatggaaaacttaataaatagatttttattaacctgataatcactatacaaatcaatgatagttggaattttatcatcttttttcattaagatagtaccatcatcatccagtgtagcatcaggatgttgacgatacgattctccagtatatttcacaatagccccaatactgagtttttcatctaataatctaactcccgtatccagcgtaatataacgttctggcaattgagaagccgggctatccccaaaataagttgcccccattgaagttggttgctgtgttttttgctgactatatgccagtgagctatagaatatacctgcatcataatgagcctcaatctcataaccgcgcatatttacccgcgttaggctattactataaataactgctgtcacattggtgttaatagcagcaaactcttcacctgtcagtgtcccatccattttacacatcctcttttcaatacaaagcacatactgatcactggtgatgtaatttttaattttagtttggaacagtgtcgctttcaggcgaaatgtatctccatcgacaattaaatttgggcgataactattgaaaccaatttgataggtatccgctttttctcctttcaagaaagggttcatagaattgccaccgtcattagaatgaaaaatttcttgagcattcggtgctcgcattgagtgcgtataactgacaaatggctgaaattcaggaataatttctgccgataacaaaataccaggattaaaccctcgctcttttagatttaattgtgtttccccttgaggaaaacaatttactcgttcttcacaggctggttttatccctttaacactgtaatccatataattcagtgccaaatctgccgtataaataccgtgttcgattttaaggcgactgtagatgctggcaatatcttgttttccacttggcgcaaacccattattttctattgcttccccagccacttttttatcttctatttcagtactgatttttttacgatatccagtattcatccatttactacccagtgtaaatgcaaagtcagtatcagcataattgaaacggctggtattactaatatcaatagcattggattggtttttagattcaccttcacccaatacgcccatcgacctgttttcaaagtcctgctggcttttgcttgagctaagcagcaatttggtatcaaccaattcactaaatggtgtgtaatgatatttcagataataatctgaactgtcgatatgacgttgattaaatttattatgataaaaacgcccacttaattccaaatcatgaaattcattgggtttaatatttaatttcatcaattgagaatttggtttttgtttaaatgtatcacgtgtaccaaattcatcgctgctgactcccatcgcgtttttataatgggcatcaatgctgtgtccactaaccgcaagcatagcgccaatagaaccatcaggactaaatgcctgcgtttttcccgcaaaagccatcatgccacttttgccgatgccattatttccatacgtccatttagtacgcacacctagattgttgccatcaaatattacatcaccaacaccaagagtacgaaaattagcacttcctaccagagcattgacagaagcagaatcgtcagattgcccacgagcaacatcaacacgaacaataaaattaggatcaattaatgcaccagtctggttataaggctgctgcccatgtgagaattcactcggagcagtaccataaaaactctggctgacaccatccaccatcatattgacgcggccaaaaccacttaagccacggatattgacgctgaccgcactttggctcacatccatctgagtataagtccccggcaagctacgcaatacgctgtccatagattccagtttattatcttcaccgacagaactataagcgccgggtttttccattgcctgagtctgtggggaattattatcttgagcacctgaaactttcaggctactaaagcgcataactttttcttttttattgtcactcgcattttcagcataagctatcccctgaagcccaataagtattacactggctcccgctatttttgccacaatcttcattaacatcacatcctaaataaaataatactgattaatactcacattgcttcgcaaatttggcgataaaatacccatgacactgataacaaattatcagcgccttgggttataaatatattttttattagtcttttagttgtggaaaataaactttggcatcatccaacattaaaaggaaactataatcaaaggcaatatcattcaagcgattaaaacgccctggttttccaccatgcccagtatccatattcgtttccagtaataagagactatccccttgctttatttcccttaatttggccatccattttgcaggttcccaatattgcacttgagaatcatgcaaacccgtcgtaaccaataaatgaggataacgctgatgtttgacattatcataagggctataagacttaatgcggaagtaatcctctttgttatttggattgccccactcttcatattcgccggtcgtcaatggaatggatggatcaagcattgtagtcacagcatccacaaaagggacttttgcaatcacaccacgatatagctccggagcctgattgatcaccgttcccatcaataaaccgcctgcgctgccaccttcggcatatacgcgctggctgtcaccatacccatcagcaagcaatgttttggttgcatcaataaaatcatgaaaactgttcattttgttttcgactttaccttgcagataccagttcttacccaattcaccaccaccacgcacatgcaccaaggcatacacaaagccgcgatccagcaaactcagcagcggagagctgaaataagggtccatactgataccataagaaccataaccgtaaatcaagattggattttctcctttcttaaataatgacttacggtataccagagaaaccggcacttctacgccatcccgggcttttacccaaatacgctggctttcatagttctctttgtcgaaccctttgacttcctgctgtttcagcaattcacgttcacccgtttgcatattccactggaataccgaactcggtgtagtcatggacgaataactatagtgcagtaaatcagtatcgggttccgggttatagtctaacgataccatatatgcaggttcatcaaacttaacgcgtttttcctgctgggttttccaatcaatctgacgaattgttgacaatcctttggtacgctcttgcactaccaaccagttgttgaacagcgcaaaattttccagatcagtctcttcctggggcgcaattaccgtctcccacagtttattaatagcgcctgcttggtataagccaaacaatggatgttcatggttggaacggatatagaattgtccacggaaatgatcgagatcatattcacgcccagcctgacgagcagagaaaatctgagtttctgattgaggattattggcatcaatcagccgatattccgaggtcgtactgctggcaatagagatcaaaatatagtcaagcgaggtactttctgatattcccagataaaaacggtcatcatcttcctgatagatttttttatcctgttggatatcagtgccatattgatgacggaataattgataaggcaacagagtctgtggatctctacgcacataaaacagcgtattaccatcatttgcccacacaatattgccagatgtgttttcaatgacactgttctgccattcaccatcacctaaatttttaaatgaaacctgataattgcggcgaccttgagtatcttctgccacagctatacgcttgttgtcccgcgtaaccgcaaacccactgactcgatagaacttatggccttttgcccgttcattaccatcaaccatcacctgccagtcggttgaattatcgacaggtttacgctgatagatcgggaaatctttccctgcctcataaacagtacgataaacatacccattataggtataaggagctgactggtcttctttactcattctgccagccatttcgttatacagtgtttcccgtaattcctggcctgatttcagcatctgctcggtatacttattctcagccgtcaagtaatcaataacgtctttatcctgacgagtgtcatcgcgcagccagtaataattgtcaacacgggtatcatcgtgaaacgtcatcttatgtggctgttttgtagccataggtggcaccatatttttctccattgcaatagtggcaaaactgttacacagcaaactaccacccagtagaaagctgcgtactacccttgttgtttgaggtgaaaataccgttttatgctgtaacatgccattaatcctgtatttttactgagataaataaaaatcaatcggcagttcaactgtcaccctgccattgattaaaataacatcagggggtaaaggtaagggttgcgatctttccaacacgagccttgcttccctgtcgagtgagttcgtccccgaacgttttattaattcactatcaatcacagtaccaaactgattaaccgtgaattttaccatcggtcgccctgttcggtttcttctctgggcatccggcggatatttcttatagcgatttaaatgcccgctgacctcagcctgccagaccgctctggcatcagcaatggcatcggaattactttcataagatgcggctgtacgagaggttatattatctgccgttgcattactggttgtcggtgcagcgctactgcgagacttttcactttcctgtttttctgccttcacacgcttaacaggctgtgtttttttaggtgcatcctgttctttctgttttttcttcggcttatgcaccaaaatattggcattttcattcacatccaattttggcatgttgatttcatcaaccttactttcctgttgctggctggcaacagacaattgctgttcaattccaataggttgattctgtatcttgtgtatcgcttctgtctgcaatgacaattccaccataaccgcaggcggaggcaggaactcctcaatatcaatatccttgggtgtataaataaaccagcccaccagcaaagcatggagagtgatcgcagcgagaaaggattttgtcacgtgaccaacgtgagtggtttgatacgtggtatacgtcaacatttcttatagcacataatatcaatgataaattaagagaatgataatcaattagatatataaatgaaaactatttttatttattagtgtcatcacatccttgtgatatttacaactattgggttatagctttagttactttgggggtaaaccagacaaaatcagcatattctctgttcagagaaaccccttgttctgcgataacgaatacagcaacctgctcatttggcgctatttttttcacatgctgagggactcccatcgcttttaccgcgtggtatccgcccgcaaatagcaaagcaggtgatggcgcgttaaccaactgctcagccatccgccgatcacgcatttgttgaatcatcgtcatggcagaaaggtgttttgcctctatgtccgcaccgtgagaatttttaatcgtttcttcgattaattttttaacgtcatcagaaacccatgccgttttatccgtaggggaatgatttttatatgcctgatcgatctccgagcgatccaaattcgccgccagcaacggataaggtgctttcaccagctccgtaaccagctccccatacaattcccacggccagccttgttgccacgccaataattgcttaattctttcctctctgacaatcggattgctctgcaaccagcttttgactttattcactttttcctgctggtttgggttaatcatttccagcaatacggaaccgtgggggcgtttctgcccaagctgctgaaccagccataactcgatctgatggtggtagggattatcatgcttttcacccacaatgactctagggtaagcagccagttgctcaagcagttcagcggaggtgatcgctttgcccgttttcatatcaagcaacatgccggattgcactaattcactggaaagggtttgaagcgctctttgagatccattttgaggatcgtgctgtggtgttacacagccgccaaacaggaaggcacacgctaaaaaagtcgattttatacaggtagatgctttcataggtattcattatcaaaatataaattttccgcatattatagataatgagaattatttacaaataaaactaccctgttaagcctatgcttggcagggtagctgatttcttcatcccgacctgattactgctatcgggacgggttataaagatgacttacagtggattggtctgtgcttcaacggcagccaacgcaaccatgttcacgatacgacggacagaagcaatcggcgtcaagatatgcactggcttcgacacgcccatcaatactgggccaactgttacaccatcggagctggtgacacgcagcaggttatagctgatacgcgcagcttccatatttggcataatcaacaaattagctgcacctttcagtgggctgtccggcataatgtcacgacgaatgttttccaccagtgccgcatctccgtgcatttcgccgtcgatttcaagtgacggagccgctttctgcaccagttctagcaccttacgcattttttgtgcggaaacacaatcagaagaaccaaaactcgaacgtgataacaaagcaactttaggttcaataccaaaacggcgcacagtttcggcagccatcaatgtaatttcagccagttcctctggagtaggatcttcattgacataagtatctgcaataaaagtattccccatcggcaacattaaggcattcatcgcacctgcggtatgtaccccctgacggaagccaaagaaatctttcactacttgataatgttcgctgtagctgccgacagtgccacaaatcaagccgtctgcttcaccacgatgtaccatgattgcaccgatcagtgtcggattaccaataaccgtacggcgggcctgctcctgagaaataccacggcgtttcatcagttggtaatattcctgccaatactctttaaaacgtggatcattttcgttattcacgacttcaaaatctttaccgacttcaatgtgcagaccttgcttcttaatacgcatttcaatgacgcttgggcgaccaatcaatactgggaatgccaatccaagggaaaccaattcctgcgtggcatgcagtacacgaatatcttccccttctgccaatacaatacgctttttctcttttttcgcctgagagaaaatcggcttcataaacaggttggttttatagacaaactcgttgagtttctcaatataagccccgaaatcagcgataggccgcgttgcgacaccggaatccatcgcagctttcgccacggcaggcgcgattttgacaatcaggcgtggatcaaatggcttcggaataatgtattcagagccaaagaacaaatcttggtcgccataggctgaagccacttcttggctttgttcggccagtgccagatccgcaattgcgtgaacacaggcgagtttcatctcttcattaatcgttgtcgccccgacatcaagtgcgccacggaagatgaatgggaagcagagcacgttgttaacttggttaggaaaatcagaacggcctgtacagataatggcatcagggcgcaccgcttttgccagtggtggcaggatttccggttctggattcgctaacgccatgatgagcggatctttcgccatcgtcttcaccatctctggtgtcaggacacccggcccagaacagccaagaaaaatatcggcatcagggatcacatccatcaacgtacgacacccattatcttcgatagcataatcggctttggtcttttccatattctcttcgcgaccacgatagataacacccttcgagtcacagacggtaatattttcacgcttcagacccagagccaccagcaagttcatacaggcaatagatgctgcacccgcaccagataccaccaagcgtactttgccgatatctttattgacaatgcgcaatccatttaataccgcagccgtacagataatcgccgtgccgtgctgatcatcatggaatacaggaattttcatccgctcacggagtttctgctcaatatagaaacattccggtgctttgatatcttcaaggttaatgccaccaaaagtcggctccaatgcagcaatgatatcaatcaatttatcaggattggactcatcaacttcaagatcaaaaacatcaatgccagagaatttcttaaatagaacgcctttaccttccataacgggtttgccggctaatgcaccgatattccccaagcccaaaacagcagtaccgttggagataaccgcgacaagattgccgcgtgcagtatatttataagccgccagtggatcttttgctatctcaaggcaaggcgcagcaacgcctggcgaatatgccaatgccaaatcacgctgtgttgttaatggcttggtcggggtaacggtgattttccctggttgcggaaattcatgaaaatcaagagcactttgttttaatttctcgtccatcatctgatcctttgcgagtcatatcgaagtgaaaacccgcccagtatagtagttacagaaggttaaatcatgatgtcagcgacattttgttaagaacccttgggaatcaagaataaaaaacagacaaaatatgatcttatgttaaccaatactagataaatattattcttataatactcataaggaggtattttatcttcaattaattaataacccgctaaattaattaaagaagcattctaaaaacaacttttaaaataagcttacaaaaacgaaatttaatctataaaatcatcatgcgtattttatttagaaaattattagcaattaaggaaacgcattttcttatggcagtgaattttatttcgcctgaatggataaacctgtttgcgatatttttatttttatatcaggatatattttcagaatctcattatctatgattcaatatactctataaaaattacacagcaatttaacataaagcagagtcctgtcttttatgttttattaaatataaaaatctgcatttctatatgggagaaggaacatgcataatcattcagtcatgatagtcgatgatcatcctatcattcgtcacggtttaaaaaggttgattgaattggaacgtgaactcattgtgactgctgaaacagacaatggtgaagatgctattaatatagcctgccagataaaacctgacattattctgatggatttaaaaatccatggcctttccggaattgatacgattaaatctctccgccgaaaagggcttgattcctatgttttggtactctcagattcagataatcgcggtgatatttatgatgcaattgatgccggtgcaaatggttatttattaaaagatattgaactggctcctctgatgagtaacataaaaaaagccgcaaatggcgatgcagtatacagtgaaaaagtctatcaatatttatccacccgtcatcttcatattgatcctttatcaaaattaaccaaacgtgaattggatgtcctaaaagaaatctcagaaggaatgacaaataaagaaatcgctgactttctttttatttcagaagaaactgtgaaagttcatacccgtaacttattgaaaaaacttaaatcccgctcccgtctagaagccaccatcatctatctaaggcatagaaaaccagagttaatctgacatctggttgatcaatgtcctcaatatgcaacacaatttccctgagtctgccaacggggaaattgtgagttaacgagattgtcaattaattaccaaccaattagtttcatatataattaataacagatgttatttgtataatttattacttcacgtgattaactaatgtcaacaggcaaaataacttgatcaagtttaattaaatttgaacataaggagagtagattgttatccatcctaaagaaatgacgtagatggcgcacatgaaagatgccgtgttatctggataaaatgccaaatttcccgcattatgtcggatgtgtaaaaccagactaaggatctcatcatgtcagataccacttctcacaaagcattcactctctacggtatcaaaaactgcgataccatgaaaaaagcgcgtcgctggctagaagaccaagagatcccctatcagtttcatgactatcgcgttgatggtctatcctctgagttgctacagttatttattgaacaagcgggctgggaacccctgttgaatactcgcggtacaacttggcgcaaattgtctgatgatcaaaagtcagctattaataatacagaagctgccaaaaaattgatgctggaacaaccttcaatcataaaacgcccgctattggtgtcagaaacagggaattatttactcggctttaacgccgaacaatatcaacagtttttctttcatgactagataaaggccaaataatgacttgtccagtaattgaacttacccagcagctaatcaaacatccttctgtcagccctgatgaccaaggatgtcaggatatactcattcaacgtctgcaaaatactggctttacaatagaacgaatgcctttcggggatactctgaatttctgggcttaccacggaacaggcacaacgtttgccctcgcaggacacactgacgtggttcctgccggtgatacttcaaaatggcaaacccctcctttcgatcccgttattcgtgatggcatgctgtatggccgtggtgcagcggatatgaaaggttctctggcggccatggttgttgctgctgaacgttttgttaaagctaatcctgaccatccaggccgcctcgctttcctgattacttcagatgaagaagccagcgcgacaaatggcacagtcaaggtggtcgaaactttaatatcacgccatgaacgcctggattactgtctggtaggagaaccttccagccagcaacgtctgggtgacataattaaaaatgggcgtcggggttccctgacagccagtttgactatccacggtattcaaggacatgttgcctatccacagctggcagataaccctattcaccgttcactgccttttctacaagaactgatcaatagccaatgggacaatggcaatgaatttttccccgcaaccagtatgcagatcgccaatattcaagcgggaactggcagcaataacgtcataccgggtaaattgtgggttcaatttaatttccgtttcagtactgagttgacagataccgagatccgccagcgggttgaagagatgctgaaaaaacataatctgaaatatgacattgactggtggctatccggccagcctttcttgacctgcaaaggtgaacttgtcgatgccgtggttgaatccattgaacagtgttgcggatataagccagagatatcaacgagtggcggcacatcggatgggcgttttattgccaaaatgggagcgcaggttgtggaattagggcctatcaacgccactatccataaagttaatgaaggtatcagcgtgtcagatttacagaaattgagcctgatttaccaacgtatcatggagcaattaatcaaatgatgacgcctgaaatgttgacaggtctgtcaacagatcacttggtgacattagcgggtaatcaccgtttacagttcaatgccactaaagcgtttcttgctatgcaaagagatgcagccaaggcaggttttaaattacagcccgccagttcatttcgtgatttcgcgcgccagcaaactatctggaatgaaaaatttcggggacaacgtccggtattggatgacaatagccagcccctcgatattacaaaaatgaccgaaggagagatttgtgaagctatcctccgctggtctgctctgcccggcgccagccgtcatcactggggtactgaactggatatttatgacccattccttctgccacaaggtaagaaattgttactggaaccatgggaatatgaaaacggcggctattttgaaccactatcagactggctgactgaaaatatgtctgtttacgatttttatcgcccattcaaccgacataacagtggtgtagcatatgaaccgtggcatatcagtttttggccgctgtctcatgaagcagaaaatttgttcaatgagcaagtgctgctaaatgtctggcaggatcacaatattgctggtattgattggttatcagccaacctctcctctctttttgaaaagtatgtcaagatagctgagccggattaagcgtaatcccagtaggcactaatttcataatattcccaggagagcatgatgcactggttgatggattattggtgggttattctgctactactcgtcggtattattgttaatgcaataaaagagttgagccgcgtcgatacgaagcgctttttagataacaaaccagaattaccccctcaccgagattttaatgataaatgggatgatgaggacgattgttcccagaaacaccgcaagaaatagtccaatttttccactgattggcaagtatctcatcaatgcttgccaatgctcctgcagtttcttcccgacaacgtttcaacaacgccttacgtccgctcagggataaatcgcgtgcgcactgttcaatatctatctgttgttgaagatattttctcaatgctggcaaagccagatcatgtgccaataataaccgctgtaacgcaaaataagacgcagacaggggacgatgagcgaatgcaaaacccgccagttcctgccagtcgctatcactgagctggttatcaccatgatgataaataggtaaggaaaaaccgatcagtaattccagccagtatgcatcacgacataattgctgttgcgcggactcagccagccatttgcccttctcactcagtggcaaaatagccatcgcggtatagcaaccactgctcgcttcaagatgggtccccatccgcaccaatcgaaagccacatgtttgccagagtgaccaaagttcagcggtataaccaaaactgacagaaagaaaatcctgcttttgtgcacgggcttcttgacactgttgagtaactaagcgctgtgcaatgccacggcggcgatattgtgcctgcacagcaatacgactgacacgctgtgaacgcatcgtcgcagcctgtggaaagccaccatgtgctgccaaagactgagccaccagattcccccttggacggcgacgccctgcccacacttcatgcgccaatgtctgtggcaactcgccttcacttaccatccataacgcaccgatcaattgttgattattcacagcggaacgagatatagcggccagaaaagtcattccgttaccatccagcaaacggcgcaaatcaagaggggatgtgcggtaatgagcactggtcaacaatccataaaactgacgcagtaattcaggttgtcgcaaccacattgcctgagtgatgggataaaagtgcaaatttttctcaggctcggaataaaccaatggctcatccggcaacgatttttcgttaaataaccgtttgtcgtcgaataacagtgagctatctaaccatgtttccagtggatcattttcagcccaacgcatcggtgtttccaattctctaacatggcaatcaggcaatgtggcacacaacttcagcaaaaatccacgtccggttccttcatagccctgcaccgttgtcgttaataacactcgtggaaaatatcggattaattcggctaattgcggggttgggatcgccgcagcttcgtcaatcagaagccaatcagcatcaatatcgtgaccttctcgattgtttttcaatcgacaatatttcaataaattgtctactgcccagaatggggttttatcaacaggagaatcctgctcaggatcggaagtcccggaataatgtcgaataacttctgtcgtgatttttgcaggtgcacagagccaacacttcccctgccattgctgtatgagcattccggccagggcagattttccgcgtcctcggggcgcagtgaccacccaaaccccctgtgaagcccgtagtaattgttcaagaatagcctgctggctggcagtaggattaccatcaggcatctgccacggtacggtttgtgataattgcactggctgaaagggttttccctgttgccataacaggatattgggaagctcaaggatttgctgttgaatatgttggataaaatgaggcgtagagatcacgccagccgactcgttccaacgcgaactgtcttcatctggctgtgctggccattgtgaccaagttggtacacgcatcaccagccagcttccggcttttagcgtaccagccagaatcgccagcgcttcggcattaaaaccacgggttacatcaaaaaccccatgcataaattcgcgcccaagcaaactaaacgcttttgctggctcaatcgcatcctcgtctccagatgcgacggttacccaatccccctgaaactgttttttcagatgaataacaatctgctcgctccactggacatcaccacttaaaaccaccaagcggcgctgcccttgctgctgcatttgttcctgcaactttttccagatcgaatctaacacggtcatggtttaccaatcatgatagataaaatacccgctgcaatcagcgggccgacgggaacgcccttgaacaacgctacacccaatacagtaccgaccaataaccccgccactgtagaaggctgactcgacatcaaggcaacacctcggcttcccagccacgatacgataataccgacagcgatagcgagcagtgatttccagttcaaaaatgaactgaatatgtcctgcgcagaaatttttccacttgctataggtgccataactccgatggtgagaatcaggatacctatcgtcaaaccatatttttccacccaagggaaaaattgattcagtggtgtaatgcggactatcagcaaaaacaacatagcaagcgttactgtcatgttatggctgataatgccaaggcctgccagcactaacaaaataagtaaagtagggtcaatatagttcatgaatttttgttccctgcaaaaaaattttactgatggtttttacaccgaccaatacacatctaatacatagcagaataataacttaaaatttaatatcttaatcatattatttgcattcaataagatattgctaattaatggccacattagtagaaaaaacagtctgtaagaaaaaatacataagattcccccttccctattatttaacaataactttaatttatagttacatttatttatttgattatgaaaaaattaatattctcaatcatattcaatatgttattaactgactatacctctcaatgagtgcctgcaatgaatgaaaattatactttggataatcaatcagccaattgactatcctaaccgccttccaacttatctaatatttatcatttaaatcatattattatgaatatttgttgttttttgcatcataattattattaataattgttgataataacattaaataatttattggtaatggaaatattataatgagatgtgtatgaaacaaagtggttggaaaaaacaaataaaacacttgtcttaatatgctcacattaataaaaaatcatgttttgatagtcaatcaatctattagccattctggttcctttttatatttatcaaaatttttctcatcaaagctacccccactattttgattaagggctatctctaattattagtttaaataatcatttaatacattaatccaaatcaccattttgtaacggtaataggatccctctcctgaatatccaatagtttcagaaagtgctttaagataaccctttcccatttacccgatgtttacagtcctgatcatagaattgctggcatttggaattattggtttacataataacggttatcaataataataattagtgataatcaaattaattcacttactaagtgtctgaaatatcatagattgtgacgatttatttgttggttcagcatcaagctacattaaccatacgacacaaacatacattaagacttttaacagggaaaatgcagaaaggttgtaaggaaagccttacaaacgggatgcattcgtatgaaagatatgaaaaaaacactcttctcaatcatgttcagtgtggcattaactggttgcaccactcaatgggtgccggtaggaagtcactataccccttttaatgaagcgaacgcagagtgcaatatagaagcactccagcagttccctgtgagaaacgaagttgcccaacggtcttcaatcaaaaccgtaaaacattactgtcctgcctgttgtaaatctgacaaagctgataaatctgacaaagactgttatttcgatcagagtgtccctacgaccgaaagttatgttatggatgttaacgaacgctccagacatcaattatatagcagctgtatggaacgaaatggttgggaagaacagacaaaatatctgttttaatgtgctgtaatagataagaattatggtctgggtagtcaatcaagctattggctatcctgaatattccctattaccacacctctttttcacatttatcaaataaatatccccgtcatcacgatcaaagatacccccactattttagtgtaggatatctctgattataggcttaagtaatcgtttgcgtcgttagtccaaaataaccccgattcggcgtgctacttcttcatacgcttcaatcaagccaccaagactctggcgaaaacggtctttatccattttatccaaagtctgctgatcccacaggcgactaccgtccggagaaaactcatcccccaatacgacgttgccgttgaacaaaccaaactctaatttgaaatccaccagaatcaaaccagcatcattgaacagtttactcaatacttcgttggctttgtaactcagtcgtttcatctcggccagatgcaccttgctaacccagccgaatgtttcacagtaagactcattgaccatcggatcatgcttggcatcatttttcaaaaacagatcaaacagggggggattcaataccattccttcttccacaccaaggcgcttcacaagagaacccgcagcacggttgcggataacacactcaaccggcaccatatccagttttttcaccaggcattcgttatctgacagcagccgttccatttgcgtcggaatacccgcctcttccagtttgttcataatgaaatggttgaatttattattcaccatacccttgcgatcaaactgttcgatgcgttcaccatccaaggctgatgtatcattacggaattccagcacaagcaggtcagggttgtcagtggaatacactgtttttgcctttccacgatacaactcagcttttttctgcatcttacactccagagatgtgacatctttaaacaaaaaaattaaacgaaaaaatttcacccaaaatataaaggggcctaggcccctttatgtattacttgtctgtagttctgctgaatgctgccttaaatacagccatcatttgatcattttcagcctgagtcagcggctggcctttctctttgataaattgcaggctgcttcggttatccaagtcgcccacctgtaacttgtaatttccttcgctgatggaaggagcctcgacgcccagttctttccagcctgaagaactcagctctttataagtcacctctatcattcccgtcgcacgcgtacgatcagtgacacgcatgcctatactttccaacgtatgcggtaatcggttccagaccacagtgtatggcgcacggacaatgatttgtggcaaagctgtattatcgctgccactgtttactactaacgcccctgtattcttcgtgctgttcaaacttgctaactcctgctgctgatttaaaccatcagacagctcgttaagcatgattaaatcataatcttggattattgccggatcagagacgactttcccatcatgttccaaactttcatttgtaacagacagagcaatttgagaaccctgcggagacacttcaatacggtagcgtccacgataaggaatattttcatctgcccgcgaccatgagatccaatcagtgaccagagtttgcttggtatcatctttttcgctaatctggtaattcttcttcgccaatagactaaccacttgtgaccacagattgctgtgttctggcgtattttcaatcaacaacttaccggttcgcacattatttcccatgtgggaacccgccaataactgcatcgcctgtactggcggacgaatatcaagggatttacccaccgcccctttttcggtcgctgatgaaatagtatattcactattttgcggcggcaatatcattcctgctggaacgttcaatgctttcagcggtggcgtctcaagataggactcatccccactcacctgacgtttatagtgctgatctttggaacaggctgccagcaaaacgactaatgacaggccagcaaccttcatgaccttcgatttttgcaataatgttgccattaaaattccctaatttttacagtaatccagccaatttcaaggcattattaaccgaaacttgtcctgcctgcgtcaacggaatcattggcaggcgcagcgtgtcatcggcaatcaatcccagtttacgacaggcccacttggctggcgtcgggctaggttcaacaaataattgatgatgcaattccatcagtcggttgttcaggctacgcgccttcacaaattcacccttctgagccagttcgtatatttgtgccatctccgcagccgctacattcgccgtcacagaaataaccccttttccaccaagctgcacaaaatcaagaaaacttgcatcatcaccactcagcaaaatgaaattttcatcattaaccaattcttggatctgactgacacgacttaagttcccagtcgcttccttaatcgcaacaatattttccagttttgccagacgggcaacagtcgatggcagtaaatcacatgcggtccgagagggtacattatacagaatttgtggtaagtcagtattgtcagctatcgctttataatgctgatataaaccttcctgtgatggtctattataataaggtgtcacagacaggcaaccagcaatacccgtattttcaaaacgacgagtcagcgaaatggcttctgccgtcgcatttgcccctgttccggcaatcaccggaatgcggccatcagccaattccagtgttgtcagtacgacatccacatgttcatcttggctgagtgttgcacattcacccgttgtcccaacagaaacaattgaagatgtaccactggcgatatgataatcaattaattttttcaaactggttttatcaatctgaccgtctgaattcattggcgttaccattgcaaccatactgcccgtaaaaccagagttaccactcaccattgccatttccccttaactaaaccttaaactgcggatgagaagttcatggtactttcttgtcatacagaagaaaactctttaagcgcacgatttcaatgaattttgttaatattaagtgtagtcgattaaacagagattataatcgcacttcccttcacaatacgattgaccttctcctgatcattttttatgtttaatgacgacacacacagcaaacatctaccgtagaaaggaaaatcgctttgcccaaatcagaacagtattttttagtgatcaccgcccttggtgcagatcgccccggcatcgtcaataccattacccgccttgccagtgtatgcggctgtaatattgaagacagccgtctggcaatgtttggcgaagagtttacctttatcatgctgctatccggtagctggaacgccattaccctgatcgaatccactctgccacagaaaggggcagaactcgaattgcttattgtgatgaaacggactcggtgcggtgtccagacaaaatttccttcgacaatttccgtcagagtggatgtggatgattcaccgggtattgttgaacgttttaccaatctgttcacgacccagaatttcaatattgctgaactggcatcaaaaacccatcccgctgaggaaaatatgcccgcccgtctgcaaatctacattacaggccataacccactggatgataatggcctcatattcaaagaatccttttatcgcctatgtacagaattaaatgcacaaggcagtattagcgtactggatcatttaaataaaaacgattaaacggagaatacgtgatgagccgattgaaagccggtgataaagccccaaaattcagtcttcctgaccaagatggcgaaaccgttagcgtatctgacttcaaaggtcagcgtgttttagtttatttttatcccaaagcgatgacgccaggctgcactgttcaggcttgtggcttgcgtgacaagatgaatgaactgaaagaaattggtgttgaagtgttgggtatcagtacagatacacctgaaaggttatctcgttttgcagaaaaagagaggctgaatttcacacttctttctgacgttgaccatcaagttgccgagcaatttggtgtttggggagaaaaacagtttatgggaaaaacctatgatggccttcaccgcatcagtttcttagttgacccaaaaggtgatattgaacacgtttttgataaattcaaaaccagtaaccatcaccaaatcgtactggactacctgaaacaacattcatcataatccggcatcgaccaatccccctgtttgacagggggaatttcgttatctacgttgacgtcgtgcctgaaatgtcagtgcaattattattctgatcctacgattttttcttcagaccaaacacgaataatagccttgatcaaagttgccagtggaatggcgaaaaagacgccccataacccccagaatccgccaaaaataatgacagaaagaatgatcacgagtgggtgtaagttcaccgcctctgagaacaagataggtacaaggagattaccatccagcccctgcacaaccagataggcaataaacagtgtccagaaatcagtaccaagcccccattgaaacagtgccacaataatgacaggaattgtgacaatcaccgtgccgatataagggatgagtacagacaaaccaacaaataccgcaagcagcagagaataacgtaatccaaagaaagcaaacaccgcataagtacaaatagtcagaataaccatctccgtgacttttccacgaatatagttgacgatctgttgattcatttcatgccatagtttacccgctaaaccgtgattacgtggcaacacactctgtaatgctgcaaccatctggcttttatctttcagcaggaaaaacaccatcaaaggaactaggatcagataaatcgcgagcgtcagtaaaccaatcacggacgccactgaaatctttaaaaaagactcaccggccagaggaagcttagtacgcagattatcggcaatcatttcaatgataccggcatcgaccaaagcaggataacgggaggttaaagtgtgtgcatattcattaaagcgattgaacatattgggtaagtcagaaaacagatttaatccctgttgccagacagtgggagcaacgatcaggataaccagcgcacttatccccataaaaattgtcaatacaatggtcactgaaagagttcggctacaacccagtttttccagttttactgtaggccattccagtagataagccagcacaattgcggcaagaacaggagccaggatgccattgaaaaaataaatgacgccaaacccaaccaacaaaattaccgatagtgcagcaacctgcggatctgcgaaacggcgatgataccatcgcatgatcatatccagcataaatacaactcctcgacagcgaacactcaattatgatttttactaaatttattacgatggactggttttaagttatgatttgctatcatacacacattcataatttaataactaactgggacacattgtttttacgagaatcattttatgataaaaacacccaagaaatccctgatagtgacattgattagcctattactatttggaaattcacccgctttatctgtaagttccgaaaattcactacccgatatcggaacaagtgcgggggcgactctcagtatcaaccaagaaatagaaatgggggatttttttatacgtcagatacgtgctggagcgccgctaattgatgaccccctgcttaatcaatacattaataaattaggccataaattagttaatcatgccgattcagtaaaaacgccttttcaattttatctgatcaataaccccgctattaacgcgtacgctgttttcggtggtaacgtagtgctacattccggtttattccgctatagccgcaatgagagtgagttggcttctgtcatggctcatgaaatctcccatgtaacacaacgccacttggctcgttttatggaagatacgcagcgcaaagcgccattcgcatgggcaggaatattaggatccatactgttgatgatggccaatccacaagcaggaatggcgacactcagcggcacactgggtggttttcagcaaggtattatcagctttacccagtcaaatgaacaggaagctgatcgcattggtatgcagattctcaacaactcaggttttaaccctcatggtatgcctgatttcatgcagattctggttgatcagacgcgatatagctctaaaccgccagaaatgttattaacccatccactacccgatagccgtttatccgatgctcgtaacagggcaaatcagtatccgaaaaaaaccattccagaatcagaatctcaagattttctgtttgcccgtgttcgcatcctgacaatcagcgctacagatcagctcaattacattgaacaaattctgaataattacagtcagggaaccgctaaagaacagctcgccgcttcttatggacgggttctccttctgtctcaggctcaaaagtatgctgaagccaaaacagtattgtctccattactggataagcagcctgataacatctggtttatcgatgctatgacggatatcgatattgagcaaaaacagtatgagcaagcgattacccgtttacagtatgctctccagaaacatcaaaataacccggtactacaaatcaatcttgccaatgcctatattcaagccaaacactatccgcaagcatcacaactgctatttcgctataccttcaacaatcctaatgatcccactggctggtcactaatgacagaattagccaaaaaacagggaaaacgtgataaagagctggtttcctacgctgagactatggcattgcaaggcaaatttgacatggctataaactatctcagccaagccagttctttggtaacattaaatagtgatgatcaggctcgttatgatgcccgtattgatcaattgcgccaattgcaacaacgttatagccaatatgacaaatgaggactttttacatgccacaggttattttttatcataaccctcgctgctcaaagagccgtgaaacactcaagctggttgaagatctcggtattgcaccagaaatcattcactatctcgacaccccaccaacggtagagcagcttaccgttttactgaagcaactgggttttaaagatgcccgtcagttaatgcgaaccaaagaagaactttataaggatctcaatcttggtgatgacacattatcccaagcggcattactccaagcaatggcaaaacaccctatattgatagagcgtccgattgttgttgtcggtgataaagctcgtctaggtcgcccaccagaacaagttaaggagattcttggctaacacctcactttccagaaaaatcatacaaacaaaaaagtgatagggacatattcactatcacttttttcctgtttccttcctggctggttcgctcagagatcaagaatatctttcacaaatggtattgtcagcttgcgctgcgccacaatagaagcacggtcaagctcatctaacgttctaaacagtgtttgcatttccctatcgagtcgtttcaacacaaaacgccctacatcttcgggtaattcaaatccccgtaatttcgcccgcaattgcaatgcctgaatcttttcatcatcagacagtggctgcaatttgtaaatctgcccccaatccagacgagaagccagatccggcaatgtcagattaatttgccgtggaggacgatccccggtgatcaataagcaggtgcggccaatctctacaatccggttataaagattgaagatagccatttcccattcttgatcgcctgcaatacattcaatattatcaatgcacactaatgataaatgttccattccatcaaggacttcaggaacaaaataggcacgtttatccagtggtacatatcccaccgcctctccctgttgggataattcggcacaagatgcatgaagcaaatggctcttgcccccgccatcgcgggaccaaaaatagatataactgccgtgtgactgactaatggccagttttattgcagctaataaggaagtattctcacctgcaaagaaactggcaaatatttcatcatcgggcaaatataggggcaaggaaagctgcgacggtgtattcagaagcacctcaaacagaatggataacgaacagcgctaagtctaccacagaaagtgactataaatgaaataaatgcgctgttcaaaacaggcattgattgttaacgtctacctttcatggaaaggtagacgttaacaatacagtagataacaaggtgttgtttttctgattggaattagaattgacatccagattagtatcaaagcctatttttccatcacaaagccgtctttatcaattacccatcaaatggctggctcaggataaagactactgacatattttattattattcaaataattagagcattactatctggagggtgctactgccacacaagacattcaaaaacattgatagattaataaaaccaagtgtcgtcgtatgatattctttattaataattaacgccctgattttaatagttataattagagataatctaaactaaaaagaatcaataaatagaaattaacgttgattaaaatttatttaggagattgacgtatcaattaaaatcactctatataatcttcctgatctctcaatcgaaaattaaaggaaaaaaccaagatatagagtgaattagtaaaaatagcgttagggaaaatatattaaacagtagactttcatcatgagtcaaaaagagaagggcttgctctttaaaacccttccttatgaattgaattgatcttacttattctacagcttcacgttttttatcattgtcaatcgattccacagaagaagtaatataaggctcctctgggcggataacactgatcaatttgaaaatcaggctcaaaccaatacctactacagttgccagtgccatacctttcaattctgctgtaccaatctggatcttcgccccactgacaccaataatcaaaataatggaggtcaggatcaggttctgtgccttgctataatcgactttagaatcaatcaatacccgaatacctgatgcgccaatgacaccatacagcaacaaggaaacaccgcccataaccgggacaggaatgacctgaattgccgcagccagtttgccaacacaagaaagcagaatggccagtatcgctgctccaccaatcacccacgaactgtacactcgggtaatcgccataacaccaatgttttcaccgtaagttgtattgggagtcgaaccaaaaaaacccgaaatcatggttgaaaaaccattcgcaaacatcgaacggtgcagaccgggatctttcaataaatccttctgcacaatattagccgtgacgaccagatgaccaacatgttccgcaatcacgaccagcgccgcgggcaaaatagtcataatggcaaaccattcaaaacgcggtgtatagaacgtaggtaatgcaaaccacggtgcctcaagtacaggtgtaaaatccactactcccataaaaaacgccagcgcatagcctgctaaaacaccaatcaggattggaataatcgccataaagccacggaacatcaccgaacccaaaattgtcacggctaacgtcaccatcgatatggtcaggttagccgtattgacttcagctccaatggctgggcgcaaacccgccatatctgctgcaacccctgccaattccagaccaatgacagcaacaattgcccccattgccgctggcggaaatatcacattgatccaaccccgtcctgctattttgacaatcaacgaaaccaaacaaaacaacagtccacaaacaataaacccacccagagccagttcatatcccagaggcaacaacaaaagtaccggcgaaataaatgcaaaactggagcctaaataagccggaattttccctttacagataaatagatacagcaatgttccaataccattgaacagcagaattgtggcaggattcactttaaataagacgggaaccaaaacagttgcgccaaacatggcaaataagtgctgtaaactcaagggaatggtctgtatcagtgatggcctttcatctaccccaatagtacggcgggtcattatttatatcctctatgttaccttgctggaagccaaaaaaaaccgacttttcagtcggctaaatgttatttagtaccgaatatcttatcgcccgcatcccccaggccaggaacaatatatccatgctcattcagacattcgtcaattgaggcagtatatagctcgacatccgggtgggccttctccagtgcggcaaccccttctggtgcggcaaccaaaaccaataccttaatcacagggcatcctgcctttttcagcagatcaatcgtagcaatcatagaaccgccggtcgccaacatcggatcaacaaccaaagccatgcgctcactaatatcagaaaccagtttctgaaaataaggcacaggttcgaaagttttttcatcacgataaaccccgacaacactgatccgcgcacttggaatattttccaatacgccatccatcatgcccaaaccggcacgcaggataggaaccacggtaattttcttccctttaatctggtctatctctaccggaccacaccatccttcaatggtcactttttctacttctaaatcagcagttgcttcatatgtcagaagactacccacttctgaggccagttcacgaaaacgcttagtgcttatatcatgatctcgcatcaggccgagtttatgtttaactaatgggtgttgaacttcaacgatcttcatgaatttctcctactgtatatagccggcagataaaaaaatcgcgggattatacctccttttcgacaccgagccactatcaatccattgatttttatcaagcataagcatttttccttttatttttgtctggcaggaaacctgcataaagctatcgcaaacgtttgcttagactgttagaattgccgccgttctgttttattcattcaaatgcaaccgcctgggggctacgcagtgaccaacaaaacctctcttagctataaagatgctggtgtcgatattgatgctggcaataccttagtcaatcgtatcaaaggtgtcgtgaaacagacccgtcgccctgaagtgatggggggattaggcggtttcggggcgctatgtgcgctgccacagaaatatcgtgaacctatcttagtttcaggtacagatggcgttggcaccaagctgcgtttggctatggatctgaaacgccacgataccatcggagttgatttggtcgccatgtgtgtcaatgatctggttgttcagggagccgaaccacttttcttccttgattactatgcaacaggcaaactggatgttgataccgcagccagtgtcattactggtattgccgaaggttgcaaacagtctggctgtgccctggtcggtggtgaaaccgccgagatgccgggtatgtatcatggcgaagattacgatgtggcggggttttgtgtcggcgtggtcgaaaaatcagagatcattgatggcagccaagttcaagtgggtgatgcgctaattgcactggcatccagtgggccacattccaatggttattcattgatccgtaaaatccttgacgtcagccagaccaatccggaaacaacagagcttgaaggcaaatcgctggcagatcatttgctcgtcccaacccgaatttatgtcaagcctgttcttgaactgattgaacagttcgagatccacgccattgcccatctgactggtggcggcttctgggaaaatatcccccgcgttctaccggaaaatatgcaggccaaaatcaatgcctccagttggcaatggccagctatctttacgtggttgcagcaggcaggcaatgtcagcaatcacgagatgtatcgcacatttaactgtggagtaggcatgatcatcgctctgccacaatctcagacaaaacaagcggttgagtggctgaacgcgacaggtgaaaacgcttggcagattggtactattaccgaatttgacaccaatactgaactgaacaccaacgagcaacaagttatcatcagcgaatgaaaaccatgaaaaaaattgtcgttttggtttccggcaatggcagcaatcttcaatccattatagacgccagccagcaaaaccggattaatgggcatatctgtgcggtattcagtaataacgccaatgcctatggcctgcaacgtgcagaacaagcgggtatccccgcccattttctcaatccacaagcgttcccggatcgcactgcttatgattgcgccctgctcacagccattgatcaatatcagccagatttagtagttttagcgggctacatgagaatactatcgcctgattttgtgcagcactactgtggacgtatgctcaatatacatccttctctgctgcccaaataccccggtctgcatactcaccgcaaagccattgaaaatggcgatcaagaacatggcacttccgtccattttgttaccgaagagcttgatggcggccccgttattttacaggccaaagtaccgatttttgaggaagatcaggaagaggatgttatcaggagagttcaggctcaagagcatgatatctatccgctggtgattggctggttcttagatgggcgcctgagcatgagcgataatatagcaatactggatggcaaaacactgccacagcagggttacgcctcagaataatctataccgaatggatttcgagttgcagtgcggcggcaagggaacgaatccccaggagcatagctaactatgtgaccggggtgagtgagcatagccaacaaaacggcaacttgaaagacgaagggtatatattgctagaccgtaaacttacagcattgtgttaagacgaaacgtgttaaggtaagacgcgttaagatgatactttgctgtaagtcgtcatttcagattaaattctttatacacccagcaaatcggttatttattcatctaacaaaatattaatctggcaataattatgtatctggtaataattaattatccgaacattatttaccgtgaatcatagttagcgtgggccaaatttaaaccagcacttatttttaaaaagcactgaggtatccaatgtccagtggttctgaaaatccacctgtaaatttacgtcctcttgagcgggaagatctccctttcgctcaccaaatcgataacaacgccagtgtcatgcgttattggtttgaagaaccctatgaagcttttgtcgagctatgtgatctctatgacaaacatatccatgaccaaagcgaacgccgttttatcattgagagcatgaacgccaaagtcggattagtggaattggtcgaaattgattatattcaccgacgcgcagaattccagattattattacaccagcctatcaggggcaaggctatgcaaccaaagcggctaaacttgcgatggaatacgcattttgtgtattaaatctctataaactttatttaattgttgataaagagaatgaaaaagcgattcatatatacaacaaattagggttccataccgaaggcgaattaatcgatgaattttttgtaaacggctcttatcatactgccattcggatgtgtactttccagcaccactattttgccaataaagcccgtgaatcccagaccagctcgctggcccattaaactaaatggagtagtaatgtcccacgaccgcctctataacgaaaaagaactcagttggctctctttcaatgaacgtgtacttcaggaagcggctgacaaaagcaatccacttattgaaagaatgaggtttttagggatctactccaataatctggatgagttttataaagttcgctttgccgatgtaaaacggcgcattcttatcagtgaagagcgagggtctgccaccagcggccgccaattattgaaaaaaattcaggccaaagtcgtaaaaatcgatcaagagttcgatgaactctataacgatttactgctggaaatggcccgtaatcagattttcctgattaatgagcgacaaatatcccccaatcagcaaatttggttgcggcaatatttccgccagcatttacgcccacacattacacctatcgtcatcaatccagaaaccaatctggttgagtttttgaaagatgattacacctatttggccgttgaaattattcgtgggcaagagacgaaatatgccttgctggaaattccctcagacaaagtaccccgtttcgtcaatttgcctccagaaatgccacgcagacgcaaatcgatgatcttgcttgataatattctgcgctatacgttggacgaaattttcaaaggttttttcgattacgatacgctgaatgtttattcgatgaaaatgacccgtgattccgaatatgatctggcaacagagatggaatccagtctgttggaactgatgtcttcaaccctgaaacagcggttgaccgccgaacctgtccggtttgtttatcagcgtgatatgcctgatgaaatggtagatctactgcgcagtaaactggggctatccaatgatgactctgtgattgccggtggccgctatcacaatttcaaagacttcatcaaatttcccaatgaagggaaccgaaatctgctgaacaaaacgatgccacggctacgccatacttggtttgagcattttcgtaacggttttgatgccatccgtgagcaggatgttctgctctattatccttatcacaccttcgagcatgtgctggaattgctgcgtcaggcatcgttcgaccccagcgtgttgtctatcaagatcaatatttatcgcgtggcaaaagattcacgcattattgattcagtgatccatgccgcccacaacggcaaaaaagtgactgtggtggttgaattacaagcccgttttgatgaagaagccaatatccactgggcgaagcgactgactgaggcgggtgtacacgttattttctccgcaccaggcctgaaaattcacgccaagttatttgttatctcacgtcttgaaggggatgaaattgtccgttatgcccatattggaaccggaaatttcaatgaaaaaacggctcgttcatacactgattattccttgctgactgccaagccggaagtcaccaacgaagttcgccgtgtatttaactttattgaaaatccttatcgcccagtcacatttgagaatctgatggtatcaccgcaaaattcgcgcgctatgctcaatcaactgattactcaggaaattgaaaatgccaaagcaggggaagcggcgggcatcactctgaaaatcaacaatcttgtggacaaggaattggtggatcgcttgtatgatgcctcagaagcgggagtcaaagtgcgtcttctgatacggggaatgtgctctctagtgccaaatcaagcgggcttcagtgaaaatatacaagtcaccagcattgtggatcgctttcttgaacacgatcgagtttatgttttcactaacaaaggggatgagaaggttttcctttcttcggctgactggatgacccgcaatatcgattatcgtattgaggtcgcagtttgtctgctcgatcctcaattaaaacagcgggttttggatattctggaattacagttcagtgatacagttaaagctcgctatatcgataaagagttaagcaatcgctatgttccacgcggaaataagcgtaaaattcgcgcacaaattgccgtctatgattacttgaagacattggaacaaccggagccaagagcctgatctatgccgttgaaacacgacaaaccaacgcccaaacccatggaaattgccaccattgatctgggctctaatagctttcacatggtgatcgcccgtattgtgaatggcgcactacaggtgatcgggcgtttaaagaaacgggttcacctcgctgatggcctcaacaataaaaatgaattaagtgaagaagctatcaatcggggccttgcctgcctttctctgtttgcagaacggttgcagggtttttccgcgaataatgtctgtctcgtaggtactcacagcctgcgtgaagccaccaacacacaagagtttctaaaacgggcgaaagaagtcatcccctatcccattgaaatcatttccggtcatgaagaagcccgcctgatcttcatgggggttgagcatactcagccggaaaaaggccgcaagctggtgatcgatatcggtggtggttctacagaactggtgattggtgaaaatttcgaaccgctgttaattgaaagccgtcgcatgggctgtgttagtttttctcgtcaattctttcctgacaacataataaacgaacaaaatttccgtagggcacggcttcaggctgcacaaaagttagaaaacctcgtttggcaattccgggtgaaaggctgggattttgccttgggagcatcaggaaccatcaaagcagtacatgaattactcgtcggactaggtgaaaaagatggtctgattacacctgagcgtctcaatatgctggtaaagcgggttctgaaatacaagaatttcaaatcactggatctgcctggtttatccgaagatcgtaaacaaacttttgtttccggcctggctatcctgtgtggtgtgttcgatgtcctgcatattcaagaactgcgcttatctgacggggcactgcgtgaaggcgtactttacgagatggaagatcgtttccgtcatcaggatattcgccaaagaaccgccaaaagccttgctgaccattataatattgatagagaacaagccgatcgcgtctggagtactgccaagacactttacggacaatgggcgacgcagaatccgaaacggctccagccacaactggaatcaattctgctttgggcggcaatgctgcatgaagtcggtttaagtatcaacctgaatgggctacaacggcattccgcctacatcctgcaacacaccgatctgccgggctttaaccaagaacagcaatcattgctggcaacattggtacgctatcatcgcaaggccattaaagtacatgagcatccccgcttttacctgttcaagaaaaaacaatatcttccgatgctccagatattacggctggcaacactgctcaacaaccagcgccaatccaccacaacacccgaatcgcttaggctggacacctctcatggtcactggacgctctacctgccacaaaactatttaacccaaaatgccctgatgcagcttgatttggaaaaagagcaggcttactggagtgatgtgattggctggtacttgcatatcaaagaggaatcgacgtaacgatatcaccctatgaagaagaaaaagaataccgttcagattacaacattaattctgctgatcagttttctgattttatttgggcgctttatctattcatccatcgcagcattggaacatcaccggcaaaagcaacaacattcgatggagcatattaggaatactaaaacaaaatagtcgtcctattatccctaaaagccatttttcagattatattatcgttagataataggatcgccctgttttttttgcactattttgcaccaaaggtacaccatgttacaatcggcctttaaatctggtaattcaactgttgccagtcaacattcccaaaagctggcagttgttcgccaacgtctgctgtctctttttattaacgataaattattcgttgatacgttattgggtcaggctgatgaacattcaacaatcagcgacgagcagttgctggagaaaattgaggaagtcagtgcgcagctgaccgatctgcacgctgccgacattgcagatattctggaggccctgccctacgatgaacgtcttgctttatggcgactcatcgataataaccagcgcggtgaggttttagtggaagcctccattccggtctgggacaatttgatcaaggatatgtctgaccttgaactattgaaagccatcggcacgctgcatgtggatgagcaggcttatattgcggaatatctaccccgtgatactacacgccgtttactgacttatctggaaccgagtcaacgcaaccgtattcgcgaagtattgcagtaccacaaagacagcatcggccagatgatggattttgaatttgtgacagtgcgaggcaacatcacactcagtacagtacaacgtttcctgcgttccagaggctccattcccgacgcaacggataaaatttttgttattgaccgcaaaaaccgccttcagggggaactcccactcacaactttgctaatcaatgccccggacaagttggttgcagaagtgatgaatacagatactgtcaccttcttaccagagcaaaagggcgaagatgccgccagtgcgttcgaacgttacgatttaatctctgctgcagtggtagataataacgggcgcctgatggggcgtctgaccgttgaggatatcattgataccttaagtgaagaaacagacaccaatatccgacgcatggggggattaagccgtgaagaagatgtgttcgcccctgttgggcagacagtaaaaacccgctgggcatggctcgccattaacttgtgcaccgcttttgttgcttcgcgggtgattggcttgtttgaacataccatttcccaactggttgcccttgcgacattaatgcccattgtcgcgggtatcggaggcaacacaggcaaccagaccattaccatgatcgtccgggcgttggcactccaccaaatccaatccggcagtttttcttatctgttattgagggagttcggtgttgctctgattaacggcgttatctggggtggaatcatgggcgttgtcacctatctactctatggcgatcttgcgatgggcggcgtgatgacaatggcaatgatattaaatctgctgatggcagctctaatgggcgtattgattccatttattatgatgaaactggggcgagatccggccattggttccagtgtgatgatcacggcaatgaccgatactggcggattctttatctttttgggattggcaacgctgtttttggtttgagctttatgggagaaacgccgatttataaatgatatcggcgttttttctcaaactattaataaaccctttcgtcccaaacactatatccagatgtccctgccatatggtgacgacaaataatgtctttatatttaatagaaacaatttcttctggctgcacttccgcatgggtaatactgtgcggatagtttggcgataattcaataattgccataacttccatattttctccaccattgactatttccctttggttacactaataatatatgtttattaaaccgatttagcataagatgctgcgtgacgggtcaccgcaacaatactgagagaatgtcgagcacatgaagaataaacgtcgtacttattttttccgatttgcggtactagccgttgtcatcgcagccgcttatttcgcgtggaactatttcaaaacgcccacaatatcagaagaaaaatcggctcaggcatcaaaatctccgcgaaatttaagacattcgccacaaccgcctgtgcaagtagcaacagccaaaatacaaactgtaccccattatttaggaggactaggtactgttcaggcggccaataccgtgactgtcaccagccttgttgctggccaattaaccgccttgcattttgatgagggtcagttcgtcaagcaaggcgatttattagcagaactcgatccccgttcctttcaaattcaactggcaaagacacaaggccaatatgccagagatcaggcaacactggccaatgcccgacaggatttagcccgctatcagcaattagcaaaaaacaactcaatctcccaacaggatctagataagcaaatatctgctgtgcgccagtatgaagctctcctgaaagctgatcagtcaggtattgatgacgcgaaactgcaattgacttacagccggattacagcccctatttccggccgtgttggtctgaaaaagattgatgttggcaattacatatctgccggtggaggaactccactcgtgatcatcacacaggtcgatccgattgatgtgttgtttgccctgccggaaaacgatattagcacggtattgaaagcacaggaaaacaataaggatgttgtcgttaccgcttgggatcgcaataaccagcagcaattggcacaaggtaaattactcagtatcgataacctgattgatgtgactactggcacgattaagataaaggcgcgattcgataaccaaaacaacgtgctgtttcccaatcaatttgtcaatattcagattaaggttaatacactggaaaatgccatcgttatcccgaatgccgcactacagatgagtaatgaggggcattatgtctggaaggtggataaagaaaacaaagtcaacaagcataaagtcacaatcgggttacaaaatgctcagttggtagtcatcagcaaaggtctggcaacaggtgatcgagtcgttacggatggtactgaccaattaaccgaaggtactggcatcaatattgtcaaaccactgaaatcagaatccgccaatactcacgatcatacgggtaaatcaaagccatcaaacagtaaggtggagaatacttaatgcattctgattctccaatgactggcggtggtccatctcgcctgtttattctacgccctgttgctaccacgctgtttatgatggcaatactactggcagggatcatcggctaccggatgctgccagtttccgctttacctcaagtggattaccctactattcaggtggtgactctctaccccggagcgagtcccgatatcatgacgtctgtcgtcaccgccccgctagaacgccaattcgggaagatgtccggcctgaaacagatgacgtcacaaagttctgggggcgcctccattataacactggtgttccagctctcgttgccattagatgtcgctgagcaggatgtacaggcagcgattaatgcagcgacgaatctattaccccatgacctaccttatccgccaatttatagcaaggtcaatccggctgatcctcctatcttgacgttggccgttacttctgatgccctgccgatgactcaggtacaggatatggtggagacccgtattgcccagcgtatttctcaagtcggaggcgttggcttggtgacactggctggtgggcagcgtccggctgtgcgcgtgaagtttaatgcacaggccatcgccgcacagggattaaacagcgaagccattcgtaccacaataatgaatgcgaatgtgagttcagcgaaaggcagttttgatggcccgactcgctcagtgacgttaaccaccaacgatcaaatgaaatccatcgacgaataccgcaatttgatcgtggcctataaaaatggtgctcctattcgtctacgtgatgtcgcgactattgaacgaggagcggaaaataccaaattaggcgcttgggcaaatgagaaacccgccattgttatcaacgttcaacgtcagcctggtgccaatgtcatcgataccacggacaatatccgtgccatgctgccggagctgatcaacagcttgcccaaatcggttaacgtggatattttgacagatcggactgtcactattcgtgcgtcggttcaagatgttcagtttgagttgttactggctatcgcgctagtcgtgatggtgatttatctgtttttacgtaatgcaacagcgaccttgattccaagcattgcggtgccactttctctggttggtacatttgccgtcatgtatttctgtggtttctctgtcaataacctcacgttgatggcattaaccatcgcagcaggtttcgttgtagatgatgcaattgttgtgatcgaaaatatctcccgctatatcgaacgaggagaaaaaccgatggctgctgccctgaaaggagcaggagaaatcggttttaccatcatctctttaacgttttcattaattgccgttctgatcccacttttgttcatgggagatattgtcggccggctgttccgagaattcgccattacacttgctgttgccattttaatttctgccgtggtatcactcacattaacgccaatgatgtgcgcacggatgctaaaagcagaagctgaaattaaacataaccgctttgaacaggccagtgaacacttctttgagcgaataattgcaatatatggcgaatggctgaaacgggttttaaatcatccctggataactctcggcgttgcattcagcacattggcattcaccgtcctgctctatttaacgatcccaaaaggatttttcccattacaggataacggcttgattcagggtacactggaagcgccgcaatctatttcattcaatgccatgtcagataaacagcggcaggtaacggctctgctactgcaagatcctgatgtagagaatgtgacaacgttcattggtgttgatggcagcaactcaacgctgaatagtgggcgtctgcaaatcaccttaaaatctctcaatcagcgtaatatccgagttgatgagatcatcccgcgcctacaggctcgcgtcgctaacgtacctgacgccaaactgtatctacaaccgacacaggatttgacaattgatacccaagttgcccgcacgcaatatcaatttacattgcaggcgactgtctctagtgaccttaacatttgggttcccaaactacaggaagcactgaaacagcgccctgaattggtggatgttggtactgactggcagaatcgggggttagtggcttatatcaatgtcaatcgcgatatggccagtcgattaggtatttccatgactgccatagataatgcactgtacaacgcttttggccaacgcttgatttcaacgatttatacccaagctaaccaatatcgggtgatccttgagcaggatacacaaaatgaagcgggtataaatgcactcaataatgttcacctgatcggaaccgataacaaggtagtgccactcagtacaattgccactgttgagcaaaaattggggtacttatccatcaatcatctgcaacaatttcctgctgtcactttttcgttcaatgtcgcacaagaggcttctcttgaagccgcggttaatgcagtcaaagaaacagagcagtcgattgggatgccaaaaaacatcaatacgcaatttcaaggagcaacactggcgttccagaatgcgctcggcaataccctatggctgattttggctgccgttatctccatgtatatcgtgctgggtattctgtacgaaagttttattcaccctgttacgatcctgtcaactttgcccactgctggcgtaggggcattgttagccctgatgatgggtggctatgagttggatattattgccattatcgggatcattttgctgatcggtattgtgaagaaaaacgccatcatgatgatcgattttgccctagcggcagaacgtgaaaaaggcatgtcgccttatgacgcgatttttcaggcttgccttctgcgtttcagacccattctgatgacaacgatggcggcgctgctgggagcattaccgttaatgctcagtacgggaatcggggctgagttacgccgtccattaggtatctgtatggtgggcggattgatcatgagccagatcctgacgctctttacaacgcctgttatttatctgttatttgaccgattagctaactattttaaaaacaagcgccaaaacagactccagagccagaatcaaggggaattagatcattcatcggttaatcatcaggagccgctgtgaagtttttcgccctatttatccagcggcctgttgccacgacgctactgagtttagccatcactttatgtggcgcactcagttttgttctgctgcctgtatcgccgctaccgaagttggacttccccttcatttcagttagtgcttacatgccaggcgcatcacctgaaaccatggcatcttccgtcgctacaccactggaacgttcactcggtaagattgctggcgtgaaggagatgacctccgacagttcgctaggcaataccaacattacgttggaattcgaacttagccgggatatcaatggcgccgcacgggatgtccaagcggcgatcaatgcagcagaaagcctgctgccttccggtatgccaagccggccaaggtactataaggcgaatctctctgatgctccgatcatggttttgactttaacgtcaactaattatagtgaagggcaactgtatgatattgcctcaacataccttgcccaaaagctttctcaagtagaaggcgtcagtaatgtgtctgtcggaggcagttccctgcctgcggtaaggattgaactgaatcccaatgccttgttcaatcagggcgtttcactcaatgatgtcagccaagccatcaacagtgccaatgcccaacgtccaacaggacatgtggattcagcgcaacagaactggcaaatacatactaatgacgaactgaagagcgcagacagttatcgctccattattgtgcattatcgtaatggttctcctgtgcgtttgcaggacgttgctaatctcaaggattccgtcgaagatattcgagcagcaggaatgtccggaggtaaccccgccatcgtactgatgattcgtcgtgaatcgggagccaatatcattgcaaccatagaccgaattcgtgctgaactgcctgctctgcgtgaatctattcctgccaatattcagcttaacgtcgcacaggatcgctcaccgcccattcgtgcctccctgcaagaagtgaaacagtcactcgccattgctgtcgctttagtgattctggtggtttttctgtttttgcgttcaggccgcgccaccctgattcccgcaattgcagtgcctgtatcactcattggtacattcaccgccatgtatttgtgtggtttcagcctgaataacctctctctgatggcattgaccattgcgacaggatttgttgtcgatgatgccattgtggtactggaaaatatttcccgccatctggaagctggattgaagcctgcccaagccgcactaaagggtgtcagagaggttggattcacggttcttgccatgagtgtttcactcgttgcagtttttattccgcttgtattgattgatgaattactcggcaggctgttccgcgactttgccgtgacactcgcgacagctatcggaatttcactactgatttctcttaccttaaccccgatgatgtgcgcgcgtctgctcaaatcatcaccgaaaaaatcgcaaaaacgtattagaggttttagcaaggtactgttgaaaattcagcagggctatgggcgttctctgaaatgggtactcaatcatacccgttgggtactgctaacattagttggtatcgttgtgctgaatgtttggctctatatcaacatcccgaaaaccttttttcctcagcaagataccggacgactcttgggattcgtcgttgccgatgaaaacagttcattccaggccatgcgcgacaagatgaaacattttatgcaggtcattgatgccgatccaacggtcgaaaatgtatcaggatttactgagagccgctcaggagttatgttgatagcactaaagccactgagagagcgtactgaaagtattgaacaagtgataacccgtttaaaagggaaactctcgaatgaagcgggtgcccaactgtatttgatccccattcaggatctcagatcgggtggacgcggcggtgctaaatcaatttatcagtttacgttgctgtccgatgatcttggtgaactgcgcaaatgggaacctgttattcgcaaagcattggcgaaattgcctcaattgactgatgttaattcagattatgaaggtaaaggctcagaaatagccattatctatgatcgtgatctgatggctcgtttgggcattagtgtcaatgaagccaatgctttgcttagcaatgctttcgggcagcagtctatttccacaatttatctgccccggaatcaatacaaagtggtcatggaagtcgcacctgaatatacacaagatgccagctcattagaaaaaatgtttgtgatcaatgccaaaggtgaacgtattccactttcctattttgcccgctggcaacctgcgaatgcaccattgggtgtttatcatcaggggctgtcagcctcctcgactatcgctttcaatgtcgcgaaagactatacactgtcggatgcgatcagtgcgatagaacgaacaatgacagagttgagtgtcccttccgcagtacgcagctctttcgcaggcacagcccaggattttcagaaaactcagagctcacaattgtgggtgatcctggcggctattgtgaccgtttatctggttttaggggtgctctatgagagttatatccatcctctgacaatcctttccactctgccttctgcgggagttggcgctttacttgcactagagctgttcaacacaccatttagtctgatcgccatgattgggatcatgctgctaattggcattgtgaagaaaaatgccatcattatggtggattttgcccttgaagcgcagaaaagtggaaaattgagtgcacaagaagcgatacttcaggccagtttattgcgcttcaggccaattatgatgactactctttcagcattattcggcgccttacctttggttctgaatagcggtgatggggctgaactgcgtcagcctctgggcattaccattgtcggaggtctagtgatgagccagcttctcacattatataccacgcctgttgtatatctgttctttgaccgactgcgtgaaaaatggcaccaccgccgtacgataaaatctcaggcgatgaaaccatcatgagacacataatgagagcaggtattagtggtaagctatttttggctattttcgcgacctgtatgctggtgctggtgacaatgcactgggggattcgcctcagcttccagcatagtttcattggttatattaagcaaaatagccaaatgcgagccaataagatggcagaagcattgacggaacaataccagaaatatggtaactgggatttcctgcttcaaaacgatcggatgatctttcaaatcatgcgaactattgaacaaaacagcgatagccgccaaagcccgtcatcccgtggctggcgcagtcaattctgggtagttgacaatcaaatgcatcgtctggtcggtcatgggagtcagatccctacagacacctatcgaaaatcagtaatttatcaagataatatcgtcggttgggtcatcgtccgtacatcagataaaatcactcgtcaagcggatatccgttttgaccgccagcaacaattaaccagttggattattgctggtttttcaaccttactggctctgattgccacttttcttctgtcccgtggttttctaaaacccgttaaacggttggtggagggaacacataaacttgccgcgggtgatttcagtgttcgtgtgaagccatccagtacagatgaaattggtcaattagcatcggactttaatcggcttgccagtacactggaaaaaaatgaacaaatgcgccgtgattatatggtggatatttctcatgaactgcgtactccactttctgtgctgcgcggtgaactggaagctttgcaggatggcgttcgccaatcaacgccagagacaatccactcactactgacggaaatcaccacactgacaaagctggtggatgatttgcatttattatccctttctgatcgtggttcgttagcctaccgacaggaactgaccaatgccagcgatctgctgcaagtcaccctagccgcttatcgtggacgttttgctgacaagcagatcacactggaactgaacttgacggaaaacgcaattctgttcgcagacccaggccggctaacacagttattccaaaacttgctggaaaatagcctgcgctataccgctgctcccggaaaaatcatcattcgggcacatctcactccccaaaagtggatcttggattggcaggatagcgcacccggactgactgtcgagcaatgccaacagatttttgaacgtttttaccgctgcgagtcttcccgtaatcgcgccagtggtggttcaggtttggggctggcgatctgttacaatatcgtcgaagcacacgatggcgttatttatgcagaaagatcatctttaggtggtcttaaaattcacgtagaattaccgctggttgaactgcctgaatataaagcacaatgagtacgcattctacacaatataccgttttaatcgttgaagatgagccaaaattagggcaactgctcattgattatctgcaagctgcagattatcagacacaatggctgacacgtggtgatgaagttattgcccatgttcagaagcaccagcctgatattatcctgcttgatatcatgctacccggccttgatgggatatcgatttgtcgagaaattcgccggttttctgatattcccattgtgatgatgaccgccagaacagaagaaattgaccggctactggggttggaaatcggtgccgacgattatatctgcaagccttatagcccaagggaaatggttgccagagtgaagaccattttgcgccgttgctatcgtccacaagatatcatcagcgaacatggctccctgacaattgatgaaaatcattttcaagcacgttatcttgatcgcgtccttgagctgacgcctgttgagtttcgcttactgaagatcatgtccagccaacccggacgagtattctcccgcgatcaactgttaaataacctctatgatgatcaccgtattgttaatgaccgtactatcgacagccatatcaagaatttgcgcagaaaactggaacaattagatgatgataaatccttcatccgctccatttatgggttgggctatcgttgggaagcggagatatgccgtttaatgtgaaacttcatccaactggaaccgtgataatcaatcccatctgtcggatttctgaagaagcccaaaatatcaccgttaatcatttcaaagtcataagatttttttgccccgagacttaattgtataaaattcaatctaaacttaagctgataattacccaatcaggggagttttttatggctactctattcagtacgggtcaactgacctgacaaagcccgccattcggctgtaatcacaattatattcccacaataaatttgtgccatagatggattaaacgttaaaattcttgtttccttagccttgcttttaatgacaaggcctgacttgaactcagatcgagaacgttattaattatgtttactccagaattactatctcctgccggctccttgaaaaacatgcgctacgcgtttgcttatggtgcagacgccatctatgccgggcagccccgttatagtctgcgtgtccgcaataacgaatttaatcatgaaactctggctcaggggattaaggaaacgcacgagttaggcaaacgtttttatgttgtcgtcaatattgctccccacaatgcaaagctgaaaacgttcatccgcgacttgaaacccgtcgttgaaatgggacctgatgcgttgattatgtccgatcctggcttaattatgatggtacgtgaagcatttcctgagatagatatccacctttcagttcaggccaatgccgttaactgggccacggttaagttctggaaacagatgggactgacacgcgttattctctcccgtgagctttcgctggaagaaattgctgaaattcgtcagcaagttcctgatatggagcttgaagtttttgttcatggcgcactttgtatggcttattctggtcgctgtctgttatcaggctatatcaacaaacgcgatccaaatcagggaacatgcactaatgcctgccgctgggaatacaatgtgcaggaaggcaaggaagataatgtcggtaatatcgttcatatgcatgatcctattctggtcaaaaatattgaaccgacacttggacagggggcaccgacagacaagatattcatgattgaagaagccaaacgtccaggggaatatatgagtgcttttgaagatgagcatggcacttatatcatgaattcgaaagatcttcgtgcgattgagcatgtcgaaaggttggccaatataggggttcattcactgaaaatcgaaggacgcactaaatccttctattattgtgcccgtactgcacaagtgtatcgccgtgctattgatgatgcagcggctggcaagccttttgactccactctgatgaccacactggaaggtctggcacaccgtggttacacagaagggttcctgcggcgccatacccatgacgcgtaccagacttatgaatacggctattcaatgtcagatacccagcaatttgtcggcgagttcactggcaatcgcgtaaatggtctagctgaagttaccgtaaaaaataaatttctggtcggagatcaactggaactgatgacaccatcaggtaatatcaactttacgctggaatctatggcaaataaaaaaggccagacaatcgaagtagcacccggagatggtcatatcgtctatctgcccattcctgaagaaattattttgaattatgcgctgcttatccgaaatttaaagggaactaataccagaacaccacatacaaaagaaatacaagaaaaataactgaaaatgaatttttaaagaaattgttctgtttttttagaaacagatcacatcaatgctattttatttctcgtattatcgagcttgaaaaatgaagaactaaaaaagttttactgtaagactaggaaccacctccttggctagctcaatctcccttgagctggccttttcttttatcccaaaataaataaaatataataaattcaaatggttaaaaataaaaccacaataaaaaaatattgttttaattaatactttctgtttcttcattacaaataccctaacgaataattaatcactctatttattataaataaaaaaatcatctcatgataaatatcattaataattcttcagtttagtgaaagaaattttaggaaaactcttttcaaattattagattgaagaataatacttatgtttaattttcatcatgccaaatgatgattatttaatttactcccctgcaagatagttaaattttaataaatgctgttctaactgaagcgatccactgctgtttccttctctgcttaccttgtgctcaacgtaaatataaacaacaatcaatagcgccttttgcaaactggagttcattatgactgatatcgctaagttgttaggaaaagacgcagaaagtttattgcagcatcaatgtactactatccaaagtgaacatctttaccttccaggcgcagatttcgtcgatcgagtcatgatcgaaaacaatcgaccaaataccgtcctgcgttcaatgcagactttattgaatcatggacgtctggcagggactggctacctttcgattttgccagtagaccaaggcgttgaacattcagccagtgcctcttttgcagccaaccctctctattttgatcccaaaaatctcgttgaattagcgatcgaagcgggttgtaactgtgttgcttcaacttatggtgttctagcatctgtctctcgccgttatgcccataaaattccgtttctggtgaaacttaatcacaatgaagcattaacctatccagcccaatatgaccaaaccctgtataccagtgtcgaacaagcatttgatatgggagcggttgcggttggtgcaacgatctattatggctctaccgaatcacgccgtcagataggagaaatttccgccgccttcgaacgtgctcacgaattaggcatggtgaccgtgttatgggcctatctgcgcaattcagctttcaagaaagatggcgttgattaccatacaagcgccgatttaaccggccaggctaaccatctggcagcaactatcggtgcagatatcgttaaacaaaaaatggctgaaaccaatggcggatatactgcaattggctttggtcacacggacaagcgtgtttatacccatttaacaaccgagcatcctatcgatctggtccgttatcagcttgctaactgttatatgggacgtgcgggattgatcaactctggcggcgcatccggagccaatgacctgagcgactccgttcgcactgccgtcatcaacaaacgagcaggtggtatggggctgattcttggccgtaaagcgttcaaaaaatcaatgaaagaaggggtagagttaatccattcggttcaagatgtttacctcgataagaaagtaaccattgcctgaccgaacttctccaactcgccatttttcatgatggggataaccatatccccatcacttaatcaccatatggttatggtgcttctactaccaccattgatgaaaatggtgcactggccctattccctttccaacatccagtgtatccgcctgcgccagtgcattctgcaaataagttttcgccgctggcagtgtgtttttccaatcaggataacggggacgtaatgcggcaagcgccgcagagagcgtacaacctgtgccatgagtgtgtcgcgtattgattctgggagcagtaaaacgccactctccttcagcagtaaacagccaatctggactttcttcattaaccagatgtcctcccttcagtaaaaccgcctgacatcccattgaaagcaattcacgcccctgatgcaacatttcaccttccgttccggcaatgttacatttcagtatggccgccgcttctggcaaatttggcgtaatcagggagacgtttggcaagagttgctctaccatcgtagttattgcttctgaggataataagggatcaccactcttagccaccataaccgtatccaacacgatatggggaacagggtaacgattcagagcttctgcaactacattgacattggcaacattggataacatacctatcttgatgctatccattctgacatcagaaagcaccgattcaagctgcgcagcgacaaagcggggatcaatgtcataaactgattggactcccatcgtattttgggcaaccaaagcggttattactgttgtgccataggccccaagtgcggagaaagtttttaaatcagcctgaatgccggcaccaccgctaggatcggttcctgcgatggtcaatgaattaattctcatgatggtgactcctagcaccagccaaagaaaagccagtatccgaataggagataccatgacttccctacgctggcattatccagatcaaataaaaatttagtatctcagaacatccactaaagtctaacagtaactataaaacaacaagataacagttcattatgtctcataaggtttctattcatctcggtgcattttaggtacatactagggacgtagaaaaaaccggataatgccaatgctcaaaactaaaactgacatccagcgtttcaccatccccgatggtaagacaatgaagaaagaaatcgtcttcaacaacggattaacaggattgtactttgctgcccgaagaaatccatcaggcgtgataacaaaaagctggcgttatattgtgggtagcaatgatattactttaggcacctaccctgcttacagtttggaagagaccagaaaatggcatttgcaacaggtacaaaagaccagacaagggtttgcacccagtaaaacactcataggaaaacccaccactatggatggtctggttcaggagtggctggaagtaaagtgcgctaaaccgtcaaaaccgggaagacaggcgatctgaaacaagcatggtaaagccctgcataatgttgaccctgaacagcttacctaccaccatgtctattcacaccttttggttatgggggtcagcaacgcttctcatcgtatgtgccagataatcaaaatggtgatgttatatgcctttcaggtgcatggcatacaagggcaacaaccgggacaaccagtctacgttcctcaaaaattgtcggagatccatgacagaaaaaaagttgctgctttggtaggtaaaatacgtgataaccatcttcaggcagagcaataccgcatcttatggcattttctgggcaacactccttcacatgcagcgatgcgctttattatggtttttggtactcgcaaatcagaatcagcaaagctggtatggcctgaaatagatttaaaagctaaaacatggaccttacctgctgaacgaaccaaaacaaaacaggagcgcgtctaccctctccctgactacctgatcagtctgttagaagagtggtcttggacacagcataaccttggcaaacagatatggacacatatcggacataccacgatgtctcattccgctgtcaggttacgggaaaccgtaggaaatgattttacgactcacgacctgagacgtagcacggcatcaatgatgagcaacgaggcgggaattgatcccattatcgtagacctgatgttaggtcatagcctcagtatggtaatttcaaagattctggcaacttaccagccaaaagcgtttcagaaaaaggtcgataaagcttggcctgtttggtttcagtggtttgagaaaaatatcatcaacaagaagccaaaggaatggcaagaggaacagcctaaacttgcggatgcaagtaaatgagtgaaaacaccatcaataaggctcttcgcaagatgggctacgatacccagcaggacatctgtggtcatggcttccgcactctggcctgtagtgctttaattgaatccggtttgtggtcagaagacgctgtagagcttcagatgagtctcaaggaaagcaacagtgtccgtggtgcctatacccacaaagccaagcatcttgaccaacgccgcctgatgcttcaatggtgggctgactatcttgatgccaatcgcaaaggcatggtaaggccatttgagtttactaacaggtaatcatattgagcaggcaaaatgtttgctaaacgaatgacaatccatccaatgataacgcataacctattgttttaaatatataaatagccatcaaccactgatggctaaaatctcgatctattatgatttttcaacaaaatttgatattgtatcaatatcaaataacgaggtcataacaatgatatcaggtcttgatggtggaaatttcatccttagcttgatggcaaaggaaagggtgaaatcaggcatactcaatagagccacgatagaaggcttcaagggtgagtataccgtgatttttgatggctcggagttgaagggcaagccactagtcttgtgtagttccagacaaccttatgaagcacgaatcttcaaaagtatcgatggcgcggtagccgaactactgcgtataggtttaagcgaagcttcagtcaaaaacaccagtaaaccgaactctaaataatcaggtgtaaaatggatatccaaaaagagacacttttttcagaaattgaaaccgcaaacagcaaacaactggctgttttaaaagctaactttcctcaatgttttgataaaaaaggggctttcattcaagaaaaacttcttgagatagtaaaatccgcggacattgaactgtcaaaagagtcatatagtttaaactggcttggcaagtcctatgcccgcctgttggctaacctgccgccaaaaacattactcaccgaagataaagaacataaccatattgagcaaaataaaaacagtcagaacctgttaattaaaggggataacctcgaagtattgaagcatatggttaatgcttactctgaaaaggtgaaaatgatttatatcgacccccatataacacaggttcggatggattcgtatataatgatgatcgtaacttcactcgagaacaactcagtgaacttgctggtatagatcttgatgaagctacacgcattcttgatttcaccgttaaaggttcaaatagtcatagcgcatggctgactttcatctatcctcgcctatatattgcacgtgaacttttaagagacgatggcattatttatatatctatagacaatcatgagttgaatcagctaaagataatgtgtgacgaaattttcagcgaacaaaatttcatcggaaatatagttagggcaaccggacaaactacaggccaagacagtggtggattaggagcttcattcgactacattttagtttatacaaagtcaaataatatcgatttaagtggattaccgttaactgaccatgacctcaaacgtttccagaataaagatgatgtaggctactatgcttatgatcaaatgagaaaaacagggagtaatgataaaagagaagagcgccctaacatgttctacgctgttctagacccagatgggaatgaagttttcccaatagcctccgctgggtatgagggacgttggagatttagtaaagaaacctacttaaaacaagtagaagataatatggttttatggaaaaaaacaaaccgtaatggagaagaagtttggtggccttatgtcaaatattatgttgaaggaagaaccaaacgcccgtctcctctttggactgaatttgagggtaataagaaagcagctcgtgatcttcgctcactatttgatgggaagaaaatctttgattttccaaaaccaattcaggtaatacagagcctaatatatattgtccctaacgcatcaaaagatgacttgatattagatttttttgcagggtcaggttcaacttctcatgcagtgatggctatcaacgctaacgatctcggaaatcgcaaatttgtttcaatacaaattccagagaatacacctgaaacatctgaggcatataattcaggttataaaaatatttttgaaataacaaaagaacgacttgtcagagcatcaaataaaattaaaaaagaacatccagattttaatggtgatctaggattcaagatatttgagacagttgatgattttcgagtaaaagatgaaagcgaactaacactttctaaccacaccttctttgatgatgctgttctaacccaaaagcaatatgacacattattaactacgtggtgtttatacgatggtagcctactcacaacaccgattgaagacgttgatcttcagggctataaagcacacttatgcgatggtcgcctgtatctgatagcacctaacttcagcagtgaatcattgaaggctttacttcaaaagctggattcagacaaagattttgctccgaacaaagtagtattttttggaggcaactttgaaagcgcaaaacagatggagctaaacgaagcacttaaaagttatgctaataaaaaatcgattgagttagatttggtggtgaggaactaagcatgtctaaagggttcacattcgagaaaaacttaccacaccaaaaagccggtgttgatgcggtgatgaatgtttttgtgtccgctattctacataagacggataatgttgctatccgtttgttggctaaccctgagttaaacctgactgaacagcaatactacaacaatctgaaagcagttcagcaatttaatggcattgaacatacaaaacagcattatgatgccaaaagcaatatcattgatatttctatggagactgggacaggtaaaacatatacatatacaaaaacaatatttgacctgaacaaagcatttggtattaataaatttattattatcgttcctactctttcaattaaggcaggaacagtaaactttttaaaaagtgaggctttaaaagaacactttcgagatgattacgaacgtgaactaaaggcttatgttgttgaaagccagaaaaactctggtaaaaacacaaagtcatatatgccacaagctattcatgattttgttgaagcaagtaatttcaataagaaatatatacatgttctcgtaatcaactcaggaatgattaactcaaagtctttaacagacacgtatgatgttggtttactagataatcagtttgatacaccattctctgcaattagtgctgttaaaccatttgtgatcattgatgaaccccataaattccctacagctaaaaagacatgggagaacattgagaaatttaatgctcaatatatcatccgttatggtgcgacattcagtgatggttatgaaaatttagtttatcgcttaacagccgttgatgcttttaatcaggatttggttaagggaatcgatgcatatgttgaagatattgttggtgatagctcagcaagcctgaaatttgttaaatcagatggtaaagaagccagatttgatctctctgagaatgaaaaaaagtcgagttatcatttgacaaaaggtgagtcattatcaattactcacagttctatacatgatctttacattgattcattaaataaaagcactgttgtgctgagcaatggtatcgagttaaaaacaggtgagtcaataaatccgtattcctatgatcaaacgcttgaagacaacatgatgcgtaaagctgtcaaagagcacttcaagttagagaaagactatctgactcaaagaccacgcataaagccacttacactattctttattgatgatattgaaggatatcgtgatggtaatgagattgccggaagcctgaagactaagtttgaagagatagtattggctgaagcaaatgaactattaaaaagcgagaaagataatttttatagaaaatatcttgagaagaccgttcaagatatttctttggttcatggcggatatttttcaaaggacaacagtgacagagatgagaaaattgagcaagaaataaacgaaatccttcatgacaaagagcttttgttatctttagaaaatccacgtcgtttcgttttctcaaaatggacgttgcgtgaaggttgggataaccctaacgtttttcagatctgtaaacttcgttcaagcggtagcactacatccaaacttcaagaggtaggacgtggtttacgccttccagtgaatgaatacatgtgtcgtgtaaaagaccgtaatttcacacttaactattatgttgattttactgaaaaagatttcgtagattctcttgtcaaagaggtcaacgatagttctttcaaagaaaccgtaccaagtaagttaacccaagagcttaaggacaagattctttctcaatatccagctctttcatcaatgaaactcatgatcgaactcgttaacaatgaaatcattgatgagaatgaaaacttcaaagattctgatgcatatgcacgcttgaaagttaagtatccagctgcattccctatcggagtaaaaccgaacaaaatcaaaaaagcttccgatggaaaaagacgcactaaaatgcgtgctggtaaatttaatgagctaagagaactatgggaactaataaatcagaaagcagtaattgagtataaaataaacagcgaaaatgagtttttgtccattttcaggtcatttatgctcgaagaagcagaaagatttacaaaatcgggcctgcatacccgtatagatagaatctacattcataatgatacagccatgtccaaaagtatcgttagtgatgatgataactttgctaaacttaatacaatggcttatcaagagtttcttgataacttatcgcaaactgtttttgtaaaacgtgataccttacataaggtattttgcgaaataaaagatactatcaatatcactgactacctgaacattcaaacaatcaggaagattaaatctggctttagcaagtatttgttgaacaattctttcaacaagttcagtctgggctacaatgtgatttcaggctctattcatcctacaaagttcacgaacgcagacggcgaacctctgaatgagatattatcaagtgatcttggtatattgaatgacagcataaaaccaccgctggattcgtatctgttcgaagaggttttttatgattcagaactggaaaagctgaatataactgatggagagattacatctgtagctgtttttacaaagataccgaagaattccattaagatcccggttgcgggtggctatacgtattctcctgactttgcttatgttgttaaaacaacaaaaggtgattatttaaactttatcattgaaacaaaaaatgtagatggaaaggatagcttacgacttgaagaagatcgcaagataaaacatgctcaagcacttttcaatcaaataagtaaatctgtcaaagtcgaatttaaaacacagttttctgcagacacaataggtgaactgattaaacaagttcgatgatgacattttatacatggtaaagggcctttcagccctttctttttcccgttaagggagctacccattgggtagaatacatatccccacacttggggaaactaaatcagcccattgggctgtaaactactccccatatatggggcaatcagacactttattgaagtgaaaaccttaacaaccatcattaattacgatatcattttccgattgtcaaaaataaattgatgtgtgatcatggtgaaaattaattaaatttggtcaagtagagattcttatttccattttttattggttccatatttttcaccatttttagctggttaataataggctaccgcgcccttcgtggcttgctcaacagctcaccgacctaaaagcaagttttaggccggttcaccgttaggacgtgaaaaaataattaatacttggatttatttatggcattttcgatatagacttggccttgtgctctataaacctgaatatcacgctcaggtagattagatatgttaagcagaatcccaaagactaattctttatctacataaccaatatcacatcctaagactttggcaacctctgcaccgaaaataattttctggcgggtgttctcttttttcgtttgctgtttctttttagcttccaagaaatataatcgttcctgcgctgaagcaatttgttgtttgatatcttttctggtcatttatgttctccctaatgttttttcttgttggcataagggacattcacatagtcataaccattactgatttgtcttttgattgatttaactttcaatttaaattgttgttttatctggtgctgctttgcttgttcccttatctggtttactattttctctgcttctaaataggcttgttccgtatcggtatatatcccatcatcaagaagcattttggtttcccaatcaatggcctcatcattatttttatacattacacctccttgtatttgttatatattatcatttatcatatttttttataattatcaatacaataagataactttatttaaaaaatatcacttcgttgtaaatattcaatttttattcatctttttaacttaagaaataatatattatccgataaatagccttgctatgatatagttccacttacagaagggtgagaacagcgttagggccagtcttgcacaaggaaaagtaaagcgccaatgtgtgaaatgaattagagattttaatttaattatactaatgattaaataactgataggatacatgaatttccattactaatggttcacgagatgcttcttaaactattaccccaaaattggcgttatctgctttcatcatacttattgattattcttgtagttatacttttaaaagtagttttctttgttatgattcataaagatctcaccgaacaacgagctgagagatttaaaaacgctccagttagtcatgctcaatatgatccttcgaaattaacacatcgcatggtaaaatttgatgagagcaatggaattatttccgacaaagaagcatataaataagaattcataatgatgatacacccatttttaccctcccaggtttttgctgttgtaatgaagtgatttccatgaaggcttttacatgttcaagtcactgccacataaattggcagcaatggtttcgtgtcacggtttcatgcagggattgccacaggcgttcaattttattcaaccaaggggaatagaccggtaaaaacaagagattaaatttaggattttttgccagccacgcgatgactttctgacttttatgaatgccatagttatctaaaatcaaggtgatcgtctttgcattaacatattgattattaagtacatctaacaacttaataaataaatccgagttctttcttaagcccccgacataagttatttctttcgttttcgcgttgaggcaacccgcaagatagtgtttctggttctttccgggggtcacaacacgcttttgttgtcccttgaaacaccaatctgccccgatttttgggttaaggtcaatatccacctcatcctcataaaaaacaggatgttgctctgaggcattggataaggccccggtgatttttgcccttttttcatcatgttcaggatcagacaatcttaacgtgggtgcggctcttcgccagacgatccccgcccgataaaagtagcgataaagtgtactttgagagagtgatatatccagtaatacattgattttatgtgtgataagctcaagactccagcgtgagcggagataaccgaaatgttgtggggagtgttttaataagaaagaaaccacagcgagaagtggctctaaattccagatggctggcctgcccggcggtaagctttttaatccgtccagtccatataatgtaaaccaatttacccagcgattgaccgaagaacgtgaggcacaaagggttttggcaacgtgagaaaccgtatcccccttgtgtaacatcaataaggccatcatccggcgagcataatccttattttgggttttctggataagctttttcattttctgtcgttcatttcgaggtatgggtgctatgataggcataactcagtccatttggtgatttgtgattttcgccattgatcagatcgtaaaaatcggactgagttccctcaagtgatctactattttgaattcttatttagcttaagagaagatttattatttgaactgcctatatttagtccacctccattaataactgttggtctgaaaagcaaatgtgttaactcatcggtaggggtggataatattttagaaagcccggatatcattcatgacctcttcgacagagtatactcttaatgcgataaatatatcaaaactctcttggataagattcatcactttaggtgttttctcacataacatatttacgattattgatatatcatttttcatctgtttttccttttgtttatggttagccccttgcggggaaaaaatataagctattatttaaaactctttgtatacgaaactaacaaggcagctactttttcaatgttaatctcattaatatcacccatattcccttcttgagcagtgaacttctcatagctcttcgttatgtgatcaatgatattgataataaatggactcataaaatcgggatcatcaagaagttcatctgaaccaccctcaccatttatttccagaaaaactttccaacttgcttcaaacgatctacaagccaaatccaagaacagtccagttgattcattctcaataatattttctttagtcatgtttatatcctcatagttaaatgcttatttaattcatttcgttttgtattagcccctttcggggccgaacaatctattattaagtcaggctaaaaattaatgctttgatatgaatacatctcatttcgaatatgaccttatccatatcgacatacatcagtctttcattcttacttgactcttccatatgttcatcaaagcgctttgccagataatctttgacatgtaagatataggactccgttctattcttatccaacataatagatgccaagaaatcatattcctcttgctccttgtatatattcagaccaaatatataaagatttttagccatcgcagcaaaagattttgtagatgattctttgatgttttttatttcttgattattcattttatttcctattgttattttaataatattattagtgagattcattgcgggaatcagcaataactctatccatccacgcttctatctcactttcgataaaggcaatcgatcttagcccaatccttacctgtttaggaaagcgacctgcattgattagcccatacattcttgcccggctaagccctaccctcttcaacacttctgggaggcggataaaccgtcttgatgctgcttcatttttcacaaagctttgctcatagaactctgttcgctgttggtttgtgttgttgtttctcattgtcttctcctgtgttgtttcgacaggactaattctatgaaaagtggcaatgataagatgcagacactggaaaacaacgtctttcgagaaagtgggatggtgtgattttggggaaaatgaaaatgtgtgaatgtcgctggttttgcataagggaacctgtcttggtggcaggctcccggagataatggaaagggcaggggttacgcatgaaattttggtcggctaaaattgattaaataacagtgcttccatataaccgttatcccatcccgctgattttcttcgcgcactcaaactcaatttactattgatatctcgtttaacaatattgagtgccattttacgtaattgggcaaatattcttgtggcgacccgctctctcatccgtgaatcatcttctcggaaagtgacatccagtacccagtgtaaactattttcgatagcccaatgttttcgtattgcacctaactgaaaggcgggagaatcatgacaactgcttaaataataacgaaagtcagaagtcaccgtgtcagaatagtgttcttgtcgtatcgtttctgttaccagaagagcttgaatatctggccaagaccttaagtgttttgtttctgatgtcagtggcagaacccatccgcgccgtctgacggtacgtccgtggctatcatcgaattcatcatggtcaggtttaaggtaaggtttttgggttatctgttgttgttgaaaatagttaaccgcttccgaaaaggttttcccctgattgcctttaagcgacaaaatataatcggcttcactctcgcgtagttgctgagcaatcgtgcgttggcaacccatcgcatccatcgtcacgagatggcctttcaatgaaagcatcgataataatgccggaatggccttaatttcgtttgattttccgtctacggcacattgacataagctaagccctttctcaaccgtgaatgcactcaccatatgtaatgcgctttggtcaattttcttatcaaacgaatgacgtaaacttttaccatcaatcgcaatgatagcccgtttttctgaagagaggtcacgagaaacccattgataaaaatgatgttcaaagaggctcgggtttaataaactgaaacagcgccggaaagtatcatgtgacggaataccccctttgagcggaagaaatgaactcagccaatcctttttgagttgaccgtactgttcaatatcagtccaggcgttagccccagcaatgacagcgcataccgcgatcactaagatatcaataaaacggtgtttgacctttccctgacaacgtgggtctggaaaatcagaaaagacatccactaaatattttcatgcgtaacccctgatggaaagggttagttttcttcttctttttcgttcattttcatggcgtcagcaactctgacatccatcatgtagctgtctttactcagatagaggttaaaaagccgcgcaaactcgcgggtcagtgctttttccgcaaaaggtttatcggtatccttaatttgtgcgcctcctctaatgacctctgaatcattcggatagagcaaacgtgacatttgctcattagaaatttttacgccacgatgattggcccacagcatcagatccagcataggaatgattctcaaggagatcaccttcttaatcgtgctcagaccgaaacgaaataggccgatctctggttccgtgatgccatactccttacgccactgtgggagcatgattttgatgtgctcgatgacttcatcatcggtcagccgtttaatgtttagccacagatatagcgaatgatcatcattcagcagttcaatatcggttaatcgctgtttaccctgttctcttgatacgggcgttgatggtgcatcaggcgaaacatcgctacgttgaagcaaattgagtttccgtaactcagcctcataacggctaatatcattgatggtcatatgctgcacatgaaatgtggcatcgaccagaggatttttcttttttgatgttgggggaatggcttcgattgaactcactaacaacggagtgccagccagtatcttggcttcttcttccagatagcgttgatagcgtggactctgttcattcatggaatcatagcggaacaggactgcacggcgacttagttcatcgttgacgtcgtttagcgtgatgtcctgtaaaacatcatagttactcattctgaaccattgctttgcggctttgataacctcacctgacttcattcttattatcctgtctgatgctgaacgatttttatgcccgatttatctgagtgttatcttatgccaagctatagcaataacgctatctcactgatagaagacaggaaacgaagagcacagcttctggtgttttgttgcagagtatttcaggggattgagtgagataggaattacctcacttccctaagattgggaatggttagggaagtgaatagggaaaaatacccataaaattatgataaataatataattatattatccagatcaggtaatacgggtacttctcagttcaatcaagaacgccccgagtcaaaataaaaaatcactctattagtagcgcaatagagtgatatttgcaatcagttatcgttaagaaaccaaactaacgataaatctatttggtcagtaatcaaataccagccaaaataagtttgttactataaagctgtgacgtttgcagccgcaggacctttaggaccattctgaatttcaaactcaacttgttggccttcagacaatgttttaaacccatctttcataattgcagaaaaatgtacaaatacatctttgctaccatcagctggagtaataaaaccaaaacctttagactcgttgaaccacttcacagtaccagtgatttttgccatttcaaaaatttcctttgaatcgctttattcgccgattgtaataaaaataaacaaacccatcttcgtcgctgttattcattaacagaaccaatacttcgtttacccatgtgttttatcacatactctttatataatcgcaagccatttttttcaggtgctgaacccaacgcacacatttaaaatccttaacaactactcctatttttaaattactaaaaaatccacacataacacaacaatatgaatttatgtaaaaataaaattttaaccccaataaaccgctttagacaatctaatactttatgctgttttccacccctattatgaagtacatcagagaattataattgccaaagaaatatttcagataaaaacaagattatgactaactgcatttcaaggctggtatatacaatataattatcttaaacgtcattaagttatattttatttatcctttattaaatattattcaattctaatatggagccacattcagctactattctattagtgcgataatattatttcataaagcttacagcgtgtggatatcaggtgctctggatggtttcagaatcggaatgggattgacattaaatgtcacagcaagtaataataattattatgcccctttgctattatcggttttttctatcaaatataattgactgtcatttcagtcaacttatattcccgggacatacaatagtatgaatgtgctttttggctggctacgctggcaatggtgatccaagatagttgaacgaggaagttagactgagtggcacacattatgttgcgcagactctatttcctgcatcattttccctgttgagtatgatgctggctgtaggaagtttaatgaatctaatcataagaccagccggaaatagatccggccggaagaatactgaaaaaatttaccgttagataactcgcgcttttgcccttttagccttggaaaacaagtagcctccccataacatgccaatccagaacggcatcaggataactgagatacgtatttccggtgtcatcagaataacgacgagaatgaatgcaaggaatattaagcacaaatagttgccgaatggataccaaaatgcctgaaacttcgtcttaattccttctgcattttttgcagctcggaatttcagatgtgccagacagatcataatccagttaatgaccaacgttgttactaccagcgccatcaacaattcaaatgcttttccgggcataatatagttaaccagcacccctatagatgttgccaatgccgacaatcctattgataaaacaggtacactgcgatgattaacttttgtcaggatgcgaggggcattaccctgttttgccaaaccatacagcatccggctgttacagtatacgccactgttataaacagataatgccgccgttaatacaaccacattcaggatattagacacccaaaagttatccaagtgatcgaaaatcaaaacaaatgggctgccgccttctaccacattcatccatgggtaaagcgaaagcagaatagacaacgaaccaatataaaacagtaggattcgataaacgacctgattagttgcctttggaatatttttttcaggatcttcagcttctgccgcagtaatcccgaccatttccagtccaccaaatgaaaacatgatcacggccatcgccataatcagaccggaaatcccgtttggcataaacccgccatactgccataaattggctacgctagcctgtggcccgccagtgccgctgatgagcaaataagctccaaagataatcatgccaataatggcagtaactttgatgatggaaaaccagaattcggtttcaccatataaccggacattaatcaggttaatggcgttgatcagcacaaagaatattgcagcagaaatccatgttgggatttccggccaccaataatgaatatacatgccgactgccgtcaattctgccattccgacaagaatgaacattgcccagtaattccagccagacaaaaaaccggcaaaatcaccccagtatttataagcaaaatggctaaacgagccagcaacaggctcttcgacaaccatttcgcccagttgacgcataattagaaatgcaataaacccaccaatggcatatccgagaagtaccgaaggcccagccatttttatggtttgagcaatccccaaaaacaatcccgttcctactgcaccaccgagggcaataagctgaatatgcctgttctttaaaccacgcttaagcgtagattgttctgcttgttctgccatctagtcctcttaattataatgcttagaacccgtcccattaagctattttatttgtcgttttgaacctgaacagggcgagaaattttctcatttcccctaatttctacgcgatttgtcgtgctcaaactaccttaacaattgtagctattggattaagctctgattttagcgcgacatttaaaccaaccccattaagctatcttatttatcactttgaacctagactgtgttcatacgaaagcaatagtttttaaacgcgctttagtacagcccaaaggggaactcagcgaatcatcttcacacgctaatccttaaggaactacgtttacgcttcggtttctacacacagtccgtgttcaaactgtcgtcaacaattaacgcctgctgggataagctcttagtctgctaattagaatcaggtgaatattaaaacatcctttcccaagaatgaatactgcgaatgtatgttagcacagatagttgcaagagaatgattgaggtgaatatcaaaaaggcaggtatcgggtaattgaacagatccccaattcaaacccttcattaccttgatcacaatggatgtccaacgctaataaatataaaaacagacacactgttattaaacatagccctaaaaaagttttttttatgttcaattgagtcacctcacaataatttcattgtagttaactttataataaaatattatagagagtttttatgtggaaaaaatttaaatttcacgcttgattactggaaatacctatgctgatgggttttgtcatcttgaaaggaagttgtgtatactcctcaaaccttcaatcaatttaaaattgtaatgccacaagataaccacttagcacttgtatgcgcactgagtaaatggatcgaaaaccaccttggccgagttatccatcttgaagagcttgctgcttattctggctattcgctttggcacatgcagaaaatattcaaggaagtcacggaaatctcgcttggaaagtacatacgccaacggcggttggccggcgctgttcacctgctgagaaacagttccttgtctatttttgatattgccttagatttcggctttggctcccaatctcattttacctatatgttccgtaaagaatatggcattacaccttacgattttcgtcaaagtacagatatagaacttgaggttaagcttccattgcatttgacttataactgccagttatgaactctagcaccatcagcggccattcgttaaggccgccgtttccttccctcacttcatgatatctattccagtgctctgaataacacagcactattgtgctgcattaatcatcatttgtatttttcgactaatgccaaagcaatcgcttccgtttccgcatcaggaacaccactaatatctgatgggcggaaatgcatctgaaacgcctgaatgattttatgggtatcttcatccaaatgacctgtctgaggcatggaatagccatagagaaccaacgctttctgtataccaatgactggcacaggcatactcggcaccctgttggccagatatttattaaccgttatgagatccggccaagcaccaataccttgttgataaagtgcttgccacggaaaaacaggaccagggtcttttttcctgagcggggcgatatcactatggccaacaacattcacagcctcaatttgatatctctgaataatatcttttgccagtcggattaatgcatcaatttgtgacgggtggtataaacaccattcttttttgataaagtgttgcttaaaaccacaattaacgatttcaatcccaatagaattgctatttaaattcttataccccctccagtcactcctccctgcatgccaggccttttcattttcagaagccaactgaaaaataacgggttctttattctcatattttggccgagatgggatgagataatggacaccgacattacctccggttaatacccgtaaagaattttgatcattcaatgccgtataatgcaaaacaagaaatcgggctgaatcgatgccttgcttagtcgaataagaatgcgagtgatcaacgatataatcgtttctgacttcccgttgaggctgatgactacaaccaatcaacaacgtaatacatacgcctaatattaattttcttatcatgtttgatcagtgattatggaggaaaaatagaatcatcatgactatatagtagataagactacaatagatgtgatgttttttactggcagaggtgcttattaaaatccaataaaaaccgggcatccactgaatgattgaatgcccggctgatacgttttatctcatatgagtaacatcatattactcataatgaatgtatatcctttaccttttaaattgctgctttattggtggctttcactcaccccaatcatatagaaagctatattcttggggattcgcttcgctcatttactaccgcgctgcaacttgaattgattaagcatatacttcagtatcaatgactgcacttctggctgtcctgagaggacttattatcccagatgccttcttcaacttccttttgaagctctggatacatattgatatcgaatgtcggcaactgccctgcttttctttgttggttgtagtccttagccagctttatcgcaatacctgatagcagaagaatagcaatcaagttaacaatcgccatacatgccatcgataagttcgccatactccagactaatggcacttctgccaacgaaccaaacatcaccatgcttaacgcagccaagcgcaggataaacaaacctgcggtgtgattacgctccaggaatatcatgttactttcagcataagcataattggcaataatcgatgtaaaagcaaagaagaagattgcaatagcaatgaatgtcgttccccaatgcccaacagccgatgataatgcccgctgagtcaattcaattccactgatagcagtcacattttcattgagaataccagaagacaggataatgacagcggttgcactacagataacaatcgtatccataaatacccccagcatctgcacatagccctgagaggccggatgcggcggatatggcgatgcggaagccgctgcgtttggtgcagaacccatccccgcttcattcgagaacagccctctttgaacaccctgaatcatcgcctgagaaatgccataacctaatgttcccgcgatcgcttcctgaaggccaaaggcacttttgataattaatgcaaatacttctggaatacgctcaatattgtgaccaataacccaaaacgccagtaacaaataagcaccagccataagtggtacgactaattccgcaacccgcgcaatcgaacgcaatccgccgaaaataatcgcgccactgataatgactaatacaataccgacataaataggtttgacatgaaaggcaaaagcagccgcttccgcaattgagtttgcctgaacagcattaaatacaagaccaaacgcgataataaggaagactgaaaacaatacccccatccatcgcttcttcaaccctttctccatatagtaggcagggccgccacgataatttccttgatcgtctttcgtcttgtacaactgggcaagcgtgctttccacaaaagaagttgccataccaataaatgcgactacccacatccaaaaaatagcgccaggcccaccagctgtaatcgcaattgcaactcccgccaggttacccgttccaacacgtgctgcaaggctagtacataaagcctgaaaagatgaaatgccagaatcatctgacttattactatttttcaagactgaaaacatgtgtccaaaatgacgaagctgtataagaccagtgcgcagtgtgaagtaaaggccaactccaaggagtaaatatattaatacgtagtcccaaagcatgttgttaatgaagttaatcagatccgtcaagatattttccccttactattagcaaacattagctgaccataaatcagtatcctgcaaaatttattgtgcccaatatcctttataattaaccagtcacaagcaacacaattctgtgtacaaaaaatacagagatacccgccagtaaaacgaaaagaatgtaacacaatatctatttcaatgggtaacttttaataatttttttacatttactttagcgtttattaagattcatactaagttttactggagatttattgcccatttcaagcctctcaagcgcatttcaccagcaatatatgctgcgtaatcttgtttccagatatattgcgaaaatacaatttaattaacaacttcacccataataaataaccatttggcaatcaagatacaaccaccacaaagcaatctcaatacaatacccttataaaaaacgtgctttaatcagaagttatctttctacaagcacaccaaatgtactactcacttttcctccctcccatatactgtcatgttccttatgtagtaataactctatttattaaaaatactaaaataattacaaaatttaatattgaaatttctaagatttacgaaaacatatagcaatattcttcttcaaatgagattattaaattttaatactgtgatagttggaaaaaaccatcattgcatattaaaattttcaattgttatttttacagtagaaacaacaacgataagttaataagatgttaatgttccactatctggccatcagataatctgctagtgaggttataattgatgttagagcgaaaaagaaaaaaccccgcagacaacattctgcctaaacgggtttatagaggaaaatcaaaatacgagtatcacccagcaacaggcggttcgatctctatctgttgtttaagttcaccagtatccgttgtttggaaagaatacaacaaggttgtagaaaaaattgaaaaaaacagcacgtagagtttgatatatgttgagattaataaagcgggagtttccactcccgttgattttctggctttcaattaattccattcatattttcaaataaaaaataaccaatgtgtaatgaattgtttgatatttctaaagaatgatatatctcaattagaataaaattcagcatccatatcaaaaaaaaccatattacgaaatattttcttgttatttatagtcaataaccacacttttaatatccaaataataataataaaatttactaataatccgcactaaaatcacattctctcacctataggccatcgacctaacccaattgacgacttcatccagccagtaagcatctcagctttcgaaatccatgctacgatataaatttaataccatccacatgttgaaacgaacaatagccaatggagtattgcttatgtatttgtgtaagatactaaaaattgctgttatccctgctctaatcgttctatcactatcaaccccagccctcgcaaaagacggagcattgattagtttacctgataagagatttgccgtcatatcagttagcgatctggaaagtgaatcaattggcagctattctatcgctgttttcaaggatcgggatctgacggaattcgaaaccggagctgttttttcccgtgatggtttggtgttcgaagataacaataagccaagagtgacatttgcagatattaacggtgatggtgccaaggagttgattgtgtacaaacttacggcaggctctgggaattatcttgaagttgatgcactcaagataacagataaaaatgtcaaattcctcgcccgaatcaatacagatagtaaacatgacccaattcagttactccgcaccctgtgtaaaaaaggccagtgcacaggtcagctgcaccattaatcacataatcaaggcacccagttttccaccggaattcggggcaaatcatgaataatgtactattgttaatgttgtcaccactatcccggtctagtcgattaagaggaaactatgaaacgtcttttactaccccttttccttgtcccattcttctcttatgccgcacatatgaatgcagataaaacagcggaaacctattgtgatttatttggaaaagcctctgtagaagcattcaagaccaatgcctcaccagatgccatagctcaaaaaacctttaatgagttgaacaagaagggattcgatcttaaggaaatccatagcaacaaggatgaattaatttcctctatcaaacaaacagtcatagaagtcagaaagaataaacaggtatttccaagccataaacattttgatgaatcattagataaatccgtcaaaacctgcaagactcaaataaaaaataccttatctcaaggtactcaataatcgattctagagcgacgaacacccatcgtcgctctatttatcatcaaatttgcggattaaactgcatacctgcaaaggtacgtacaggattacccctttctatttggttgtgaaataaacgtcgttcagccttaagttgagcctgatgcatatcttgctgttgctgtagccgatgctccaacaacaagcaagcaagccgccgattagcatgctgacttcgctccgactgtatcttgacactgattccactagcaatatgcactgcccgaatcgctgattctgttttgttgacatgcagcccaccaggacctgaggctcttagcgtttcaaaacggatttcactttccatcatttgctgtaaaggtttaaactgcgccacaccgataaaccagtttttgcggccgtctccttttcgccacggacttgcacaaatccatttgatagtaccgttccagcgctcaaaaagctgctgttcattttcgccctgaatagcaaccatcacagagcgtaatgtatgagaacgccgccctgcctcctcctccaatatatcagccataacacctaattcgtcggcttcatggatcaactgttccaaagcctttctgacggccagcgcacattcatctggcccctgagcagcggaaatctgcaacaatatcattccttgttaccccgcgttttatatgtcagaacgggcttaagccgcgctatcaatttcaccaaacccgcttgcagcatagcatccatcacgccgcctataggtttataagcttctggggcttcctgaaaaatcagttgcttatccagacaaatcacacgactgccaaatgcggtacgagagagttgttctgcgttataacgcccagttaaacgtgctttacactcaccacgcatccatttcctccccgcaccatgtgcaagagaaaagagactgcgatcactggtcagtggctgaaccaagtagctgtaatcccctcgagatcccggaataattacggctccttgatcagaaggtgttgctcccttacgatgcagccagccatcaacaccgccaattgtgtatggcataagcatattatgtgaaacatcaaataaacaacttccatgagttcgccagcgttttaacatccgctctgcaattaactggcggttaaaacaagcatagtccagagcttgctgatgcagttgaagataactctgtgcttccgggctggaggctatcagcccattatgcccatgttcgcgaacatgctgttcaagaataacttgtcccaacccgcgcgaaccactatgtaccaataataagagctgttgcttattcaattgccatgtttcgagcatttccggctgataaatttcatccagttgctgcaattcagcaaaatgattgccaccaccaatcgttcccggtgaataacaaaaatgctcaggtatatcatcaggcaactctgctgcttgcagaggattatcaatagaaccaggccgtttttccagcttgtccagcgaccatttattcagtgtcaaatctgttcgccacaacgccataccgcagccaatgtcattgccaataagggctggataaaaacgtgaatgtgaaaaaaatgcagcgccaacgggatatcctctgcccggatggagatcaggcagaccaacgacgcttaccatatcagggagttgtgctgttgtttcaagttgctggatagctttaccttccagccaagtattttctgctgcgataatctgaacgcgagacgcagctaaatgcaaagtattgcccatggatcaatcctatgatcaatgaaaaaataagggatgtgatcaggccttcctagccaaagcaatactaaaaagaaaaatcagtaattagctatgagctggcctgagaagagtcattgttgttgtcatcataaattcctcctttcagttattaatggggtttagcttatatctgtacttacagacgctgcatcttactctaagtcttatagccattaccggtgttttatttaatctcatctgcccgcaagtaatagttgctgatagggcatattctattattacaaaaagatatagccatctattttcataaatgactatatctatagtgatcacaaatgaattcgactttaatacttatttaattatatcttacaaaattaattacatgatggcttatgtgttttgtgatttaacgccccgtgcttaatgagtaatttttgcatttcttctaaattacgctcacaggcataggttaatgcgctttgatcataagaatacatacttttatcatccgttatcgtaaataaattcagattcgcaccctgctcaatcagatattttactatctcaattctattattgcttgctgcgatcattaccggtgtttcgccgtcatcttcaatagtttgatcatttaaatcaagttcatgcttcattaaattatgtattttcttcactatgttggtatttttacctaaaactgccgattttaaggtatgatgaacatcccttgtgtctgtcgcccacaaattagctttctttgatattaaataatccactatatcttcataaccaataaaggtagcccaacccagtgcagtttgatttaagctaccggtgtctttggcttcaatatcctgaccactctcaaccatttttttgacggtttcaaaatcaccttgcttaatagcatcaaaccacttgctgttttctccggtagaaggctcttcataaaaaactctatacgatagcctttgtgggttagccagatcgaccatctccacataatccagcctgaatttcttgtacttgtccggattattctcatttaatacttgagcattaacattaaccgatgtaaatagtaacgtaaaaagcattattatctttctcataattccctcattatttaatctaatttcacgtttaaaagagtaaaagaatataatcaaaatagattatttctgttactgttatgccttattatcgttgagttacaattctttaatatcttacactactgattaatcttatcaatcgttacccgcaacaattaaatttacaatctcggttggctatatattgattttctaatctcaatcaaaataagatatattatttctatacgcaattaacttgaagaggcgggttttaaaatctggaagttatcagtcaaccgagtggtgagctctttcgctttttctggcaatgtgacatgaaaaaagtgacgcagcgtttcacggaatgttttggtatccggaaaatagacattgtttcgtacctgctcattcacatacttccataatcgctcaatcgggttgaggttagggctgtaaggcggcaggtagtgcaactcaatattcaaaacctcggcaaaaaattgaacgactgcggaacggtgataacccgcaccatccagaataatgtggattttttgcgaaagtgggtaggtttcccggattgagccgaaaaaaaggacgacatttttcgcgttaatcgtcggatattcacgaacaatagtctcttcaatccgttgtaaattaagggcacccatgatgttgagtcgagtacgactgcccgtggtttcaaccactttgacgtgcttccgcccgctcttcatccagccataacttaattttgtggacagggtcgggtgaaccgcatcaataaacaaaataggcgtattctggccacattcttctttcaacgcgttgtaggtttcaataaactgttgctgtttatccgcatcaaatttatgcggagcacccattggcttcttgtagctgaaaccctgacggtgaagccatttcgtcattcctgcaacagtgaaagtcacctgccatcgagcccgaacataggccacaatttgggcggtagtgtgcatcaaatttgccatcagatactccactaatgctgtcgtttgttcggcagacaaacggctttcagagcccccattttcaggggcgagtttttcctcagagaagtaatctttcagatggcgactcaccgtactttcatggatccgcaaagcctgggcaatcatctgggcagtccagccttctgaggccaaaagcacggccttaatgcggtcacgtactcgtccatcgcgagtcgtatcatgcatcaattcgagggcttctttttgggcatctgtcagattaattttcatgagcgcgatcatgatctgatacaaatgaaaaatcaagcatcttcaatgacgacggatatatatcataatttaaccggagataaatctgttttaaggaaaagtttgagtggaattttggtaaacgaatctcttatctcaataaatcaacggaagctatcaggcgttcaaaatcgtaagtcacaatcttggcagcaatcgccctttccgttcccttaacgataaagtcaattggtgaacacggtgaagttttcaggagcaatggcaaacggaacaggttcaataatcaataatgggctgtggtgagtgactctgatatattcatgacatttataatgggatttcatgaaggattatatatggcggaagtagtaaaattcataaattcgcttttttgtgattatgtttttctatttggttttttttggtgcatttctgttcctatagggctgatttttacagctatggcatgtgtattcaaaaaagcaacctacagaattttatgttcaatattggctatattctttttatttccaccaatattcgcgtttattatttcctgtaaacatgaaaaatagagatggaattaccgaatgtcagttcccaggtgtggtcataatgaaagcatggggattcgattattttcagaaaccccattgagaatggctgtcagctaaaaaggctaaaaacagcaataccaaaactaccaagaccgactaatagaaccatcaaattagaaaaagaacgataggggcgtagtggttcaaccaagtacgttgatagagacggtaaaacaaacaaaataagcgcaatcataggtccagtgatgcctgcgataactttcagagtattcggattccagatagtaatcattaaagtaaggacaaaaacaatagccatgccgatcaacttatcacgcactttattttctttatgatggagaattttactctccaatgctccgactaatcctctgactccctccaatgctccaaaataagttcctaagaatgattttgtcatagcaatgatagcaacaggggttgccgttattgctatccagtacaagccctctttctgcgcgatcgcgctgagaatggtaatattgttgtctttagttgcctgtatttcctgaggtgataacgttaaaacacaactaaatacaaaaaacagaatgactatgcagattagcgcataagtgggtttcacaatctgtttaatgtggtattccgcatctgttttataggctcgtttacagtggttagaaaaagtagacataattggggtgtggctgaaagagaataccataactggcattagtaaccaaagtgctctcactgaatccagatcaatatgaatattgctgatgagatgtttaatgtttgcactatcccattgaaatataagcgtcacagataatgtcagcaggtaaagaatgagtggaagaactaacacgcccatgaatttcagtgtgatttttttacccaataagaaaattaggtgtaaccctaaaactaccataaacgctgttagtgttcgtggaaactgaatctgccaaaattgctgcaacaaaatattaacggaattggtaatagatattgcataaacaaaaataataagcaggaaagttagtgcataaaaaaagttgatgatacgagctatcctgatcccataatattgtttggttgcactgagtaatgtgggagaaggggaattgctggtaatgatataacgtgcaagacctaggtgagggtaataggtaaatgggaatgctatcaatagcataaccaacatagcaagtggtccggatagtcctaattgtatagggagaaacagggttcctgcacctactgccgttccgaatagtgcataaaaccaaatattgtattcatgaatccacttttgttccgtcttcaagtacgtctcctactaagtttatagtttttcatgttttcctaaaccaggataaagataaatcttttcaggaaaaacagtgtgccaaccaccgccacactcactgcaagccatgcaataaaccgatattgcagtcggctgttaacgttttccagtctgtcacaagctgccttgagccttttatccagtgcatcaaaagatgcttctgttatctccagccgttgcggtagttttttaccaaacgtttcattgagcttatcaaagctgctctgcatacctttggtaatttcatcccgcgcgcccattttgaggctattcagtcacgttgtgacctcaccggacattcgtgatgtttgcctgatggaagtctgaaagggttgttttcaggctctacaatgttgccaccatctcccgagactgtttatgcagcgagtctgtccggctgtcattctccagtgcatgaaggtgttacgttaccgtagcttttcatcgcgagtctgactgccggcgacgatcagtgcctttgtcgctttctggatttcttccgcgatgcgttccgggcgctgtgcacgttcaaaatgctggttgcaggtattctgccagttctcacgaagctgcatcagacgtgctttacgggtttcaatggtcagcccggaataggctttctgacagcctcgtattcaggatttttggggttataacgtcggaaatactattcagagtcactgcgaatagcatcattgatgcggacagaaaacatctggtgacagtgtagctgctcccctccgtctacggaggtggaaacgtgaatagattaacgcttcaaaccccattaagcgcgccttctgcattattgcattttcccgaaggataacccattatcagcaatactggaagttctgttaaattatcagacttgtagtggggaaaaatagctgttcatatcttagttgatcttgacggtcgattagtacggtttttatgacttaataggtcggattttaagtaagtctcagtctgctttatgacgcaaattatgacatgtactcaatgcttaccaagcgcagtaattacaacgagtttaagttattttcataatatacgtcataattatcaccaaggttaagatctaaaccacacaaacacgcaaatttaattatggagtatgcgaaagcggcgcaggcaaaagatgttccccaatagtttctattattactcacttacaattctcgtagtcatattcattctactcatcgccagataattttcgtattaaagacatgctcagctcacagcaagcgtaaaagacagaatattacctgacttcaccttaatgcaacagaacccggataaataccacgatgaccgaggcaaagactggattattttagccgagaaatagcgttcaaattttaatccgttttgcaggggaatttcggtgtacaaaaaacaaacgggaactattaagcccccgttatctattcaattacgcaatcaatcacatatgagagataagtgcatcaccgaactcactacatttcagcagcttagcgccttccatcaggcgttcgaagtcgtaagttacggttttggcagcaatcgccccttccgttcccttaataataaggtcagcagcttcaaaccatcccatgtggcgcaacatcatctcagcagagagaatcacagagcctgggttcactttgtcctgaccagcatatttaggtgcagtaccgtgtgtcgcttcaaacaatgcgcattcatcaccgatatttgcccctggtgcaataccaataccgcctacctgtgccgccaatgcatcagaaatgtagtcaccgttcaagttcatacaagcgataacatcgtactcagccggacgcagcaggatttgttgcaggaaagcatccgcaatcacatctttaatgatgatgtctttgccactcttaggattcttgatcttcacccatggaccaccatccagcagttcaccgccgaattcggtgagagccagttcataaccccagtctttgaaagcgccttcagtgaatttcatgatgttgcctttgtgaaccaaagtcactgattcacgatcgttatcgatggcatattcaatcgcagcacgtaccagacgctgagtcccttcttctgaacatggtttcacaccgataccacattgctgaggaaaacggatcttagtgacacccatttcatcctgcaggaatttgatcactttatccgcttctgctgagcctgctttccattcaataccagcataaatgtcttcagcattttcccggaagatgaccatatcggttaattcaggttgtttaaccgggcttggagtaccttgatagtaacgaacagggcgcaaacagatgtatagatctaattgctggcgcagggccacgttcagagaacgaataccaccaccaacaggtgttgtcagagggcctttgatagcaatacggtagtcacggatcagatccagagtttcctctggcaaccagacatctttgccataaacctgggtagatttctctccggtgtagatttccatccaagaaattttgcgctcaccgccgtaagctttctgaaccgcagcatcaacaactttcagcatgaccggcgttacatcaataccaatgccatccccttcgatataagggattaccgggttattcggaacatttaatttacctttggcatcaatagtaatttttttaccttccgccggaacaactactttgctttccattaacctctcctttcaagataagcgcaatgacttgttaattttttgtaagggacgtgtcaatactacttgaatattctgcaaacgccaatggtcacagatttaaggtacaatacgcaccctcattttgcgcgatggcttatcatgacaaatatctcttttaaaaaacgtaaacttaaccgattcagccaaagaaaaaataaagatactataaaaaaattaacaggccctcgcagggtactgatctttaacaaaccttatgatgtgctcccacaattcaccgatgaaatggggcggacaacgttaaaggattttatcccatttcttgatgtttatgccgcaggtcgtctggatcgcgatagcgaagggttgctgattttaaccaacgatggaaaattgcaggccaagttgacgcagcctcataaaaaaacagctaaggtttattatgttcaggttgaaggaattcctgatgagagcgctctgaacaagctacgcaacggcgtcacattgaaagatggcccaacactttccgctggggccgagttggtagaagaaccagaatggctctgggaaaggattcctcctattcgggaacggaaaagtattccagtaagctggcttaaaattaccctttttgaaggccgcaaccgtcaggtacgcagaatgaccgctcatgtcggttttccaacattgcgcttaattcgtttcagtatgggttcgttacaattggggcagctatccccaggagaatggagagaaattgattttgtttaatccacacgtcacagttgcctgcattgtgcatgcaaaaagcaaatttttgatcgtcgaagaattcattaatgagattcccctctggaaccagcctgcgggtcatcttgaagcgggcgaaacgttgctggaagccgctgaacgcgaattatgggaagaaaccggcattcgtgccaagccacaggcattattgaaattacatcagtggaacgcccctgatggtacgccttttatccgttttctgttcctgattgaaatggaacaaatcgtagataccgatccacaagataaagatattcactgctgccactggctaaatgcagaagagatcctcagcagcccacagctacgatcaccgctcgttgctgaaagtatccgctgttatctggaaaatcaggcttacccgttatcaatattggatagctatgggtcacctttcaccaaatgaacttttaaataagaagccgaataagaaagcgcgcgaagacgtttggtgcaccttatctaccgacgtgttaaagtattgcgcttgtttttttccgcagtgagatatatccatgttagataacagccagaaaaaagtcattgtcgggatatccggcggtgtagattcatccgtttccgcctaccttctgcaacagcagggttatcaggtagctggtctgttcatgaaaaattgggaagaagacgacggtgaagaatattgctcggctgccgctgatcttgcggatgcccaggcagtttgtgacaaactgggcattgagctgcataccattaattttgcagccgagtattgggataatgtgtttgaacatttccttgctgaatataaagcgggcagaactccaaatcccgatatcctctgtaacaaagagattaaattcaaagcatttctggaatttgctgctgaggatttaggggctgattacatcgcaacaggccattatgtccgccgtcgggatgtggatggtatcagccaattgctccgtggactggatgacaataaagatcaaagctactttttgtataccttgagccaccaacaaattgctaaaagcctgtttcccgttggggagctggaaaaacccgaagttcgccgcattgctgaagaaatcgggctggtaaccgccaagaaaaaagactctacaggcatttgctttattggtgagcgtaaattccgcgattttctggggcgctacctgcctgcccagccgggttctatcattacagttgatggacagaccatcggtcagcatactggtctgatgtaccacacactcggccaacgcaaaggattggggatcggtggaaccaaagatggcagcgaagaggcatggtatgttgtcgataaagatgtcgaaaacaatacgctgattgttgctcagggtcatgatcatcctcgtctgatgtctgtcggtttgattgcacaacagcttgattgggttgatcgtcagacattaaaaacagaaattcgctgcgtagtaaaaacgcgctatcgtcagcatgacattccctgcactgtcatccccttgagtgaagacaaaattgaagttcgttttgatagccccgttgccgctgtcaccccaggtcagtcggccgtattttatcagggggaaatctgtctaggcggtggcgtgatcgaacaacgtatacaggagtagccgtggctaaaaattattatgacattacactggcactggcaggtatctgccagtcaggccatctggttcagcagcttgcccatgaaggccagtgtgatgccgatacttttgaagtgatgatcaacagtatcttgaacatgaatccggcatccacacaggatgtctttggcaacgatgcctgcaacctgcgcatcggccttgatgctatgttgagcatgttcaacaacactcgcagtggagtctctgccggccttacccgctatatgttgagcctaatagtattagaacgccgacttagcaaaaatcaggcggcagctaatgaactggctaatcgcattaaccagctagagcgtcaacaaacctactttgaacctatgtcagagggtatcctcaacgcccttgcgggtatctatgtcgatgttatcagcccattagggcctcgcattcaagtcacgggttcacctgatgtattacgcaatacgctggtacaggcgaaagtccgagcagcattactggcaggtatccgcagcgccgtattatggcagcaagttggcggcagtcgcctgcaaatcatgttttctcgtcagcgcctaatccgacaggcaaaagacattcttgatcattgttaaattaaatccgggagttgctaccaatggaattatcctcactgaccgctgtttctccaattgatggtcgttacggcgacaaagttagcgcactgcgcgctatttttagtgagttcggcttactgaaattccgcgtgcaggttgaagtacgttggctgcaaaaactggccgccacaacagaaattaaagaagttcctgcgtttgatgcaagcgcaaacgcttacctgaatgaaattgtcgcaaatttcaatgaacaggacgcactgcgcatcaaagaaattgaacgcacaaccaaccatgacgttaaggccgttgagtattttctgaaagaaaaagtggcgcatattcctgctcttcatcaagtctctgaatttattcattttgcctgcacatcagaagacatcaataatttgtcgcatgcattgatgctcaaaaccgcccgtgaagagattatactgcctcaatggcgtcagttgatcgacactatcaagcgtatggcccacgactaccgtgacttacctttgttgtcacgtacacacggacaacccgccaccccttctactgttggtaaagaattggctaacgtagcttatcgtatggagcgccaatttcgccagtttgggcaggttgagatcctaggtaaaatcaacggtgctgtcggcaactacaatgctcacctgtctgcctatccgcaggtggattggcaccagttcagcgaatcattcgtcacatctctggggattcagtggaatccatataccactcaaatcgagccacatgattacattgcggaactgtttgattgtgtagcacgttttaacactatcctactggattttgatcgtgatacctggggttacattgccctgaatcatttcaaacagaaaacagttgctggtgaaatcggctcttctaccatgccacataaagtcaatccaattgattttgaaaattctgaaggaaatctgggattggcaaatgctgttctggggcatcttgccagcaaactacccgtttcccgctggcagcgtgatctgacggattcaactgtattgcgcaatctgggtgtgggtttggggtacgcgctaattgcttatcaagccaccatgaaaggtctgaataaattggaaatcaacgaacagcacctgttagatgagctggatcagaactgggaagtgctggctgaacctatccaaaccgtcatgcgccgttacagtattgaaaaaccctatgaaaaattgaaaaaactaacacgcggtaaacgcgttgatgccgaaggtatgaaaaccttcattgatggccttgagcttcccgaagaggaaaaatctcgtctcaaatccatgacaccagcaaactacattggctatgccacttcactagtcgatgaattaaaataaaattttttcatatatccccctatggacaggaaattttcctgtccataggggaaaaaaagcatgcgaaaaattacataaaacataaataaaagcaaagttatctactcccaccaattctaatcccttgtttttaaaagtcactttcattaatattccggcttggccaaaatagttactatacttaattcaatcataataatgatatatataatcttatttaatacctgttgacgaaattgactatttagctattttaaatttacttagtaaacgttactgattagcataaggaatcattatgcgtatactcattattgaagatgaggcgatacttcgccatcatttgacagtacagctccaagaactcggtcatcaggttgatgcggctgaaaataccaaagaagctgattattatctgaaagaaaatcatcctgatattgctatcgtcgatctggggttacccggagaagatggcctcagcatgatacggcgttggcgcagcgatcaggttaatttaccgatcctaatcctcacagttcatgacagctggcaagaaaaggtcacagtactgaatgctggagcagatgattatgttaccaagccttttcgtctggaagagattaacgcgcgcatacaggcattaatgcgacgtcatagtgggctagcatctcaactcgttgaattatcgccattcttaattgatctctctcgcaaagagttttcagttaataaaaacagtatcaaattgactgcattcgaatatacgattatcgaaactctgatgcgtaataatggcaaagttgtcagtaaagaatcactgatgcgccagttataccctgatgctgaattacgtgaaagtcatacaattgatgtattaatgggacgcttaagaaaaaaaatatcgaatgagtggtcagacgaagtcattgttacagtccgaggccaagggtatcgtttcgatgtaaaacaacatgatatttaaattttcgaaaaagcatatttcactgagaactcgatttctcatggcgacgtcggccattatccttgcgctgacgctgtcatatggccttgtcgccattatcgggtatttagtgagttttgataaaacaatttactccatactccgtagccaaagtaatttatttagtaccttggctaaatgggatggtagcaagctggttattaaaattccctcaaatttatccatgactaatcgctccctggccctgatttatgacaatcaaggtcgtattctctggcgccaaaatcatacgccagaattggaaaaaaaaattcctgaggaatggctgaaaaaagatggtttgcatgatttatctatctcttttaaagaaaaggaaggttttctctaccctaaaacatcgactcagtcagacaattcaaccaaaaccgacgggatcgataatgatgagtcattaacttattctgtagcagtcaactcttatgctaagaccgataaactgcctgcgatgacaattgttattattgatactatcccacaagatatgcagagttcagtgaaagtctgggcatggtttggatatgtattgcttgccaacctgattttaatcatcccattaatctggcttgctgccgattggagtctgcgtccaattaaatcggtaattacccaaataagctctctggaaagaggtgaacgtgaaaaattggatgaagagccccccaacgaattaaaaggtctggtcagaaacctgaatgcattattaagcaatgaacgtcgacgttatactagatatcgcacgacactttctgacttatcacatggcctaaaaaccccattagccgtgttgcaatctaccctactttcactgcgctcaggtaaacagatgtccattacacaggctgaaccaatcatgcttgagcaaatcaaccggatgtcccaactagttgactactacctacgtcgtgccaatatgcacagcgatcataacctacttttgagacagacttcttccgtctcaattttgctggatagactgatcatcgcactgacaaaagtttatcagtacaaaggggtcgatattacactggatgtttcttccgaaatcacttggttaggcgaaaagaatgacttcttggaagtgatgggaaatgttctggaaaatgcctgtaaatattgtctggagttcgtcgaaatcaccgccttaatgggcgataattctgtcactatcattgtcgatgatgatggcccaggtgtaccgccagaaaaacgcgacatgattttcgagcgtggtctacgtgcagatacattacgttctggtcaagggttagggctgtcaattgctgctgaaattgtcgtgcaatatgacggaagcatcagcgttgaagatagcccacttggggggactagggtaaatgtagtattccgctcacagcaaagctgtgaatactgagtgggagcaagctcgaaatatttcaaccaaaactgatatcgtgattgactattcgttataatggccggaaattcacttgtcactcaggatgtcaccatggattatcagctaaatctggactggcaatcgtttttgcagaatcattggcaaaaacggccactgctgattaagcagggtttccagcaatttatcgatcccctttctcccgacgaactggcgggactggcgatggaaaatgaaatcgatagccgtttggtcagtcagaaaaacggtcgttgggaagtttcacatggaccatttgaaatttatgaccatttaggcgaaaaagactggtcattacttgtacaagccgttaatcactggcatcttccttcttctgccctgatgaaaccatttcgcatgctgtctgactggcgaatggatgatctgatggtctctttctctgttccagacggtggtgtcggccctcaccttgaccaatatgatgtgtttatcattcaggggcagggacgccgtcgctggcgtgtcggcgaaaaaataccaatgaaacagcattgccctcaccctgatttattacaggttgatccttttgaggcaatcattgatgaagaaatgttgccaggggatattctttatattccccctggattcccgcacgaaggctacgctatcgaggattcactaaattattccataggcttccgcgcacccaatgcccgtgaactcttcagtggttttgctgattatattctggcaaatgaattgggaagccatcgttatagcgatccagagctggcattgcgtgataatccagcgctaattcagtcaaatgaactggacactctgcgaataatgatgcgtgatctgctggaacaaccagcaactttccaaaattggtttggcgaatttatctcccaatcacgccatgagttggacattgccccaccagaacccccttatgaaagcgatgaaatttatgaactgctgaagcaaggtgaaagtttgaatcgcttaagtgggttacgcgtcctgcgagttggtgatcaatgttttgtcaatggcgaattaatagatactcctcatatccatgccgctgatgcgctttgtcagcatgatcgagtggatgcgggtattctgggtgatgccattgatgatgttcgttttatcagcctactagcggcattggtcaatagcggttactggtattttaatgattaatctctgagtaaaaaatccatctgcatagcagatggattttctatatgtcaaataatgaattgttttcacggatagctgtcagttcagcaatcctcatgatgacacttaccgcctgctccattccttccagtgaaataaattcataccgactatggtaattatacccacccgtaaaaatattcgggcaaggcaaaccacgataagacagttgtgctccgtcagtaccaccacgaataggctgaattatcggttcaatatcgcaatccagcatagcttgtttagcaatggcaataacatgagggtgtttcatcatttcactgtacatattgtaataacggtcatcaatcgtcagttcaatgtagcaatctgggtgcagtccttttcccgccttttccgcaatagcgcatagcgtgtttttacgtttttcaaaattatcacggtcaaaatcacggacaaggtaatacatctcagcacgttccaccgtaccttttacactctgcaagtgataaaaacctgcatatccttccgtatgttcaggtgtttcgtccactggcagtgcatgatggatgcgcattgccagagaagatgcattgaccatcacccctttggcgctgccaggatggaccacattaccgacaatcttgatagtcacagtcgctgcattgaagttttcaaactccaactcacccacaccacccccatccacggtataggcccattcagcaccaaaagcttctacatcaaaagagtgccctcctttgccaatctcttcatcgggcgtgaatgcaaccctaatatcgccatgtggaatgttttgctgcttcaagcgcaccatcgctgtgataatttcagcaatgcccgccttatcatccgctcccaataaagtttttccatccgccataatcaatgtttttcccaataaattatgcaataccggaaacatgactggcgacagcacttcatttcctatccccaaggcaatatccccccctcgatagttttccaagatttgcggattaacatgcttaccagagaaatccggcgaagtatcgagatgtgaaataaaaccgatgacaggtacagaccaggcaacattggatggcaacgttgccattacacaaccctgctcattcagtgtaattagaaaaaccaagctgagtcaactcatcatgcagtgctttggcgagtttcagttgaccattactgctgggaacggctttagctgatggttttgattgagtatcaaacgcaatatattcaaaaaaacgctctaataatctgtccatcttctcctccccctgaatcatctatcttcattatggagaagagggacagtataagtattgcgtcaaatcagcttttatccgccttcatctgctgaagtaatgactgaacatattgcgtgacaattttactggcatgaccatagtgtttttcatcaaataggctttcgacctgactgggttccagattcaactcaatagtaagtgtgccagataacttagcttcatgcacaaaacctgcggcgggataaacgtgaccagacgtccctatggcaataaaaagatcagcatccgctaaagcagaataaatctgctccatacccaatggcatttcaccaaaccatacgacatggggacgcagtggagaaggaaactggcaacaatggcagcggtcttccgttgtcaattcggtcttccattcaatcacctgaccagactggcaacagcgcgctttcaacaattcaccgtgcatatgcaaaacacgacgacttcctgctcgttcatgcaagttatcgatattctgtgtcacgagcagaaaattatcccccagttgctgttctagctctaccaaggcataatgcgcggcattaggctggatttccggctgctggagctgttttcgacgcgcattgtaaaatgcctgaactaattcagcatcacgttggaaaccttctggcgtagcaacatcttcaacacgatgttcttcccacaggccatcagaagagcgaaatgttcgaatgcctgactcagcggagatacccgcccccgtcagtacgaccacatgaggcctttttattttatttgccaatcgaatatccctgtaaaaattttttctatttaatcgctgacaccgcaatcgtttaatcttgcaaaacttaccaaaccgatgacgaacacgcataaaactatttccttagcattgccctaatcttcctttcacccggcacctgttctgtttagaacatgcttaggtcgtctattctgctgattagaaccctacccgttaaatcgctatcgattaaaccgacacgatagcgcgcttagaggattgttgatactttggcatattattgaccgctcaaaatccgtgctggatcaagtttactggcccgacgagccggataccaactggccaacagactcaatatcaatgccgttaacaggacatagaaaatatccatagcatgtaattctgatggcagaaaatcaataaaatagatatcaccagaaaggaattgatgaccgagcagtttttccagccctttaataatagtcgtcagattcagcgatgtgaggatgccagccatcgtgccaataacgctgccgaccatgccagtcagtaatccataccataaaaaaatcgctctgatatgaccatctttagctcccagtgtacgcaaaatagcaatatcactgcttttgtctttcacagccataatcagcgttgaaacaatattaaagcaagccacaccgataaccagaaccatcgctaggtacatgatgccgcgtaccatctggatatcgttgtacatatatccgtagtcctttatccatgtactgatatagacatatttttctgtcgccttacccgcatccaaaacccgctgttctgcggcaaaaacattatcagctttgatggcaatccccgtaatagcatgaccataatccagatattgctgcgcatcggataaaggaaccaaagccagacgatgatccagcatgccacttaactggaaaatcccagtaacctgtaggcgaatgcgtttcggctgcaaaagtttcaaactcggatcactattggggatcatgaccgtcagccagtcaccttgtttcacatgcagcgaattcgccacaccctgccctaaaatcacctgatgtttgccagcatgaaacactttccatgcatcatcaccgacaaattgaggcaaagcactgacatcagcttcggtggtcggctcaacacctcgtatctgtacagcgtggagtttttcacctttctccatcaatccggtaaattcaatataaggggaaacaccaacaatacccgctgtctgttttacgcgctcaagtgcctgttcccaatgctgaaaaggctgttctaccgcgtagacctgcccatgtggtacaacagaaagcacccggtttttcagttctcgttcaaaaccgttcatagcactcaagccgataatcagcactgcaacaccaagcatgatacccaatgtcgaaatgacagaaatcaaagaaaccattcctgcacgacgacgacctcggctaaaccgtaatgcggtaaataatgcaagaggcaaattcgccattacctctctcccaccagaacgagttcatcctgtaaaaacccatcgcgcatttcgacctgacgagccaatcggccagcaagtttcagatcatgagtcaccaccagaaacgccgtcccttgacgttgattcaattcctgcaaaatttcaaagatgctgtcagcattacgctggtcaaggttgcctgttggttcatccgccagcaccagtgatggttcattcaccaatgcacgggcaatagcgacacgctggcgctcaccgccggacagttcagcaggccgatggtgtgcccgcttttccaacccaaccgccgccagcatctccagcgctttttgtgaagcctggcgctttttaccgccaatcaataacggcatagcaacattttccaacgcactgaaatcaggcaatagatgatggaactggtaaataaaaccgatttcactgttgcgtaactcggctcgtacagaggcagacatttcattcaatgatcgccctttaaaaagaacttctccggacgtaggcgaatccagtccgccaagcaaatgcagaagtgtacttttacccgatcccgaactgccgacaatcgccatcatttctctctgccgtatggaaaaagtgacattctttaacacttctgtggaaacctgcccttcctgatattttttgcacagatgatgacacagcaataagggttgattactcataacgtaaagcctcagcaggttgaatggcagccgcgcgccaggaaggatatagagtcgataatagggagatcaacatggcactggtggcaataagcaccacttgggtaatatcaatcgcaacaggtaattggataccttcagtcaacaggccaacaagaggcattaaactgtttaactgactggaaagcagaacacccagccccgttcccaacaaagcaccaatgatgccagcactccccccttggatcatgaagatcgccattacctgacggcgggttagtccctgcgtctgcaagatggcaatttcaccctgtttttccatcaccaataaagagagggaagtgatgatgttaaaagcagcgactgcgatgatcaggctcaacagtaaccccatcatatttttttccatccgaacagcctgaaaaaattcgcccttgcgttcacgccaatctttccatactaatccttccggtaaagtttgctggcttaatacatccaccgtcagcggttgattgagatacagacgccagccagtgatattatccatgggataacggaataagcgcaccgcatcttgttgattgaccagcatttccgtgtcatcgacttcactattggcaaaaaatgttccaatcaccgtgaataaccgctggctgggaattctacccatcggcgtaagctggctggcacttggtacgataacgcggatctgatcacctcgtttaacacccagctttatagccaacttctcccccaagatgacgaaataacgtccgggttgtaactgagtacgatcaatatcagcaatatgcgccgccagtggcgtatattcattaggagtgatacccaacatgattcccacaccaacattacgggcactttgtagcaccacatcgccttgtacaatcggagtaatacggttaactccttttagacccgaaagctgattcatcgggtgctcatcagggttgatagagcctttttctgatgtgatgattgcctgcggcataaaacccaaaatactgctttccaatgaacgttcaaaaccattcatgactgacagcacagtaatcagtgcagccacacccagcgtaataccaatggccgataaccaagagacaaaacggccgaatttatcgaccgctcgtccgcgcatatagcgcaatcctataaataatgagacagattgaaacatgaaatccgccgtatcaaaatgatgtttttaaaaacaatgggttaagaaaaaatgtcatattttatctctagttatgtatgccaatatgtacaaaaccaatatctatcccgtcagctttacttatcacatagtatcaccgtttcgctcagatttgattatcgtcaatttcaagtgaaaaataaaaaaaccagccattatactcaaccctcgaaaattttggcctgatacagaaaaggctacgccgatgcgtagccttgaaaacgccataatctaatataaagatactattaacaagagcttctgatgtcatccaatctgacttgcgctcctctggaagtactacccagatacttttgccaaaatcaataaacatgaaatctattactcttctgttgccaaagcaaagtgttcagtgataataaagggcagcaatactgtatggaaccactcgtaccccggttctgtgtttttttactttctctcaacctgccagcgtatttgttgcaaggctacttggtcaaaaatgtgttgggaatggactaaaccttagagaacacatcaaacgcttatgtccgcaaaataccgttatcaacttcctgaacgtcgcggtgatatccgccagttgggtcatttgactggtgccgcctgtgcagtcgaatgtgccgaaatcattgaacgtcactcaggtccagtgctactggtgacacaagatatgcaaaatgctttgcgattgcgtgatgaaattctgcaattcacccacgcaccaataaatatgctgtcagattgggaaacattaccttacgatagtttttcaccccaccaagaaatcatctcaaatcgcttatccacgctttatcacttaccgttcatgacgaaaggtgcactaatcctgcccgtcaatacgttgatgcagcgtgtttgtccacatgaatatctcaagggacatgccttggttatgttcaaaggtcagcacctttcacgggataaactgcggacagaactggaacagtccggttatcgtagtgttgagcaagtacttgaacatggtgaatttgctacacgcggcgccttgtttgatatgttcccgatggggagtgaacatccttaccgcattgattttttcgatgatgaaatcgatagcctgcgtactttcgatgtagatagccagcgaacactggctgaagtggaaacaatcaatttattgccagcccatgaattcccgactgatcaagaggcgattgaattattccgcagtcaatggcgcgaacagtttgaagttcgccgcgatgctgagcatatttaccagcaggtcagcaagaaaatgctgccggctggcattgagtactggcaacccctgttctttgaacagcccctgcctgcgatttttgattatctacccgaaaataccttgctcattacacaggatttagtcagcgcagcagagcgtttttggcaggatacagcacaacgctttgaaagccgaaaaattgatccaatgcggccattactatctcctgagcggatttggctacctgtcgataaattattcgctgaattaaaaaactggccccgcattcaggttaaaaatgacgcactccctcaaaaagcaggaagcaccaaccttgcttatcaggctctccctgatttatcggttgccacacagcacaaaacacctttggataaggtgcgccgtttcatcgaacagttcaacggcaggatcgttttctcggtagaaagtgagggacgtcgggaaaccgtacaagagctgttgtcacgtatcaaaattagcccgataaaaataaaacagctgatagatgccaatgagtctggctgtttcttgatgataggggcggcggagcatggtttcattgatgaagaaaataaactcgcacttatctgcgaaagcgacatgctcggtgagcgtgtaagtcggcgccggcaagatagccgacgcaccatcaatactgatactttgatccgcaacctcgctgaactgcgtcgtggccagcctgttgttcaccttgaacatggtgttggtcgttatcagggactgattacgctggaaacagggggcatcaaggcggagtatctgatcctgacctatgccggagaagacaaactgtatgtgccagtctcctccctgcatctcatcagccgttatgctggcggtgcagaggatagcgccccactacacaaattaggtggagaagcgtggaataaagcacgtcaaaaagcggccgaaaaagtacgtgatgtcgccgctgagttactggatgtgtatgcgcagcgtgccattaaaccgggctttgccttcaagcaggatcccgagcaataccaactgttttgccaaagttttccgtttgatacgacacctgatcaagaacaaacgatcaatgcggtactggatgatatgtgccaacccattgccatggatcggttagtgtgtggtgatgttggctttgggaaaaccgaagtcgcgatgcgcgccgcttttatggccatcactaataacaaacaggtagccgttctcgtgccgacaaccctgttggcacagcagcattatgataatttccgagatcgctttgcaaactggcctgtgcatcttgaagtactgtcacgctttcgcagtgcaaaagaacaacagcaggttattgatatggctgctgaaggcaaagtcgatatcatcatcggtacccataaacttctacaaaatgatctgtgctggaaagatattggtttattgattgtcgatgaagaacaccgttttggagttcgccacaaagaacgtatcaaagccattcgtgctgatgtcgacgtcctgactctgaccgcgactcccattcctcgcacgcttaatatggcaatgagtggtatgcgtgatctatcgattatcgccacgccgcctgcccggcgtttagcggtcaaaacctttgtacgtgaatatgacagtttagtcgtccgtgaatccatcctgcgggagatcttgcgtggtggccaggtttattacctctataatgatgtcgaaaatattgagaaggctaaaaatcggctggaagaattagttcctgaagccagaatcgtcgtcggccatgggcagatgcgtgaacgtgatctggaacgggtcatggcagatttccatcaccaacgttttaatgtgctggtatgtaccaccattattgaaaccggaattgatatccccagtgccaatacgattatcattgaacgcgctgatcactttggattggcccagttgcaccagttacgcggacgtgtcgggcgctcccatcatcaggcatatgcttatctgctgactccaaacccaaaagccatgactaccgacgcccaaaagcgcctggaggccatcgcatccctcgaggacttaggtgcagggtttgcactcgccactcatgatctggaaatcaggggagctggtgaattgttaggtgaagaccaaagcggccagatggccagcgtcggttttacactctacatggaactgttggaaagtgccgttgatgcgctcaaaaacggacgtgagccatcacttgaagatttaaccagcagccagaccgagattgaactacgtatgccggtacttttgcctggtgattatatccctgacgtgaatatgcgcctgtctttctataagcgcattgccagcgcccacaatgacgctgaactggctgaactgaaggttgaattgattgaccgatttggtttactgcctgatccgagtcgccagttattgcaatctgcctcaattcgtctgaccgcacagaatttgggtatcaaacgcatcgaagcgcatgagaaaggtggctttatcgagttcagtgataacaataaagtcgacccaaattatctgatcggtttattgcagacacagcctaacatttatcggctggatggtccctctaaactgaaatttattactgaattaacagagagacctgcacgtttgtctttcatccagcaattattggaagccttcattcagcatcagatataacacaacgattgcactgtttcgccgatacggttccaggcgaaacagtgcaatctccttctgaaaaaagtatggctacaaatatggctggagaattaattgccctttttcatttaacggaatggtttgctccggtttgtacgtcactcgcacttttccaggattatccccaatagtataattaacatcatacccaacggtgcgttgctccttcacataaaccatcaggcaattttttaatgctgaatggtttaatgcaagatattccctgcttgcttttatattgtcaagaagagtcaatatacggtattcatatcccgtaaagagaccccctttcatatcttctgatctaataggaatggcgaatactgtctcatggcaatagtgatgaggagtaagaaccgttattcggataggctctgaagataatacttgcgcaactttgggttgtggggattcaaaataaagtgttgcggcagtgccaatggcagcaatagcaattagagagcctattccatactgtcttatctttaatttacccacatagcaccttgatatattaataattttatacacatttttattgaagcatgctccctgaatatttaagagaactaaaaatgcgttcaattcattatttaagaaaaatcctattccattagcctaatataataaaatcattaaatttacactctttatttcatgcctttatcattttgaatatctccaatcctaacagtttaaactacattgttatgctacagtaagataactgaaacaggctctgttacaataattaattaagcatgtagataaatagtttcagttaactataaataattaacctacaacaataacatttaaatttattcgttaaatcatatcaataaaatctgaatttattattttaataaaaatcatgaaatatattaataattaattaattcaaatagatacttggatttaataaaatacgtttattgattataataaatcattcagaattaaattagataataataattatgataggtgtaataataaatataataggatagataaatggctcatctgtgttaattaaattcagatgaaccattttcagtaaattagtgcaatttcaaccgcggacgaatgacacgattgatgccaccaaccagcatcatcaaacctgtttttatatatccatgcagtgctacctgatgcatacgatacaatgagatataaaccacacgtgcaatacggccttctaccatcattgacccgcgcatcaagttacccatcaggctaccaactgtactgaacttagataatgaaaccaatgaaccatgatctttataaacatattcttttaatggcttttcattcaataaagccagaatattatcatagcaacgactcgccatttggtgagcagactgggcacgaggaggaacaaacccaccctcttttttcgggcatgatgcacaatcaccaatggcgaagacatcagcatccaacgtcgtctgcaaagtcggcttcacaaccaactgactaatgcggtttgtttccaacccaccaatgtctttcataaaatcaggcgctttaattcccgctgcccaaaccatcagggaagccttgatcaactctccatctttggtattcaggccatgcttatctgcgctggtcaccatagtcttggtcaacaccttgacgccaagtttggtcaattcctgatgtgccgcactggaaatccgtggaggcaatgccggaagaatacgctcacccgcttcaaccagagtgacattcagcgcgtctgaattcaaactctcaaaaccgtagctattaaactgcttaacagcattgtacagttcagctgaaagttctacgccagttgcgccaccgccaacaatcgcgatgttgactttttctcccgcacactggttggcagaatatttcaggaacaagttcagcatttcattatgaaaacgatgcgcctgttgtggattatcgaggaaaatgcagttttcctttacacctgccgtgccgaaatcattcgactggctacccaatgccataacaagaatgtcgtaagccagctctcgctctgctaccagcagatcattgctttcatcacggatttccgccagagtgattttctttccatcacgatcgatattcgtaagcgtgcctaactggaagttaaaatgatggttactggcatgagctaaataactcaatgcatcaacaccatcatcaagagaacccgttgctacttcatgtaataatggtttccataaatggctgttgttgcgatccaccaaagtaatttcggctttttgcttacgccccaatttgcgccccaaacgcgttgccagctctaaaccaccagcgcccccaccaataatgacaattcttgtctttggcgttgtcatgactaccccactgaaaatacaactaatgttatgtaaggcgctaaagccgtttcttttaataacgttcttaaataacatcagatttgacaagtttcatactgcaaatatctccagagtatcatggctggttagttggtcataccaaaaatagtcacgatcaaattcttttgattaattagacatcagtcacgaaattttcgcgcttactttcaattaatctgatgtatatcttatttatgaacaataagaatttataatgttaatgctgtgtgaatatgaagtttgatttgatagaaacggggtctcatcgggaaataataaagaggaaaaatcgagaagaaaaacaaaaaagggacagaattgccaactagcaacccatccccaattttattaaaataaatatataaaacaatgattaaatataacttaaccactgctcacacaagccattcaattctttatttgcctgttgccagcgttgtgatttcttcaactcttccagactgtattgactaccctgatgatataaccgtgctaccctatcagatttgaccatcggcaaattatccagcacgctgattgccccctgccgattgttgcacaccagaatcatgtcacaacccgcttccaatgaggcttttcctcgctcggcatagccgcccatgatagccgcaccttccatcgacaaatcatcggaaaaaataacaccttcaaattccagttgctgacgcaaaatagatttcagccaataaggtgaaccactggctggaagatcatctacttgagaataaaccacatgagcaggcataattgcatcaagcaggttacgttggataagatcgcgaaaaatctgcatatcatggcagctaatggcatccatcgagcgattgtcccttggcgtttctttgtgagagtctgctacaactgctccatgccccggaaaatgcttacctgtcgatttcatccctgcggaatgcatgcccttgataaatttttctgccatcatcaccgcgagttcaagctctccgtggaatgagcgctcaccaatcgcagtgcactggtgtcctagatccagtacaggagcaaaactgatatcaatgtccattgcaatcatttctgatgccattaaccaacccgattcttgcgccaaatgcgctcccataagcaagtcattcaagcaggcaaaagactgtgcggcaggtaaacgagtaaagccttcatgaaaacgctgaacacgtcccccttcctgatcgaccgcaatcaccaaacggtaatgcgacgcttcacggatttggcgaattaattcacgcaattgttgcgtatcctggaagttgcgggtaaacaggattaaaccgcccactaatggatgttgcaaaatttcgcgttcttcattatccaactcataaccaacaacatctaacattactggccccataacattcctcacctctatatcattggttgccatctataattcatcgtcattaatggcgattgatactatccagcgtgttaaaacgccagtttaatgcgccaatttaaatccctggcgcagagggtgcgccaatactaaaaattgtggatctttcgtctgctgccaacgtacttcataccacatcagcatcatatatctgacccacggttcccaccgtttaattctctgctgcaataatgtgatatccgcgtaccctgatgcgtaactacaataataatctaaaaaaatctgttgctgcatctcattccactgattgcctttaaacaacacagccaatgaaaaaccaatatcgacatcagcggcatattcccaatcaatcaattttaacccttctacagtcataagtagattatcggggtgaatatccatgtgagcaggtgctattttcagggttgttggcgttctggctgccataaaaaatttctgcaaacgcagccagcgaggagataagcggctctggtcaatctgctgccactgagatgcgatttgctttttgaattggaggggataacccaatcggtgatggttatgaagagtggcaagtatctgtgccagtaactgctgcaataatggtaagttcaacgtttcatgagttatctttgttcccgaaaaccattccagcaatagccaatcaccgttcatggctattactttaggagagatgccagtggaagataacctgcgtaaaacctgattttcccgctgacgatccacacccagtgtttcactattctgtgtttgtgtgcgcccaaccatctggcgcacaccatctgtaatagagaaacttccctgtgtcagtccatttaatcgcctgatttcccaattttttactggaatgtcaggccattgctgacataacattctcagcaaggtgttatcgctagttaacatcaccgctacctgaccaaagtatttcacccgttttaaccagcataagctgtatttctatgttacgttgatcgttactaccagaaaccacggagtagagcacataatcagcactcaaataacgtgccaagccaatagatttactgcgcaatcccaagctatcttccgatgacaatcccaatgcctgttgagctctatgcacttgttttttcggtacaatctgaaaaagctgtttacggctcacggcatcagtaatgatatcagtcacttgcagggctctcagcgaaccattagtgttgtttttaacagtatcgacaagtaatacttttcccgtttccacaccattggccttaaccatctgcgcaaccaacggttgaacaatgccattccaattagtcgactgaatcttaggtggctgaggaactttatccgatggctgtacttgtggttccgtttttttctctggcttcacaggtgtaacaggagcaggcgactgtattggtaagttacaactcgccagaaacatcgctgataatataacaaagagaattcttttcattaatctactccggttacagcgctatcgtgtaccaataatggtaaatcacattactttaccaacagtggccccaatggacgtccacccaccatatgcatatggatatggaaaacttcctgcccggaatggcgattacagttcatgatgaggcgataaccatcttctgcgatgccttcttgttgtgcgattttcgctgcaaccgtgaacaggcgtcccaatgcaagctcatgctctggagtaacatcgttaaccgttgggatcaatacgtttggcacgatcagaatatgggtgggcgcttgaggggtaatgtcacggaatgctgttaccagatcatcctgataaacaatatcagaaggaatttcacgacgaatgattttgctaaaaatagtttcttctgccatctcacttctccttttttgtcattaaagatgactcatgattaagtctgaatacgaagtcgaaatactaaactaaaacataaaaggttatctagataacttaattttctgggatgttgatatgaaacaggtcacaaaaatttctggttgtcaccgcggccaattcatcaagactcacccctttcaataccgccatatattcagcgacatcacgtacataggcaggctgattctgcttgcctcgatgcggtataggtgccagataaggtgagtcagtttctaccaaaatccgatcgagtgggacaaaccttgccgcttcacggatctgttctgcattgcgaaatgtcacgataccagagaaagaaatataaaaacccagatccagcaaagctctcgccgtatctttatcttccgtaaaacagtgcagcacaccgccacattcctgtactttttcttctcgcaagaccaaaagagtatcatcctttgcatcgcgggtatgaacaatgacaggtttgtttaatttacgtcctatgcggatatgttcacgaaaggaagttcgctgtaactctgcattttctttttgataataataatccagaccggtttctcccattgcgacgacatcatcgtccgctgcaagccgggcaagttcatcaaaatcgtagccttcatccagattcaatggatgaataccgcaggaatacgcgatattttcacgtttaccaatcaaattcttcatttgctggaatcccggcagcgtagtcgccactgccaacatatacttcacatcccgttctgctgccttagccacaacatcatccatactcttgtgtagagtttcataatcaaggcaatcgagatgacagtgtgaatcaactaaaaacataatatgctcgtatctaaatgagttgccgtgtggggcaaagctgcttttcccaattgagtaattgtcctgtcaacaataattcccgattgatgcccaccacagatagtaattgatgacgacaatgtacccaatcatcaactgtacttaataatttttccacactttgagtggaagccagatgatggatcaaagcctgctgatcttggttgacgcagtaatcctgcgcctgctgctgccatttcacagcatcggataacaagctaaccagccaatacaaagattgctgtgcatcatcacgattcaataatggtaaaagtgacagggtatcacagttatacaatgcctgttcaattgcctgacaaaacacatttctctgctgccatttttcagtctgaagcaactgttcagcagcaagaggcgcaccctgtgaaagttttaacgccgtctgcgcatccagcgatgatattgcagggagttgatgttgcagccaataaagccctacatgctgttcaggcacaggcagaaaatagtaaaagcagcgactgcgcagcgttgccagcaaacgcgctggacgctggcactgcaacaaaaaataggtattttgagggggttcttccaatgtttttagcaaggcgttggaagcagcatcggtcagagactccgcagagggtagccagataattttagcgccaccttgttgagaatattcgtaaagtctttcgttgagctgacgtacagcatcaactccaatagtactttttcccttttcaggggcaagaacatgccagtcagaatgcgtttctgccaacatcagatgacagccgtgacacttgccacaacttttcattccttgtttgtcctgacacatcaaccagcggctcaatccatacaataacgcatcggcccccgttccatcatgagcatgaagcaaaagggcatggtgcccacgctcctgctgatgggattcaatcaacaggcgatatgcatggttaagccacggataccagttcatgcctgcatgtcctgttgtttcaaccactgtaataaggtctgacgaatagcatcctgcactttttccagcggttgtgtcgcatctacttttttgatggtgtcatcttgtgccacaagctcgagatatctttcacgagtacggtggaaaaaatccaaggattctttttcaatgcgatccaattcaccccgctcacgagcacgctgtaaaccaacctctggtggcaaatcgagataaatagtcaaatccgggtaaaaatcaccgagtgccgattcgcgtaatgatgtcatcagtttctgatcaatgccacgaccaccgccctgatatgcctgagaggaaagatcatgacgatctccaaccacccaagttcctttttccagtgccggcttgataacattttctaccaattggactctggctgcatatagcatcaatacttctgccttattcgtcagtgattcaccttcaacgccctgtttgatgagttgacgtaatttttctgccaacggagttccacccggttcacgagtaaaaatcagatcagaaatgccatactgtttcaatgtttcaaccactgttcggattgcagtggttttccctgcgccctcaagcccttcaataacaataaatttgctgttcatttatcctgctttaatctctgacgataaagatttaccgccctattatgttctgccagattcgcagtgaatgtatgaccgccattaccatttgcaacaaagtataagtaccctgtcacagcagggtgtgccgcagctttaatcgaagctaggcttggcatggcgataggcgttggcggtaatccttcaatcatataagtattatatggcgtaaaagcagtcaggttactacggaaaatagaacccgtatacttatcccccaacccatatattactgtcggatcagtttgtaatctcatctttaaccgcagccgattaataaataccgaagcaacttttgtacgctcagaatctattgctgtctctttttcgattatggatgccatgatcaacatctcataaacactcttatatggcagatttttttcgcgatttttccactcttgctctagtgccatgttcattttttgatgagcacgttttagcaattcaacatcactggttcctgcggtgtacaggtaagtatcgggatagagccaaccttccaatggttcttccgctttcatgtctaaagcgtcagtcaattcctttggtgatttgccctctgcttcatgttttaagtatggcgcattctgtaatattttctcccagtcagacaatcgacttccttcaacgaaacggatagaaaattgcacttctttaccgctggaaaatagttgcaagattgctcgcaatgacatgccttgttgcaaacgataagtaccagccttaaatttcgccaattctggttttaatcggaataaccacgacaacaattggtgatctttgattaagttatgctgaaccaacaatattcctagcccagcacgccctgttcctgctggcacagtaaatatcatttcttgattaagattaattttctgattagcaaaattttctatttttttcacaaaagaaaaaaacatgattgctacaatcataataatcaagctgggtaaaatgaaaatacgctttttaagtttcattggtaatcactttgacctatccttcaatgatgagtattgaataactacagccttaaacatgcaggcaataaatactcatgcaattctcttgattgatatttccatgcaggctgatttttatgcgcctgaatttggtttactgcgataacaggcatcaaggaattgcagataatcacctcatcagcatgagctaatacctcaggataacgcatgacacatgacaggttataatcactttctgccaataattgcataatcttctgccgcatcaccccttctacaccacattgattcaaatcaggcgtataaacgtttttaccttttcgccagaaaatattagcagtacaacactcaaccagtaagccatcactatcaagaaccagtgcttcatcagcctttgactgctcaatgaatctttttatcagaacctgttccaagcggttcaagtgtttaatacccgccaaatggggattgatacccataacaattgggctaagaacgagtgaaataccatttttacgctggataacatactgttctggatatgaactcaacgagagaacctgatttggctcgatagcatcactaataccataaccacgaccaccaactcctctggagagaataactttcagaataccggattcacagccggtaaccacctgcttaatatgatcctcaagttgcagccaatccagtgctggcataaacagtttttcaacgcctttttgtaaccgttttatgtgcaaaggtagcaaagctgcctgcccttgctcaacttttattgttgtaaaacagccatcaccaaattgtaccgcacgatcattaacaggtaattgattacacggtttgccattaatcaaatacatcatttcattttctaattttcgataagaaggcgtgataacctcagctattaaggagcgttatcatagtatatgaaccgtggcagtgcaaaaatgcctattcaaaaaaaatcataaaaatcaggaataaaaaagcctcaacaaatgttgaggctcttcataaaaagaggacgtttttatatcttacggaaaatcagtgacccattagtaccaccgaaaccgaaagaattacacagtgcgtattccatcccttcaactttacgtgcttcgcctggaacaagatccaaacggcagttttcatcctgattttccaaattaatggttggaggaacaatctgctcacgtaaagcaagaatagtgaaaatcgattcaatcgctcccgcagcacccagcaagtgacctgtcattgatttggttgaactcaccaatactttagtgccttcaccaaaaacagattctaccgcacgagcttccgcaagatcaccaacttgcgttgaagtaccatgagcattaatgtagcccacttggtctggggaaatatccgcatctttcagggcattttccattgcaagcgcagcacccgctccatcttcaggcggtgatgtcatatgataagcatcactgctcataccaaagccaacgatttcagcgtaaatttttgcaccacgttttttggcatgttcgtattcttcaagaaccagaacaccggcgccatcacccagcacaaacccgtctcgatctttatcccaaggacggcttgcaccttgaggatcatcattacgggtcgataatgcacgagcagcaccaaaccctgcaacgccaaatgtagtactggctttctcagtaccacctgccagcataatatcagcatcattgtacgcaataatacgagctgcatgaccgatattgtgcacgccagaggtacaggcagttgcaatggagatgctaggaccacgaagaccataaaggatgctcagatggcctgcaaccatattgatgatggtcgaaggtacaaagaatgggctgaccttgcgaggtcccgccgagagcaatgtactgtggttttcttcaataagacccaaaccaccaataccagaaccaatagcagcaccaaagcggctagcattggcttctgttacttcgattcctgcatcttcaatagcttgtataccagcagcaattccatactgaataaacagatccatttttcgagcatctttgcgcgaaatattgaaatcttcatgattaaaatttttcaccacaccagcaaacttagttgcatggttagcggtgtcaaaatgttcgataaggccgataccactctgtccggcacaaacagcgttccaagaagactctactgtattgccgacaggagataacatgcctagtccggtcacgactactcgacgcttagacacggttatcctccagggagggaaaaaatttaggacgaagaacataggcggtcgaacgaccgcctaggtatgtatgcttatttacctgcgttttcaacgtagtcaatagcagcctgaactgtagtgattttttcagcttcttcgtctgggatctcgatatcgaactcttcttccagagccattaccagttcaactgtgtcaagagaatcagcgccnnnnnnnnnnnnnnnnnnnnnnnnnnnnnnnnnnnnnnnnnnnnnnnnn
